(12) United States Patent
Ayal et al.

(10) Patent No.: US 8,937,215 B2
(45) Date of Patent: Jan. 20, 2015

(54) POLYNUCLEOTIDES AND POLYPEPTIDES FOR INCREASING DESIRABLE PLANT QUALITIES

(75) Inventors: Sharon Ayal, Kiryat-Ekron (IL); Basia Judith Vinocur, Rechovot (IL); Alex Diber, Rishon-LeZion (IL); Hagai Karchi, Moshav Sitriya (IL); Limor Poraty, Holon (IL)

(73) Assignee: Evogene Ltd., Rechovot (IL)

( * ) Notice: Subject to any disclaimer, the term of this patent is extended or adjusted under 35 U.S.C. 154(b) by 34 days.

(21) Appl. No.: 13/387,760

(22) PCT Filed: Aug. 2, 2010

(86) PCT No.: PCT/IB2010/053501
§ 371 (c)(1),
(2), (4) Date: Jan. 30, 2012

(87) PCT Pub. No.: WO2011/015985
PCT Pub. Date: Feb. 10, 2011

(65) Prior Publication Data
US 2012/0131696 A1    May 24, 2012

Related U.S. Application Data

(60) Provisional application No. 61/231,040, filed on Aug. 4, 2009, provisional application No. 61/293,743, filed on Jan. 11, 2010.

(51) Int. Cl.
*A01H 1/00* (2006.01)
*C12N 15/82* (2006.01)

(52) U.S. Cl.
CPC ........ *C12N 15/8271* (2013.01); *C12N 15/8247* (2013.01); *C12N 15/8261* (2013.01)
USPC ....................................................... 800/278

(58) Field of Classification Search
None
See application file for complete search history.

(56) References Cited

U.S. PATENT DOCUMENTS

2004/0034888 A1 * 2/2004 Liu et al. ................. 800/289
2004/0214272 A1 10/2004 La Rosa et al.
2009/0089898 A1 4/2009 Karchi et al.
2009/0094717 A1 * 4/2009 Troukhan et al. ............. 800/290
2009/0183270 A1 7/2009 Adams et al.

FOREIGN PATENT DOCUMENTS

| WO | WO 2004/104162 | 12/2004 |
| WO | WO 2005/121364 | 12/2005 |
| WO | WO 2007/020638 | 2/2007 |
| WO | WO 2007/049275 | 5/2007 |
| WO | WO 2008/075364 | 6/2008 |
| WO | WO 2008/122980 | 6/2008 |
| WO | WO 2009/013750 | 1/2009 |
| WO | WO 2011/015985 | 2/2011 |

OTHER PUBLICATIONS

Frohman et al 1988 PNAS 85: p. 8998-9002.*
International Preliminary Report on Patentability Dated Feb. 16, 2012 From the International Bureau of WIPO Re. Application No. PCT/LB2010/053501.
Corrected International Search Report and the Written Opinion Dated Apr. 11, 2011 From the International Searching Authority Re. Application No. PCT/IB10/53501.
International Search Report and the Written Opinion Dated Mar. 15, 2011 From the International Searching Authority Re. Application No. PCT/IB10/53501.
Invitation to Pay Additional Fees Dated Dec. 21, 2010 From the International Searching Authority Re. Application No. PCT/IB10/53501.
Li et al. "The Arabidopsis NFYA5 Transcription Factor is Regulated Transcriptionally and Posttranscriptionally to Promote Drought Resistance", The Plant Cell, 20: 2238-2251, Aug. 2008.
Zhang et al. "Altered Archtiecture and Enhanced Drought Tolerance in Rice via the Down-Regulation of Indole-3-Acetic Acid by TLD1/OsGH3.13 Activation", Plant Physiology, 151: 1889-1901, Dec. 2009.

* cited by examiner

*Primary Examiner* — Brent T Page
*Assistant Examiner* — Matthew Keogh

(57) ABSTRACT

Polynucleotides and isolated polypeptides, nucleic acid constructs comprising the isolated polynucleotides, transgenic plants expressing same and methods of using same for increasing abiotic stress tolerance, yield, biomass, growth rate, vigor, oil content, fiber yield, fiber quality, and/or nitrogen use efficiency of a plant are disclosed.

17 Claims, 4 Drawing Sheets

POLYNUCLEOTIDES AND POLYPEPTIDES FOR INCREASING DESIRABLE PLANT QUALITIES

RELATED APPLICATIONS

This application is a National Phase of PCT Patent Application No. PCT/IB2010/053501 having International filing date of Aug. 2, 2010, which claims the benefit of priority of U.S. Provisional Patent Application Nos. 61/231,040 filed on Aug. 4, 2009 and 61/293,743 filed on Jan. 11, 2010. The contents of the above applications are all incorporated herein by reference.

FIELD AND BACKGROUND OF THE INVENTION

The present invention, in some embodiments thereof, relates to isolated polypeptides and polynucleotides, nucleic acid constructs comprising same, transgenic plants expressing same and methods of using same for increasing abiotic stress tolerance (ABST), water use efficiency (WUE), yield (e.g., grain quantity and/or quality), biomass, oil content, growth rate, vigor, nitrogen use efficiency (NUE) and/or fertilizer use efficiency (FUE) of a plant.

The ever-increasing world population and the decreasing availability in arable land for agriculture affect the yield of plants and plant-related products. The global shortage of water supply, desertification, abiotic stress (ABS) conditions (e.g., salinity, drought, flood, suboptimal temperature and toxic chemical pollution), and/or limited nitrogen and fertilizer sources cause substantial damage to agricultural plants such as major alterations in the plant metabolism, cell death, and decreases in plant growth and crop productivity.

Drought is a gradual phenomenon, which involves periods of abnormally dry weather that persists long enough to produce serious hydrologic imbalances such as crop damage, water supply shortage and increased susceptibility to various diseases.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Thus, salination of soils that are used for agricultural production is a significant and increasing problem in regions that rely heavily on agriculture, and is worsen by over-utilization, over-fertilization and water shortage, typically caused by climatic change and the demands of increasing population.

Suboptimal temperatures affect plant growth and development through the whole plant life cycle. Thus, low temperatures reduce germination rate and high temperatures result in leaf necrosis. In addition, mature plants that are exposed to excess heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorobis or leakage of ions from cell membranes. In addition, chilling may lead to yield losses and lower product quality through the delayed ripening of maize. Excessive light conditions, which occur under clear atmospheric conditions subsequent to cold late summer/autumn night's, can lead to photoinhibition of photosynthesis (disruption of photosynthesis).

Suboptimal nutrient (macro and micro nutrient) affect plant growth and development through the whole plant life cycle. One of the essential macronutrients for the plant is Nitrogen. Nitrogen is responsible for biosynthesis of amino acids and nucleic acids, prosthetic groups, plant hormones, plant chemical defenses, and the like. Nitrogen is often the rate-limiting element in plant growth and all field crops have a fundamental dependence on inorganic nitrogenous fertilizer. Since fertilizer is rapidly depleted from most soil types, it must be supplied to growing crops two or three times during the growing season. Additional important macronutrients are Phosphorous (P) and Potassium (K), which have a direct correlation to yield and general plant tolerance.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, protein and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

WO publication No. 2009/013750 discloses genes, constructs and methods of increasing abiotic stress tolerance, biomass and/or yield in plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2007/049275 discloses isolated polypeptides, polynucleotides encoding same, transgenic plants expressing same and methods of using same for increasing plant abiotic stress tolerance and biomass.

WO publication No. 2004/104162 discloses methods of increasing abiotic stress tolerance and/or biomass in plants and plants generated thereby.

WO publication No. 2005/121364 discloses polynucleotides and polypeptides involved in plant fiber development and methods of using same for improving fiber quality, yield and/or biomass of a fiber producing plant.

WO publication No. 2007/020638 discloses methods of increasing abiotic stress tolerance and/or biomass in plants and plants generated thereby.

WO publication No. 2009/083958 discloses methods of increasing water use efficiency, fertilizer use efficiency, biotic/abiotic stress tolerance, yield and biomass in plant and plants generated thereby.

WO publication No. 2010/020941 discloses methods of increasing nitrogen use efficiency, abiotic stress tolerance, yield and biomass in plants and plants generated thereby.

SUMMARY OF THE INVENTION

According to an aspect of some embodiments of the present invention there is provided a method of increasing abiotic stress tolerance, yield, biomass, growth rate, vigor, oil content, fiber yield, fiber quality, and/or nitrogen use efficiency of a plant, comprising expressing within the plant an exogenous polynucleotide comprising a nucleic acid sequence at least 80% identical to SEQ ID NOs:1-473, 783-1272, 1277-4139, 4142, 4146-5508 or 5509, thereby increasing the abiotic stress tolerance, yield, biomass, growth rate, vigor, oil content, fiber yield, fiber quality, and/or nitrogen use efficiency of the plant.

According to an aspect of some embodiments of the present invention there is provided a method of increasing abiotic stress tolerance, yield, biomass, growth rate, vigor, oil content, fiber yield, fiber quality, and/or nitrogen use efficiency of a plant, comprising expressing within the plant an exogenous polynucleotide comprising the nucleic acid sequence selected from the group consisting of SEQ ID NOs: 1-473, 783-1272, 1274, 1275, 1277-4142, and 4146-5509, thereby increasing the abiotic stress tolerance, yield, biomass, growth rate, vigor, oil content, fiber yield, fiber quality, and/or nitrogen use efficiency of the plant.

According to an aspect of some embodiments of the present invention there is provided a method of increasing abiotic stress tolerance, yield, biomass, growth rate, vigor, oil content, fiber yield, fiber quality, and/or nitrogen use efficiency of a plant, comprising expressing within the plant an exogenous polynucleotide comprising a nucleic acid sequence encoding a polypeptide at least 80% identical to SEQ ID NO:474-562, 564-620, 622-750, 752-782, 5510-5939, 5946-6856, 6858-7540, 7543, 7544, 7548-8735 or 8736, thereby increasing the abiotic stress tolerance, yield, biomass, growth rate, vigor, oil content, fiber yield, fiber quality, and/or nitrogen use efficiency of the plant.

According to an aspect of some embodiments of the present invention there is provided a method of increasing abiotic stress tolerance, yield, biomass, growth rate, vigor, oil content, fiber yield, fiber quality, and/or nitrogen use efficiency of a plant, comprising expressing within the plant an exogenous polynucleotide comprising a nucleic acid sequence encoding a polypeptide selected from the group consisting of SEQ ID NOs:474-782, 5510-5940, 5942, 5943, 5945-6856, 6858-7544, and 7548-8736, thereby increasing the abiotic stress tolerance, yield, biomass, growth rate, vigor, oil content, fiber yield, fiber quality, and/or nitrogen use efficiency of the plant.

According to an aspect of some embodiments of the present invention there is provided an isolated polynucleotide comprising a nucleic acid sequence at least 80% identical to SEQ ID NO:1-473, 783-1272, 1277-4139, 4142, 4146-5508 or 5509, wherein the nucleic acid sequence is capable of increasing abiotic stress tolerance, yield, biomass, growth rate, vigor, oil content, fiber yield, fiber quality, and/or nitrogen use efficiency of a plant.

According to an aspect of some embodiments of the present invention there is provided an isolated polynucleotide comprising the nucleic acid sequence selected from the group consisting of SEQ ID NOs:1-473, 783-1272, 1274, 1275, 1277-4142, and 4146-5509.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO:474-562, 564-620, 622-750, 752-782, 5510-5939, 5946-6856, 6858-7540, 7543, 7544, 7548-8735 or 8736, wherein the amino acid sequence is capable of increasing abiotic stress tolerance, yield, biomass, growth rate, vigor, oil content, fiber yield, fiber quality, and/or nitrogen use efficiency of the plant.

According to an aspect of some embodiments of the present invention there is provided an isolated polynucleotide comprising a nucleic acid sequence encoding a polypeptide which comprises the amino acid sequence selected from the group consisting of SEQ ID NOs:474-782, 5510-5940, 5942, 5943, 5945-6856, 6858-7544, and 7548-8736.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO:474-562, 564-620, 622-750, 752-782, 5510-5939, 5946-6856, 6858-7540, 7543, 7544, 7548-8735 or 8736, wherein the amino acid sequence is capable of increasing abiotic stress tolerance, yield, biomass, growth rate, vigor, oil content, fiber yield, fiber quality, and/or nitrogen use efficiency of a plant.

According to an aspect of some embodiments of the present invention there is provided an isolated polypeptide comprising the amino acid sequence selected from the group consisting of SEQ ID NOs:474-782, 5510-5940, 5942, 5943, 5945-6856, 6858-7544, and 7548-8736.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to some embodiments of the invention, the nucleic acid sequence is as set forth in SEQ ID NO:1-473, 783-1272, 1274, 1275, 1277-4142, 4146-5508 or 5509.

According to some embodiments of the invention, the polynucleotide consists of the nucleic acid sequence selected from the group consisting of SEQ ID NOs:1-473, 783-1272, 1274, 1275, 1277-4142, and 4146-5509.

According to some embodiments of the invention, the nucleic acid sequence encodes an amino acid sequence at least 80% homologous to SEQ ID NO:474-562, 564-620, 622-750, 752-782, 5510-5939, 5946-6856, 6858-7540, 7543, 7544, 7548-8735 or 8736.

According to some embodiments of the invention, the nucleic acid sequence encodes the amino acid sequence selected from the group consisting of SEQ ID NOs:474-782, 5510-5940, 5942, 5943, 5945-6856, 6858-7544, and 7548-8736.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of salinity, drought, water deprivation, flood, etiolation, low temperature, high temperature, heavy metal toxicity, anaerobiosis, nutrient deficiency, nutrient excess, atmospheric pollution and UV irradiation.

According to some embodiments of the invention, the yield comprises seed yield or oil yield.

According to some embodiments of the invention, the promoter is heterologous to the isolated polynucleotide and/or to the host cell.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

Implementation of the method and/or system of embodiments of the invention can involve performing or completing selected tasks manually, automatically, or a combination thereof. Moreover, according to actual instrumentation and equipment of embodiments of the method and/or system of the invention, several selected tasks could be implemented by hardware, by software or by firmware or by a combination thereof using an operating system.

For example, hardware for performing selected tasks according to embodiments of the invention could be implemented as a chip or a circuit. As software, selected tasks according to embodiments of the invention could be implemented as a plurality of software instructions being executed by a computer using any suitable operating system. In an exemplary embodiment of the invention, one or more tasks according to exemplary embodiments of method and/or system as described herein are performed by a data processor, such as a computing platform for executing a plurality of instructions. Optionally, the data processor includes a volatile memory for storing instructions and/or data and/or a non-volatile storage, for example, a magnetic hard-disk and/or removable media, for storing instructions and/or data. Optionally, a network connection is provided as well. A display and/or a user input device such as a keyboard or mouse are optionally provided as well.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
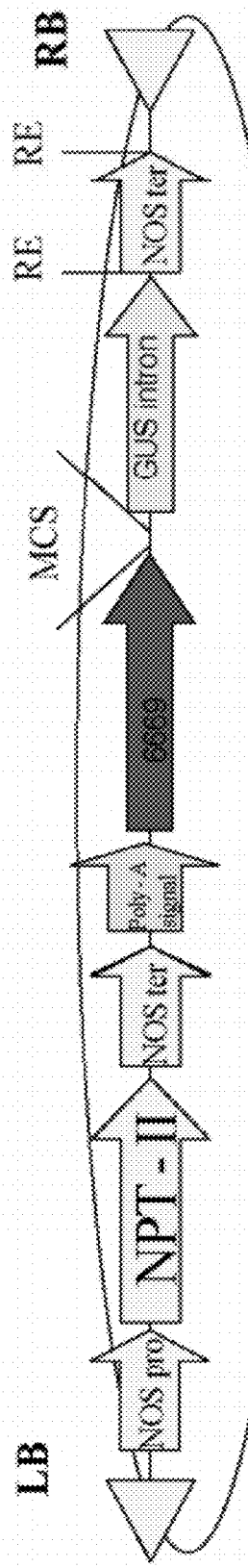
FIG. 1 is a schematic illustration of the modified pGI binary plasmid containing the new At6669 promoter (SEQ ID NO:8741) and the GUSintron (pQYN_6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUSintron reporter gene.
Figure 2:
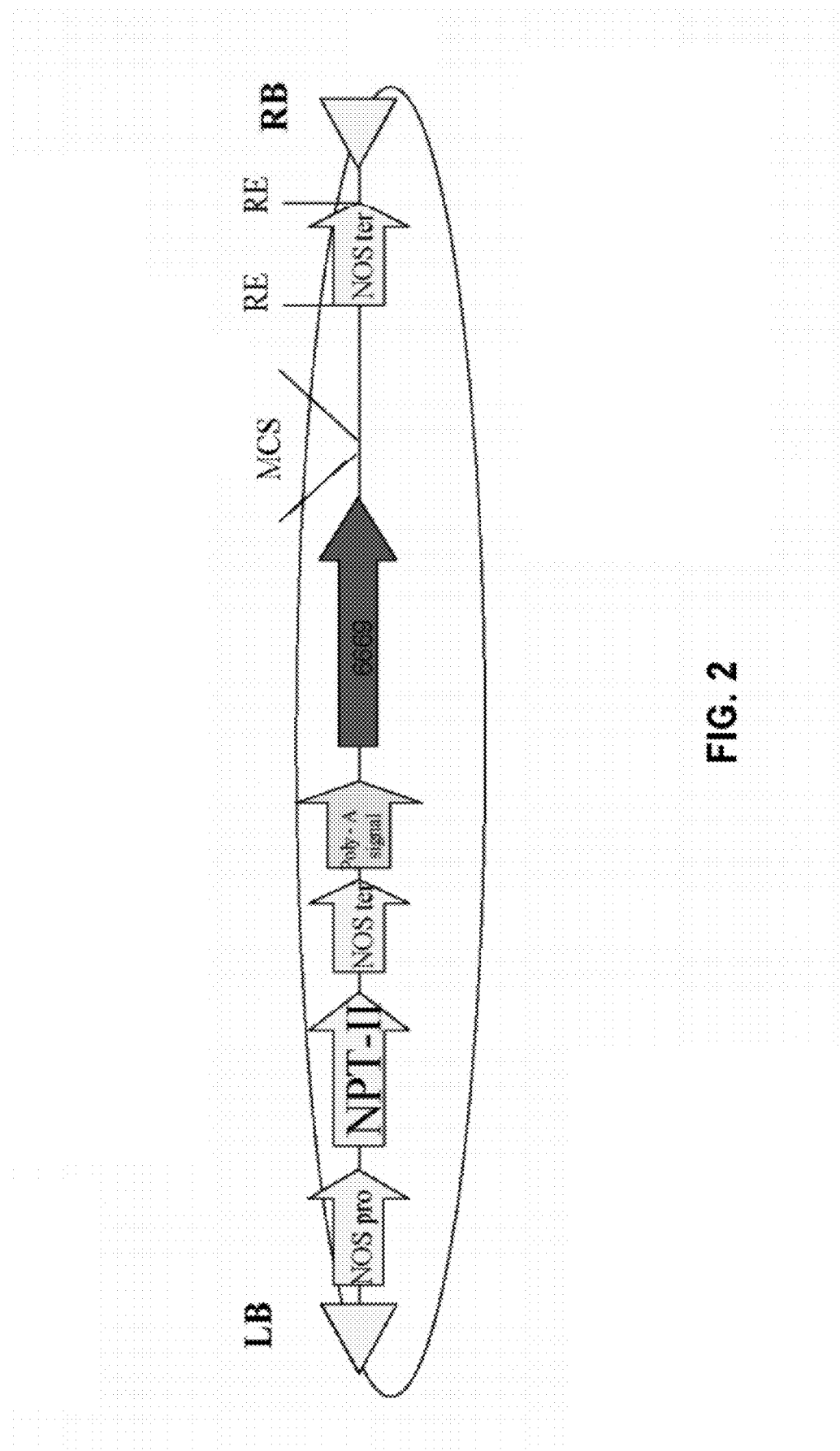
FIG. 2 is a schematic illustration of the modified pGI binary plasmid containing the new At6669 promoter (SEQ ID NO:8741) (pQFN) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the MCS of the vector.
Figure 3:
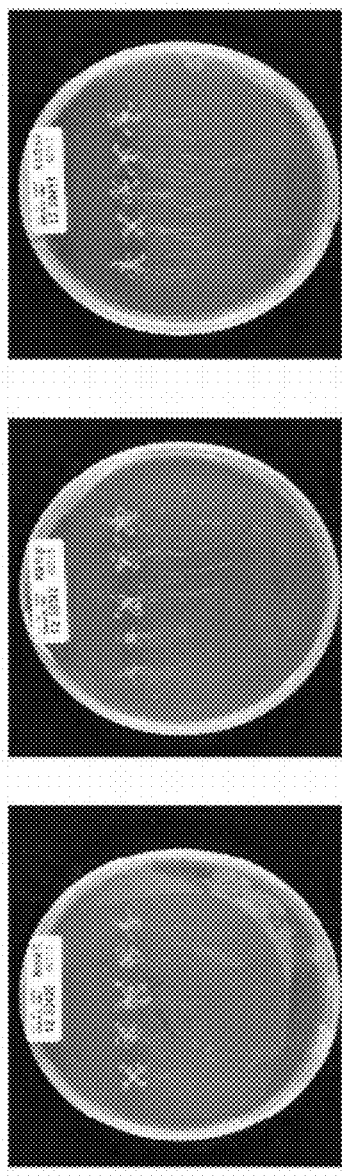
FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG.
Figure 3:
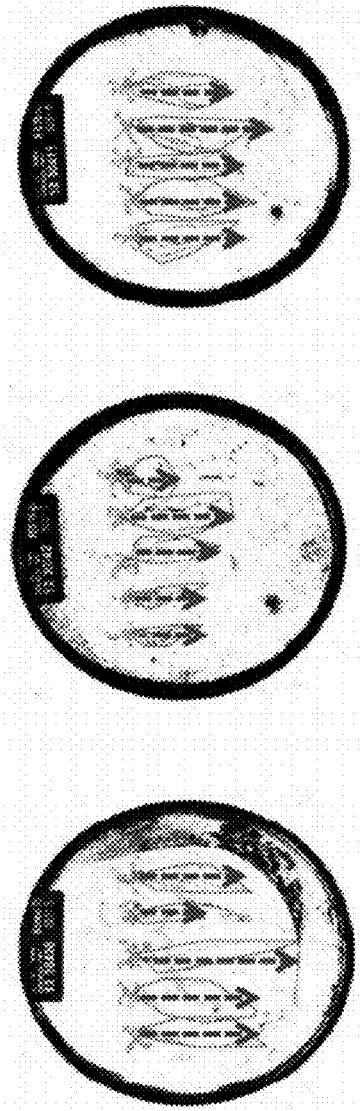
Figure 4:
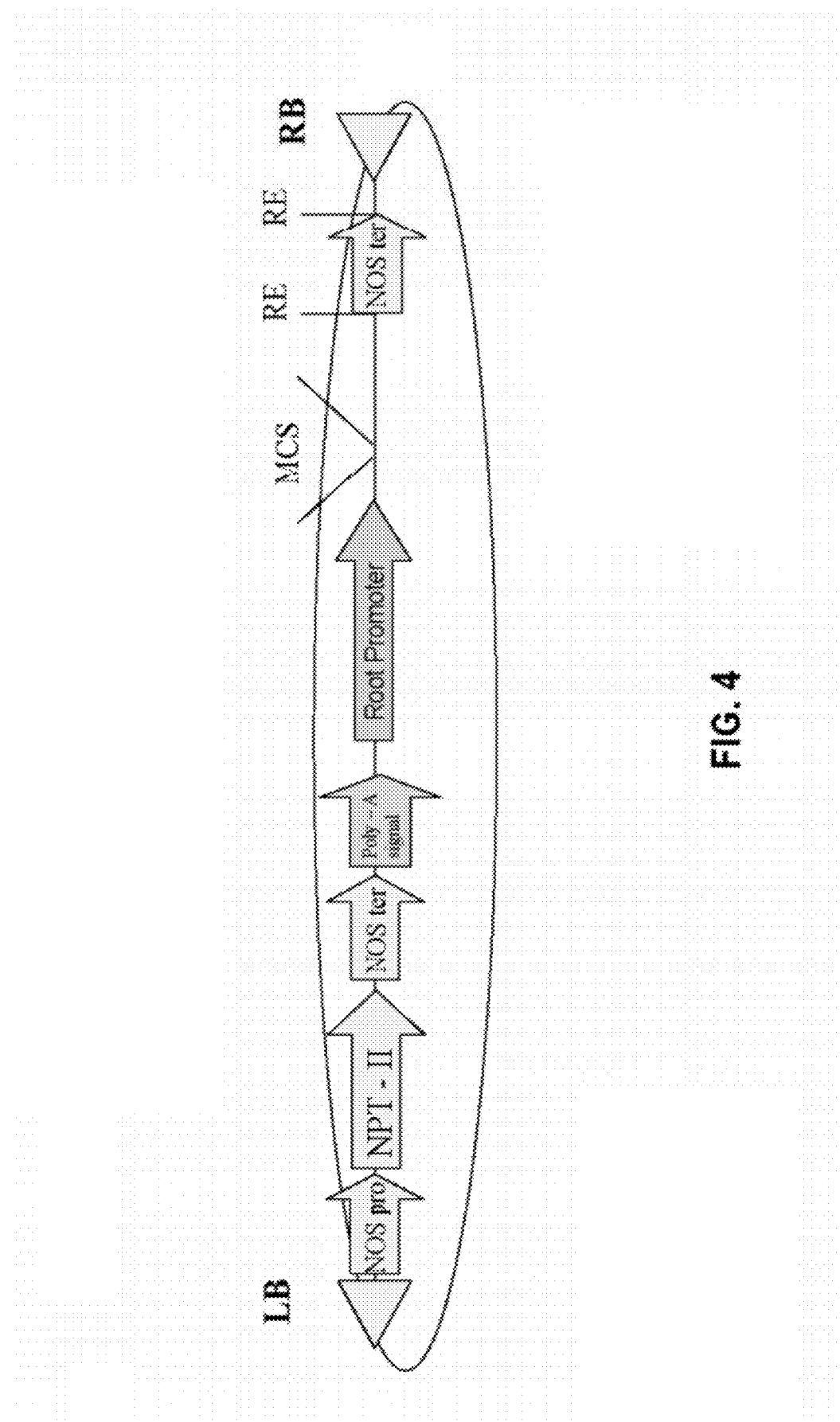
FIG. 4 is a schematic illustration of the modified pGI binary plasmid containing the Root Promoter (pQNa_RP) used for expressing the isolated polynucleotide sequences of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal); The isolated polynucleotide sequences according to some embodiments of the invention were cloned into the MCS of the vector.

The present invention, in some embodiments thereof, relates to isolated polypeptides and polynucleotides, nucleic acid constructs comprising the isolated polypeptides, transgenic plants expressing same and methods of using same for increasing abiotic stress tolerance (ABST), water use efficiency (WUE), yield (e.g., grain quantity and/or quality), biomass, oil content, growth rate, vigor, nitrogen use efficiency (NUE) and/or fertilizer use efficiency (FUE) of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have identified novel polypeptides and polynucleotides which can be used to increase abiotic stress tolerance, yield, biomass, growth rate, vigor, oil content, fiber yield, fiber quality, and/or nitrogen use efficiency of a plant.

Thus, as shown in the Examples section which follows, the present inventors have utilized bioinformatics tools to identify polynucleotides which enhance abiotic stress tolerance, yield (e.g., seed yield, oil yield, oil content), biomass, growth rate, vigor, and/or nitrogen use efficiency of a plant. Genes which affect the trait-of-interest were identified based on expression profiles of genes of several *Arabidopsis* ecotypes and tissues, Tomato, *Sorghum, Maize* and Barley varieties (Examples 1-8), homology with genes known to affect the trait-of-interest and using digital expression profile in specific tissues and conditions (Tables 1-53, Examples 1-8; polynucleotides SEQ ID NOs:1-274; polypeptides SEQ ID NOs: 474-731). Homologous polypeptides and polynucleotides having the same function were also identified (Table 54, Example 10; polynucleotides SEQ ID NOs:783-5509; polypeptides SEQ ID NOs:5510-8736). Transgenic plants over-expressing the identified polynucleotides and polypeptides (Table 55, Example 11) were found to exhibit increased abiotic stress tolerance (e.g., under osmotic stress or salinity stress), nitrogen use efficiency (e.g., root performance), biomass (under stress conditions or normal/standard conditions), growth rate (under stress conditions or normal/standard conditions), and yield (Tables 56-83); Examples 14-15). Altogether, these results suggest the use of the novel polynucleotides and polypeptides of the invention for increasing abiotic stress tolerance, yield (including oil yield, seed yield and oil content), growth rate, biomass, vigor and/or nitrogen use efficiency of a plant.

Thus, according to an aspect of some embodiments of the invention, there is provided method of increasing abiotic stress tolerance, yield, biomass, growth rate, vigor, oil content, fiber yield, fiber quality, and/or nitrogen use efficiency of a plant, comprising expressing within the plant an exogenous polynucleotide comprising a nucleic acid sequence at least 80% identical to SEQ ID NO:1-473, 783-1272, 1277-4139, 4142, 4146-5508 or 5509, thereby increasing the abiotic stress tolerance, yield, biomass, growth rate, vigor, oil content, fiber yield, fiber quality, and/or nitrogen use efficiency of the plant.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section. The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield. It should be noted that improved ABST will confer plants with improved vigor also under non-stress conditions, resulting in crops having improved biomass and/or yield e.g., elongated fibers for the cotton industry, higher oil content.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day).

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand. Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigor. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (Zea mays L.) hybrids based on Corn Belt germplasm in the European Atlantic.

It should be noted that a plant yield can be determined under stress (e.g., abiotic stress, nitrogen-limiting conditions) and/or non-stress (normal) conditions. As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, *Ceiba pentandra*), desert willow, creosote bush, winterfat, balsa, kenaf, roselle, jute, sisal abaca, flax, corn, sugar cane, hemp, ramie, kapok, coir, bamboo, spanish moss and *Agave* spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow.

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in abiotic stress tolerance, yield, biomass, growth rate, vigor, oil content, fiber yield, fiber quality, and/or nitrogen use efficiency of a plant as compared to a native plant [i.e., a plant not modified with the biomolecules (polynucleotide or polypeptides) of the invention, e.g., a non-transformed plant of the same species which is grown under the same growth conditions).

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-473, 783-1272, 1277-4139, 4142, and 4146-5509.

According to some embodiments of the invention, the homology is a global homology, i.e., an homology over the entire amino acid or nucleic acid sequences of the invention and not over portions thereof.

Identity (e.g., percent homology) can be determined using any homology comparison software, including for example, the BlastN software of the National Center of Biotechnology Information (NCBI) such as by using default parameters.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-473, 783-1272, 1277-4139, 4142, and 4146-5509.

According to some embodiments of the invention the exogenous polynucleotide is set forth by SEQ ID NO:1-473, 783-1272, 1274, 1275, 1277-4142, 4146-5508 or 5509.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 474-562, 564-620, 622-750, 752-782, 5510-5939, 5946-6856, 6858-7540, 7543, 7544, and 7548-8736.

Homology (e.g., percent homology) can be determined using any homology comparison software, including for example, the BlastP or TBLASTN software of the National Center of Biotechnology Information (NCBI) such as by using default parameters, when starting from a polypeptide sequence; or the tBLASTX algorithm (available via the NCBI) such as by using default parameters, which compares the six-frame conceptual translation products of a nucleotide query sequence (both strands) against a protein sequence database.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be blasted against, for example, the 28,469 full-length cDNA clones from Oryza sativa Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a prologue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor-joining tree (Hypertext Transfer Protocol://en (dot) wikipedia (dot) org/wiki/Neighbor-joining) which helps visualizing the clustering.

According to some embodiments of the invention, the exogenous polynucleotide encodes a polypeptide consisting of the amino acid sequence set forth by SEQ ID NO:474-782, 5510-5940, 5942, 5943, 5945-6856, 6858-7544, 7548-8735 or 8736.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N[(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs:217, 273, 274, and 473.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-473, 783-1272, 1277-4139, 4142, and 4146-5509.

According to some embodiments of the invention the nucleic acid sequence is capable of increasing abiotic stress tolerance, yield, biomass, growth rate, vigor, oil content, fiber yield, fiber quality, and/or nitrogen use efficiency of a plant.

According to some embodiments of the invention the isolated polynucleotide comprising the nucleic acid sequence selected from the group consisting of SEQ ID NOs:1-473, 783-1272, 1274, 1275, 1277-4142, and 4146-5509.

According to some embodiments of the invention the isolated polynucleotide is set forth by SEQ ID NO:1-473, 783-1272, 1274, 1275, 1277-4142, 4146-5508 or 5509.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs: 474-562, 564-620, 622-750, 752-782, 5510-5939, 5946-6856, 6858-7540, 7543, 7544, and 7548-8736.

According to some embodiments of the invention the amino acid sequence is capable of increasing abiotic stress tolerance, yield, biomass, growth rate, vigor, oil content, fiber yield, fiber quality, and/or nitrogen use efficiency of a plant.

The invention provides an isolated polynucleotide comprising a nucleic acid sequence encoding a polypeptide which comprises the amino acid sequence selected from the group consisting of SEQ ID NOs:474-782, 5510-5940, 5942, 5943, 5945-6856, 6858-7544, and 7548-8736.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs: 474-562, 564-620, 622-750, 752-782, 5510-5939, 5946-6856, 6858-7540, 7543, 7544, and 7548-8736.

According to some embodiments of the invention, the polypeptide comprising an amino acid sequence selected from the group consisting of SEQ ID NOs:474-782, 5510-5940, 5942, 5943, 5945-6856, 6858-7544, and 7548-8736.

According to some embodiments of the invention, the polypeptide is set forth by SEQ ID NO:474-782, 5510-5940, 5942, 5943, 5945-6856, 6858-7544, 7548-8735 or 8736.

According to some embodiments of the invention, there is provided a nucleic acid construct comprising the isolated polynucleotide of the invention, and a promoter for directing transcription of the nucleic acid sequence of the isolated polynucleotide in a host cell.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp., *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chacoomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeria japonica, Cymbopogon* spp., *Cynthea dealbata, Cydonia oblonga, Dalbergia monetaria, Davallia divaricata, Desmodium* spp., *Dicksonia squarosa, Dibeteropogon amplectens, Dioclea* spp, *Dolichos* spp., *Dorycnium rectum, Echinochloa pyramidalis, Ehraffia* spp., *Eleusine coracana, Eragrestis* spp., *Erythrina* spp., *Eucalypfus* spp., *Euclea schimperi, Eulalia* vi/losa, *Pagopyrum* spp., *Feijoa* sellowlana, *Fragaria* spp., *Flemingia* spp, *Freycinetia banksli, Geranium thunbergii, GinAgo biloba, Glycine javanica, Gliricidia* spp, *Gossypium hirsutum, Grevillea* spp., *Guibourtia coleosperma, Hedysarum* spp., *Hemaffhia altissima, Heteropogon contoffus, Hordeum vulgare, Hyparrhenia rufa, Hypericum erectum, Hypeffhelia dissolute, Indigo incamata, Iris* spp., *Leptarrhena pyrolifolia, Lespediza* spp., *Lettuca* spp., *Leucaena leucocephala, Loudetia simplex, Lotonus bainesli, Lotus* spp., *Macrotyloma axillare, Malus* spp., *Manihot esculenta, Medicago saliva, Metasequoia glyptostroboides, Musa sapientum, Nicotianum* spp., *Onobrychis* spp., *Ornithopus* spp.,

*Oryza* spp., *Peltophorum africanum*, *Pennisetum* spp., *Persea gratissima*, *Petunia* spp., *Phaseolus* spp., *Phoenix canariensis*, *Phormium cookianum*, *Photinia* spp., *Picea glauca*, *Pinus* spp., *Pisum sativam*, *Podocarpus totara*, *Pogonarthria fleckii*, *Pogonaffhria squarrosa*, *Populus* spp., *Prosopis cineraria*, *Pseudotsuga menziesii*, *Pterolobium stellatum*, *Pyrus communis*, *Quercus* spp., *Rhaphiolepsis umbellata*, *Rhopalostylis sapida*, *Rhus natalensis*, *Ribes grossularia*, *Ribes* spp., *Robinia pseudoacacia*, *Rosa* spp., *Rubus* spp., *Salix* spp., *Schyzachyrium sanguineum*, *Sciadopitys vefficillata*, *Sequoia sempervirens*, *Sequoiadendron giganteum*, *Sorghum bicolor*, *Spinacia* spp., *Sporobolus fimbriatus*, *Stiburus alopecuroides*, *Stylosanthos humilis*, *Tadehagi* spp, *Taxodium distichum*, *Themeda triandra*, *Trifolium* spp., *Triticum* spp., *Tsuga heterophylla*, *Vaccinium* spp., *Vicia* spp., *Vitis vinifera*, *Watsonia pyramidata*, *Zantedeschia aethiopica*, *Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barely, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

Any suitable promoter sequence can be used by the nucleic acid construct of the present invention. Preferably the promoter is a constitutive promoter, a tissue-specific, or an abiotic stress-inducible promoter.

Suitable constitutive promoters include, for example, CaMV 35S promoter (SEQ ID NO:8739; Odell et al., Nature 313:810-812, 1985); *Arabidopsis* At6669 promoter (SEQ ID NO:8738; see PCT Publication No. WO04081173A2); *Arabidopsis* new At6669 promoter (SEQ ID NO:8741); maize Ubi 1 (Christensen et al., Plant Sol. Biol. 18:675-689, 1992); rice actin (McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); GOS2 (de Pater et al, Plant J Nov; 2(6):837-44, 1992); ubiquitin (Christensen et al, Plant Mol. Biol. 18: 675-689, 1992); Rice cyclophilin (Bucholz et al, Plant Mol. Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608,149; 5,608,144; 5,604,121; 5,569,597; 5,466,785; 5,399,680; 5,268,463; and 5,608,142.

Suitable tissue-specific promoters include, but not limited to, leaf-specific promoters [such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO:8740), from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (Albanietal, Plant Cell, 9: 171-184, 1997), sunflower oleosin (Cummins, et al., Plant Mol. Biol. 19: 873-876, 1992)], endosperm specific promoters [e.g., wheat LMW and HMW, glutenin-1 (Mol Gen Genet. 216:81-90, 1989; NAR 17:461-2), wheat a, b and g gliadins (EMBO3:1409-15, 1984), Barley ltrl promoter, barley B1, C, D hordein (Theor Appl Gen 98:1253-62, 1999; Plant J 4:343-55, 1993; Mol Gen Genet. 250:750-60, 1996), Barley DOF (Mena et al, The Plant Journal, 116(1): 53-62, 1998), Biz2 (EP99106056.7), Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma of al, Plant Mol. Biol. 39:257-71, 1999), rice oleosin (Wu et at, J. Biochem., 123: 386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen. Genet.

217:240-245; 1989), apetala-3], and root promoters such as the ROOTP promoter [SEQ ID NO: 8742].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in E. coli (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338:274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is a virulent and thus is incapable of causing severe symptoms such as reduced growth rate, mosaic, ring spots, leaf roll, yellowing, streaking, pox formation, tumor formation and pitting. A suitable a virulent virus may be a naturally occurring a virulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since processes which increase abiotic stress tolerance, yield, biomass, growth rate, vigor, oil content, fiber yield, fiber quality, and/or nitrogen use efficiency of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on abiotic stress tolerance, yield, biomass, growth rate, vigor, oil content, fiber yield, fiber quality, and/or nitrogen use efficiency.

Expressing a plurality of exogenous polynucleotides in a single host plant can be effected by co-introducing multiple nucleic acid constructs, each including a different exogenous polynucleotide, into a single plant cell. The transformed cell can than be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, drought, water deprivation, excess of water (e.g., flood, waterlogging), etiolation, low temperature, high temperature, heavy metal toxicity, anaerobiosis, nutrient deficiency, nutrient excess, atmospheric pollution and UV irradiation.

Thus, the invention encompasses plants exogenously expressing the polynucleotide(s), the nucleic acid constructs and/or polypeptide(s) of the invention. Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., abiotic stress tolerance, yield, biomass, growth rate, vigor, oil content, fiber yield, fiber quality, and/or nitrogen use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

The effect of the transgene (the exogenous polynucleotide encoding the polypeptide) on abiotic stress tolerance can be determined using known methods such as detailed below and in the Examples section which follows.

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought tolerance assay/Osmoticum assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control Arabidopsis plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water use efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)]\times 100 \qquad \text{Formula I:}$$

Fertilizer use efficiency—To analyze whether the transgenic plants are more responsive to fertilizers, plants are grown in agar plates or pots with a limited amount of fertilizer, as described, for example, in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic plants (e.g., *Arabidopsis* plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock—transgenic plants expressing the uidA reporter gene (GUS) under the same promoter or transgenic plants carrying the same promoter but lacking a reporter gene are used as control.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant vigor—The plant vigor can be calculated by the increase in growth parameters such as leaf area, fiber length, rosette diameter, plant fresh weight and the like per time.

Growth rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Relative growth area can be calculated using Formula II.

Relative growth rate area=Regression coefficient of area along time course.     Formula II Seed yield—Evaluation of the seed yield per plant can be done by measuring the amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area.

In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula III:

1000 Seed Weight=number of seed in sample/sample weight $X$ 1000.     Formula III The Harvest Index can be calculated using Formula IV.

Harvest Index=Average seed yield per plant/Average dry weight.     Formula IV

Grain protein concentration—Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol://World-Wide Web (dot) cottoninc (dot) com/Classificationof-Cotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods. According to some embodiments of the invention, the oil comprises a seed oil.

According to some embodiments of the invention, the oil comprises a vegetative portion oil.

According to some embodiments of the invention, the plant cell forms a part of a plant.

As used herein the term "about" refers to ±10%.

The terms "comprises", "comprising", "includes", "including", "having" and their conjugates mean "including but not limited to".

The term "consisting of means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA extraction—Tissues growing at various growth conditions (as described below) were sampled and RNA was extracted using TRIzol Reagent from Invitrogen [Hypertext Transfer Protocol://World Wide Web (dot) invitrogen (dot) com/content (dot)cfm?pageid=469]. Approximately 30-50 mg of tissue was taken from samples. The weighed tissues were ground using pestle and mortar in liquid nitrogen and resuspended in 500 μl of TRIzol Reagent. To the homogenized lysate, 100 μl of chloroform was added followed by precipitation using isopropanol and two washes with 75% ethanol. The RNA was eluted in 30 μl of RNase-free water. RNA samples were cleaned up using Qiagen's RNeasy mini-kit clean-up protocol as per the manufacturer's protocol (QIAGEN Inc, CA USA). For convenience, each micro-array expression information tissue type has received an expression Set ID.

Correlation analysis—was performed for selected genes according to some embodiments of the invention, in which the characterized parameters (measured parameters according to the correlation IDs) were used as "x axis" for correlation with the tissue transcriptom which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved nitrogen use efficiency, abiotic stress tolerance, yield, growth rate and the like).

Example 1

Bio-Informatics Tools for Identification of Genes which Increase Abiotic Stress Tolerance, Yield and Agronomical Important Traits in Plants The present inventors have identified polynucleotides which upregulation of expression thereof can increase abiotic stress tolerance (ABST), water use efficiency (WUE), yield, oil content, growth rate, vigor, biomass, nitrogen use efficiency (NUE), and fertilizer use efficiency (FUE) of a plant.

All nucleotide sequence datasets used here were originated from publicly available databases or from performing sequencing using the Solexa technology (e.g. Barley and *Sorghum*). Sequence data from 100 different plant species was introduced into a single, comprehensive database. Other information on gene expression, protein annotation, enzymes and pathways were also incorporated. Major databases used include:

Genomes
  *Arabidopsis* genome [TAIR genome version 6 (Hypertext Transfer Protocol://World Wide Web (dot) *arabidopsis* (dot) org/)]
  Rice genome [IRGSP build 4.0 (Hypertext Transfer Protocol://rgp (dot) dna (dot) affrc (dot) go (dot) jp/IRGSP/)].
  Poplar [*Populus trichocarpa* release 1.1 from JGI (assembly release v1.0) (Hypertext Transfer Protocol://World Wide Web (dot) genome (dot) jgi-psf (dot) org/)]
  Brachypodium [JGI 4x assembly, Hypertext Transfer Protocol://World Wide Web (dot) brachpodium (dot) org)]

Soybean [DOE-JGI SCP, version Glyma0 (Hypertext Transfer Protocol://World Wide Web (dot) phytozome (dot) net/)]

Grape [French-Italian Public Consortium for Grapevine Genome Characterization grapevine genome (Hypertext Transfer Protocol://World Wide Web (dot) genoscope (dot) cns (dot) fr/)]

Castobean [TIGR/J Craig Venter Institute 4× assembly [(Hypertext Transfer Protocol://msc (dot) jcvi (dot) org/r_communis]

*Sorghum* [DOE-JGI SCP, version Sbil [Hypertext Transfer Protocol://World Wide Web (dot) phytozome (dot) net/)].

Partially assembled genome of Maize [Hypertext Transfer Protocol://maizesequence (dot) org/]

Expressed EST and mRNA sequences were extracted from the following databases:

GenBank versions 154, 157, 160, 161, 164, 165, 166 and 168 (Hypertext Transfer Protocol://World Wide Web (dot) ncbi (dot) nlm (dot) nih (dot) gov/dbEST/)

RefSeq (Hypertext Transfer Protocol://World Wide Web (dot) ncbi (dot) nlm (dot) nih (dot) gov/RefSeq/).

TAIR (Hypertext Transfer Protocol://World Wide Web (dot) *arabidopsis* (dot) org/).

Protein and Pathway Databases

Uniprot [Hypertext Transfer Protocol://World Wide Web (dot) uniprot (dot) org/].

AraCyc [Hypertext Transfer Protocol://World Wide Web (dot) *arabidopsis* (dot) org/biocyc/index (dot) jsp].

ENZYME [Hypertext Transfer Protocol://expasy (dot) org/enzyme/].

Microarray datasets were downloaded from:

GEO (Hypertext Transfer Protocol://World Wide Web.ncbi.nlm.nih.gov/geo/)

TAIR (Hypertext Transfer Protocol://World Wide Web.arabidopsis.org/).

Proprietary microarray data (WO2008/122980 and Example 2 below).

QTL and SNPs information

Gramene [Hypertext Transfer Protocol://World Wide Web (dot) gramene (dot) org/qtl/].

Panzea [Hypertext Transfer Protocol://World Wide Web (dot) panzea (dot) org/index (dot) html].

Database assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (arabidopsis, rice, castorbean, grape, brachypodium, poplar, soybean, sorghum) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:

Blast search [Hypertext Transfer Protocol://blast (dot) ncbi (dot) nlm (dot) nih (dot) gov/Blast (dot) cgi] against all plant UniProt [Hypertext Transfer Protocol://World Wide Web (dot) uniprot (dot) org/] sequences was performed. Open reading frames of each putative transcript were analyzed and longest ORF with higher number of homologues was selected as predicted protein of the transcript. The predicted proteins were analyzed by InterPro [Hypertext Transfer Protocol://World Wide Web (dot) ebi (dot) ac (dot) uk/interprod/].

Blast against proteins from AraCyc and ENZYME databases was used to map the predicted transcripts to AraCyc pathways.

Predicted proteins from different species were compared using blast algorithm [Hypertext Transfer Protocol://World Wide Web (dot) ncbi (dot) nlm (dot) nih (dot) gov/Blast (dot) cgi] to validate the accuracy of the predicted protein sequence, and for efficient detection of orthologs.

Gene expression profiling—Several data sources were exploited for gene expression profiling, namely microarray data and digital expression profile (see below). According to gene expression profile, a correlation analysis was performed to identify genes which are co-regulated under different development stages and environmental conditions and associated with different phenotypes.

Publicly available microarray datasets were downloaded from TAIR and NCBI GEO sites, renormalized, and integrated into the database. Expression profiling is one of the most important resource data for identifying genes important for ABST, increased yield, growth rate, vigor, biomass, oil content, WUE, NUE and FUE of a plant.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags, that assembled into 67,477 unigenes (32,357 singletons and 35,120 contigs). Analysis of the data obtained against the Cucurbit Genomics Database [Hypertext Transfer Protocol://World Wide Web (dot) icugi (dot) org/] confirmed the accuracy of the sequencing and assembly. Expression patterns of selected genes fitted well their qRT-PCR data.

Example 2

Production of Tomato Transcriptom and High Throughput Correlation Analysis Using 44K Tomato Oligonucleotide Micro-Array In order to produce a high throughput correlation analysis, the present inventors utilized a Tomato oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 Tomato genes and transcripts. In order to define correlations between the levels of RNA expression with ABST, yield components or vigor related parameters various plant characteristics of 18 different Tomato varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of Tomato Varieties Across Ecotype Grown Under 50% Irrigation Conditions Experimental Procedures Growth procedure—Tomato variety was grown under normal conditions (4-6 Liters/m² per day) until flower stage. At this time, irrigation was reduced to 50% compared to normal conditions.

RNA extraction—Two tissues at different developmental stages [flower and leaf], representing different plant characteristics, were sampled and RNA was extracted as described above. For convenience, each micro-array expression information tissue type has received a Set ID as summarized in Table 1 below.

TABLE 1

| Tomato transcriptom expression sets | |
|---|---|
| Expression Set | Set ID |
| Leaf grown under Normal Irrigation | A |
| Leaf grown under 50% Irrigation | B |
| Flower grown under Normal Irrigation | C |
| Flower grown under 50% Irrigation | D |

Table 1: Provided are the identification (ID) letters of each of the tomato expression sets.

Tomato yield components and vigor related parameters under 50% water irrigation assessment—10 Tomato varieties in 3 repetitive blocks (named A, B, and C), each containing 6 plants per plot were grown at net house. Plants were phenotyped on a daily basis following the standard descriptor of tomato (Table 2, below). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large). Next, analyzed data was saved to text files and processed using the JMP statistical analysis software (SAS institute).

Data parameters collected are summarized in Table 2, hereinbelow.

TABLE 2

| Tomato correlated parameters (vectors) | |
|---|---|
| Correlated parameter with | Correlation Id |
| 50% Irrigation; Vegetative fresh weight [gr.] | 1 |
| 50% Irrigation; Fruit per plant [gr.] | 2 |
| 50% Irrigation; Inflorescence weight [gr.] | 3 |
| 50% Irrigation; number of flowers | 4 |
| 50% Irrigation; relative Water use efficiency | 5 |
| 50% Irrigation; Ripe fruit average weight [gr.] | 7 |
| 50% Irrigation: SPAD | 8 |
| Normal Irrigation; vegetative fresh weight [gr.] | 9 |
| Normal Irrigation; Fruit per plant [gr.] | 10 |
| Normal Irrigation; Inflorescence weight [gr.] | 11 |
| Normal Irrigation; number of flowers | 12 |
| Normal Irrigation; relative Water use efficiency | 13 |
| Normal Irrigation; number of fruit per plant | 14 |
| Normal Irrigation; Ripe fruit average weight [gr.] | 15 |
| Normal Irrigation; SPAD | 16 |
| 50% Irrigation; Vegetative fresh weight [gr.]/ Normal Irrigation; vegetative fresh weight [gr.] | 17 |
| 50% Irrigation; Fruit per plant [gr.]/Normal Irrigation; Fruit per plant [gr.] | 18 |
| 50% Irrigation; Inflorescence weight [gr.]/Normal Irrigation; Inflorescence weight [gr.] | 19 |
| 50% Irrigation; number of flowers/Normal Irrigation; number of flowers | 20 |
| 50% Irrigation; relative Water use efficiency/Normal Irrigation; Water use efficiency | 21 |
| 50% Irrigation; Ripe fruit average weight [gr.]/ Normal Irrigation; Ripe fruit average weight [gr.] | 22 |
| 50% Irrigation: SPAD/Normal Irrigation; SPAD | 23 |

Table 2. Provided are the tomato correlated parameters. "gr." = grams; "SPAD" = chlorophyll levels;

Fruit Weight (grams)—At the end of the experiment [when 50% of the fruit were ripe (red)] all fruits from plots within blocks A-C were collected. The total fruits were counted and weighted. The average fruits weight was calculated by dividing the total fruit weight by the number of fruits.

Plant vegetative Weight (grams)—At the end of the experiment [when 50% of the fruit were ripe (red)] all plants from plots within blocks A-C were collected. Fresh weight was measured (grams).

Inflorescence Weight (grams)—At the end of the experiment [when 50% of the fruits were ripe (red)] two Inflorescence from plots within blocks A-C were collected. The Inflorescence weight (gr.) and number of flowers per inflorescence were counted.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Water use efficiency (WUE)—can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the following Formula I[(FW−DW)/(TW−DW)×100] as described above.

Plants that maintain high relative water content (RWC) compared to control lines were considered more tolerant to drought than those exhibiting reduced relative water content Experimental Results 10 different Tomato varieties were grown and characterized for 27 parameters as described above. The average for each of the measured parameter was calculated using the JMP software and values are summarized in Tables 3, 4 and 5 below. Subsequent correlation analysis between the various transcriptom sets (Table 1) and the average parameters was conducted, and results were integrated to the database.

TABLE 3

Tomato accessions, measured parameters

| Variety | 2 | 10 | 1 | 9 | 7 | 15 | 18 | 17 |
|---|---|---|---|---|---|---|---|---|
| 612 | 0.47 | 0.83 | 2.62 | 1.53 | 0.01 | 0.05 | 0.57 | 1.72 |
| 613 | 0.48 | 0.34 | 1.09 | 3.17 | 0.19 | 0.01 | 1.41 | 0.34 |
| 617 | 2.04 | 0.49 | 2.63 | 2.24 | 0.10 | 0.01 | 4.20 | 1.18 |
| 618 | 0.25 | 0.45 | 2.71 | 1.98 | 0.00 | 0.05 | 0.55 | 1.36 |
| 622 | 0.29 | 0.21 | 1.95 | 3.21 | 0.01 | 0.01 | 1.39 | 0.61 |
| 623 | 1.02 | 0.31 | 1.76 | 2.75 | 0.00 | 0.01 | 3.28 | 0.64 |
| 626 | 0.27 | 0.85 | 2.21 | 1.89 | 0.00 | 0.03 | 0.32 | 1.17 |
| 629 | 0.53 | 0.33 | 1.76 | 1.65 | 0.14 | 0.00 | 1.62 | 1.06 |
| 630 | 0.55 | 0.31 | 0.63 | 3.01 | 0.04 | 0.00 | 1.76 | 0.21 |
| 631 | 0.41 | 0.29 | 1.11 | 2.29 | 0.09 | 0.01 | 1.42 | 0.48 |

Table 3: Provided are the measured yield components and vigor related parameters under 50% water irrigation for the tomato accessions (Varieties) according to the Correlation ID numbers (described in Table 2 above) as follows: 2 [50% Irrigation; Fruit per plant (gr.)]; 10 [Normal Irrigation; Fruit per plant (gr.)]; 1 [50% Irrigation; Vegetative fresh weight (gr.)]; 9 [Normal Irrigation; vegetative fresh weight (gr.)]; 7 [50% Irrigation; ripe Fruit average weight (gr.)]; 15 [Normal Irrigation; Ripe fruit average weight (gr.)]; 18 [50% Irrigation; Fruit per plant (gr.)/Normal Irrigation; Fruit per plant (gr.)]; 17 [50% Irrigation; Vegetative fresh weight (gr.)/Normal Irrigation; vegetative fresh weight (gr.)].

TABLE 4

Tomato accessions, additional measured parameters

| Variety | 22 | 8 | 16 | 5 | 13 | 23 |
|---|---|---|---|---|---|---|
| 612 | 0.19 | 49.30 | 49.70 | 72.12 | 72.83 | 0.99 |
| 613 | 24.37 | 67.10 | 37.20 | 74.51 | 76.47 | 1.80 |
| 617 | 20.26 | 56.00 | 48.20 | 66.13 | 54.79 | 1.16 |
| 618 | 0.04 | 38.90 | 43.40 | 68.33 | 77.61 | 0.90 |
| 622 | 0.86 | 50.20 | 58.50 | 73.21 | 64.71 | 0.86 |
| 623 | 0.74 | 60.50 | 51.10 | 62.50 | 75.25 | 1.18 |
| 626 | 0.17 | 54.70 | 57.90 | 62.82 | 56.77 | 0.94 |
| 629 | 27.89 | 47.70 | 54.50 | 75.22 | 100.00 | 0.88 |
| 630 | 11.79 | 58.10 | 41.60 | 63.68 | 63.16 | 1.40 |
| 631 | 9.98 | 59.40 | 59.10 | 62.31 | 75.13 | 1.01 |

Table 4: Provided are the measured yield components and vigor related parameters under 50% water irrigation for the tomato accessions (Varieties) according to the Correlation (Corr.) ID numbers (described in Table 2 above) as follows: 22 [50% Irrigation; Ripe fruit average weight (gr.)/Normal Irrigation; Ripe fruit average weight (gr.)]; 8 [50% Irrigation; SPAD]; 16 [Normal Irrigation; SPAD]; 5 [50% Irrigation; relative Water use efficiency]; 13 [Normal Irrigation; relative Water use efficiency]; 23 [50% Irrigation; SPAD/Normal Irrigation; SPAD].

TABLE 5

Tomato accessions, additional measured parameters

| Variety | 21 | 4 | 12 | 3 | 11 | 20 | 19 |
|---|---|---|---|---|---|---|---|
| 612 | 0.99 | 16.67 | 5.67 | 0.37 | 1.17 | 2.94 | 0.32 |
| 613 | 0.97 | 6.50 | 19.33 | 0.41 | 0.34 | 0.34 | 1.19 |
| 617 | 1.21 | 11.67 | 9.67 | 0.55 | 0.44 | 1.21 | 1.25 |
| 618 | 0.88 | 25.33 | 8.33 | 0.31 | 11.31 | 3.04 | 0.03 |
| 622 | 1.13 | 14.67 | 10.00 | 0.30 | 0.73 | 1.47 | 0.42 |
| 623 | 0.83 | 29.67 | 7.00 | 0.31 | 0.83 | 4.24 | 0.38 |
| 626 | 1.11 | 18.33 | 5.33 | 8.36 | 1.02 | 3.44 | 8.20 |

TABLE 5-continued

Tomato accessions, additional measured parameters

| Variety | 21 | 4 | 12 | 3 | 11 | 20 | 19 |
|---|---|---|---|---|---|---|---|
| 629 | 0.75 | 12.67 | 9.00 | 0.44 | 0.66 | 1.41 | 0.67 |
| 630 | 1.01 | 12.67 | 10.67 | 0.27 | 0.70 | 1.19 | 0.38 |
| 631 | 0.83 | 11.33 | 9.00 | 0.43 | 0.33 | 1.26 | 1.31 |

Table 5: Provided are the measured yield components and vigor related parameters under 50% water irrigation for the tomato accessions (Varieties) according to the Correlation (Corr.) ID numbers (described in Table 2 above) as follows: 21 [50% Irrigation; relative Water use efficiency/ Normal Irrigation; Water use efficiency]; 4 [50% Irrigation; number of flowers]; 12 [Normal Irrigation; number of flowers]; 3 [50% Irrigation; Inflorescence weight (gr.)]; 11 [Normal Irrigation; Inflorescence weight (gr.)]; 20 [50% Irrigation; number of flowers/Normal Irrigation; number of flowers]; 19 [50% Irrigation; Inflorescence weight (gr.)/Normal Irrigation; Inflorescence weight (gr.)].

Correlation of early vigor traits across collection of Tomato ecotypes under high salinity concentration—Ten Tomato varieties were grown in 3 repetitive plots, each containing 17 plants, at a net house under semi-hydroponics conditions. Briefly, the growing protocol was as follows: Tomato seeds were sown in trays filled with a mix of vermiculite and peat in a 1:1 ratio. Following germination, the trays were transferred for the high salinity to 100 mM NaCl solution or to the normal growth solution [full Hogland; $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]-40.5 grams/liter; Mn—20.2 grams/liter; Zn 10.1 grams/liter; Co 1.5 grams/liter; and Mo 1.1 grams/liter), solution's pH should be 6.5-6.8].

RNA extraction—All 10 selected Tomato varieties were sample per each treatment. Two tissues [leaves and flowers] growing at 50% irrigation or under Normal conditions were sampled and RNA was extracted as described above.

TABLE 6

Tomato transcriptom experimental sets

| Expression Set | Set ID |
|---|---|
| Leaves at 100 mM NaCl | Q |
| Leaves at Normal conditions | R |
| Roots at 100 mM NaCl | S |
| Roots at Normal conditions | T |

Table 6. Provided are the tomato transcriptom experimental sets Q-T.

Tomato vigor related parameters under 100 mM NaCl—following 5 weeks of growing, plant were harvested and analyzed for leaf number, plant height, and plant weight. Next, analyzed data was saved to text files and processed using the JMP statistical analysis software (SAS institute).

Data parameters collected are summarize in Table 7, hereinbelow.

TABLE 7

Tomato correlated parameters (vectors)

| Correlated parameter with | Correlation Id |
|---|---|
| 100 mM NaCl: leaf Number | 24 |
| 100 mM NaCl: Plant height | 25 |
| 100 mM NaCl: Plant biomass | 26 |
| Normal: leaf Number | 27 |
| Normal: Plant height | 28 |
| 100 mM NaCl: leaf Number/Normal: leaf Number | 29 |
| 100 mM NaCl: Plant height/Normal: Plant height | 30 |

Table 7. Provided are the tomato correlated parameters (ID numbers 1-7).

Experimental Results 10 different Tomato varieties were grown and characterized for 3 parameters as described above. The average for each of the measured parameter was calculated using the JMP software and values are summarized in Tables 8 below. Subsequent correlation analysis between the various transcriptom sets (Table 6) and the average parameters, was conducted. Follow, results were integrated to the database.

TABLE 8

Tomato accessions, measured parameters

| Variety | 24 | 27 | 25 | 28 | 26 | 29 | 30 |
|---|---|---|---|---|---|---|---|
| 1139 | 3.56 | 6.56 | 5.60 | 45.33 | 0.36 | 0.54 | 0.12 |
| 2078 | 3.94 | 6.89 | 6.46 | 47.78 | 0.44 | 0.57 | 0.14 |
| 2958 | 5.00 | 7.33 | 8.47 | 40.78 | 0.26 | 0.68 | 0.21 |
| 5077 | 4.00 | 6.22 | 8.56 | 55.33 | 0.71 | 0.64 | 0.15 |
| 5080 | 3.56 | 6.33 | 8.87 | 56.22 | 0.46 | 0.56 | 0.16 |
| 5084 | 4.39 | 6.44 | 7.56 | 48.67 | 0.54 | 0.68 | 0.16 |
| 5085 | 3.17 | 5.89 | 8.64 | 55.78 | 0.66 | 0.54 | 0.15 |
| 5088 | 3.72 | 5.56 | 5.57 | 37.44 | 0.40 | 0.67 | 0.15 |
| 5089 | 4.00 | 6.11 | 5.82 | 49.56 | 0.52 | 0.65 | 0.12 |
| 5092 | 4.28 | 5.67 | 9.36 | 46.33 | 0.45 | 0.75 | 0.20 |

Table 8: Provided are the measured vigor related parameters under 100 mM NaCl for the tomato accessions (Varieties) according to the Correlation (Corr.) ID numbers (described in Table 7 above) as follows: 24 [100 mM NaCl: leaf Number]; 27 [Normal: leaf Number]; 25 [100 mM NaCl: Plant height]; 28 [Normal: Plant height]; 26 [100 mM NaCl: Plant biomass]; 29 [100 mM NaCl: leaf Number/Normal: leaf Number]; 30 [100 mM NaCl: Plant height/Normal: Plant height].

TABLE 9

Correlation analysis between the expression level of selected Genes of some embodiments of the invention in various tissues and the phenotypic performance under normal or drought conditions

| Gene Name | R Value | P Value | Exp. set | Corr. Set ID | Gene Name | R Value | P Value | Exp. set | Corr. Set ID |
|---|---|---|---|---|---|---|---|---|---|

Table 9. "Corr. Set ID" - correlation set ID according to the correlated parameters Tables 2 and 7 above.

TABLE 10

Correlation analysis between the expression level of selected Orthologs genes of some embodiments of the invention in various tissues and the phenotypic performance under normal or drought conditions

| Gene Name | R value | P value | Exp. set | Corr. Set ID | Gene Name | R value | P value | Exp. set | Corr. Set ID |
|---|---|---|---|---|---|---|---|---|---|

Table 10. "Corr. Set ID" - correlation set ID according to the correlated parameters Tables 2 and 7 above.

Example 3

Production of *Sorghum* Transcriptom and High Throughput Correlation Analysis Using 44 K *Sorguhm* Oligonucleotide Micro-Arrays In order to produce a high throughput correlation analysis, the present inventors utilized a *Sorghum* oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 *Sorghum* genes and transcripts. In order to define correlations between the levels of RNA expression with ABST and yield components or vigor related parameters, various plant characteristics of 17 different sorghum varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of *Sorghum* Varieties Across Ecotype Grown Under Severe Drought Conditions Experimental Procedures 17 *Sorghum* varieties were grown in 3 repetitive plots, in field. Briefly, the growing protocol was as follows: sorghum seeds were sown in soil and grown under normal condition until around 35 days from sowing, around V8 (Last leaf visible, but still rolled up, ear beginning to swell). At this point, irrigation was stopped, and severe drought stress was developed. In order to define correlations between the levels of RNA expression with drought, yield components or vigor related parameters, the 17 different sorghum varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

RNA extraction—All 10 selected *Sorghum* varieties were sample per each treatment. Plant tissues [Flag leaf and Flower meristem] growing under severe drought stress and plants grown under Normal conditions were sampled and RNA was extracted as described above. For convenience, each microarray expression information tissue type has received a Set ID as summarized in Table 11 below. Data parameters collected are summarize in Table 12, hereinbelow.

TABLE 11

Sorghum transcriptom experimental sets

| Expression Set | Set ID |
|---|---|
| Drought Stress: Flag leaf | U |
| Drought Stress: Flower meristem | V |
| Drought Stress: inflorescence | W |
| Normal conditions: Flag leaf | X |
| Normal conditions: Flower meristem | Y |
| Normal conditions: inflorescence | Z |

Table 11: Provided are the sorghum transcriptom experimental set U-Z.

Data parameters collected are summarize in Table 12, hereinbelow.

TABLE 12

Sorghum correlated parameters (vectors)

| Correlated parameter with | Correlation Id |
|---|---|
| DW Drought [gr.] | 1 |
| DW (5I) Drought [gr.] | 2 |
| FW Inflorescence (5I) Drought [gr.] | 3 |
| DW Inflorescence (5I) Drought [gr.] | 4 |
| Grain per Inflorescence Drought [gr.] | 5 |
| Grain per Inflorescence(5I) Drought [gr.] | 6 |
| SPAD Drought | 7 |
| Harvest Index Drought | 8 |
| Leaf TP1 Drought | 9 |
| Leaf TP2 Drought | 10 |
| Leaf TP3 Drought | 11 |
| Leaf TP4 Drought | 12 |
| Leaf TP5 Drought | 13 |
| Leaf TP6 Drought | 14 |
| Plant Height TP2 Drought [cm] | 15 |

TABLE 12-continued

Sorghum correlated parameters (vectors)

| Correlated parameter with | Correlation Id |
|---|---|
| Plant Height TP3 Drought [cm] | 16 |
| Plant Height TP4 Drought [cm] | 17 |
| Plant Height TP5 Drought [cm] | 18 |
| Plant Height TP6 Drought [cm] | 19 |
| DW Normal [gr.] | 20 |
| DW (5I) Normal [gr.] | 21 |
| FW Inflorescence(5I) Normal [gr.] | 22 |
| DW Inflorescence(5I) Normal [gr.] | 23 |
| Grain per Plant Normal [gr.] | 24 |
| Grain per Plant (5I) Normal [gr.] | 25 |
| SPAD Normal | 26 |
| Harvest Index Normal | 27 |
| Leaf TP1 Normal | 28 |
| Leaf TP2 Normal | 29 |
| Leaf TP3 Normal | 30 |
| Leaf TP4 Normal | 31 |
| Leaf TP5 Normal | 32 |
| Leaf TP6 Normal | 33 |
| Plant Height TP2 Normal [cm] | 34 |
| Plant Height TP3 Normal [cm] | 35 |
| Plant Height TP4 Normal [cm] | 36 |
| Plant Height TP5 Normal [cm] | 37 |
| Plant Height TP6 Normal [cm] | 38 |
| DW Drought/Normal [gr.] | 39 |
| Grain per Plant drought/Normal [gr.] | 40 |
| SPAD Drought/Normal | 41 |
| Harvest Index drought/Normal | 42 |
| FW(5I) Drought/Normal [gr.] | 43 |
| DW(5I) Drought/Normal [gr.] | 44 |
| Grain per Plant (5I) Drought/Normal [gr.] | 45 |
| Plant Hight TP5 Drought/Normal [cm] | 46 |
| LeafTP5 Drought/Normal | 47 |

TABLE 12. Provided are the Sorghum correlated parameters (vectors). "DW" = Dry Weight; (5I)" = Average of five Inflorescences; "FW" = Fresh Weight; "gr." = grams; "cm" = centimeter; "SPAD" = chlorophyll levels; "TP1" = X days after sowing; "TP2" = X days after sowing; "TP3" = X days after sowing; "TP4" = X days after sowing; "TP5" = X days after sowing; "TP6" = X days after sowing.

Grain per Plant (gr.)—At the end of the experiment (Inflorescence were dry) all spikes from plots within blocks A-C were collected. 5 Inflorescence were separately threshed and grains were weighted, all addition Inflorescence were threshed together and weighted as well. The average weight per Inflorescence was calculated by dividing the total grain weight by number of total Inflorescence per plot, or in case of 5 inflorescence, by weight by the total grain number by 5.

Plant height—Plant were characterize for height during groin period in 6 time Points. In each measure, plants were measured for its height using measuring tape. Height was measured from ground level to top of the longest leaf.

Inflorescence Weight (gr.)—At the end of the experiment (when Inflorescence were dry) five Inflorescence from plots within blocks A-C were collected. The Inflorescence were weighted (gr.).

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Vegetative dry weight and Inflorescence—At the end of the experiment (when Inflorescence were dry) all Inflorescence and vegetative material from plots within blocks A-C were collected. The biomass and Inflorescence weight of each plot was separated, measured and divided by the number of Inflorescence.

Dry weight=total weight of the vegetative portion above ground (excluding roots) after drying at 70° C. in oven for 48 hours;

Harvest Index (for sorghum)—The harvest index is calculated using Formula V.

Harvest Index=Average grain dry weight per Inflorescence/(Average vegetative dry weight per Inflorescence+Average Inflorescence dry weight)    Formula V Experimental Results 16 different sorghum varieties were grown and characterized for 49 parameters as described above. The average for each of the measured parameter was calculated using the JMP software and values are summarized in Tables 13-18 below. Subsequent correlation analysis between the various transcriptom sets (Table 11) and the average parameters, was conducted. Follow, results were integrated to the database.

TABLE 13

Sorghum accessions, measured parameters

| Seed ID | 1 | 2 | 3 | 4 | 5 | 6 | 7 | 8 |
|---|---|---|---|---|---|---|---|---|
| 20 | 0.20 | 0.47 | 0.39 | 0.01 | 0.03 | 0.05 | 38.33 | 0.13 |
| 21 | 0.20 | 0.49 | 0.43 | 0.01 | 0.03 | 0.05 | 38.98 | 0.15 |
| 22 | 0.34 | 0.73 | 0.30 | 0.01 | 0.02 | 0.04 | 42.33 | 0.06 |
| 25 | 0.54 | 0.54 | 0.21 | 0.02 | 0.03 | 0.04 | 43.15 | 0.05 |
| 26 | 0.36 | 0.61 | 0.30 | 0.01 | 0.02 | 0.04 | 39.85 | 0.06 |
| 27 | 0.15 | 0.48 | 0.44 | 0.01 | 0.05 | 0.07 | 42.68 | 0.34 |
| 28 | 0.13 | 0.44 | 0.38 | 0.01 | 0.03 | 0.04 | 43.31 | 0.21 |
| 29 | 0.18 | 0.51 | 0.47 | 0.01 | 0.05 | 0.08 |  | 0.29 |
| 30 | 0.12 | 0.45 | 0.40 | 0.01 | 0.04 | 0.05 | 42.71 | 0.30 |
| 31 | 0.10 | 0.44 | 0.38 | 0.00 | 0.03 | 0.04 | 40.08 | 0.29 |
| 32 | 0.13 | 0.43 | 0.38 | 0.01 | 0.03 | 0.04 | 43.98 | 0.20 |
| 33 | 0.12 | 0.48 | 0.43 | 0.01 | 0.03 | 0.07 | 45.44 | 0.25 |
| 34 | 0.18 | 0.54 | 0.43 | 0.01 | 0.05 | 0.10 | 44.75 | 0.29 |
| 35 | 0.14 | 0.46 | 0.41 | 0.01 | 0.04 | 0.05 | 42.58 | 0.25 |
| 36 | 0.13 | 0.42 | 0.38 | 0.01 | 0.04 | 0.04 | 43.81 | 0.32 |
| 37 | 0.18 | 0.50 | 0.43 | 0.01 | 0.04 | 0.05 | 46.73 | 0.23 |

Table 13: Provided are the measured parameters under 50% irrigation conditions of Sorghum accessions (Seed ID) according to the Correlation ID numbers (described in Table 12 above) as follows:
1 [DW Drought (gr.)];
2 [W(5I) Drought (gr.)];
3 [FW Inflorescence(5I) Drought (gr.)];
4 [DW Inflorescence (5I) Drought (gr.)];
5 [Grain per Inflorescence Drought (gr.)];
6 [Grain per Inflorescence(5I) Drought (gr.)];
7 [SPAD Drought];
8 [Harvest Index Drought.

TABLE 14

Sorghum accessions, addition measured parameters

| Seed ID | 9 | 10 | 11 | 12 | 13 | 14 | 15 | 16 |
|---|---|---|---|---|---|---|---|---|
| 20 | 3.00 | 5.33 | 4.50 | 7.75 | 7.08 | 7.75 | 10.75 | 22.25 |
| 21 | 4.25 | 5.50 | 5.75 | 7.92 | 8.58 | 7.92 | 8.00 | 18.50 |
| 22 | 5.00 | 5.83 | 5.75 | 8.67 | 9.08 | 8.67 | 16.00 | 30.33 |
| 25 | 4.25 | 5.25 | 5.50 | 8.17 | 9.58 | 8.17 | 13.83 | 27.92 |
| 26 | 5.50 | 6.25 | 6.00 | 9.38 | 9.75 | 9.38 | 16.33 | 32.67 |
| 27 | 5.00 | 6.50 | 6.17 | 9.13 | 9.08 | 9.13 | 15.17 | 32.25 |
| 28 | 4.75 | 5.75 | 5.83 | 8.58 | 7.75 | 8.58 | 13.50 | 28.92 |
| 29 | 5.25 | 6.50 | 5.17 | 9.50 | 8.50 | 8.25 | 16.42 | 26.83 |
| 30 | 5.50 | 6.25 | 5.92 | 7.83 | 7.08 | 7.83 | 17.58 | 34.17 |
| 31 | 5.00 | 6.75 | 6.08 | 7.25 | 6.75 | 13.08 | 15.83 | 30.50 |
| 32 | 5.50 | 6.25 | 5.92 | 9.00 | 8.25 | 9.00 | 17.00 | 30.58 |
| 33 | 5.00 | 6.42 | 6.08 | 7.50 | 7.92 | 7.50 | 13.92 | 27.17 |
| 34 | 5.00 | 6.33 | 6.08 | 10.00 | 9.83 | 10.00 | 14.83 | 27.58 |
| 35 | 5.00 | 5.50 | 5.42 | 8.38 | 8.50 | 8.38 | 12.50 | 28.00 |

TABLE 14-continued

Sorghum accessions, addition measured parameters

| Seed ID | 9 | 10 | 11 | 12 | 13 | 14 | 15 | 16 |
|---|---|---|---|---|---|---|---|---|
| 36 | 4.75 | 6.33 | 5.33 | 8.67 | 9.17 | 8.67 | 17.58 | 29.33 |
| 37 | 5.25 | 5.58 | 5.50 | 10.00 | 10.58 | 9.50 | 15.92 | 30.42 |

Table 14: Provided are the measured parameters under 50% irrigation conditions of Sorghum accessions (Seed ID) according to the Correlation ID numbers (described in Table 12 above) as follows:
9 [Leaf TP1 Drought];
10 [Leaf TP2 Drought];
11 [Leaf TP3 Drought];
12 [Leaf TP4 Drought];
13 [Leaf TP5 Drought];
14 [Leaf TP6 Drought];
15 [Plant Height TP2 Drought (cm)];
16 [Plant Height TP3 Drought (cm)].

TABLE 15

Sorghum accessions, addition measured parameters

| Seed ID | 17 | 18 | 19 | 20 | 21 | 22 | 23 | 24 |
|---|---|---|---|---|---|---|---|---|
| 20 | 38.00 | 50.25 | 38.00 | 0.16 | 0.46 | 0.41 | 0.008 | 0.031 |
| 21 | 30.83 | 45.25 | 30.83 | 0.25 | 0.69 | 0.49 | 0.012 | 0.026 |
| 22 | 110.83 | 92.08 | 60.83 | 0.33 | 0.44 | 0.15 | 0.007 | 0.019 |
| 25 | 49.58 | 73.92 | 49.58 | 0.46 | 0.56 | 0.09 | 0.015 | 0.027 |
| 26 | 49.75 | 100.50 | 49.75 | 0.36 | 0.55 | 0.13 | 0.010 | 0.046 |
| 27 | 46.88 | 58.67 | 46.88 | 0.15 | 0.47 | 0.42 | 0.009 | 0.048 |
| 28 | 41.92 | 70.75 | 41.92 | 0.14 | 0.45 | 0.39 | 0.007 | 0.031 |
| 29 | 46.13 | 67.67 | 46.13 | 0.17 | 0.48 | 0.41 | 0.010 | 0.040 |
| 30 | 50.17 | 68.50 | 50.17 | 0.13 | 0.46 | 0.33 | 0.008 | 0.038 |
| 31 | 43.58 | 65.67 | 43.58 | 0.10 | 0.42 | 0.39 | 0.005 | 0.032 |
| 32 | 50.83 | 79.25 | 50.92 | 0.10 | 0.42 | 0.41 | 0.008 | 0.033 |
| 33 | 42.42 | 57.67 | 42.42 | 0.11 | 0.50 | 0.43 | 0.010 | 0.033 |
| 34 | 45.50 | 78.58 | 45.50 | 0.16 | 0.49 | 0.44 | 0.010 | 0.052 |
| 35 | 50.38 | 60.75 | 50.38 | 0.13 | 0.45 | 0.42 | 0.008 | 0.036 |
| 36 | 48.83 | 71.17 | 53.83 | 0.14 | 0.47 | 0.43 | 0.008 | 0.038 |
| 37 | 49.83 | 73.92 | 51.42 | 0.21 | 0.52 | 0.43 | 0.013 | 0.042 |

Table 15: Provided are the measured parameters under 50% irrigation conditions of Sorghum accessions (Seed ID) according to the Correlation ID numbers (described in Table 12 above) as follows:
17 [Plant Height TP4 Drought (cm)];
18 [Plant Height TP5 Drought (cm)];
19 [Plant Height TP6 Drought (cm)];
20 [DW Normal (gr.)];
21 [DW (5I) Normal (gr.)];
22 [FW Inflorescence(5I) Normal (gr.)];
23 [DW Inflorescence(5I) Normal (gr.)];
24 [Grain per Plant Normal (gr.)].

TABLE 16

Sorghum accessions, addition measured parameters

| Seed ID | 25 | 26 | 27 | 28 | 29 | 30 | 31 | 32 |
|---|---|---|---|---|---|---|---|---|
| 20 | 0.05 | 43.01 | 0.20 | 4.33 | 5.31 | 5.44 | 6.73 | 6.75 |
| 21 | 0.05 | 40.70 | 0.11 | 4.00 | 6.08 | 6.38 |  | 8.38 |
| 22 | 0.03 | 43.26 | 0.05 | 4.67 | 6.00 | 6.56 | 8.44 | 9.81 |
| 25 | 0.03 | 45.76 | 0.05 | 4.33 | 5.38 | 5.13 | 7.88 | 8.69 |
| 26 | 0.07 | 41.61 | 0.12 | 5.17 | 6.31 | 6.31 | 8.13 | 9.50 |
| 27 | 0.06 | 45.21 | 0.33 | 4.83 | 6.13 | 6.19 | 9.13 | 9.19 |
| 28 | 0.04 | 45.14 | 0.23 | 4.33 | 6.06 | 6.06 | 7.50 | 6.69 |
| 29 | 0.06 | 43.03 | 0.24 | 4.67 | 6.13 | 5.63 | 8.25 | 9.00 |
| 30 | 0.06 | 45.59 | 0.30 | 4.17 | 6.44 | 5.94 | 7.00 | 6.75 |
| 31 | 0.05 | 44.83 | 0.34 | 5.00 | 7.00 | 6.00 | 6.75 | 6.38 |
| 32 | 0.06 | 45.33 | 0.35 | 4.83 | 6.31 | 6.38 | 8.06 | 7.81 |
| 33 | 0.07 | 46.54 | 0.29 | 4.67 | 6.25 | 6.31 | 6.94 | 7.88 |
| 34 | 0.07 | 43.99 | 0.41 | 4.67 | 6.25 | 5.94 | 7.94 | 9.94 |
| 35 | 0.05 | 45.09 | 0.29 | 4.33 | 5.63 | 5.94 | 8.06 | 8.69 |
| 36 | 0.06 | 45.14 | 0.28 | 4.67 | 6.38 | 5.75 | 7.56 | 8.56 |
| 37 | 0.05 | 43.13 | 0.20 | 4.17 | 5.88 | 6.56 | 7.94 | 10.31 |

Table 16: Provided are the measured parameters under 50% irrigation conditions of Sorghum accessions (Seed ID) according to the Correlation ID numbers (described in Table 12 above) as follows:
25 [Grain per Plant (5I) Normal (gr.)];
26 [SPAD Normal];
27 [Harvest Index Normal];
28 [Leaf TP1 Normal];
29 [Leaf TP2 Normal];
30 [Leaf TP3 Normal];
31 [Leaf TP4 Normal];
32 [Leaf TP5 Normal].

TABLE 17

Sorghum accessions, addition measured parameters

| Seed ID | 33 | 34 | 35 | 36 | 37 | 38 | 39 | 40 |
|---|---|---|---|---|---|---|---|---|
| 20 | 6.73 | 10.63 | 24.50 | 37.31 | 47.13 | 37.31 | 1.26 | 0.83 |
| 21 |  | 8.00 | 19.88 |  | 40.06 |  | 0.81 | 1.19 |
| 22 | 8.44 | 16.00 | 31.13 | 47.75 | 82.94 | 47.75 | 1.02 | 1.03 |
| 25 | 7.88 | 14.19 | 27.25 | 45.94 | 74.13 | 45.94 | 1.16 | 0.94 |
| 26 | 8.13 | 15.31 | 27.25 | 41.44 | 79.69 | 41.44 | 1.01 | 0.48 |
| 27 | 9.13 | 15.69 | 31.19 | 44.88 | 58.00 | 44.88 | 0.99 | 1.05 |
| 28 | 7.50 | 15.88 | 30.25 | 42.13 | 58.81 | 42.13 | 0.94 | 0.89 |
| 29 | 8.25 | 14.63 | 26.19 | 41.00 | 64.31 | 41.00 | 1.06 | 1.28 |
| 30 | 7.00 | 18.38 | 31.88 | 42.50 | 58.69 | 42.06 | 0.96 | 0.96 |
| 31 | 6.75 | 18.13 | 32.19 | 41.88 | 59.25 | 41.88 | 1.04 | 0.92 |
| 32 | 8.06 | 17.25 | 29.75 | 43.38 | 66.88 | 43.38 | 1.33 | 0.82 |
| 33 | 6.94 | 14.88 | 28.13 | 39.81 | 60.63 | 39.81 | 1.05 | 0.90 |
| 34 | 7.94 | 13.50 | 27.00 | 40.63 | 73.38 | 40.63 | 1.12 | 0.99 |
| 35 | 8.06 | 14.63 | 29.19 | 44.38 | 59.63 | 44.38 | 1.10 | 1.04 |
| 36 | 7.56 | 16.38 | 27.75 | 43.25 | 64.69 | 43.25 | 0.94 | 1.04 |
| 37 | 7.94 | 17.31 | 31.63 | 41.00 | 73.81 | 41.00 | 0.86 | 0.98 |

Table 17: Provided are the measured parameters under 50% irrigation conditions of Sorghum accessions (Seed ID) according to the Correlation ID numbers (described in Table 12 above) as follows:
33 [Leaf TP6 Normal];
34 [Plant Height TP2 Normal (cm)];
35 [Plant Height TP3 Normal (cm)];
36 [Plant Height TP4 Normal (cm)];
37 [Plant Height TP5 Normal (cm)];
38 [Plant Height TP6 Normal (cm)];
39 [DW Drought/Normal (gr.)];
40 [Grain per Plant drought/Normal (gr.)].

TABLE 18

Sorghum accessions, addition measured parameters

| Seed ID | 41 | 42 | 43 | 44 | 45 | 46 | 47 |
|---|---|---|---|---|---|---|---|
| 20 | 0.89 | 0.66 | 0.95 | 1.03 | 1.06 | 1.07 | 1.05 |
| 21 | 0.96 | 1.38 | 0.88 | 0.71 | 1.13 | 1.13 | 1.02 |
| 22 | 0.98 | 1.09 | 2.01 | 1.67 | 1.27 | 1.11 | 0.93 |
| 25 | 0.94 | 0.86 | 2.26 | 0.96 | 1.18 | 1.00 | 1.10 |
| 26 | 0.96 | 0.52 | 2.37 | 1.10 | 0.55 | 1.26 | 1.03 |
| 27 | 0.94 | 1.04 | 1.03 | 1.02 | 1.13 | 1.01 | 0.99 |
| 28 | 0.96 | 0.93 | 0.97 | 0.97 | 0.79 | 1.20 | 1.16 |
| 29 | 0.91 | 1.19 | 1.16 | 1.06 | 1.35 | 1.05 | 0.94 |
| 30 | 0.94 | 0.97 | 1.23 | 0.98 | 0.88 | 1.17 | 1.05 |
| 31 | 0.89 | 0.86 | 0.98 | 1.04 | 0.94 | 1.11 | 1.06 |
| 32 | 0.97 | 0.58 | 0.91 | 1.03 | 0.66 | 1.19 | 1.06 |
| 33 | 0.98 | 0.84 | 0.99 | 0.97 | 0.97 | 0.95 | 1.01 |
| 34 | 1.02 | 0.70 | 0.98 | 1.12 | 1.37 | 1.07 | 0.99 |
| 35 | 0.94 | 0.89 | 0.98 | 1.02 | 0.91 | 1.02 | 0.98 |

TABLE 18-continued

Sorghum accessions, addition measured parameters

| Seed ID | 41 | 42 | 43 | 44 | 45 | 46 | 47 |
|---|---|---|---|---|---|---|---|
| 36 | 0.97 | 1.12 | 0.88 | 0.88 | 0.73 | 1.10 | 1.07 |
| 37 | 1.08 | 1.14 | 1.01 | 0.96 | 0.99 | 1.00 | 1.03 |

Table 18: Provided are the measured parameters under 50% irrigation conditions of Sorghum accessions (Seed ID) according to the Correlation ID numbers (described in Table 12 above) as follows:
41 [SPAD Drought/Normal];
42 [Harvest Index drought/Normal];
43 [FW(5I) Drought/Normal (gr.)];
44 [DW(5I) Drought/Normal (gr.)];
45 [Grain per Plant (5I) Drought/Normal (gr.)];
46 [Plant HightTP5 Drought/Normal (cm)];
47 [LeafTP5 Drought/Normal].

*Sorghum* vigor related parameters under 100 mM NaCl and low temperature (8-10° C.)—Ten *Sorghum* varieties were grown in 3 repetitive plots, each containing 17 plants, at a net house under semi-hydroponics conditions. Briefly, the growing protocol was as follows: *Sorghum* seeds were sown in trays filled with a mix of vermiculite and peat in a 1:1 ratio. Following germination, the trays were transferred to the high salinity solution (100 mM NaCl) solution, low temperature (8-10° C.) or at Normal growth solution [full Hogland; KNO3—0.808 grams/liter, MgSO4—0.12 grams/liter, KH2 PO4—0.172 grams/liter and 0.01% (volume/volume) of 'Super coratin' micro elements (Iron-EDDHA [ethylenediamine-N,N'-bis(2-hydroxyphenylacetic acid)]-40.5 grams/liter; Mn—20.2 grams/liter; Zn 10.1 grams/liter; Co 1.5 grams/liter; and Mo 1.1 grams/liter), solution's pH should be 6.5-6.8].

RNA extraction—All 10 selected *Sorghum* varieties were sample per each treatment. Two tissues [leaves and roots] growing at 100 mM NaCl, low temperature (8-10° C.) or under Normal conditions were sampled and RNA was extracted as described above.

TABLE 19

Sorghum correlated parameters (vectors)

| Correlated parameter with | Correlation Id |
|---|---|
| 100 mM NaCl: leaf Number | 48 |
| 100 mM NaCl: Plant height | 49 |
| 100 mM NaCl: Shoot DW | 50 |
| 100 mM NaCl: Root DW | 51 |
| 100 mM NaCl: SPAD | 52 |
| low temperature: leaf Number | 53 |
| low temperature: Plant height | 54 |
| low temperature: Shoot DW | 55 |
| low temperature: Root DW | 56 |
| low temperature: SPAD | 57 |
| Normal: leaf Number | 58 |
| Normal: Plant height | 59 |
| Normal: Shoot DW | 60 |
| Normal: Root DW | 61 |
| Normal: SPAD | 62 |
| leaf Number 100 mM NaCl/Normal | 63 |
| Plant height 100 mM NaCl/Normal | 64 |
| Shoot DW 100 mM NaCl/Normal | 65 |
| Root DW 100 mM NaCl/Normal | 66 |
| SPAD 100 mM NaCl/Normal | 67 |
| leaf Number low temperature/Normal | 68 |
| Plant height low temperature/Normal | 69 |
| Shoot DW low temperature/Normal | 70 |
| Root DW low temperature/Normal | 71 |
| SPAD low temperature/Normal | 72 |

Table 19: provided are the Sorghum correlated parameters (vectors).

Experimental Results 10 different *Sorghum* varieties were grown and characterized for 25 parameters as described above (Table 19). The average for each of the measured parameter was calculated using the JMP software and values are summarized in Tables 20-22 below. Subsequent correlation analysis between the various transcriptom sets (Table 11) and the average parameters (Tables 20-22), was conducted (Tables 23 and 24). Follow, results were integrated to the database.

TABLE 20

Sorghum accessions, measured parameters

| Seed ID | 48 | 51 | 50 | 52 | 49 | 53 | 56 |
|---|---|---|---|---|---|---|---|
| 20 | 3.67 | 0.35 | 0.66 | 32.73 | 14.63 | 3.88 | 0.83 |
| 22 | 3.88 | 1.45 | 2.43 | 35.14 | 16.31 | 4.16 | 0.95 |
| 26 | 4.28 | 1.49 | 2.40 | 27.97 | 20.56 | 4.52 | 1.47 |
| 27 | 4.03 | 0.81 | 1.61 | 30.93 | 14.70 | 4.28 | 1.06 |
| 28 | 3.97 | 1.03 | 1.77 | 34.53 | 16.43 | 4.33 | 0.71 |
| 29 | 3.98 | 0.95 | 1.66 | 29.99 | 16.12 | 4.17 | 1.38 |
| 30 | 3.90 | 2.00 | 2.23 | 32.09 | 15.61 | 3.94 | 2.04 |
| 31 | 4.18 | 1.39 | 2.76 | 31.86 | 18.71 | 4.26 | 1.03 |
| 34 | 3.70 | 1.29 | 1.29 | 32.51 | 13.65 | 4.20 | 1.01 |
| 37 | 3.82 | 1.76 | 1.55 | 34.32 | 15.72 | 4.04 | 1.01 |

Table 20: Provided are the measured parameters under 100 mM NaCl and low temperature (8-10° C.) conditions of Sorghum accessions (Seed ID) according to the Correlation ID numbers (described in Table 19 above) as follows:
48 [100 mM NaCl: leaf Number];
51 [100 mM NaCl: Root DW];
50 [100 mM NaCl: Shoot DW];
52 [100 mM NaCl: SPAD];
49 [100 mM NaCl: Plant height];
53 [low temperature: leaf Number];
56 [low temperature: Root DW].

TABLE 21

Sorghum accessions, addition measured parameters

| Seed ID | 55 | 57 | 54 | 58 | 59 | 61 | 60 |
|---|---|---|---|---|---|---|---|
| 20 | 1.03 | 28.62 | 8.83 | 4.17 | 11.22 | 0.42 | 0.81 |
| 22 | 1.34 | 30.31 | 12.32 | 4.48 | 13.77 | 1.07 | 1.89 |
| 26 | 1.71 | 27.04 | 14.42 | 4.93 | 17.48 | 1.38 | 2.51 |
| 27 | 1.28 | 32.28 | 9.50 | 4.53 | 13.08 | 0.83 | 1.26 |
| 28 | 1.12 | 28.28 | 12.53 | 4.52 | 13.50 | 0.86 | 1.55 |
| 29 | 1.69 | 29.89 | 11.82 | 4.64 | 13.53 | 0.96 | 1.50 |
| 30 | 2.24 | 32.47 | 11.28 | 4.49 | 16.75 | 1.11 | 1.93 |
| 31 | 1.26 | 28.63 | 13.22 | 4.79 | 16.15 | 0.99 | 1.95 |
| 34 | 1.08 | 31.71 | 9.97 | 4.37 | 13.95 | 0.80 | 1.48 |
| 37 | 1.02 | 29.61 | 10.02 | 4.54 | 15.28 | 0.88 | 1.85 |

Table 21: Provided are the measured parameters under 100 mM NaCl and low temperature (8-10° C.) conditions of Sorghum accessions (Seed ID) according to the Correlation ID numbers (described in Table 19 above) as follows:
55 [low temperature: Shoot DW];
57 [low temperature: SPAD];
54 [low temperature: Plant height];
58 [Normal: leaf Number];
59 [Normal: Plant height];
61 [Normal: Root DW];
60 [Normal: Shoot DW].

TABLE 22

Sorghum accessions, addition measured parameters

| Seed ID | 66 | 71 | 70 | 67 | 72 |
|---|---|---|---|---|---|
| 20 | 0.83 | 1.97 | 1.28 | 1.23 | 1.07 |
| 22 | 1.35 | 0.88 | 0.71 | 1.20 | 1.03 |
| 26 | 1.08 | 1.07 | 0.68 | 0.94 | 0.91 |
| 27 | 0.98 | 1.29 | 1.02 | 1.06 | 1.11 |
| 28 | 1.20 | 0.83 | 0.72 | 1.38 | 1.13 |
| 29 | 0.99 | 1.45 | 1.12 | 1.22 | 1.21 |
| 30 | 1.80 | 1.83 | 1.16 | 1.04 | 1.05 |
| 31 | 1.40 | 1.03 | 0.65 | 1.25 | 1.12 |

TABLE 22-continued

Sorghum accessions, addition measured parameters

| Seed ID | 66 | 71 | 70 | 67 | 72 |
|---|---|---|---|---|---|
| 34 | 1.63 | 1.27 | 0.73 | 0.99 | 0.96 |
| 37 | 2.00 | 1.14 | 0.55 | 1.02 | 0.88 |

Table 22: Provided are the measured parameters under 100 mM NaCl and low temperature (8-10° C.) conditions of Sorghum accessions (Seed ID) according to the Correlation ID numbers (described in Table 19 above) as follows:
66 [Root DW 100 mM NaCl/Normal];
71 [Root DW low temperature/Normal];
70 [Shoot DW low temperature/Normal];
67 [SPAD 100 mM NaCl/Normal];
72 [SPAD low temperature/Normal].

Tables 23 and 24 hereinbelow, provide correlation analysis between the characterized parameters (as described above in Examples 2 and 3) and the tissue transcriptom.

TABLE 23

Correlation analysis between the expression level of selected Genes of some embodiments of the invention in various tissues and the phenotypic performance under normal or drought conditions

| Gene Name | R | P value | Exp. set | Corr. Set ID | Gene Name | R | P value | Exp. set | Corr. Set ID |
|---|---|---|---|---|---|---|---|---|---|
| LAB276 | 0.7 | 0.03523 | X | 24 | LAB174 | 0.8 | 0.004143 | V | 5 |
| LAB174 | 0.81 | 0.006827 | Y | 24 | LAB290 | 0.9 | 0.000239 | U | 1 |
| LAB290 | 0.83 | 0.00258 | Y | 24 | LAB290 | 0.8 | 0.004123 | W | 1 |
| LAB347 | 0.78 | 0.00722 | V | 4 | LAB295 | 0.8 | 0.002967 | V | 3 |
| LAB295 | 0.83 | 0.00311 | V | 5 | LAB295 | 0.8 | 0.010068 | Y | 24 |
| LAB304 | 0.80 | 0.01113 | Z | 21 | LAB304 | 0.7 | 0.023194 | W | 6 |

Table 23. "Corr. Set ID" - correlation set ID according to the correlated parameters Table

TABLE 24

Correlation analysis between the expression level of selected Orthologs genes of some embodiments of the invention in various tissues and the phenotypic performance under normal or drought conditions

| Gene Name | R | P value | Exp. set | Corr. Set ID | Gene Name | R | P value | Exp. set | Corr. Set ID |
|---|---|---|---|---|---|---|---|---|---|

Table 24. "Corr. Set ID" - correlation set ID according to the correlated parameters Table above.

Example 4

Production of Maize Transcriptom and High Throughput Correlation Analysis with Yield and Nue Related Parameters Using 44K Maize Oligonucleotide Micro-Arrays In order to produce a high throughput correlation analysis between plant phenotype and gene expression level, the present inventors utilized a maize oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 maize genes and transcripts. In order to define correlations between the levels of RNA expression with yield and NUE components or vigor related parameters, various plant characteristics of 12 different maize hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of Maize Hybrids Across Ecotypes Grown Under Regular Growth Conditions Experimental Procedures 12 Maize hybrids were grown in 3 repetitive plots, in field. Maize seeds were planted and plants were grown in the field using commercial fertilization and irrigation protocols. In order to define correlations between the levels of RNA expression with NUE and yield components or vigor related parameters, the 12 different maize hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Analyzed *Sorghum* tissues—All 10 selected maize hybrids were sample per each treatment. Plant tissues [Flag leaf, Flower meristem, Grain, Cobs, Internodes] growing under Normal conditions were sampled and RNA was extracted as described above. Each micro-array expression information tissue type has received a Set ID as summarized in Table 25 below.

TABLE 25

| Maize transcriptom expression sets | |
|---|---|
| Expression Set | Set ID |
| Maize field/Normal/flower meristem | A |
| Maize field/Normal/Ear | B |
| Maize field/Normal/Grain Distal | C |
| Maize field/Normal/Grain Basal | D |
| Maize field/Normal/Internode | E |
| Maize field/Normal/Leaf | F |

Table 25: Provided are the maize transcriptom expression sets.
Leaf = the leaf below the main ear;
Flower meristem = Apical meristem following male flower initiation;
Ear = the female flower at the anthesis day.
Grain Distal = maize developing grains from the cob extreme area,
Grain Basal = maize developing grains from the cob basal area;
Internodes = internodes located above and below the main ear in the plant.

The following parameters were collected using digital imaging system:

Grain Area ($cm^2$)—At the end of the growing period the grains were separated from the ear. A sample of ~200 grains were weight, photographed and images were processed using the below described image processing system. The grain area was measured from those images and was divided by the number of grains.

Grain Length and Grain width (cm)—At the end of the growing period the grains were separated from the ear. A sample of ~200 grains were weight, photographed and images were processed using the below described image processing system. The sum of grain lengths/or width (longest axis) was measured from those images and was divided by the number of grains.

Ear Area (cm²)—At the end of the growing period 5 ears were, photographed and images were processed using the below described image processing system. The Ear area was measured from those images and was divided by the number of Ears.

Ear Length and Ear Width (cm) At the end of the growing period 5 ears were, photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.)—At the end of the experiment all ears from plots within blocks A-C were collected. 6 ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear FW (gr.)—At the end of the experiment (when ears were harvested) total and 6 selected ears per plots within blocks A-C were collected separately. The plants with (total and 6) were weighted (gr.) separately and the average ear per plant was calculated for total (Ear FW per plot) and for 6 (Ear FW per plant).

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located Leaf number per plant—Plants were characterized for leaf number during growing period at 5 time points. In each measure, plants were measured for their leaf number by counting all the leaves of 3 selected plants per plot.

Relative Growth Rate was calculated using Formula II (described above).

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS)

Dry weight per plant—At the end of the experiment (when Inflorescence were dry) all vegetative material from plots within blocks A-C were collected.

Dry weight=total weight of the vegetative portion above ground (excluding roots) after drying at 70° C. in oven for 48 hours;

Harvest Index (HI) (Maize)—The harvest index was calculated using Formula VI.

Harvest Index=Average grain dry weight per Ear/(Average vegetative dry weight per Ear+Average Ear dry weight)    Formula VI Percent Filled Ear [%]—it was calculated as the percentage of the Ear area with grains out of the total ear.

Cob diameter [cm]—The diameter of the cob without grains was measured using a ruler.

Kernel Row Number per Ear—The number of rows in each ear was counted.

Experimental Results 12 different maize hybrids were grown and characterized for different parameters: The average for each of the measured parameter was calculated using the JMP software (Tables 27-88) and a subsequent correlation analysis was performed (Tables 29-30). Results were then integrated to the database.

TABLE 26

Maize correlated parameters (vectors)

| Correlations | Correlation ID |
|---|---|
| SPAD 54DPS [SPAD units] | 1 |
| SPAD 46DPS [SPAD units] | 2 |
| Growth Rate Leaf Num | 3 |
| Plant Height per Plot [cm] | 4 |
| Ear Height [cm] | 5 |
| Leaf Number per Plant [number] | 6 |
| Ear Length [cm] | 7 |
| Percent Filled Ear [%] | 8 |
| Cob Diameter [mm] | 9 |
| Kernel Row Number per Ear [number] | 10 |
| DW per Plant [gr] | 11 |
| Ear FW per Plant gr] | 12 |
| Normalized Grain Weight per plant [gr] | 13 |
| Ears FW per plot [gr] | 14 |
| Normalized Grain Weight per plot [gr] | 15 |
| Ear Area [cm2] | 16 |
| Ear Width [cm] | 17 |
| Grain Area [cm2] | 18 |
| Grain Length [cm] | 19 |
| Grain Width [cm] | 20 |

Table 26. SPAD 46DPS and SPAD 54DPS: Chlorophyl level after 46 and 54 days after sowing (DPS).

TABLE 27

Measured parameters in Maize accessions under normal conditions

| Seed ID | 1 | 2 | 3 | 4 | 5 | 6 | 7 | 8 | 9 | 10 | 11 |
|---|---|---|---|---|---|---|---|---|---|---|---|
| Line 1 | 54.8 | 55.3 | 0.306 | 287 | 135 | 11.9 | 20.9 | 80.4 | 28.7 | 16.2 | 656 |
| Line 2 | 54.3 | 51.7 | 0.283 | 278 | 135 | 12 | 19.7 | 80.6 | 29 | 16.2 | 658 |
| Line 3 | 57.2 | 56.4 | 0.221 | 270 | 116 | 8.4 | 19.1 | 94.3 | 23.8 | 15 | 472 |

TABLE 27-continued

Measured parameters in Maize accessions under normal conditions

| Seed ID | 1 | 2 | 3 | 4 | 5 | 6 | 7 | 8 | 9 | 10 | 11 |
|---|---|---|---|---|---|---|---|---|---|---|---|
| Line 4 | 56 | 53.5 | 0.281 | 275 | 132 | 11.7 | 20.5 | 82.1 | 28.1 | 16.2 | 641 |
| Line 5 | 59.7 | 55.2 | 0.269 | 238 | 114 | 11.8 | 21.3 | 92.7 | 25.7 | 15.9 | 581 |
| Line 6 | 59.1 | 59.4 | 0.244 | 225 | 94.3 | 12.3 | 18.2 | 82.8 | 25.8 | 15.2 | 569 |
| Line 7 | 58 | 58.5 | 0.244 | 264 | 121 | 12.4 | 19 | 73.2 | 26.4 | 16 | 511 |
| Line 8 | 60.4 | 55.9 | 0.266 | 252 | 108 | 12.2 | 18.6 | 81.1 | 25.2 | 14.8 | 544 |
| Line 9 | 54.8 | 53 | | | | | | | | | |
| Line 10 | 53.3 | 50 | | | | | | | | | |
| Line 11 | 61.1 | 59.7 | 0.301 | 278 | 112 | 12.6 | 21.7 | 91.6 | 26.7 | 15.4 | 522 |
| Line 12 | 51.4 | 53.9 | 0.194 | 164 | 60.4 | 9.28 | 16.7 | 81.1 | 14.3 | 574 | 141 |

Table 27. Provided are the values of each of the parameters (as described above) measured in maize accessions (Seed ID) under regular growth conditions. Growth conditions are specified in the experimental procedure section.

TABLE 28

Additional measured parameters in Maize accessions under regular growth conditions

| Seed ID | 12 | 13 | 14 | 15 | 16 | 17 | 18 | 19 | 20 |
|---|---|---|---|---|---|---|---|---|---|
| Line 1 | 272 | 157 | 280 | 140 | 91.6 | 5.73 | 0.806 | 1.23 | 0.824 |
| Line 2 | 246 | 141 | 278 | 154 | 85.1 | 5.58 | 0.753 | 1.17 | 0.81 |
| Line 3 | 190 | 129 | 190 | 121 | 77.9 | 5.1 | 0.674 | 1.07 | 0.794 |
| Line 4 | 262 | 154 | 288 | 152 | 90.5 | 5.67 | 0.755 | 1.18 | 0.803 |
| Line 5 | 264 | 177 | 248 | 159 | 96 | 5.53 | 0.766 | 1.2 | 0.803 |
| Line 6 | 178 | 120 | 176 | 117 | 72.4 | 5.23 | 0.713 | 1.12 | 0.803 |
| Line 7 | 189 | 120 | 192 | 123 | 74 | 5.22 | 0.714 | 1.14 | 0.791 |
| Line 8 | 197 | 134 | 205 | 131 | 76.5 | 5.33 | 0.753 | 1.13 | 0.837 |
| Line 9 | | | | | | | | | |
| Line 10 | | | | | | | | | |
| Line 11 | 261 | 173 | 264 | 171 | 95.4 | 5.58 | 0.762 | 1.18 | 0.812 |
| Line 12 | | 54.3 | 143 | 40.8 | 55.2 | 4.12 | 0.796 | 0.921 | 0.675 |

Table 28. Provided are the values of each of the parameters (as described above) measured in maize accessions (Seed ID) under regular growth conditions. Growth conditions are specified in the experimental procedure section.

TABLE 29

Correlation between the expression level of selected Genes of some embodiments of the invention in various tissues and the phenotypic performance under normal across maize accessions

| Gene Name | R | P value | Exp. set | Corr. Set ID | Gene Name | R | P value | Exp. set | Corr. Set ID |
|---|---|---|---|---|---|---|---|---|---|

Table 29. "Corr. Set ID" - correlation set ID according to the correlated parameters Table above.

TABLE 30

Correlation between the expression level of selected ABST homologous genes of some embodiments of the invention in various tissues and the phenotypic performance under normal across maize accessions

| Gene Name | R | P value | Exp. Set | Corr. Set ID | Gene Name | R | P value | Exp. Set | Corr. Set ID |
|---|---|---|---|---|---|---|---|---|---|

Table 30. "Corr. Set ID"—correlation set ID according to the correlated parameters Table above.

Example 5

Production of Barley Transcriptom and High Throughput Correlation Analysis Using 44K Barley Oligonucleotide Micro-Array In order to produce a high throughput correlation analysis comparing between plant phenotype and gene expression level, the present inventors utilized a Barley oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 47,500 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed Barley tissues—Five tissues at different developmental stages [meristem, flower, booting spike, stem, flag leaf], representing different plant characteristics, were sampled and RNA was extracted as described above. Each micro-array expression information tissue type has received a Set ID as summarized in Table 31 below.

TABLE 31

Barley transcriptom expression sets

| Expression Set | Set ID |
|---|---|
| Meristem | A |
| Flower | B |
| Booting spike | C |
| Stem | D |
| Flag leaf | E |

Table 31.

Barley yield components and vigor related parameters assessment—25 Barley accessions in 4 repetitive blocks (named A, B, C, and D), each containing 4 plants per plot were grown at net house. Plants were phenotyped on a daily basis following the standard descriptor of barley (Table 32, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

TABLE 32

Barley standard descriptors

| Trait | Parameter | Range | Description |
|---|---|---|---|
| Growth habit | Scoring | 1-9 | Prostrate (1) or Erect (9) |
| Hairiness of basal leaves | Scoring | P (Presence)/ A (Absence) | Absence (1) or Presence (2) |
| Stem pigmentation | Scoring | 1-5 | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

Table 32.

Grains per spike—At the end of the experiment (50% of the spikes were dry) all spikes from plots within blocks A-D are collected. The total number of grains from 5 spikes that were manually threshed was counted. The average grain per spike is calculated by dividing the total grain number by the number of spikes.

Grain average size (cm)—At the end of the experiment (50% of the spikes were dry) all spikes from plots within blocks A-D are collected. The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

Grain average weight (mgr)—At the end of the experiment (50% of the spikes were dry) all spikes from plots within blocks A-D are collected. The total grains from 5 spikes that were manually threshed were counted and weight. The average weight was calculated by dividing the total weight by the total grain number.

Grain yield per spike (gr)—At the end of the experiment (50% of the spikes were dry) all spikes from plots within blocks A-D are collected. The total grains from 5 spikes that were manually threshed were weight. The grain yield was calculated by dividing the total weight by the spike number.

Spike length analysis—At the end of the experiment (50% of the spikes were dry) all spikes from plots within blocks A-D are collected. The five chosen spikes per plant were measured using measuring tape excluding the awns.

Spike number analysis—At the end of the experiment (50% of the spikes were dry) all spikes from plots within blocks A-D are collected. The spikes per plant were counted.

Growth habit scoring—At the growth stage 10 (booting), each of the plants was scored for its growth habit nature. The scale that was used was 1 for prostate nature till 9 for erect.

Hairiness of basal leaves—At the growth stage 5 (leaf sheath strongly erect; end of tillering), each of the plants was scored for its hairiness nature of the leaf before the last. The scale that was used was 1 for prostate nature till 9 for erect.

Plant height—At the harvest stage (50% of spikes were dry) each of the plants was measured for its height using measuring tape. Height was measured from ground level to top of the longest spike excluding awns.

Days to flowering—Each of the plants was monitored for flowering date. Days of flowering was calculated from sowing date till flowering date.

Stem pigmentation—At the growth stage 10 (booting), each of the plants was scored for its stem color. The scale that was used was 1 for green till 5 for full purple.

Vegetative dry weight and spike yield—At the end of the experiment (50% of the spikes were dry) all spikes and vegetative material from plots within blocks A-D are collected. The biomass and spikes weight of each plot was separated, measured and divided by the number of plants.

Dry weight=total weight of the vegetative portion above ground (excluding roots) after drying at 70° C. in oven for 48 hours;

Spike yield per plant=total spike weight per plant (gr) after drying at 30° C. in oven for 48 hours.

Harvest Index (for barley)—The harvest index is calculated using Formula XVI.

Harvest Index=Average spike dry weight per plant/ (Average vegetative dry weight per plant+Average spike dry weight per plant)   Formula XVI:

TABLE 33

Barley correlated parameters (vectors)

| Correlated parameter with (units) | Correlation Id |
|---|---|
| Grains per spike (numbers) | 1 |
| Grains size (mm$^2$) | 2 |
| Grain weight (miligrams) | 3 |
| Grain Yield per spike (gr/spike) | 4 |
| Spike length (cm) | 5 |
| Spikes per plant (numbers) | 6 |
| Growth habit (scores 1-9) | 7 |
| Hairiness of basal leaves (scoring 1-2) | 8 |
| Plant height (cm) | 9 |
| Days to flowering (days) | 10 |

TABLE 33-continued

Barley correlated parameters (vectors)

| Correlated parameter with (units) | Correlation Id |
|---|---|
| Stem pigmentation (scoring 1-5) | 11 |
| Vegetative dry weight (gram) | 12 |
| Harvest Index (ratio) | 13 |

Table 33.

Experimental Results 13 different Barley accessions were grown and characterized for 13 parameters as described above. The average for each of the measured parameter was calculated using the JMP software and values are summarized in Tables 34 and 35 below. Subsequent correlation analysis between the various transcriptom sets (Table 31) and the average parameters, was conducted (Tables 36 and 37). Follow, results were integrated to the database.

TABLE 34

Measured parameters of correlation Ids in Barley accessions

| Accession/Parameter | 6 | 10 | 3 | 5 | 2 | 1 | 7 |
|---|---|---|---|---|---|---|---|
| Amatzya | 48.85 | 62.40 | 35.05 | 12.04 | 0.27 | 20.23 | 2.60 |
| Ashqelon | 48.27 | 64.08 | 28.06 | 10.93 | 0.23 | 17.98 | 2.00 |
| Canada park | 37.42 | 65.15 | 28.76 | 11.83 | 0.24 | 17.27 | 1.92 |
| Havarim stream | 61.92 | 58.92 | 17.87 | 9.90 | 0.17 | 17.73 | 3.17 |
| Jordan est | 33.27 | 63.00 | 41.22 | 11.68 | 0.29 | 14.47 | 4.33 |
| Klil | 41.69 | 70.54 | 29.73 | 11.53 | 0.28 | 16.78 | 2.69 |
| Maale Efraim | ND | 52.80 | 25.22 | 8.86 | 0.22 | 13.47 | 3.60 |
| Mt Arbel | 40.63 | 60.88 | 34.99 | 11.22 | 0.28 | 14.07 | 3.50 |
| Mt Harif | 62.00 | 58.10 | 20.58 | 11.11 | 0.19 | 21.54 | 3.00 |
| Neomi | 49.33 | 53.00 | 27.50 | 8.58 | 0.22 | 12.10 | 3.67 |
| Neot Kdumim | 50.60 | 60.40 | 37.13 | 10.18 | 0.27 | 14.36 | 2.47 |
| Oren canyon | 43.09 | 64.58 | 29.56 | 10.51 | 0.27 | 15.28 | 3.50 |
| Yeruham | 51.40 | 56.00 | 19.58 | 9.80 | 0.18 | 17.07 | 3.00 |

Table 34. Provided are the values of each of the parameters measured in Barley accessions according to the following correlation identifications (Correlation Ids): 6 = Spikes per plant; 10 = Days to flowering; 3 = Grain weight; 5 = Spike length; 2 = Grains Size; 1 = Grains per spike; 7 = Growth habit.

TABLE 35

Barley accessions, additional measured parameters

| Accession/Parameter | 8 | 9 | 4 | 11 | 12 | 13 |
|---|---|---|---|---|---|---|
| Amatzya | 1.53 | 134.27 | 3.56 | 1.13 | 78.87 | 0.45 |
| Ashqelon | 1.33 | 130.50 | 2.54 | 2.50 | 66.14 | 0.42 |
| Canada park | 1.69 | 138.77 | 2.58 | 1.69 | 68.49 | 0.40 |
| Havarim stream | 1.08 | 114.58 | 1.57 | 1.75 | 53.39 | 0.44 |
| Jordan est | 1.42 | 127.75 | 3.03 | 2.33 | 68.30 | 0.43 |
| Klil | 1.69 | 129.38 | 2.52 | 2.31 | 74.17 | 0.40 |
| Maale Efraim | 1.30 | 103.89 | 1.55 | 1.70 | 35.35 | 0.52 |
| Mt Arbel | 1.19 | 121.63 | 2.62 | 2.19 | 58.33 | 0.48 |
| Mt Harif | 1.00 | 126.80 | 2.30 | 2.30 | 62.23 | 0.44 |
| Neomi | 1.17 | 99.83 | 1.68 | 1.83 | 38.32 | 0.49 |
| Neot Kdumim | 1.60 | 121.40 | 2.68 | 3.07 | 68.31 | 0.45 |
| Oren canyon | 1.08 | 118.42 | 2.35 | 1.58 | 56.15 | ND |
| Yeruham | 1.17 | 117.17 | 1.67 | 2.17 | 42.68 | ND |

Table 35. Provided are the values of each of the parameters measured in Barley accessions according to the following correlation identifications (Correlation Ids): 8 = Hairiness of basal leaves; 9 = Plant height; 4 = Grain yield per spike; 11 = Stem pigmentation; 12 = Vegetative dry weight; 13 = Harvest Index.

TABLE 36

Correlation between the expression level of selected Genes of some embodiments of the invention in various tissues and the phenotypic performance under normal conditions across barley accessions

| Gene Name | R | P value | Exp. Set ID | Corr. Set ID | Gene Name | R | P value | Exp. Set ID | Corr. Set ID |
|---|---|---|---|---|---|---|---|---|---|
| LAB195 | 0.80 | 0.193838 | D | 5 | LAB195 | 0.73 | 0.2649 | D | 12 |

Table 36. "Corr. Set ID"—correlation set ID according to the correlated parameters Table

TABLE 37

Correlation between the expression level of selected Orthologs genes of some embodiments of the invention in various tissues and the phenotypic performance under normal conditions across barley accessions

| Gene Name | R | P value | Exp. Set | Corr. Set ID | Gene Name | R | P value | Exp. Set | Corr. Set ID |
|---|---|---|---|---|---|---|---|---|---|
| LAB352_H0 | 0.71 | 0.0470 | C | 6 | | | | | |

Table 37. "Corr. Set ID"—correlation set ID according to the correlated parameters Table above.

Example 6

Production of *Arabidopsis* Transcriptom and High Throughput Correlation Analysis Using 44K *Arabidopsis* Oligonucleotide Micro-Array In order to produce a high throughput correlation analysis comparing between plant phenotype and gene expression level, the present inventors utilized a *Arabidopsis* oligonucleotide micro-array, produced by Agilent Technologies [Hypertext Transfer Protocol://World Wide Web (dot) chem (dot) agilent (dot) com/Scripts/PDS (dot) asp?1Page=50879]. The array oligonucleotide represents about 44,000 *Arabidopsis* genes and transcripts. To define correlations between the levels of RNA expression with NUE, yield components or vigor related parameters various plant characteristics of 14 different *Arabidopsis* ecotypes were analyzed. Among them, ten ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed *Arabidopsis* tissues—Two tissues of plants [leaves and stems] growing at two different nitrogen fertilization levels (1.5 mM Nitrogen or 6 mM Nitrogen) were sampled and RNA was extracted as described above. Each micro-array expression information tissue type has received a Set ID as summarized Table 38 below.

TABLE 38

*Arabidopsis* transcriptom experimental sets

| Expression Set | Set ID |
|---|---|
| Leaves at 1.5 mM Nitrogen fertilization | A |
| Leaves at 6 mM Nitrogen fertilization | B |
| Stems at 1.5 mM Nitrogen fertilization | C |
| Stem at 6 mM Nitrogen fertilization | D |

Table 38.

*Arabidopsis* yield components and vigor related parameters under different nitrogen fertilization levels assessment—10 *Arabidopsis* accessions in 2 repetitive plots each containing 8 plants per plot were grown at greenhouse. The growing protocol used was as follows: surface sterilized seeds were sown in Eppendorf tubes containing 0.5× Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of $KNO_3$, supplemented with 2 mM $CaCl_2$, 1.25 mM $KH_2PO_4$, 1.50 mM $MgSO_4$, 5 mM KCl, 0.01 mM $H_3BO_3$ and microelements, while normal irrigation conditions was achieved by applying a solution of 6 mM inorganic nitrogen also in the form of $KNO_3$, supplemented with 2 mM $CaCl_2$, 1.25 mM $KH_2PO_4$, 1.50 mM $MgSO_4$, 0.01 mM $H_3BO_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [Hypertext Transfer Protocol://rsb (dot) info (dot) nih (dot) gov/ij/] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

Data parameters collected are summarized in Table 39, hereinbelow.

TABLE 39

*Arabidopsis* correlated parameters (vectors)

| Correlated parameter with | Correlation Id |
|---|---|
| N 1.5 mM; Rosette Area at day 8 [$cm^2$] | 1 |
| N 1.5 mM; Rosette Area at day 10 [$cm^2$] | 2 |
| N 1.5 mM; Plot Coverage at day 8 [%] | 3 |
| N 1.5 mM; Plot Coverage at day 10 [%] | 4 |
| N 1.5 mM; Leaf Number at day 10 | 5 |
| N 1.5 mM; Leaf Blade Area at day 10 [$cm^2$] | 6 |
| N 1.5 mM; RGR of Rosette Area at day 3 [$cm^2$/day] | 7 |
| N 1.5 mM; t50 Flowering [day] | 8 |
| N 1.5 mM; Dry Weight [gr/plant] | 9 |
| N 1.5 mM; Seed Yield [gr/plant] | 10 |
| N 1.5 mM; Harvest Index | 11 |
| N 1.5 mM; 1000 Seeds weight [gr] | 12 |
| N 1.5 mM; seed yield/rosette area at day 10 [gr/$cm^2$] | 13 |
| N 1.5 mM; seed yield/leaf blade [gr/$cm^2$] | 14 |
| N 1.5 mM; % Seed yield reduction compared to N 6 mM | 15 |
| N 1.5 mM; % Biomass reduction compared to N 6 mM | 16 |
| N 1.5 mM; N level/DW [SPAD unit/gr] | 17 |
| N 1.5 mM; DW/N level [gr/SPAD unit] | 18 |
| N 1.5 mM; seed yield/N level [gr/SPAD unit] | 19 |
| N 6 mM; Rosette Area at day 8 [$cm^2$] | 20 |
| N 6 mM; Rosette Area at day 10 [$cm^2$] | 21 |
| N 6 mM; Plot Coverage at day 8 [%] | 22 |
| N 6 mM; Plot Coverage at day 10 [%] | 23 |

TABLE 39-continued

*Arabidopsis* correlated parameters (vectors)

| Correlated parameter with | Correlation Id |
|---|---|
| N 6 mM; Leaf Number at day 10 | 24 |
| N 6 mM; Leaf Blade Area at day 10 | 25 |
| N 6 mM; RGR of Rosette Area at day 3 [cm$^2$/gr] | 26 |
| N 6 mM; t50 Flowering [day] | 27 |
| N 6 mM; Dry Weight [gr/plant] | 28 |
| N 6 mM; Seed Yield [gr/plant] | 29 |
| N 6 mM; Harvest Index | 30 |
| N 6 mM; 1000 Seeds weight [gr] | 31 |
| N 6 mM; seed yield/rosette area day at day 10 [gr/cm$^2$] | 32 |
| N 6 mM; seed yield/leaf blade [gr/cm$^2$] | 33 |
| N 6 mM; N level/FW | 34 |
| N 6 mM; DW/N level [gr/SPAD unit] | 35 |
| N 6 mM; N level/DW (SPAD unit/gr plant) | 36 |
| N 6 mM; Seed yield/N unit [gr/SPAD unit] | 37 |

Table 39.
"N" = Nitrogen at the noted concentrations;
"gr." = grams;
"SPAD" = chlorophyll levels;
"t50" = time where 50% of plants flowered;
"gr/SPAD unit" = plant biomass expressed in grams per unit of nitrogen in plant measured by SPAD.
"DW" = plant dry weight;
"N level/DW" = plant Nitrogen level measured in SPAD unit per plant biomass [gr];
"DW/N level" = plant biomass per plant [gr]/SPAD unit;

Assessment of NUE, yield components and vigor-related parameters—Ten *Arabidopsis* ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital Imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process is repeated every 2-3 days starting at day 9-12 till day 16-19 (respectively) from transplanting.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data was saved to text files and analyzed using the JMP statistical analysis software (SAS institute).

Leaf analysis—Using the digital analysis leaves data was calculated, including leaf number, leaf blade area, Rosette diameter and area.

Vegetative growth rate: the relative growth rate (RGR) of leaf blade area (Formula VIII), leaf number (Formula IX), rosette area (Formula X), rosette diameter (Formula XI), plot coverage (Formula XII) and Petiole Relative Area (XIII) are calculated as follows:

Relative growth rate of leaf blade area=Regression coefficient of leaf area along time course.    Formula VIII Relative growth rate of plant leaf number=Regression coefficient of plant leaf number along time course.    Formula IX Relative growth rate of rosette area=Regression coefficient of rosette area along time course.    Formula X Relative growth rate of rosette diameter=Regression coefficient of rosette diameter along time course.    Formula XI Relative growth rate of plot coverage=Regression coefficient of plot.    Formula XII Petiole Relative Area=[(Leaf blade*Leaf number)/Rosette.    Formula XIII Seed yield and 1000 seeds weight—At the end of the experiment all seeds from all plots were collected and weighed in order to measure seed yield per plant in terms of total seed weight per plant (gr). For the calculation of 1000 seed weight, an average weight of 0.02 grams was measured from each sample, the seeds were scattered on a glass tray and a picture was taken. Using the digital analysis, the number of seeds in each sample was calculated.

Dry weight and seed yield—At the end of the experiment, plant were harvested and left to dry at 30° C. in a drying chamber. The biomass was separated from the seeds, weighed and divided by the number of plants. Dry weight=total weight of the vegetative portion above ground (excluding roots) after drying at 30° C. in a drying chamber.

Harvest Index—The harvest index was calculated using Formula IV as described above.

$T_{50}$ days to flowering—Each of the repeats was monitored for flowering date. Days of flowering was calculated from sowing date till 50% of the plots flowered.

Plant nitrogen level—The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaf. Three measurements per leaf were taken per plot. Based on this measurement, parameters such as the ratio between seed yield per nitrogen unit [seed yield/N level=seed yield per plant [gr]/SPAD unit], plant DW per nitrogen unit [DW/N level=plant biomass per plant [g]/SPAD unit], and nitrogen level per gram of biomass [N level/DW=SPAD unit/plant biomass per plant (gr)] were calculated.

Percent of seed yield reduction—measures the amount of seeds obtained in plants when grown under nitrogen-limiting conditions compared to seed yield produced at normal nitrogen levels expressed in %.

Experimental Results 10 different *Arabidopsis* accessions (ecotypes) were grown and characterized for 37 parameters as described above. The average for each of the measured parameters was calculated using the JMP software and values are summarized in Table 40 below. Subsequent correlation analysis between the various transcriptom sets (Table 38) and the measured parameters was conducted (Tables 41 and 42 below). Following are the results integrated to the database.

TABLE 40

| Ecotype\Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| N 1.5 mM; Rosette Area at day 8 | 0.760 | 0.709 | 1.061 | 1.157 | 0.996 | 1.000 | 0.910 | 0.942 | 1.118 | 0.638 |
| N 1.5 mM; Rosette Area at day 10 | 1.430 | 1.325 | 1.766 | 1.971 | 1.754 | 1.832 | 1.818 | 1.636 | 1.996 | 1.150 |
| N 1.5 mM; Plot Coverage % at day 8 | 3.221 | 3.003 | 4.497 | 4.902 | 4.220 | 4.238 | 3.858 | 3.990 | 4.738 | 2.705 |
| N 1.5 mM; Plot Coverage % at day 10 | 6.058 | 5.614 | 7.484 | 8.351 | 7.432 | 7.764 | 7.702 | 6.933 | 8.458 | 4.871 |
| N 1.5 mM; Leaf Number at day 10 | 6.875 | 7.313 | 7.313 | 7.875 | 7.938 | 7.750 | 7.625 | 7.188 | 8.625 | 5.929 |
| N 1.5 mM; Leaf Blade Area at day 10 | 0.335 | 0.266 | 0.374 | 0.387 | 0.373 | 0.370 | 0.386 | 0.350 | 0.379 | 0.307 |
| N 1.5 mM; RGR of Rosette Area at day 3 | 0.631 | 0.793 | 0.502 | 0.491 | 0.605 | 0.720 | 0.825 | 0.646 | 0.668 | 0.636 |
| N 1.5 mM; t50 Flowering [day] | 15.967 | 20.968 | 14.836 | 24.708 | 23.566 | 23.698 | 18.059 | 19.488 | 23.568 | 21.888 |
| N 1.5 mM; Dry Weight [gr/plant] | 0.164 | 0.124 | 0.082 | 0.113 | 0.184 | 0.124 | 0.134 | 0.106 | 0.148 | 0.171 |
| N 1.5 mM; Seed Yield [gr/plant] | 0.032 | 0.025 | 0.023 | 0.010 | 0.006 | 0.009 | 0.032 | 0.019 | 0.012 | 0.014 |
| N 1.5 mM; Harvest Index | 0.192 | 0.203 | 0.295 | 0.085 | 0.031 | 0.071 | 0.241 | 0.179 | 0.081 | 0.079 |
| N 1.5 mM; 1000 Seeds weight[gr] | 0.016 | 0.016 | 0.018 | 0.014 | 0.018 | 0.022 | 0.015 | 0.014 | 0.022 | 0.019 |
| N 1.5 mM; seed yield/rosette area day at day 10 | 0.022 | 0.019 | 0.014 | 0.005 | 0.003 | 0.005 | 0.018 | 0.013 | 0.007 | 0.012 |
| N 1.5 mM; seed yield/leaf blade | 0.095 | 0.095 | 0.063 | 0.026 | 0.015 | 0.024 | 0.084 | 0.059 | 0.034 | 0.044 |
| N 1.5 mM; % Seed yield reduction compared to 6 mM | 72.559 | 84.701 | 78.784 | 87.996 | 91.820 | 92.622 | 76.710 | 81.938 | 91.301 | 85.757 |
| N 1.5 mM; % Biomass reduction compared to 6 mM | 60.746 | 76.706 | 78.560 | 78.140 | 62.972 | 78.641 | 73.192 | 83.068 | 77.190 | 70.120 |
| N 1.5 mM; Spad/FW | 45.590 | | | 42.108 | 28.151 | | 53.111 | | | 67.000 |
| N 1.5 mM; SPAD/DW | 167.300 | | | 241.061 | 157.823 | | 194.977 | | | 169.343 |
| N 1.5 mM; DW/SPAD | 0.006 | | | 0.004 | 0.006 | | 0.005 | | | 0.006 |
| N 1.5 mM; seed yield/spad | 0.001 | | | 0.000 | 0.000 | | 0.001 | | | 0.000 |
| N 6 mM; Rosette Area at day 8 | 0.759 | 0.857 | 1.477 | 1.278 | 1.224 | 1.095 | 1.236 | 1.094 | 1.410 | 0.891 |
| N 6 mM; Rosette Area at day 10 | 1.406 | 1.570 | 2.673 | 2.418 | 2.207 | 2.142 | 2.474 | 1.965 | 2.721 | 1.642 |
| N 6 mM; Plot Coverage % at day 8 | 3.216 | 3.631 | 6.259 | 5.413 | 5.187 | 4.641 | 5.236 | 4.634 | 5.974 | 3.774 |
| N 6 mM; Plot Coverage % at day 10 | 5.957 | 6.654 | 11.324 | 10.244 | 9.352 | 9.076 | 10.485 | 8.327 | 11.528 | 6.958 |
| N 6 mM; Leaf Number at day 10 | 6.250 | 7.313 | 8.063 | 8.750 | 8.063 | 8.750 | 8.375 | 7.125 | 9.438 | 6.313 |
| N 6 mM; Leaf Blade Area at day 10 | 0.342 | 0.315 | 0.523 | 0.449 | 0.430 | 0.430 | 0.497 | 0.428 | 0.509 | 0.405 |
| N 6 mM; RGR of Rosette Area at day 3 | 0.689 | 1.024 | 0.614 | 0.601 | 0.477 | 0.651 | 0.676 | 0.584 | 0.613 | 0.515 |
| N 6 mM; t50 Flowering [day] | 16.371 | 20.500 | 14.635 | 24.000 | 23.378 | 23.595 | 15.033 | 19.750 | 22.887 | 18.804 |
| N 6 mM; Dry Weight [gr/plant] | 0.419 | 0.531 | 0.382 | 0.518 | 0.496 | 0.579 | 0.501 | 0.628 | 0.649 | 0.573 |
| N 6 mM; Seed Yield [gr/plant] | 0.116 | 0.165 | 0.108 | 0.082 | 0.068 | 0.119 | 0.139 | 0.107 | 0.138 | 0.095 |
| N 6 mM; Harvest Index | 0.280 | 0.309 | 0.284 | 0.158 | 0.136 | 0.206 | 0.276 | 0.171 | 0.212 | 0.166 |
| N 6 mM; 1000 Seeds weight[gr] | 0.015 | 0.017 | 0.018 | 0.012 | 0.016 | 0.016 | 0.015 | 0.014 | 0.017 | 0.016 |
| N 6 mM; seed yield/rosette area day at day 10 | 0.082 | 0.106 | 0.041 | 0.034 | 0.031 | 0.056 | 0.057 | 0.055 | 0.051 | 0.058 |
| N 6 mM; seed yield/leaf blade | 0.339 | 0.526 | 0.207 | 0.183 | 0.158 | 0.277 | 0.281 | 0.252 | 0.271 | 0.235 |
| N 6 mM; Spad/FW | 22.489 | | | 28.268 | 17.641 | | 33.323 | | | 39.033 |
| N 6 mM; DW/SPAD (biomass/N unit) | 0.019 | | | 0.018 | 0.028 | | 0.015 | | | 0.015 |
| N 6 mM; spad/DW (gN/g plant) | 53.705 | | | 54.625 | 35.548 | | 66.479 | | | 68.054 |
| N 6 mM; Seed yield/N unit | 0.004 | | | 0.003 | 0.002 | | 0.005 | | | 0.003 |

Table 40. Provided are the measured parameters under various treatments in various ecotypes (*Arabidopsis* accessions).

TABLE 41

Correlation between the expression level of selected Genes of some embodiments of the invention in various tissues and the phenotypic performance under normal or low nitrogen fertilization conditions across *Arabidopsis* accessions

| Gene Name | R | P value | Exp. set | Corr. Set ID | Gene Name | R | P value | Exp. set | Corr. Set ID |
|---|---|---|---|---|---|---|---|---|---|
| LAB190 | 0.880 | 0.0495 | D | 37 | LAB190 | 0.84 | 0.0021 | A | 19 |

Table 41. "Corr. Set ID"—correlation set ID according to the correlated parameters Table

TABLE 42

Correlation between the expression level of selected Orthologs genes of some embodiments of the invention in various tissues and the phenotypic performance under normal or low nitrogen fertilization conditions across *Arabidopsis* accessions

| Gene Name | R | P value | Exp. Set | Corr. Set ID | Gene Name | R | P value | Exp. Set | Corr. Set ID |
|---|---|---|---|---|---|---|---|---|---|

Table 42. "Corr. Set ID" correlation set ID according to the correlated parameters Table above.

Example 7

Production of *Arabidopsis* Transcriptom and High Throughput Correlation Analysis of Yield, Biomass and/or Vigor Related Parameters Using 44K *Arabidopsis* Full Genome Oligonucleotide Micro-Array To produce a high throughput correlation analysis comparing between plant phenotype and gene expression level, the present inventors utilized an *Arabidopsis thaliana* oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 40,000 *A. thaliana* genes and transcripts designed based on data from the TIGR ATH1 v.5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed *Arabidopsis* tissues—Five tissues at different developmental stages including root, leaf, flower at antithesis, seed at 5 days after flowering (DAF) and seed at 12 DAF, representing different plant characteristics, were sampled and RNA was extracted as described above. Each micro-array expression information tissue type has received a Set ID as summarized in Table 43 below.

TABLE 43

Tissues used for *Arabidopsis* transcriptom expression sets

| Expression Set | Set ID |
|---|---|
| Root | A |
| Leaf | B |
| Flower | C |
| Seed 5 DAF | D |
| Seed 12 DAF | E |

Table 43: Provided are the identification (ID) letters of each of the *Arabidopsis* expression sets (A-E).
DAF = days after flowering.

Yield components and vigor related parameters assessment—Eight out of the nine *Arabidopsis* ecotypes were used in each of 5 repetitive blocks (named A, B, C, D and E), each containing 20 plants per plot. The plants were grown in a greenhouse at controlled conditions in 22° C., and the N:P:K fertilizer (20:20:20; weight ratios) [nitrogen (N), phosphorus (P) and potassium (K)] was added. During this time data was collected, documented and analyzed. Additional data was collected through the seedling stage of plants grown in a tissue culture in vertical grown transparent agar plates. Most of chosen parameters were analyzed by digital imaging.

Digital imaging in Tissue culture—A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital imaging in Greenhouse—The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P43.0 GHz processor) and a public domain program—ImageJ 1.37, Java based image processing program, which was developed at the U.S National Institutes of Health and is freely available on the internet at Hypertext Transfer Protocol://rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root analysis—During 17 days, the different ecotypes were grown in transparent agar plates. The plates were photographed every 3 days starting at day 7 in the photography room and the roots development was documented (see examples in FIGS. 3A-F). The growth rate of roots was calculated according to Formula XIV: Relative growth rate of root coverage=Regression coefficient of root coverage along time course.

Vegetative growth rate analysis—was calculated according to Formulas VIII-XIII above. The analysis was ended with the appearance of overlapping plants.

For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN Ultra—Oxford Instrument) and its MultiQuant sowftware package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr).

Oil yield—The oil yield was calculated using Formula XV.

Seed Oil yield=Seed yield per plant (gr)*Oil % in seed.  Formula XV

Harvest Index (seed)—The harvest index was calculated using Formula IV (described above).

Experimental Results

Nine different *Arabidopsis* ecotypes were grown and characterized for 18 parameters (named as vectors).

TABLE 44

*Arabidopsis* correlated parameters (vectors)

| Correlated parameter with | Correlation ID |
|---|---|
| Root length day 13 (cm) | 1 |
| Root length day 7 (cm) | 2 |
| Relative root growth (cm/day) day 13 | 3 |
| Fresh weight per plant (gr) at bolting stage | 4 |
| Dry matter per plant (gr) | 5 |
| Vegetative growth rate (cm$^2$/day) till 8 true leaves | 6 |
| Blade circularity | 7 |
| Lamina width (cm) | 8 |
| Lamina length (cm) | 9 |
| Total leaf area per plant (cm) | 10 |
| 1000 Seed weight (gr) | 11 |
| Oil % per seed | 12 |
| Seeds per silique | 13 |
| Silique length (cm) | 14 |
| Seed yield per plant (gr) | 15 |
| Oil yield per plant (mg) | 16 |
| Harvest Index | 17 |
| Leaf width/length | 18 |

Table 44. Provided are the *Arabidopsis* correlated parameters (correlation ID Nos. 1-18).
Abbreviations:
cm = centimeter(s);
gr = gram(s);
mg = milligram(s).

The characterized values are summarized in Tables 45 and 46 below.

TABLE 45

Measured parameters in *Arabidopsis* ecotypes

| Ecotype | 15 | 16 | 12 | 11 | 5 | 17 | 10 | 13 | 14 |
|---|---|---|---|---|---|---|---|---|---|
| An-1 | 0.34 | 118.63 | 34.42 | 0.0203 | 0.64 | 0.53 | 46.86 | 45.44 | 1.06 |
| Col-0 | 0.44 | 138.73 | 31.19 | 0.0230 | 1.27 | 0.35 | 109.89 | 53.47 | 1.26 |
| Ct-1 | 0.59 | 224.06 | 38.05 | 0.0252 | 1.05 | 0.56 | 58.36 | 58.47 | 1.31 |
| Cvi (N8580) | 0.42 | 116.26 | 27.76 | 0.0344 | 1.28 | 0.33 | 56.80 | 35.27 | 1.47 |
| Gr-6 | 0.61 | 218.27 | 35.49 | 0.0202 | 1.69 | 0.37 | 114.66 | 48.56 | 1.24 |

TABLE 45-continued

Measured parameters in *Arabidopsis* ecotypes

| Ecotype | 15 | 16 | 12 | 11 | 5 | 17 | 10 | 13 | 14 |
|---|---|---|---|---|---|---|---|---|---|
| Kondara | 0.43 | 142.11 | 32.91 | 0.0263 | 1.34 | 0.32 | 110.82 | 37.00 | 1.09 |
| Ler-1 | 0.36 | 114.15 | 31.56 | 0.0205 | 0.81 | 0.45 | 88.49 | 39.38 | 1.18 |
| Mt-0 | 0.62 | 190.06 | 30.79 | 0.0226 | 1.21 | 0.51 | 121.79 | 40.53 | 1.18 |
| Shakdara | 0.55 | 187.62 | 34.02 | 0.0235 | 1.35 | 0.41 | 93.04 | 25.53 | 1.00 |

Table 45. Provided are the values of each of the parameters measured in *Arabidopsis* ecotypes: 15 = Seed yield per plant (gram); 16 = oil yield per plant (mg); 12 = oil % per seed; 11 = 1000 seed weight (gr); 5 = dry matter per plant (gr); 17 = harvest index; 10 = total leaf area per plant (cm); 13 = seeds per silique; 14 = Silique length (cm).

TABLE 46

Additional measured parameters in *Arabidopsis* ecotypes

| Ecotype | 6 | 3 | 2 | 1 | 4 | 9 | 8 | 18 | 7 |
|---|---|---|---|---|---|---|---|---|---|
| An-1 | 0.313 | 0.631 | 0.937 | 4.419 | 1.510 | 2.767 | 1.385 | 0.353 | 0.509 |
| Col-0 | 0.378 | 0.664 | 1.759 | 8.530 | 3.607 | 3.544 | 1.697 | 0.288 | 0.481 |
| Ct-1 | 0.484 | 1.176 | 0.701 | 5.621 | 1.935 | 3.274 | 1.460 | 0.316 | 0.450 |
| Cvi (N8580) | 0.474 | 1.089 | 0.728 | 4.834 | 2.082 | 3.785 | 1.374 | 0.258 | 0.370 |
| Gr-6 | 0.425 | 0.907 | 0.991 | 5.957 | 3.556 | 3.690 | 1.828 | 0.356 | 0.501 |
| Kondara | 0.645 | 0.774 | 1.163 | 6.372 | 4.338 | 4.597 | 1.650 | 0.273 | 0.376 |
| Ler-1 | 0.430 | 0.606 | 1.284 | 5.649 | 3.467 | 3.877 | 1.510 | 0.305 | 0.394 |
| Mt-0 | 0.384 | 0.701 | 1.414 | 7.060 | 3.479 | 3.717 | 1.817 | 0.335 | 0.491 |
| Shakdara | 0.471 | 0.782 | 1.251 | 7.041 | 3.710 | 4.149 | 1.668 | 0.307 | 0.409 |

Table 46. Provided are the values of each of the parameters measured in *Arabidopsis* ecotypes: 6 = Vegetative growth rate (cm$^2$/day) until 8 true leaves; 3 = relative root growth (cm/day) (day 13); 2 = Root length day 7 (cm); 1 = Root length day 13 (cm); 4 = fresh weight per plant (gr) at bolting stage; 9. = Lamima length (cm); 8 = Lamina width (cm); 18 = Leaf width/length; 7 = Blade circularity.

Tables 47 and 48 provide the correlation analyses.

TABLE 47

Correlation between the expression level of selected Genes of some embodiments of the invention in various tissues and the phenotypic performance under normal or low nitrogen fertilization conditions across *Arabidopsis* accessions

| Gene Name | R | P value | Exp. set | Corr. Set ID | Gene Name | R | P value | Exp. set | Corr. Set ID |
|---|---|---|---|---|---|---|---|---|---|

Table 47. "Corr. Set ID"—correlation set ID according to the correlated parameters Table above.

TABLE 48

Correlation between the expression level of selected Orthologs genes of some embodiments of the invention in various tissues and the phenotypic performance under normal or low nitrogen fertilization conditions across *Arabidopsis* accessions

| Gene Name | R | P value | Exp. set | Corr. Set ID | Gene Name | R | P value | Exp. set | Corr. Set ID |
|---|---|---|---|---|---|---|---|---|---|

Table 48. "Corr. Set ID"—correlation set ID according to the correlated parameters Table above.

Example 8

Plant Fiber Development in Cotton Production of Cotton Transcriptom and High Throughput Correlation Analysis Using Cotton Oligonucleotide Microarray In order to conduct high throughput gene expression correlation analysis, the present inventors used cotton oligonucleotide microarray, designed and produced by "Comparative Evolutionary Genomics of Cotton" [Hypertext Transfer Protocol (http)://cottonevolution (dot) info/). This Cotton Oligonucleotide Microarray is composed of 12,006 Integrated DNA Technologies (IDT) oligonucleotides derived from an assembly of more than 180,000 *Gossypium* ESTs sequenced from 30 cDNA libraries. For additional details see PCT/IL2005/000627 and PCT/IL2007/001590 which are fully incorporated herein by reference.

TABLE 49

Cotton transcriptom experimental sets

| Expression Set | Set ID |
|---|---|
| cotton fiber 5d | A |
| cotton fiber 10d | B |

Table 49.

In order to define correlations between the levels of RNA expression and fiber length, fibers from 8 different cotton lines were analyzed. These fibers were selected showing very good fiber quality and high lint index (Pima types, originating from other cotton species, namely G. barbadense), different levels of quality and lint indexes from various G. hirsutum lines: good quality and high lint index (Acala type), and poor quality and short lint index (Tamcot type, and old varieties). A summary of the fiber length of the different lines is provided in Table 50.

Experimental Procedures

RNA extraction—Fiber development stages, representing different fiber characteristics, at 5, 10 and 15 DPA were sampled and RNA was extracted as described above.

Fiber length assessment—Fiber length of the selected cotton lines was measured using fibrograph. The fibrograph system was used to compute length in terms of "Upper Half Mean" length. The upper half mean (UHM) is the average length of longer half of the fiber distribution. The fibrograph measures length in span lengths at a given percentage point World Wide Web (dot) cottoninc (dot) com/Classificationof-Cotton/?Pg=4#Length].

Experimental Results

Eight different cotton lines were grown, and their fiber length was measured. The fibers UHM values are summarized in Table 50 hereinbelow. The R square was calculated for each of the genes.

TABLE 50

Summary of the fiber length of the 8 different cotton lines

| Cotton variety | Length (UHM) | |
| --- | --- | --- |
| | Mean | STD |
| SA 217 SD | 0.89 | 0.04 |
| SA 68 SD | 1.01 | 0.03 |
| Tamcot | 1.06 | 0.01 |
| DP 90 | 1.1 | 0.08 |
| ZG 236 | 1.15 | 0.00 |
| Coker 310 | 1.21 | 0.02 |
| S7 | 1.26 | 0.02 |
| Pima | 1.36 | 0.00 |

Table 50: Presented are the means and standard deviations (STD) of 8 different cotton lines.

TABLE 51

Correlation between the expression level of selected genes of some embodiments of the invention in various tissues and the phenotypic performance under normal conditions in cotton

| Gene Name | R | P value | Exp. set | Corr. Set ID | Gene Name | R | P value | Exp. set | Corr. Set ID |
| --- | --- | --- | --- | --- | --- | --- | --- | --- | --- |

Table 51. "Corr. Set ID"—correlation set refer to fiber length

TABLE 52

Correlation between the expression level of selected orthologs genes of some embodiments of the invention in various tissues and the phenotypic performance under normal conditions in cotton

| Gene Name | R | P value | Exp. Set | Corrl. Set ID | Gene Name | R | P value | Exp. Set | Corr. Set ID |
| --- | --- | --- | --- | --- | --- | --- | --- | --- | --- |

Table 52. "Corr. Set ID"—correlation set refer to fiber length

Example 9

Identification of Genes which Increase ABST, Growth Rate, Vigor, Yield, Biomass, Oil Content, WUE, NUE and/or FUE in Plants Based on the above described bioinformatics and experimental tools, the present inventors have identified 217 which exhibit a major impact on abiotic stress tolerance, plant yield, oil content, growth rate, vigor, biomass, growth rate, nitrogen use efficiency, water use efficiency and fertilizer use efficiency when expression thereof is increased in plants. The identified genes, their curated polynucleotide and polypeptide sequences, as well as their updated sequences according to GenBank database are summarized in Table 53, hereinbelow.

TABLE 53

Identified genes for increasing abiotic stress tolerance, water use efficiency, yield, growth rate, vigor, biomass, growth rate, oil content, nitrogen use efficiency and fertilizer use efficiency of a plant

| Gene Name | Cluster Name | Organism | Polynucl. SEQ ID NO: | Polypep. SEQ ID NO: |
| --- | --- | --- | --- | --- |
| LAB53 | barley\|gb157SOLEXA\|AF000939 | barley | 1 | 474 |
| LAB54 | barley\|gb157SOLEXA\|AF026538 | barley | 2 | 475 |

TABLE 53-continued

Identified genes for increasing abiotic stress tolerance, water use efficiency, yield,
growth rate, vigor, biomass, growth rate, oil content, nitrogen use efficiency and
fertilizer use efficiency of a plant

| Gene Name | Cluster Name | Organism | Polynucl. SEQ ID NO: | Polypep. SEQ ID NO: |
|---|---|---|---|---|
| LAB55 | barley\|gb157SOLEXA\|AJ477127 | barley | 3 | 476 |
| LAB56 | barley\|gb157SOLEXA\|AL504663 | barley | 4 | 477 |
| LAB58 | barley\|gb157SOLEXA\|BE420577 | barley | 5 | 478 |
| LAB64 | barley\|gb157SOLEXA\|BF624328 | barley | 6 | 479 |
| LAB65 | barley\|gb157SOLEXA\|BQ662625 | barley | 7 | 480 |
| LAB67 | brachypodium\|gb169\|BE414847 | *brachypodium* | 8 | 481 |
| LAB68 | brachypodium\|gb169\|BE415661 | *brachypodium* | 9 | 482 |
| LAB69 | brachypodium\|gb169\|BE418188 | *brachypodium* | 10 | 483 |
| LAB70 | canola\|gb161\|CD814191 | canola | 11 | 484 |
| LAB71 | cotton\|gb164\|BE052211 | cotton | 12 | 485 |
| LAB72 | cotton\|gb164\|CO132512 | cotton | 13 | 486 |
| LAB73 | grape\|gb160\|BM436750 | grape | 14 | 487 |
| LAB74 | grape\|gb160\|CB004439 | grape | 15 | 488 |
| LAB76 | grape\|gb160\|CB974118 | grape | 16 | 489 |
| LAB80 | rice\|gb170\|OS01G09620 | rice | 17 | 490 |
| LAB81 | rice\|gb170\|OS02G54780 | rice | 18 | 491 |
| LAB82 | rice\|gb170\|OS02G54890 | rice | 19 | 492 |
| LAB83 | rice\|gb170\|OS03G21640 | rice | 20 | 493 |
| LAB84 | rice\|gb170\|OS04G58810 | rice | 21 | 494 |
| LAB86 | rice\|gb170\|OS08G37660 | rice | 22 | 495 |
| LAB88 | rice\|gb170\|OS09G27820 | rice | 23 | 496 |
| LAB89 | rice\|gb170\|OS10G37760 | rice | 24 | 497 |
| LAB92 | sorghum\|gb161.crp\|AI724271 | *sorghum* | 25 | 498 |
| LAB93 | sorghum\|gb161.crp\|AI783065 | *sorghum* | 26 | 499 |
| LAB94 | sorghum\|gb161.crp\|AW282995 | *sorghum* | 27 | 500 |
| LAB97 | sorghum\|gb161.crp\|AW283405 | *sorghum* | 28 | 501 |
| LAB98 | sorghum\|gb161.crp\|AW285328 | *sorghum* | 29 | 502 |
| LAB101 | sorghum\|gb161.crp\|AW677797 | *sorghum* | 30 | 503 |
| LAB102 | sorghum\|gb161.crp\|AW679677 | *sorghum* | 31 | 504 |
| LAB106 | sorghum\|gb161.crp\|BE363251 | *sorghum* | 32 | 505 |
| LAB107 | sorghum\|gb161.crp\|BE366167 | *sorghum* | 33 | 506 |
| LAB108 | sorghum\|gb161.crp\|BE366746 | *sorghum* | 34 | 507 |
| LAB109 | sorghum\|gb161.crp\|BG047558 | *sorghum* | 35 | 508 |
| LAB110 | sorghum\|gb161.crp\|BM322761 | *sorghum* | 36 | 509 |
| LAB113 | tomato\|gb164\|AA824960 | tomato | 37 | 510 |
| LAB115 | tomato\|gb164\|AI488164 | tomato | 38 | 511 |
| LAB116 | tomato\|gb164\|AI637375 | tomato | 39 | 512 |
| LAB117 | tomato\|gb164\|AI772185 | tomato | 40 | 513 |
| LAB119 | tomato\|gb164\|AI772981 | tomato | 41 | 514 |
| LAB120 | tomato\|gb164\|AW218593 | tomato | 42 | 515 |
| LAB121 | tomato\|gb164\|AW223810 | tomato | 43 | 516 |
| LAB122 | tomato\|gb164\|AW442266 | tomato | 44 | 517 |
| LAB123 | tomato\|gb164\|AW442830 | tomato | 45 | 518 |
| LAB124 | tomato\|gb164\|BG123767 | tomato | 46 | 519 |
| LAB125 | tomato\|gb164\|BG124210 | tomato | 47 | 520 |
| LAB126 | tomato\|gb164\|BG126148 | tomato | 48 | 521 |
| LAB127 | tomato\|gb164\|BG127842 | tomato | 49 | 522 |
| LAB128 | tomato\|gb164\|BG128502 | tomato | 50 | 523 |
| LAB129 | tomato\|gb164\|BG129905 | tomato | 51 | 524 |
| LAB130 | tomato\|gb164\|BG133230 | tomato | 52 | 525 |
| LAB131 | tomato\|gb164\|BG626085 | tomato | 53 | 526 |
| LAB133 | tomato\|gb164\|BG629133 | tomato | 54 | 527 |
| LAB137 | wheat\|gb164\|BE416704 | wheat | 55 | 528 |
| LAB138 | wheat\|gb164\|BE426494 | wheat | 56 | 529 |
| LAB141 | wheat\|gb164\|BE591380 | wheat | 57 | 530 |
| LAB145 | rice\|gb170\|OS12G25090 | rice | 58 | 531 |
| LAB147 | rice\|gb170\|OS05G49940 | rice | 59 | 532 |
| LAB152 | sorghum\|gb161.crp\|AW746652 | *sorghum* | 60 | 533 |
| LAB153 | sorghum\|gb161.crp\|AW923691 | *sorghum* | 61 | 534 |
| LAB154 | sorghum\|gb161.crp\|AW923843 | *sorghum* | 62 | 535 |
| LAB156 | sorghum\|gb161.crp\|BG357440 | *sorghum* | 63 | 536 |
| LAB157 | sorghum\|gb161.crp\|BI075600 | *sorghum* | 64 | 537 |
| LAB158 | sorghum\|gb161.crp\|BI098554 | *sorghum* | 65 | 538 |
| LAB159 | sorghum\|gb161.crp\|BM317501 | *sorghum* | 66 | 539 |
| LAB160 | sorghum\|gb162.crp\|BM329994 | *sorghum* | 67 | 540 |
| LAB161 | sorghum\|gb161.crp\|BQ704124 | *sorghum* | 68 | 541 |
| LAB162 | sorghum\|gb161.crp\|CD949495 | *sorghum* | 69 | 542 |
| LAB163 | sorghum\|gb161.crp\|CF074481 | *sorghum* | 70 | 543 |
| LAB164 | sorghum\|gb161.crp\|CF430071 | *sorghum* | 71 | 544 |
| LAB165 | sorghum\|gb161.crp\|SBGWP119861 | *sorghum* | 72 | 545 |
| LAB166 | sorghum\|gb161.crp\|BG239954 | *sorghum* | 73 | 546 |
| LAB167 | sorghum\|gb161.crp\|AI724270 | *sorghum* | 74 | 547 |

TABLE 53-continued

Identified genes for increasing abiotic stress tolerance, water use efficiency, yield, growth rate, vigor, biomass, growth rate, oil content, nitrogen use efficiency and fertilizer use efficiency of a plant

| Gene Name | Cluster Name | Organism | Polynucl. SEQ ID NO: | Polypep. SEQ ID NO: |
|---|---|---|---|---|
| LAB169 | sorghum\|gb161.crp\|AW053133 | sorghum | 75 | 548 |
| LAB170 | sorghum\|gb161.crp\|AW065993 | sorghum | 76 | 549 |
| LAB171 | sorghum\|gb161.crp\|AW155674 | sorghum | 77 | 550 |
| LAB172 | sorghum\|gb161.crp\|AW453175 | sorghum | 78 | 551 |
| LAB174 | sorghum\|gb161.crp\|AW679828 | sorghum | 79 | 552 |
| LAB175 | sorghum\|gb161.crp\|AW745804 | sorghum | 80 | 553 |
| LAB176 | sorghum\|gb161.crp\|CD205409 | sorghum | 81 | 554 |
| LAB177 | sorghum\|gb161.crp\|CF431793 | sorghum | 82 | 555 |
| LAB178 | tomato\|gb164\|AI490504 | tomato | 83 | 556 |
| LAB179 | wheat\|gb164\|CV763774 | wheat | 84 | 557 |
| LAB181 | arabidopsis\|gb165\|AT1G30500 | arabidopsis | 85 | 558 |
| LAB182 | arabidopsis\|gb165\|AT1G54160 | arabidopsis | 86 | 559 |
| LAB183 | arabidopsis\|gb165\|AT2G17500 | arabidopsis | 87 | 560 |
| LAB185 | arabidopsis\|gb165\|AT2G28400 | arabidopsis | 88 | 561 |
| LAB186 | arabidopsis\|gb165\|AT2G42520 | arabidopsis | 89 | 562 |
| LAB187 | arabidopsis\|gb165\|AT3G11410 | arabidopsis | 90 | 563 |
| LAB188 | arabidopsis\|gb165\|AT3G44860 | arabidopsis | 91 | 564 |
| LAB189 | arabidopsis\|gb165\|AT3G58570 | arabidopsis | 92 | 565 |
| LAB190 | arabidopsis\|gb165\|AT5G39050 | arabidopsis | 93 | 566 |
| LAB191 | arabidopsis\|gb165\|AT5G47640 | arabidopsis | 94 | 567 |
| LAB193 | barley\|gb157SOLEXA\|AL500288 | barley | 95 | 568 |
| LAB195 | barley\|gb157SOLEXA\|AL502556 | barley | 96 | 569 |
| LAB197 | barley\|gb157SOLEXA\|AV832785 | barley | 97 | 570 |
| LAB204 | barley\|gb157SOLEXA\|BE411310 | barley | 98 | 571 |
| LAB206 | barley\|gb157SOLEXA\|BE420904 | barley | 99 | 572 |
| LAB207 | barley\|gb157SOLEXA\|BE421932 | barley | 100 | 573 |
| LAB210 | barley\|gb157SOLEXA\|BG365882 | barley | 101 | 574 |
| LAB211 | barley\|gb157SOLEXA\|BG368375 | barley | 102 | 575 |
| LAB212 | barley\|gb157SOLEXA\|BG418029 | barley | 103 | 576 |
| LAB213 | barley\|gb157SOLEXA\|BI949346 | barley | 104 | 577 |
| LAB217 | cotton\|gb164\|AI731250 | cotton | 105 | 578 |
| LAB218 | cotton\|gb164\|BG443778 | cotton | 106 | 579 |
| LAB220 | maize\|gb170\|AI615250 | maize | 107 | 580 |
| LAB221 | maize\|gb170\|AI622102 | maize | 108 | 581 |
| LAB222 | maize\|gb170\|CA400624 | maize | 109 | 582 |
| LAB224 | rice\|gb170\|OS01G14440 | rice | 110 | 583 |
| LAB225 | rice\|gb170\|OS01G52110 | rice | 111 | 584 |
| LAB228 | rice\|gb170\|OS01G68320 | rice | 112 | 585 |
| LAB229 | rice\|gb170\|OS01G68370 | rice | 113 | 586 |
| LAB230 | rice\|gb170\|OS01G68730 | rice | 114 | 587 |
| LAB231 | rice\|gb170\|OS01G68750 | rice | 115 | 588 |
| LAB232 | rice\|gb170\|OS01G68760 | rice | 116 | 589 |
| LAB233 | rice\|gb170\|OS01G68810 | rice | 117 | 590 |
| LAB234 | rice\|gb170\|OS01G68820 | rice | 118 | 591 |
| LAB235 | rice\|gb170\|OS01G68860 | rice | 119 | 592 |
| LAB236 | rice\|gb170\|OS02G08440 | rice | 120 | 593 |
| LAB237 | rice\|gb170\|OS02G32520 | rice | 121 | 594 |
| LAB238 | rice\|gb170\|OS02G51750 | rice | 122 | 595 |
| LAB240 | rice\|gb170\|OS03G04770 | rice | 123 | 596 |
| LAB241 | rice\|gb170\|OS03G05310 | rice | 124 | 597 |
| LAB242 | rice\|gb170\|OS03G15890 | rice | 125 | 598 |
| LAB243 | rice\|gb170\|OS03G49440 | rice | 126 | 599 |
| LAB247 | rice\|gb170\|OS05G27780 | rice | 127 | 600 |
| LAB249 | rice\|gb170\|OS05G46480 | rice | 128 | 601 |
| LAB250 | rice\|gb170\|OS05G51510 | rice | 129 | 602 |
| LAB252 | rice\|gb170\|OS08G35620 | rice | 130 | 603 |
| LAB253 | rice\|gb170\|OS09G15670 | rice | 131 | 604 |
| LAB254 | rice\|gb170\|OS09G31031 | rice | 132 | 605 |
| LAB255 | rice\|gb170\|OS09G31090T2 | rice | 133 | 606 |
| LAB258 | rice\|gb170\|OS09G31478 | rice | 134 | 607 |
| LAB259 | rice\|gb170\|OS09G31482 | rice | 135 | 608 |
| LAB260 | rice\|gb170\|OS10G11580 | rice | 136 | 609 |
| LAB261 | rice\|gb170\|OS10G28200 | rice | 137 | 610 |
| LAB262 | rice\|gb170\|OS10G35460 | rice | 138 | 611 |
| LAB263 | rice\|gb170\|OS10G36550 | rice | 139 | 612 |
| LAB264 | rice\|gb170\|OS10G37340 | rice | 140 | 613 |
| LAB265 | rice\|gb170\|OS12G41880 | rice | 141 | 614 |
| LAB267 | sorghum\|gb161.crp\|AF083327 | sorghum | 142 | 615 |
| LAB268 | sorghum\|gb161.crp\|AI391767 | sorghum | 143 | 616 |
| LAB269 | sorghum\|gb161.crp\|AI714721 | sorghum | 144 | 617 |
| LAB270 | sorghum\|gb161.crp\|AI834359 | sorghum | 145 | 618 |
| LAB271 | sorghum\|gb161.crp\|AI855376 | sorghum | 146 | 619 |

TABLE 53-continued

Identified genes for increasing abiotic stress tolerance, water use efficiency, yield, growth rate, vigor, biomass, growth rate, oil content, nitrogen use efficiency and fertilizer use efficiency of a plant

| Gene Name | Cluster Name | Organism | Polynucl. SEQ ID NO: | Polypep. SEQ ID NO: |
|---|---|---|---|---|
| LAB272 | sorghum\|gb161.crp\|AW067349 | sorghum | 147 | 620 |
| LAB274 | sorghum\|gb161.crp\|AW283715 | sorghum | 148 | 621 |
| LAB275 | sorghum\|gb161.crp\|AW287164 | sorghum | 149 | 622 |
| LAB276 | sorghum\|gb161.crp\|AW676813 | sorghum | 150 | 623 |
| LAB277 | sorghum\|gb161.crp\|AW677021 | sorghum | 151 | 624 |
| LAB278 | sorghum\|gb161.crp\|AW678652 | sorghum | 152 | 625 |
| LAB279 | sorghum\|gb161.crp\|AW745740 | sorghum | 153 | 626 |
| LAB280 | sorghum\|gb161.crp\|AW924546 | sorghum | 154 | 627 |
| LAB281 | sorghum\|gb161.crp\|AW924680 | sorghum | 155 | 628 |
| LAB282 | sorghum\|gb161.crp\|BE126094 | sorghum | 156 | 629 |
| LAB283 | sorghum\|gb161.crp\|BE363639 | sorghum | 157 | 630 |
| LAB284 | sorghum\|gb161.crp\|BE366498 | sorghum | 158 | 631 |
| LAB286 | sorghum\|gb161.crp\|BE599941 | sorghum | 159 | 632 |
| LAB289 | sorghum\|gb161.crp\|BG050539 | sorghum | 160 | 633 |
| LAB290 | sorghum\|gb161.crp\|BG050987 | sorghum | 161 | 634 |
| LAB292 | sorghum\|gb161.crp\|BG051832 | sorghum | 162 | 635 |
| LAB293 | sorghum\|gb161.crp\|BG104129 | sorghum | 163 | 636 |
| LAB294 | sorghum\|gb161.crp\|BG158316 | sorghum | 164 | 637 |
| LAB295 | sorghum\|gb161.crp\|BG558012 | sorghum | 165 | 638 |
| LAB296 | sorghum\|gb161.crp\|BM259168 | sorghum | 166 | 639 |
| LAB297 | sorghum\|gb161.crp\|BM417007 | sorghum | 167 | 640 |
| LAB298 | sorghum\|gb161.crp\|BM737392 | sorghum | 168 | 641 |
| LAB299 | sorghum\|gb161.crp\|CB924966 | sorghum | 169 | 642 |
| LAB300 | sorghum\|gb161.crp\|CD220284 | sorghum | 170 | 643 |
| LAB302 | sorghum\|gb161.crp\|CD233103 | sorghum | 171 | 644 |
| LAB303 | sorghum\|gb161.crp\|CD233331 | sorghum | 172 | 645 |
| LAB304 | sorghum\|gb161.crp\|EB406896 | sorghum | 173 | 646 |
| LAB306 | soybean\|gb168\|AW684299 | soybean | 174 | 647 |
| LAB307 | soybean\|gb168\|BE822951 | soybean | 175 | 648 |
| LAB308 | soybean\|gb168\|BF633506 | soybean | 176 | 649 |
| LAB309 | soybean\|gb168\|BF637946 | soybean | 177 | 650 |
| LAB310 | soybean\|gb168\|BM521769 | soybean | 178 | 651 |
| LAB311 | sunflower\|gb162\|DY950975 | sunflower | 179 | 652 |
| LAB312 | tomato\|gb164\|AF079231 | tomato | 180 | 653 |
| LAB314 | tomato\|gb164\|AI485630 | tomato | 181 | 654 |
| LAB315 | tomato\|gb164\|AI487529 | tomato | 182 | 655 |
| LAB316 | tomato\|gb164\|AI773156 | tomato | 183 | 656 |
| LAB317 | tomato\|gb164\|AI773737 | tomato | 184 | 657 |
| LAB318 | tomato\|gb164\|AI899075 | tomato | 185 | 658 |
| LAB319 | tomato\|gb164\|AW032666 | tomato | 186 | 659 |
| LAB320 | tomato\|gb164\|AW979674 | tomato | 187 | 660 |
| LAB323 | tomato\|gb164\|BG132099 | tomato | 188 | 661 |
| LAB324 | tomato\|gb164\|BG628155 | tomato | 189 | 662 |
| LAB325 | tomato\|gb164\|BG630481 | tomato | 190 | 663 |
| LAB326 | tomato\|gb164\|BG642701 | tomato | 191 | 664 |
| LAB327 | tomato\|gb164\|BP889760 | tomato | 192 | 665 |
| LAB329 | tomato\|gb164\|X51904 | tomato | 193 | 666 |
| LAB335 | wheat\|gb164\|BE488670 | wheat | 194 | 667 |
| LAB336 | wheat\|gb164\|BE490582 | wheat | 195 | 668 |
| LAB337 | wheat\|gb164\|BE498413 | wheat | 196 | 669 |
| LAB339 | wheat\|gb164\|BE604530 | wheat | 197 | 670 |
| LAB340 | wheat\|gb164\|BF478640 | wheat | 198 | 671 |
| LAB342 | brachypodium\|gb169\|BE404202 | brachypodium | 199 | 672 |
| LAB343 | canola\|gb161\|CX187805 | canola | 200 | 673 |
| LAB344 | maize\|gb170\|AI665177 | maize | 201 | 674 |
| LAB345 | rice\|gb170\|OS02G48730 | rice | 202 | 675 |
| LAB346 | rice\|gb170\|OS06G18000 | rice | 203 | 676 |
| LAB347 | sorghum\|gb161.crp\|BG239839 | sorghum | 204 | 677 |
| LAB348 | sorghum\|gb161.crp\|EB407478 | sorghum | 205 | 678 |
| LAB349 | soybean\|gb168\|BE820344 | soybean | 206 | 679 |
| LAB351 | switchgrass\|gb167\|DN148583 | switchgrass | 207 | 680 |
| LAB352 | wheat\|gb164\|BE604638 | wheat | 208 | 681 |
| LAB353 | wheat\|gb164\|BF428610 | wheat | 209 | 682 |
| LAB355 | brachypodium\|gb169\|BF473402 | brachypodium | 210 | 683 |
| LAB367 | canola\|gb161\|CN726397 | canola | 211 | 684 |
| LAB381 | poplar\|gb170\|CV256220 | poplar | 212 | 685 |
| LAB383 | soybean\|gb168\|CA850722 | soybean | 213 | 686 |
| LAB276_H0 | maize\|gb170\|BG321080 | maize | 214 | 687 |
| LAB290_H0 | maize\|gb170\|AI665410 | maize | 215 | 688 |
| LAB347_H0 | maize\|gb170\|BM381583 | maize | 216 | 689 |
| LAB291 | sorghum\|gb161.crp\|BG051306 | sorghum | 217 | — |
| LAB109 | sorghum\|gb161.crp\|BG047558 | sorghum | 35 | 699 |

TABLE 53-continued

Identified genes for increasing abiotic stress tolerance, water use efficiency, yield, growth rate, vigor, biomass, growth rate, oil content, nitrogen use efficiency and fertilizer use efficiency of a plant

| Gene Name | Cluster Name | Organism | Polynucl. SEQ ID NO: | Polypep. SEQ ID NO: |
|---|---|---|---|---|
| LAB55 | barley\|gb157SOLEXA\|AJ477127 | barley | 218 | 690 |
| LAB64 | barley\|gb157SOLEXA\|BF624328 | barley | 219 | 691 |
| LAB64 | barley\|gb157SOLEXA\|BF624328 | barley | 220 | 692 |
| LAB65 | barley\|gb157SOLEXA\|BQ662625 | barley | 221 | 693 |
| LAB67 | brachypodium\|gb169\|BE414847 | *brachypodium* | 222 | 481 |
| LAB68 | brachypodium\|gb169\|BE415661 | *brachypodium* | 223 | 482 |
| LAB69 | brachypodium\|gb169\|BE418188 | *brachypodium* | 224 | 483 |
| LAB72 | cotton\|gb164\|CO132512 | cotton | 225 | 694 |
| LAB83 | rice\|gb170\|OS03G21640 | rice | 226 | 493 |
| LAB89 | rice\|gb170\|OS10G37760 | rice | 227 | 695 |
| LAB92 | sorghum\|gb161.crp\|AI724271 | *sorghum* | 228 | 498 |
| LAB97 | sorghum\|gb161.crp\|AW283405 | *sorghum* | 229 | 696 |
| LAB97 | sorghum\|gb161.crp\|AW283405 | *sorghum* | 230 | 697 |
| LAB106 | sorghum\|gb161.crp\|BE363251 | *sorghum* | 231 | 698 |
| LAB110 | sorghum\|gb161.crp\|BM322761 | *sorghum* | 232 | 509 |
| LAB120 | tomato\|gb164\|AW218593 | tomato | 233 | 700 |
| LAB125 | tomato\|gb164\|BG124210 | tomato | 234 | 701 |
| LAB133 | tomato\|gb164\|BG629133 | tomato | 235 | 702 |
| LAB158 | sorghum\|gb161.crp\|BI098554 | *sorghum* | 236 | 703 |
| LAB160 | sorghum\|gb161.crp\|BM329994 | *sorghum* | 237 | 704 |
| LAB161 | sorghum\|gb161.crp\|BQ704124 | *sorghum* | 238 | 705 |
| LAB162 | sorghum\|gb161.crp\|CD949495 | *sorghum* | 239 | 542 |
| LAB165 | sorghum\|gb161.crp\|SBGWP119861 | *sorghum* | 240 | 706 |
| LAB177 | sorghum\|gb161.crp\|CF431793 | *sorghum* | 241 | 707 |
| LAB178 | tomato\|gb164\|AI490504 | tomato | 242 | 556 |
| LAB179 | wheat\|gb164\|CV763774 | wheat | 243 | 708 |
| LAB193 | barley\|gb157SOLEXA\|AL500288 | barley | 244 | 709 |
| LAB193 | barley\|gb157SOLEXA\|AL500288 | barley | 245 | 568 |
| LAB207 | barley\|gb157SOLEXA\|BE421932 | barley | 246 | 573 |
| LAB218 | cotton\|gb164\|BG443778 | cotton | 247 | 710 |
| LAB221 | maize\|gb170\|AI622102 | maize | 248 | 711 |
| LAB222 | maize\|gb170\|CA400624 | maize | 249 | 712 |
| LAB224 | rice\|gb170\|OS01G14440 | rice | 250 | 583 |
| LAB274 | sorghum\|gb161.crp\|AW283715 | *sorghum* | 251 | 713 |
| LAB280 | sorghum\|gb161.crp\|AW924546 | *sorghum* | 252 | 714 |
| LAB293 | sorghum\|gb161.crp\|BG104129 | *sorghum* | 253 | 715 |
| LAB293 | sorghum\|gb161.crp\|BG104129 | *sorghum* | 254 | 716 |
| LAB295 | sorghum\|gb161.crp\|BG558012 | *sorghum* | 255 | 717 |
| LAB297 | sorghum\|gb161.crp\|BM417007 | *sorghum* | 256 | 718 |
| LAB298 | sorghum\|gb161.crp\|BM737392 | *sorghum* | 257 | 641 |
| LAB300 | sorghum\|gb161.crp\|CD220284 | *sorghum* | 258 | 719 |
| LAB303 | sorghum\|gb161.crp\|CD233331 | *sorghum* | 259 | 720 |
| LAB311 | sunflower\|gb162\|DY950975 | sunflower | 260 | 721 |
| LAB314 | tomato\|gb164\|AI485630 | tomato | 261 | 722 |
| LAB316 | tomato\|gb164\|AI773156 | tomato | 262 | 723 |
| LAB320 | tomato\|gb164\|AW979674 | tomato | 263 | 724 |
| LAB323 | tomato\|gb164\|BG132099 | tomato | 264 | 725 |
| LAB326 | tomato\|gb164\|BG642701 | tomato | 265 | 726 |
| LAB327 | tomato\|gb164\|BP889760 | tomato | 266 | 727 |
| LAB348 | sorghum\|gb161.crp\|EB407478 | *sorghum* | 267 | 728 |
| LAB349 | soybean\|gb168\|BE820344 | soybean | 268 | 729 |
| LAB381 | poplar\|gb170\|CV256220 | poplar | 269 | 730 |
| LAB276_H0 | maize\|gb170\|BG321080 | maize | 270 | 687 |
| LAB290_H0 | maize\|gb170\|AI665410 | maize | 271 | 688 |
| LAB347_H0 | maize\|gb170\|BM381583 | maize | 272 | 731 |
| LAB176 | sorghum\|gb161.crp\|CD205409 | *sorghum* | 273 | — |
| LAB291 | sorghum\|gb161.crp\|BG051306 | *sorghum* | 274 | — |

Table 53. Provided are the identified genes which expression thereof in plants increases abiotic stress tolerance, water use efficiency, yield, growth rate, vigor, biomass, growth rate, oil content, nitrogen use efficiency and fertilizer use efficiency of a plant.
"Polynucl."—polynucleotide;
"Polypep."—polypeptide.

Example 10

Identification of Homologues which Affect ABST, WUE, Yield, Growth Rate, Vigor, Biomass, Oil Content, NUE and/or FUE of a Plant The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To further investigate and identify putative ortholog genes of the genes affecting ABST, WUE, yield (e.g., seed yield, oil yield, biomass, grain quantity and/or quality), oil content, growth rate, vigor, NUE and FUE (presented in Table 53, Example 9 above), all sequences were aligned using the BLAST (/Basic Local Alignment Search Tool/). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing to construct a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

Methods for searching and identifying homologues of yield and improved agronomic traits such as ABS tolerance and FUE related polypeptides or polynucleotides are well within the realm of the skilled artisan. The search and identification of homologous genes involves the screening of sequence information available, for example, in public databases, which include but are not limited to the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (orthologue) or a family of similar genes and those genes will provide the same preferred phenotype as the genes presented here. Advantageously, these family members may be useful in the methods of the invention. Example of other plants are included here but not limited to, barley (*Hordeum vulgare*), Arabidopsis (*Arabidopsis thaliana*), maize (*Zea mays*), cotton (Gossypium), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*), Wheat (*Triticum aestivum*)

The above-mentioned analyses for sequence homology is preferably carried out on a full-length sequence, but may also be based on a comparison of certain regions such as conserved domains. The identification of such domains would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (Hypertext Transfer Protocol://World Wide Web (dot) biochem (dot) ucl (dot) ac (dot) uk/bsm/dbbrowser/protocol/prodomqry (dot) html), PR (Hypertext Transfer Protocol://pir (dot) Georgetown (dot) edu/) or Pfam (Hypertext Transfer Protocol:// World Wide Web (dot) sanger (dot) ac (dot) uk/Software/ Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes and polypeptides described in Table 53 above have been identified from the databases using BLAST software using the Blastp and tBlastn algorithms. The query nucleotide and polypeptide sequences are described in Table 53 above (polynucleotide SEQ ID NOs: 1-217, and 218-274; polypeptide SEQ ID NOs:474-689, and 690-731) and the identified homologues are provided in Table 54, below.

TABLE 54

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 783 | LAB53 | brachypodium\|09v1\|TMPLAF000939T1 | 5510 | 474 | 95 | globlastp |
| 784 | LAB53 | leymus\|gb166\|EG375693 | 5511 | 474 | 95 | globlastp |
| 785 | LAB53 | wheat\|gb164\|BE517987 | 5512 | 474 | 94.2 | globlastp |
| 786 | LAB53 | wheat\|gb164\|BE415276 | 5513 | 474 | 93.3 | globlastp |
| 787 | LAB53 | pseudoroegneria\|gb167\|FF342766 | 5514 | 474 | 91.3 | globlastp |
| 788 | LAB53 | oat\|10v1\|GO594607 | 5515 | 474 | 82.1 | globlastp |
| 789 | LAB54 | pseudoroegneria\|gb167\|FF342146 | 5516 | 475 | 82 | globlastp |
| 790 | LAB54 | wheat\|gb164\|BE428598 | 5517 | 475 | 81.1 | globlastp |
| 791 | LAB54 | wheat\|gb164\|BE428634 | 5518 | 475 | 80.1 | globlastp |
| 792 | LAB55 | wheat\|gb164\|BE499218 | 5519 | 476 | 94.3 | globlastp |
| 793 | LAB55 | wheat\|gb164\|BE415921 | 5520 | 476 | 93.9 | globlastp |
| 794 | LAB55 | brachypodium\|09v1\|DV476207 | 5521 | 476 | 89 | globlastp |
| 795 | LAB55 | brachypodium\|gb169\|BE500339 | 5521 | 476 | 89 | globlastp |
| 796 | LAB55 | cenchrus\|gb166\|EB653436 | 5522 | 476 | 84.2 | globlastp |
| 797 | LAB55 | switchgrass\|gb167\|FE647153 | 5523 | 476 | 82.9 | globlastp |
| 798 | LAB55 | rice\|gb170\|OS10G33250 | 5524 | 476 | 82.6 | globlastp |
| 799 | LAB55 | sorghum\|gb161.crp\|BG051887 | 5525 | 476 | 82.6 | globlastp |
| 800 | LAB55 | maize\|gb170\|AW313258 | 5526 | 476 | 81.9 | globlastp |
| 801 | LAB55 | switchgrass\|gb167\|DN151704 | 5527 | 476 | 81.1 | globlastp |
| 802 | LAB55 | brachypodium\|gb169\|BF485087 | 5528 | 476 | 81 | globlastp |
| 803 | LAB56 | wheat\|gb164\|AF022915 | 5529 | 477 | 97.7 | globlastp |
| 804 | LAB56 | brachypodium\|09v1\|DV471918 | 5530 | 477 | 94.1 | globlastp |
| 805 | LAB56 | brachypodium\|gb169\|AF022915 | 5530 | 477 | 94.1 | globlastp |
| 806 | LAB56 | sorghum\|09v1\|SB09G023310 | 5531 | 477 | 91.6 | globlastp |
| 807 | LAB56 | sorghum\|gb161.crp\|AW037050 | 5531 | 477 | 91.6 | globlastp |
| 808 | LAB56 | rice\|gb170\|OS05G39770 | 5532 | 477 | 91 | globlastp |
| 809 | LAB56 | maize\|gb170\|AI711957 | 5533 | 477 | 90.8 | globlastp |
| 810 | LAB56 | switchgrass\|gb167\|DN141956 | 5534 | 477 | 89.6 | globlastp |
| 811 | LAB56 | maize\|gb170\|AI795602 | 5535 | 477 | 88.3 | globlastp |
| 812 | LAB58 | wheat\|gb164\|BE411978 | 5536 | 478 | 99.2 | globlastp |
| 813 | LAB58 | wheat\|gb164\|BE419135 | 5537 | 478 | 98.5 | globlastp |
| 814 | LAB58 | pseudoroegneria\|gb167\|FF342690 | 5538 | 478 | 97.7 | globlastp |
| 815 | LAB58 | leymus\|gb166\|EG386152 | 5539 | 478 | 97.3 | globlastp |
| 816 | LAB58 | leymus\|gb166\|EG393155 | 5540 | 478 | 95.5 | globlastp |
| 817 | LAB58 | rice\|gb170\|OS04G58280 | 5541 | 478 | 85.2 | globlastp |
| 818 | LAB58 | switchgrass\|gb167\|DN150075 | 5542 | 478 | 83.5 | globlastp |
| 819 | LAB58 | switchgrass\|gb167\|DN150641 | 5543 | 478 | 83 | globlastp |
| 820 | LAB58 | sugarcane\|gb157.3\|CA067894 | 5544 | 478 | 81.1 | globlastp |
| 821 | LAB58 | sugarcane\|gb157.3\|CA131680 | 5545 | 478 | 80.7 | globlastp |
| 822 | LAB58 | sugarcane\|gb157.3\|CA067846 | 5546 | 478 | 80.2 | globlastp |
| 823 | LAB67 | oat\|10v1\|GR325144 | 5547 | 481 | 82.3 | globlastp |
| 824 | LAB69 | lolium\|10v1\|AU246926 | 5548 | 483 | 92.3 | globlastp |
| 825 | LAB69 | oat\|10v1\|GR318171 | 5549 | 483 | 91.2 | globlastp |
| 826 | LAB69 | oat\|10v1\|GR313573 | 5550 | 483 | 90.6 | globlastp |
| 827 | LAB69 | barley\|10v1\|BE437673 | 5551 | 483 | 89 | globlastp |
| 828 | LAB69 | barley\|gb157SOLEXA\|BE437673 | 5551 | 483 | 89 | globlastp |
| 829 | LAB69 | wheat\|gb164\|CA684829 | 5552 | 483 | 89 | globlastp |
| 830 | LAB69 | leymus\|gb166\|EG380193 | 5553 | 483 | 88.5 | globlastp |
| 831 | LAB69 | wheat\|gb164\|BE418188 | 5554 | 483 | 87.9 | globlastp |
| 832 | LAB69 | wheat\|gb164\|BF478406 | 5555 | 483 | 87.9 | globlastp |
| 833 | LAB69 | rice\|gb170\|OS01G60830 | 5556 | 483 | 80.2 | globlastp |
| 834 | LAB70 | b_rapa\|gb162\|CV544933 | 484 | 484 | 100 | globlastp |
| 835 | LAB70 | b_oleracea\|gb161\|AM386651 | 5557 | 484 | 97.3 | globlastp |
| 836 | LAB70 | canola\|gb161\|CD826649 | 5557 | 484 | 97.3 | globlastp |
| 837 | LAB70 | arabidopsis\|gb165\|AT2G32150 | 5558 | 484 | 89.7 | globlastp |
| 838 | LAB70 | arabidopsis_lyrata\|09v1\|JGIAL014318 | 5559 | 484 | 89 | globlastp |
| 839 | LAB70 | radish\|gb164\|EV550109 | 5560 | 484 | 88.51 | glotblastn |
| 840 | LAB76 | cassava\|09v1\|DV447303 | 5561 | 489 | 81.57 | glotblastn |
| 840 | LAB72 | cassava\|09v1\|DV447303 | 5561 | 694 | 81.25 | glotblastn |
| 841 | LAB80 | switchgrass\|gb167\|FE606158 | 5562 | 490 | 81.7 | globlastp |
| 841 | LAB92 | switchgrass\|gb167\|FE606158 | 5562 | 498 | 85.5 | globlastp |
| 842 | LAB80 | barley\|gb157SOLEXA\|BE438039 | 5563 | 490 | 81.3 | globlastp |
| 843 | LAB80 | barley\|10v1\|BE438039 | 5563 | 490 | 81.3 | globlastp |
| 844 | LAB81 | brachypodium\|09v1\|DV488004 | 5564 | 491 | 86.7 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 845 | LAB81 | brachypodium\|gb169\|BE421729 | 5564 | 491 | 86.7 | globlastp |
| 846 | LAB81 | sorghum\|09v1\|SB04G035550 | 5565 | 491 | 86.3 | globlastp |
| 847 | LAB81 | sorghum\|gb161.crp\|BG411926 | 5565 | 491 | 86.3 | globlastp |
| 848 | LAB81 | maize\|gb170\|BM266787 | 5566 | 491 | 85.6 | globlastp |
| 849 | LAB81 | oat\|10v1\|GR336389 | 5567 | 491 | 84.7 | globlastp |
| 850 | LAB82 | switchgrass\|gb167\|DN145536 | 5568 | 492 | 96.34 | glotblastn |
| 851 | LAB82 | sorghum\|09v1\|SB04G035630 | 5569 | 492 | 95.9 | globlastp |
| 852 | LAB82 | sorghum\|gb161.crp\|AW360697 | 5569 | 492 | 95.9 | globlastp |
| 853 | LAB82 | maize\|gb170\|AI619207 | 5570 | 492 | 95.7 | globlastp |
| 854 | LAB82 | maize\|gb170\|BM380723 | 5571 | 492 | 95.2 | globlastp |
| 855 | LAB82 | brachypodium\|09v1\|GT811044 | 5572 | 492 | 94.8 | globlastp |
| 856 | LAB82 | brachypodium\|gb169\|BE425568 | 5572 | 492 | 94.8 | globlastp |
| 857 | LAB82 | oat\|10v1\|GR316374 | 5573 | 492 | 94.52 | glotblastn |
| 858 | LAB82 | wheat\|gb164\|BE425568 | 5574 | 492 | 93.2 | globlastp |
| 859 | LAB82 | barley\|10v1\|BQ757459 | 5575 | 492 | 90.8 | globlastp |
| 860 | LAB82 | barley\|gb157SOLEXA\|AV834539 | 5576 | 492 | 90.4 | globlastp |
| 861 | LAB82 | brachypodium\|09v1\|BRADI1G47000 | 5577 | 492 | 89.3 | globlastp |
| 862 | LAB82 | maize\|gb170\|BQ528947 | 5578 | 492 | 88.4 | globlastp |
| 863 | LAB82 | sorghum\|gb161.crp\|BQ528947 | 5579 | 492 | 87.7 | globlastp |
| 864 | LAB82 | sorghum\|09v1\|SB10G005920 | 5580 | 492 | 87.5 | globlastp |
| 865 | LAB82 | brachypodium\|gb169\|CRPBD005242 | 5581 | 492 | 85.2 | globlastp |
| 866 | LAB82 | sorghum\|09v1\|TMPLBM380723T1 | 5582 | 492 | 84.7 | globlastp |
| 867 | LAB82 | apple\|gb171\|CN495624 | 5583 | 492 | 84.1 | globlastp |
| 868 | LAB82 | castorbean\|09v1\|EE256668 | 5584 | 492 | 84.1 | globlastp |
| 869 | LAB82 | castorbean\|gb160\|EE256668 | 5585 | 492 | 83.8 | globlastp |
| 870 | LAB82 | chestnut\|gb170\|SRR006295S0005865 | 5586 | 492 | 83.3 | globlastp |
| 871 | LAB82 | melon\|gb165\|AM716067 | 5587 | 492 | 83.1 | globlastp |
| 872 | LAB82 | cucumber\|09v1\|AM716067 | 5588 | 492 | 82.9 | globlastp |
| 873 | LAB82 | bean\|gb167\|CV532271 | 5589 | 492 | 82.6 | globlastp |
| 874 | LAB82 | oak\|gb170\|DB996638 | 5590 | 492 | 82.6 | globlastp |
| 875 | LAB82 | cassava\|09v1\|CK649453 | 5591 | 492 | 82.2 | globlastp |
| 876 | LAB82 | citrus\|gb166\|BQ624759 | 5592 | 492 | 82 | globlastp |
| 877 | LAB82 | lotus\|09v1\|BI417308 | 5593 | 492 | 82 | globlastp |
| 878 | LAB82 | lotus\|gb157.2\|BI417308 | 5593 | 492 | 82 | globlastp |
| 879 | LAB82 | maize\|gb170\|AW498313 | 5594 | 492 | 82 | globlastp |
| 880 | LAB82 | poplar\|10v1\|BI125519 | 5595 | 492 | 82 | globlastp |
| 881 | LAB82 | poplar\|gb170\|BI125519 | 5595 | 492 | 82 | globlastp |
| 882 | LAB82 | soybean\|gb168\|AW351046 | 5596 | 492 | 82 | globlastp |
| 883 | LAB82 | soybean\|gb168\|BE821006 | 5597 | 492 | 81.5 | globlastp |
| 884 | LAB82 | cassava\|gb164\|CK649453 | 5598 | 492 | 81.3 | globlastp |
| 885 | LAB82 | cotton\|gb164\|AI726355 | 5599 | 492 | 81.3 | globlastp |
| 886 | LAB82 | poplar\|10v1\|BI139040 | 5600 | 492 | 81.3 | globlastp |
| 887 | LAB82 | poplar\|gb170\|BI139040 | 5600 | 492 | 81.3 | globlastp |
| 888 | LAB82 | chickpea\|09v2\|FE668469 | 5601 | 492 | 81.28 | glotblastn |
| 889 | LAB82 | arabidopsis_lyrata\|09v1\|JGIAL025004 | 5602 | 492 | 81.1 | globlastp |
| 890 | LAB82 | arabidopsis\|gb165\|AT4G30440 | 5602 | 492 | 81.1 | globlastp |
| 891 | LAB82 | aquilegia\|10v1\|DR925021 | 5603 | 492 | 81 | globlastp |
| 892 | LAB82 | rice\|gb170\|OS06G08810 | 5604 | 492 | 81 | globlastp |
| 893 | LAB82 | strawberry\|gb164\|C0817269 | 5605 | 492 | 81 | globlastp |
| 894 | LAB82 | solanum_phureja\|09v1\|SPHBG137061 | 5606 | 492 | 80.4 | globlastp |
| 895 | LAB82 | spurge\|gb161\|DV120331 | 5607 | 492 | 80.4 | globlastp |
| 896 | LAB82 | nasturtium\|10v1\|SRR032558S0298847 | 5608 | 492 | 80.32 | glotblastn |
| 897 | LAB82 | potato\|10v1\|BG597853 | 5609 | 492 | 80.32 | glotblastn |
| 898 | LAB82 | potato\|gb157.2\|BI176457 | 5609 | 492 | 80.32 | glotblastn |
| 899 | LAB82 | canola\|10v1\|EE419654 | 5610 | 492 | 80.2 | globlastp |
| 900 | LAB82 | canola\|10v1\|DY023561 | 5611 | 492 | 80 | globlastp |
| 901 | LAB82 | canola\|gb161\|DY023561 | 5611 | 492 | 80 | globlastp |
| 902 | LAB82 | canola\|gb161\|EE419654 | 5612 | 492 | 80 | globlastp |
| 903 | LAB88 | rice\|gb170\|OS09G27750 | 5613 | 496 | 93.2 | globlastp |
| 904 | LAB88 | sugarcane\|10v1\|BQ533005 | 5614 | 496 | 86.7 | globlastp |
| 905 | LAB88 | maize\|gb170\|BE639051 | 5615 | 496 | 86.2 | globlastp |
| 906 | LAB88 | sugarcane\|gb157.3\|BQ533005 | 5616 | 496 | 86.1 | globlastp |
| 907 | LAB88 | cenchrus\|gb166\|EB653325 | 5617 | 496 | 86 | globlastp |
| 908 | LAB88 | switchgrass\|gb167\|FE647922 | 5618 | 496 | 85.8 | globlastp |
| 909 | LAB88 | switchgrass\|gb167\|FL702178 | 5619 | 496 | 85.54 | glotblastn |
| 910 | LAB88 | barley\|10v1\|BG300899 | 5620 | 496 | 84.3 | globlastp |
| 911 | LAB88 | barley\|gb157SOLEXA\|BG300899 | 5620 | 496 | 84.3 | globlastp |
| 912 | LAB88 | brachypodium\|09v1\|DV475195 | 5621 | 496 | 83.6 | globlastp |
| 913 | LAB88 | wheat\|gb164\|BE516906 | 5622 | 496 | 83.2 | globlastp |
| 914 | LAB88 | leymus\|gb166\|EG374982 | 5623 | 496 | 83 | globlastp |
| 915 | LAB88 | switchgrass\|gb167\|FL692984 | 5624 | 496 | 82.93 | glotblastn |
| 916 | LAB88 | wheat\|gb164\|AL823095 | 5625 | 496 | 82.9 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 917 | LAB88 | wheat\|gb164\|BE498656 | 5626 | 496 | 82.9 | globlastp |
| 918 | LAB88 | brachypodium\|gb169\|BE425783 | 5627 | 496 | 82.72 | glotblastn |
| 919 | LAB88 | sorghum\|09v1\|SB02G026280 | 5628 | 496 | 81.7 | globlastp |
| 920 | LAB88 | sorghum\|gb161.crp\|AW677026 | 5628 | 496 | 81.7 | globlastp |
| 921 | LAB89 | sorghum\|09v1\|SB01G031210 | 5629 | 497 | 84.1 | globlastp |
| 922 | LAB89 | maize\|gb170\|AI745764 | 5630 | 497 | 82.8 | globlastp |
| 923 | LAB89 | switchgrass\|gb167\|DW177254 | 5631 | 497 | 80.7 | globlastp |
| 924 | LAB92 | maize\|gb170\|BE056189 | 5632 | 498 | 86.9 | globlastp |
| 925 | LAB92 | maize\|gb170\|AW054623 | 5633 | 498 | 84.21 | glotblastn |
| 926 | LAB92 | cenchrus\|gb166\|BM084651 | 5634 | 498 | 82.2 | globlastp |
| 927 | LAB93 | sugarcane\|10v1\|CA088623 | 5635 | 499 | 96 | globlastp |
| 928 | LAB93 | sugarcane\|gb157.3\|BQ536470 | 5636 | 499 | 95.7 | globlastp |
| 929 | LAB93 | switchgrass\|gb167\|FE618012 | 5637 | 499 | 87.7 | globlastp |
| 930 | LAB93 | maize\|gb170\|AI783065 | 5638 | 499 | 85.9 | globlastp |
| 931 | LAB93 | rice\|gb170\|OS03G02530 | 5639 | 499 | 82 | globlastp |
| 932 | LAB93 | brachypodium\|09v1\|DV469218 | 5640 | 499 | 80.2 | globlastp |
| 933 | LAB94 | sugarcane\|10v1\|CA078203 | 5641 | 500 | 98.9 | globlastp |
| 934 | LAB94 | sugarcane\|gb157.3\|CA078203 | 5642 | 500 | 98.9 | globlastp |
| 935 | LAB94 | maize\|gb170\|AW216139 | 5643 | 500 | 97.2 | globlastp |
| 936 | LAB94 | switchgrass\|gb167\|DN143081 | 5644 | 500 | 97.2 | globlastp |
| 937 | LAB94 | maize\|gb170\|BG842835 | 5645 | 500 | 96.1 | globlastp |
| 938 | LAB94 | switchgrass\|gb167\|FE624707 | 5646 | 500 | 95.73 | glotblastn |
| 939 | LAB94 | cenchrus\|gb166\|EB655101 | 5647 | 500 | 94.7 | globlastp |
| 940 | LAB94 | rice\|gb170\|OS03G16670 | 5648 | 500 | 88.7 | globlastp |
| 941 | LAB94 | brachypodium\|09v1\|DV472385 | 5649 | 500 | 87.9 | globlastp |
| 942 | LAB94 | brachypodium\|gb169\|BE421885 | 5649 | 500 | 87.9 | globlastp |
| 943 | LAB94 | barley\|10v1\|BE193799 | 5650 | 500 | 87.6 | globlastp |
| 944 | LAB94 | barley\|gb157SOLEXA\|BE421885 | 5650 | 500 | 87.6 | globlastp |
| 945 | LAB94 | oat\|10v1\|GO586906 | 5651 | 500 | 87.3 | globlastp |
| 946 | LAB94 | wheat\|gb164\|BE426589 | 5652 | 500 | 87.3 | globlastp |
| 947 | LAB94 | wheat\|gb164\|BE443811 | 5653 | 500 | 87.3 | globlastp |
| 948 | LAB94 | leymus\|gb166\|EG392526 | 5654 | 500 | 87.2 | globlastp |
| 949 | LAB94 | wheat\|gb164\|AL826955 | 5655 | 500 | 86.9 | globlastp |
| 950 | LAB94 | pseudoroegneria\|gb167\|FF345077 | 5656 | 500 | 86.6 | globlastp |
| 951 | LAB97 | maize\|gb170\|AI964653 | 5657 | 501 | 93.5 | globlastp |
| 952 | LAB97 | switchgrass\|gb167\|FE603346 | 5658 | 501 | 93.5 | globlastp |
| 953 | LAB97 | millet\|09v1\|EVO454PM004428 | 5659 | 501 | 89.5 | globlastp |
| 954 | LAB97 | sugarcane\|10v1\|CA070094 | 5660 | 501 | 89.5 | globlastp |
| 955 | LAB97 | switchgrass\|gb167\|FE622833 | 5661 | 501 | 86.2 | globlastp |
| 956 | LAB97 | switchgrass\|gb167\|FE634485 | 5662 | 501 | 83.1 | globlastp |
| 957 | LAB97 | oat\|10v1\|GO589167 | 5663 | 501 | 81.45 | glotblastn |
| 958 | LAB97 | switchgrass\|gb167\|FE632663 | 5664 | 501 | 80.9 | globlastp |
| 959 | LAB98 | sugarcane\|gb157.3\|CA094179 | 5665 | 502 | 90.9 | globlastp |
| 960 | LAB98 | sugarcane\|gb157.3\|BQ534494 | 5666 | 502 | 86.7 | globlastp |
| 961 | LAB98 | sugarcane\|10v1\|CA075265 | 5667 | 502 | 86.7 | globlastp |
| 962 | LAB98 | sugarcane\|gb157.3\|CA095912 | 5668 | 502 | 84.85 | glotblastn |
| 963 | LAB98 | maize\|gb170\|AA979797 | 5669 | 502 | 84.1 | globlastp |
| 964 | LAB98 | sugarcane\|gb157.3\|CA213458 | 5670 | 502 | 83 | globlastp |
| 965 | LAB98 | maize\|gb170\|DN218642 | 5671 | 502 | 81.71 | glotblastn |
| 966 | LAB101 | sugarcane\|gb157.3\|CA092106 | 5672 | 503 | 92.15 | glotblastn |
| 967 | LAB101 | maize\|gb170\|AW506976 | 5673 | 503 | 89.3 | globlastp |
| 968 | LAB101 | switchgrass\|gb167\|FE623004 | 5674 | 503 | 85.2 | globlastp |
| 969 | LAB101 | sugarcane\|10v1\|CA092106 | 5675 | 503 | 83.14 | glotblastn |
| 970 | LAB101 | sorghum\|09v1\|SB05G020410 | 5676 | 503 | 82.3 | globlastp |
| 971 | LAB102 | sugarcane\|gb157.3\|CA085176 | 5677 | 504 | 94.1 | globlastp |
| 972 | LAB102 | sugarcane\|10v1\|CA085176 | 5678 | 504 | 93.41 | glotblastn |
| 973 | LAB102 | sugarcane\|gb157.3\|CA133383 | 5679 | 504 | 92.7 | globlastp |
| 974 | LAB102 | switchgrass\|gb167\|FL786617 | 5680 | 504 | 90.2 | globlastp |
| 975 | LAB102 | maize\|gb170\|AW330714 | 5681 | 504 | 80.6 | globlastp |
| 976 | LAB106 | maize\|gb170\|CD960060 | 5682 | 505 | 85.6 | globlastp |
| 977 | LAB106 | maize\|gb170\|AI372243 | 5683 | 505 | 84.5 | globlastp |
| 978 | LAB106 | switchgrass\|gb167\|FE605362 | 5684 | 505 | 84 | globlastp |
| 979 | LAB107 | maize\|gb170\|CA399032 | 5685 | 506 | 96.1 | globlastp |
| 980 | LAB107 | sugarcane\|gb157.3\|CA065542 | 5686 | 506 | 93.92 | glotblastn |
| 981 | LAB107 | switchgrass\|gb167\|DN142686 | 5687 | 506 | 84.6 | globlastp |
| 982 | LAB107 | sugarcane\|10v1\|CA065611 | 5688 | 506 | 84.5 | globlastp |
| 983 | LAB107 | rice\|gb170\|OS10G32680 | 5689 | 506 | 82.97 | glotblastn |
| 984 | LAB109 | maize\|gb170\|CD948529 | 5690 | 508 | 86 | globlastp |
| 985 | LAB113 | potato\|10v1\|BQ119431 | 5691 | 510 | 93.8 | globlastp |
| 986 | LAB113 | potato\|gb157.2\|BQ119431 | 5691 | 510 | 93.8 | globlastp |
| 987 | LAB113 | eggplant\|10v1\|FS017035 | 5692 | 510 | 90 | globlastp |
| 988 | LAB115 | solanum_phureja\|09v1\|SPHAI488164 | 5693 | 511 | 97.7 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 989 | LAB115 | potato\|gb157.2\|BG590998 | 5694 | 511 | 96.5 | glotblastn |
| 990 | LAB115 | eggplant\|10v1\|FS001103 | 5695 | 511 | 93.8 | globlastp |
| 991 | LAB115 | pepper\|gb171\|BM062112 | 5696 | 511 | 92.6 | globlastp |
| 992 | LAB115 | petunia\|gb171\|EB174978 | 5697 | 511 | 86.7 | globlastp |
| 993 | LAB115 | tobacco\|gb162\|EB426842 | 5698 | 511 | 83.8 | globlastp |
| 994 | LAB116 | solanum_phureja\|09v1\|SPHAI637375 | 5699 | 512 | 94.8 | globlastp |
| 995 | LAB116 | potato\|10v1\|BG596647 | 5699 | 512 | 94.8 | globlastp |
| 996 | LAB116 | potato\|gb157.2\|BE923899 | 5699 | 512 | 94.8 | globlastp |
| 997 | LAB117 | solanum_phureja\|09v1\|SPHAI772185 | 5700 | 513 | 93 | globlastp |
| 998 | LAB117 | tobacco\|gb162\|AB073628 | 5701 | 513 | 82.2 | globlastp |
| 999 | LAB119 | potato\|10v1\|BE919943 | 5702 | 514 | 91.2 | globlastp |
| 1000 | LAB119 | solanum_phureja\|09v1\|SPHAI772981 | 5703 | 514 | 90.7 | globlastp |
| 1001 | LAB119 | potato\|gb157.2\|BE919943 | 5704 | 514 | 90.7 | globlastp |
| 1002 | LAB119 | pepper\|gb171\|CA523161 | 5705 | 514 | 84.5 | globlastp |
| 1003 | LAB120 | solanum_phureja\|09v1\|SPHAW218593 | 5706 | 515 | 96.7 | globlastp |
| 1004 | LAB121 | solanum_phureja\|09v1\|SPHAW223810 | 5707 | 516 | 98.7 | globlastp |
| 1005 | LAB121 | potato\|gb157.2\|CN463702 | 5708 | 516 | 98.1 | globlastp |
| 1006 | LAB121 | potato\|10v1\|BI919647 | 5708 | 516 | 98.1 | globlastp |
| 1007 | LAB121 | potato\|10v1\|BG888636 | 5709 | 516 | 96.8 | globlastp |
| 1008 | LAB121 | potato\|gb157.2\|BG888636 | 5709 | 516 | 96.8 | globlastp |
| 1009 | LAB121 | potato\|gb157.2\|CK863276 | 5710 | 516 | 96.1 | globlastp |
| 1010 | LAB121 | tomato\|gb164\|AW216800 | 5711 | 516 | 94.2 | globlastp |
| 1011 | LAB121 | eggplant\|10v1\|FS012746 | 5712 | 516 | 93.51 | glotblastn |
| 1012 | LAB121 | potato\|10v1\|CV476486 | 5713 | 516 | 93.5 | globlastp |
| 1013 | LAB121 | solanum_phureja\|09v1\|SPHAW216800 | 5714 | 516 | 93.5 | globlastp |
| 1014 | LAB121 | solanum_phureja\|09v1\|SPHCRPSP004689 | 5715 | 516 | 93.5 | globlastp |
| 1015 | LAB121 | potato\|gb157.2\|BG887542 | 5716 | 516 | 92.9 | globlastp |
| 1016 | LAB121 | tobacco\|gb162\|AY329069 | 5717 | 516 | 92.9 | globlastp |
| 1017 | LAB121 | tomato\|gb164\|AI774877 | 5718 | 516 | 92.9 | globlastp |
| 1018 | LAB121 | solanum_phureja\|09v1\|SPHAF123255 | 5719 | 516 | 92.2 | globlastp |
| 1019 | LAB121 | potato\|gb157.2\|BG592733 | 5719 | 516 | 92.2 | globlastp |
| 1020 | LAB121 | tobacco\|gb162\|AY329067 | 5720 | 516 | 92.2 | globlastp |
| 1021 | LAB121 | potato\|10v1\|BF053349 | 5719 | 516 | 92.2 | globlastp |
| 1022 | LAB121 | solanum_phureja\|09v1\|SPHCV477365 | 5721 | 516 | 91.6 | globlastp |
| 1023 | LAB121 | tomato\|gb164\|AF123255 | 5722 | 516 | 91.6 | globlastp |
| 1024 | LAB121 | pepper\|gb171\|BM060336 | 5723 | 516 | 91.6 | globlastp |
| 1025 | LAB121 | pepper\|gb171\|CA522343 | 5724 | 516 | 91.6 | globlastp |
| 1026 | LAB121 | tomato\|09v1\|AF123255 | 5722 | 516 | 91.6 | globlastp |
| 1027 | LAB121 | eggplant\|10v1\|FS033633 | 5725 | 516 | 90.9 | globlastp |
| 1028 | LAB121 | potato\|gb157.2\|CV477365 | 5726 | 516 | 90.9 | globlastp |
| 1029 | LAB121 | solanum_phureja\|09v1\|SPHCRPSP039416 | 5727 | 516 | 90.26 | glotblastn |
| 1030 | LAB121 | potato\|10v1\|CN464789 | 5728 | 516 | 89.6 | globlastp |
| 1031 | LAB121 | potato\|10v1\|DN590196 | 5729 | 516 | 89.6 | globlastp |
| 1032 | LAB121 | pepper\|gb171\|CA522586 | 5730 | 516 | 89.6 | globlastp |
| 1033 | LAB121 | solanum_phureja\|09v1\|SPHCN464789 | 5731 | 516 | 88.3 | globlastp |
| 1034 | LAB121 | soybean\|gb168\|AW980952 | 5732 | 516 | 83.8 | globlastp |
| 1035 | LAB121 | medicago\|gb157.2\|BG647589 | 5733 | 516 | 83.1 | globlastp |
| 1036 | LAB121 | soybean\|gb168\|AW567705 | 5734 | 516 | 83.1 | globlastp |
| 1037 | LAB121 | papaya\|gb165\|EX251993 | 5735 | 516 | 82.6 | globlastp |
| 1038 | LAB121 | peanut\|gb171\|EG373080 | 5736 | 516 | 82.6 | globlastp |
| 1039 | LAB121 | medicago\|09v1\|AW683787 | 5737 | 516 | 82.5 | globlastp |
| 1040 | LAB121 | medicago\|gb157.2\|AW683787 | 5737 | 516 | 82.5 | globlastp |
| 1041 | LAB121 | medicago\|09v1\|AW684008 | 5738 | 516 | 82.5 | globlastp |
| 1042 | LAB121 | tobacco\|gb162\|AY329073 | 5739 | 516 | 82.5 | globlastp |
| 1043 | LAB121 | cotton\|gb164\|BE051984 | 5740 | 516 | 82.4 | globlastp |
| 1044 | LAB121 | cacao\|gb167\|CA796637 | 5741 | 516 | 82.2 | globlastp |
| 1045 | LAB121 | cotton\|gb164\|BE054707 | 5742 | 516 | 81.9 | globlastp |
| 1046 | LAB121 | cotton\|gb164\|BF272955 | 5743 | 516 | 81.9 | globlastp |
| 1047 | LAB121 | papaya\|gb165\|EX252008 | 5744 | 516 | 81.9 | globlastp |
| 1048 | LAB121 | peanut\|gb171\|EE123664 | 5745 | 516 | 81.9 | globlastp |
| 1049 | LAB121 | soybean\|gb168\|BG646416 | 5746 | 516 | 81.9 | globlastp |
| 1050 | LAB121 | jatropha\|09v1\|FM890538 | 5747 | 516 | 81.6 | globlastp |
| 1051 | LAB121 | papaya\|gb165\|AY387588 | 5748 | 516 | 81.3 | globlastp |
| 1052 | LAB121 | peanut\|gb171\|EC365300 | 5749 | 516 | 81.3 | globlastp |
| 1053 | LAB121 | peanut\|gb171\|EE126279 | 5750 | 516 | 81.3 | globlastp |
| 1054 | LAB121 | soybean\|gbl68\|CA798992 | 5751 | 516 | 81.3 | globlastp |
| 1055 | LAB121 | tomato\|09v1\|DV103969 | 5752 | 516 | 81.2 | globlastp |
| 1056 | LAB121 | soybean\|gb168\|BU548154 | 5753 | 516 | 81.2 | globlastp |
| 1057 | LAB121 | spurge\|gb161\|DV112249 | 5754 | 516 | 81.2 | globlastp |
| 1058 | LAB121 | spurge\|gb161\|DV116657 | 5755 | 516 | 81.2 | globlastp |
| 1059 | LAB121 | medicago\|09v1\|LLBG452648 | 5756 | 516 | 81.1 | globlastp |
| 1060 | LAB121 | medicago\|gb157.2\|BG452648 | 5756 | 516 | 81.1 | globlastp |

TABLE 54-continued

Homologues of the identified genes/polypeptides for increasing abiotic stress
tolerance, water use efficiency, yield, growth rate, vigor, oil content, biomass, growth
rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1061 | LAB121 | cassava\|09v1\|DR084888 | 5757 | 516 | 81 | globlastp |
| 1062 | LAB121 | cotton\|gb164\|BF269213 | 5758 | 516 | 80.9 | globlastp |
| 1063 | LAB121 | cotton\|gb164\|CA993196 | 5759 | 516 | 80.9 | globlastp |
| 1064 | LAB121 | cichorium\|gb171\|EH690049 | 5760 | 516 | 80.8 | globlastp |
| 1065 | LAB121 | potato\|gb157.2\|CV476486 | 5761 | 516 | 80.65 | glotblastn |
| 1066 | LAB121 | cotton\|gb164\|BQ403095 | 5762 | 516 | 80.6 | globlastp |
| 1067 | LAB121 | papaya\|gb165\|EX252058 | 5763 | 516 | 80.6 | globlastp |
| 1068 | LAB121 | peanut\|gb171\|EE127248 | 5764 | 516 | 80.6 | globlastp |
| 1069 | LAB121 | soybean\|gb168\|BM886953 | 5765 | 516 | 80.5 | globlastp |
| 1070 | LAB121 | cassava\|09v1\|DR086686 | 5766 | 516 | 80.4 | globlastp |
| 1071 | LAB121 | cassava\|gb164\|DR084888 | 5767 | 516 | 80.4 | globlastp |
| 1072 | LAB121 | cassava\|gb164\|DR086686 | 5766 | 516 | 80.4 | globlastp |
| 1073 | LAB121 | poplar\|10v1\|BU813549 | 5768 | 516 | 80.3 | globlastp |
| 1074 | LAB121 | cacao\|gb167\|CU476839 | 5769 | 516 | 80.3 | globlastp |
| 1075 | LAB121 | cotton\|gb164\|BQ409689 | 5770 | 516 | 80.3 | globlastp |
| 1076 | LAB121 | lettuce\|10v1\|DW075714 | 5771 | 516 | 80.3 | globlastp |
| 1077 | LAB121 | lettuce\|gb157.2\|DW075714 | 5771 | 516 | 80.3 | globlastp |
| 1078 | LAB121 | poplar\|10v1\|DT507125 | 5768 | 516 | 80.3 | globlastp |
| 1079 | LAB121 | poplar\|gb170\|BU813549 | 5768 | 516 | 80.3 | globlastp |
| 1080 | LAB121 | dandelion\|gb161\|DY824523 | 5772 | 516 | 80.1 | globlastp |
| 1081 | LAB121 | soybean\|gb168\|BQ630709 | 5773 | 516 | 80 | globlastp |
| 1082 | LAB121 | cotton\|gb164\|CA993586 | 5774 | 516 | 80 | globlastp |
| 1083 | LAB122 | solanum_phureja\|09v1\|SPHAW442266 | 5775 | 517 | 98.3 | globlastp |
| 1084 | LAB122 | potato\|gb157.2\|BG889978 | 5775 | 517 | 98.3 | globlastp |
| 1085 | LAB122 | potato\|10v1\|BG888028 | 5775 | 517 | 98.3 | globlastp |
| 1086 | LAB122 | potato\|gb157.2\|BG888028 | 5776 | 517 | 96.9 | globlastp |
| 1087 | LAB122 | eggplant\|10v1\|FS078554 | 5777 | 517 | 92.3 | globlastp |
| 1088 | LAB122 | tobacco\|gb162\|EB430956 | 5778 | 517 | 89.2 | globlastp |
| 1089 | LAB123 | solanum_phureja\|09v1\|SPHAW442830 | 5779 | 518 | 87.4 | globlastp |
| 1090 | LAB123 | potato\|10v1\|BF460376 | 5780 | 518 | 87 | globlastp |
| 1091 | LAB123 | potato\|gb157.2\|BF460376 | 5781 | 518 | 87 | globlastp |
| 1092 | LAB124 | potato\|10v1\|BF154317 | 5782 | 519 | 91.9 | globlastp |
| 1093 | LAB124 | potato\|gb157.2\|BF154317 | 5782 | 519 | 91.9 | globlastp |
| 1094 | LAB124 | solanum_phureja\|09v1\|SPHBG123767 | 5783 | 519 | 89 | globlastp |
| 1095 | LAB127 | solanum_phureja\|09v1\|SPHBG127842 | 5784 | 522 | 96.9 | globlastp |
| 1096 | LAB127 | potato\|10v1\|CK269532 | 5784 | 522 | 96.9 | globlastp |
| 1097 | LAB127 | potato\|gb157.2\|CK269532 | 5785 | 522 | 96.5 | globlastp |
| 1098 | LAB127 | eggplant\|10v1\|FS089521 | 5786 | 522 | 93.4 | globlastp |
| 1099 | LAB128 | potato\|gb157.2\|BE922546 | 5787 | 523 | 92.6 | globlastp |
| 1100 | LAB128 | potato\|10v1\|BE922546 | 5787 | 523 | 92.6 | globlastp |
| 1101 | LAB128 | potato\|10v1\|BQ111829 | 5788 | 523 | 92.3 | globlastp |
| 1102 | LAB128 | potato\|gb157.2\|BG598290 | 5789 | 523 | 92.28 | glotblastn |
| 1103 | LAB128 | solanum_phureja\|09v1\|SPHBG128502 | 5790 | 523 | 92 | globlastp |
| 1104 | LAB128 | eggplant\|10v1\|FS007523 | 5791 | 523 | 87.5 | globlastp |
| 1105 | LAB128 | petunia\|gb171\|CV295560 | 5792 | 523 | 85.5 | globlastp |
| 1106 | LAB128 | tobacco\|gb162\|EH618301 | 5793 | 523 | 84.2 | globlastp |
| 1107 | LAB129 | solanum_phureja\|09v1\|SPHBG129905 | 5794 | 524 | 91.2 | globlastp |
| 1108 | LAB129 | pepper\|gb171\|GD052614 | 5795 | 524 | 80 | glotblastn |
| 1109 | LAB130 | solanum_phureja\|09v1\|SPHBG133230 | 5796 | 525 | 89.23 | glotblastn |
| 1110 | LAB131 | potato\|10v1\|BG890172 | 5797 | 526 | 97.3 | globlastp |
| 1111 | LAB131 | solanum_phureja\|09v1\|SPHBG127715 | 5798 | 526 | 96.7 | globlastp |
| 1112 | LAB131 | tobacco\|gb162\|EB424672 | 5799 | 526 | 90.9 | globlastp |
| 1113 | LAB131 | potato\|gb157.2\|BF460303 | 5800 | 526 | 89.4 | globlastp |
| 1114 | LAB131 | solanum_phureja\|09v1\|SPHAF204790 | 5801 | 526 | 89.1 | globlastp |
| 1115 | LAB131 | pepper\|gb171\|AF082722 | 5802 | 526 | 88.8 | globlastp |
| 1116 | LAB131 | potato\|gb157.2\|BF054105 | 5803 | 526 | 88.8 | globlastp |
| 1117 | LAB131 | potato\|10v1\|BF460303 | 5803 | 526 | 88.8 | globlastp |
| 1118 | LAB131 | tomato\|gb164\|AF204790 | 5804 | 526 | 88.4 | globlastp |
| 1119 | LAB131 | tomato\|09v1\|AF204790 | 5805 | 526 | 88.1 | globlastp |
| 1120 | LAB131 | eggplant\|10v1\|FS008074 | 5806 | 526 | 87.2 | globlastp |
| 1121 | LAB131 | tomato\|gb164\|BG127715 | 5807 | 526 | 83.6 | globlastp |
| 1122 | LAB131 | potato\|gb157.2\|BG890172 | 5808 | 526 | 82.4 | globlastp |
| 1123 | LAB131 | citrus\|gb166\|BQ623443 | 5809 | 526 | 81.3 | globlastp |
| 1124 | LAB131 | ipomoea_nil\|10v1\|BJ558237 | 5810 | 526 | 81.2 | globlastp |
| 1125 | LAB131 | arabidopsis_lyrata\|09v1\|JGIAL032554 | 5811 | 526 | 80.9 | globlastp |
| 1126 | LAB131 | monkeyflower\|10v1\|GO946694 | 5812 | 526 | 80.9 | globlastp |
| 1127 | LAB131 | ipomoea\|gb157.2\|BJ558237 | 5813 | 526 | 80.9 | globlastp |
| 1128 | LAB131 | canola\|10v1\|CN828978 | 5814 | 526 | 80.5 | globlastp |
| 1129 | LAB131 | canola\|gb161\|CN828978 | 5814 | 526 | 80.5 | globlastp |
| 1130 | LAB131 | coffea\|10v1\|DV675045 | 5815 | 526 | 80.2 | globlastp |
| 1131 | LAB131 | radish\|gb164\|EX764030 | 5816 | 526 | 80.2 | globlastp |
| 1132 | LAB133 | solanum_phureja\|09v1\|SPHBG629133 | 5817 | 527 | 87 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1133 | LAB137 | brachypodium|gb169|BE416704 | 5818 | 528 | 85.97 | glotblastn |
| 1134 | LAB137 | brachypodium|09v1|DV479869 | 5819 | 528 | 85.2 | globlastp |
| 1135 | LAB141 | barley|gb157SOLEXA|BI953426 | 5820 | 530 | 97.34 | glotblastn |
| 1136 | LAB141 | barley|10v1|BI953426 | 5821 | 530 | 97.09 | glotblastn |
| 1137 | LAB141 | brachypodium|09v1|DV478705 | 5822 | 530 | 92.01 | glotblastn |
| 1138 | LAB141 | brachypodium|gb169|BE591380 | 5823 | 530 | 92.01 | glotblastn |
| 1139 | LAB141 | rice|gb170|OS09G27050 | 5824 | 530 | 84.99 | glotblastn |
| 1140 | LAB141 | sorghum|09v1|SB02G025930 | 5825 | 530 | 84.75 | glotblastn |
| 1141 | LAB141 | sorghum|gb161.crp|AW283712 | 5825 | 530 | 84.75 | glotblastn |
| 1142 | LAB141 | maize|gb170|LLCD940999 | 5826 | 530 | 82.25 | glotblastn |
| 1143 | LAB141 | sorghum|09v1|SB07G022430 | 5827 | 530 | 81.64 | glotblastn |
| 1143 | LAB252 | sorghum|09v1|SB07G022430 | 5827 | 603 | 87.6 | globlastp |
| 1144 | LAB141 | sorghum|gb161.crp|AW287657 | 5828 | 530 | 81.64 | glotblastn |
| 1144 | LAB252 | sorghum|gb161.crp|AW287657 | 5828 | 603 | 87.3 | globlastp |
| 1145 | LAB141 | switchgrass|gb167|FL754019 | 5829 | 530 | 80.63 | glotblastn |
| 1146 | LAB141 | maize|gb170|BQ441996 | 5830 | 530 | 80.39 | glotblastn |
| 1146 | LAB252 | maize|gb170|BQ441996 | 5830 | 603 | 87.2 | globlastp |
| 1147 | LAB145 | sugarcane|10v1|CA288211 | 5831 | 531 | 84.62 | glotblastn |
| 1147 | LAB167 | sugarcane|10v1|CA288211 | 5831 | 547 | 80.3 | globlastp |
| 1148 | LAB145 | sugarcane|gb157.3|CA288211 | 5831 | 531 | 84.62 | glotblastn |
| 1148 | LAB167 | sugarcane|gb157.3|CA288211 | 5831 | 547 | 80.3 | globlastp |
| 1149 | LAB145 | sugarcane|10v1|CF571685 | 5832 | 531 | 80 | glotblastn |
| 1149 | LAB167 | sugarcane|10v1|CF571685 | 5832 | 547 | 86.8 | globlastp |
| 1150 | LAB145 | sugarcane|gb157.3|CF571685 | 5832 | 531 | 80 | glotblastn |
| 1150 | LAB167 | sugarcane|gb157.3|CF571685 | 5832 | 547 | 86.8 | globlastp |
| 1151 | LAB152 | maize|gb170|AI901645 | 5833 | 533 | 92.6 | globlastp |
| 1152 | LAB152 | sugarcane|gb157.3|CA150670 | 5834 | 533 | 92.57 | glotblastn |
| 1153 | LAB152 | switchgrass|gb167|FL692374 | 5835 | 533 | 82.7 | globlastp |
| 1154 | LAB152 | switchgrass|gb167|FL713549 | 5836 | 533 | 81 | globlastp |
| 1155 | LAB153 | sugarcane|10v1|CA123230 | 5837 | 534 | 97.6 | globlastp |
| 1156 | LAB153 | sugarcane|gb157.3|CA123230 | 5837 | 534 | 97.6 | globlastp |
| 1157 | LAB153 | maize|gb170|T18415 | 5838 | 534 | 92.5 | globlastp |
| 1158 | LAB153 | switchgrass|gb167|FE637514 | 5839 | 534 | 90.6 | globlastp |
| 1159 | LAB153 | switchgrass|gb167|FL789468 | 5840 | 534 | 89.4 | globlastp |
| 1160 | LAB153 | cenchrus|gb166|EB655013 | 5841 | 534 | 85.4 | globlastp |
| 1161 | LAB153 | brachypodium|09v1|DV480172 | 5842 | 534 | 83.1 | globlastp |
| 1162 | LAB153 | brachypodium|gb169|BE421446 | 5842 | 534 | 83.1 | globlastp |
| 1163 | LAB153 | rice|gb170|OS02G54060 | 5843 | 534 | 82.7 | globlastp |
| 1164 | LAB154 | maize|gb170|AW066925 | 5844 | 535 | 94.1 | globlastp |
| 1165 | LAB154 | barley|10v1|AV833850 | 5845 | 535 | 90.2 | globlastp |
| 1166 | LAB154 | barley|10v1|BI958438 | 5846 | 535 | 90.2 | globlastp |
| 1167 | LAB154 | brachypodium|09v1|DV469301 | 5847 | 535 | 89.9 | globlastp |
| 1168 | LAB154 | brachypodium|gb169|BE637762 | 5847 | 535 | 89.9 | globlastp |
| 1169 | LAB154 | wheat|gb164|BE515523 | 5848 | 535 | 89.9 | globlastp |
| 1170 | LAB154 | wheat|gb164|BF483856 | 5849 | 535 | 89.6 | globlastp |
| 1171 | LAB154 | wheat|gb164|CA660347 | 5850 | 535 | 89.3 | globlastp |
| 1172 | LAB154 | oat|10v1|GR356133 | 5851 | 535 | 88.7 | globlastp |
| 1173 | LAB154 | rice|gb170|OS04G55710 | 5852 | 535 | 88.7 | globlastp |
| 1174 | LAB154 | oat|10v1|GR358853 | 5853 | 535 | 87.8 | globlastp |
| 1175 | LAB154 | barley|gb157SOLEXA|AL499742 | 5854 | 535 | 82.6 | globlastp |
| 1176 | LAB159 | sugarcane|10v1|DN195185 | 5855 | 539 | 96.6 | globlastp |
| 1177 | LAB159 | maize|gb170|BM340195 | 5856 | 539 | 94.8 | globlastp |
| 1178 | LAB159 | switchgrass|gb167|DN148099 | 5857 | 539 | 92.4 | globlastp |
| 1179 | LAB159 | rice|gb170|OS07G04990 | 5858 | 539 | 88.5 | globlastp |
| 1180 | LAB159 | wheat|gb164|BE605214 | 5859 | 539 | 85.4 | globlastp |
| 1181 | LAB159 | leymus|gb166|EG386154 | 5860 | 539 | 85.2 | globlastp |
| 1182 | LAB159 | barley|10v1|BI951567 | 5861 | 539 | 84.9 | globlastp |
| 1183 | LAB159 | barley|gb157SOLEXA|BEI951567 | 5861 | 539 | 84.9 | globlastp |
| 1184 | LAB159 | wheat|gb164|BE604066 | 5862 | 539 | 84.9 | globlastp |
| 1185 | LAB159 | oat|10v1|CN817195 | 5863 | 539 | 83.3 | globlastp |
| 1186 | LAB159 | fescue|gb161|DT679429 | 5864 | 539 | 83.3 | globlastp |
| 1187 | LAB159 | brachypodium|09v1|DV479518 | 5865 | 539 | 82.9 | globlastp |
| 1188 | LAB159 | brachypodium|gb169|BE704541 | 5865 | 539 | 82.9 | globlastp |
| 1189 | LAB161 | maize|gb170|AI622212 | 5866 | 541 | 95.5 | globlastp |
| 1190 | LAB161 | switchgrass|gb167|DT948963 | 5867 | 541 | 92.42 | glotblastn |
| 1191 | LAB161 | rice|gb170|OS09G18320 | 5868 | 541 | 81.6 | globlastp |
| 1192 | LAB162 | maize|gb170|AI586902 | 5869 | 542 | 93.7 | globlastp |
| 1193 | LAB162 | switchgrass|gb167|FE658082 | 5870 | 542 | 91.9 | globlastp |
| 1194 | LAB162 | rice|gb170|OS06G04610 | 5871 | 542 | 86.2 | globlastp |
| 1195 | LAB162 | oat|10v1|CN819671 | 5872 | 542 | 84.3 | globlastp |
| 1196 | LAB162 | leymus|gb166|EG384069 | 5873 | 542 | 83.6 | globlastp |
| 1197 | LAB162 | wheat|gb164|BF201230 | 5874 | 542 | 83.18 | glotblastn |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1198 | LAB162 | brachypodium|09v1|GT776617 | 5875 | 542 | 82.5 | globlastp |
| 1199 | LAB162 | wheat|gb164|BG606378 | 5876 | 542 | 82.16 | glotblastn |
| 1200 | LAB164 | brachypodium|gb169|BE445505 | 5877 | 544 | 82.2 | globlastp |
| 1201 | LAB165 | sorghum|09v1|SB04G027460 | 5878 | 545 | 97.53 | glotblastn |
| 1202 | LAB165 | maize|gb170|CD936465 | 5879 | 545 | 91.36 | glotblastn |
| 1203 | LAB165 | rice|gb170|OS02G51910 | 5880 | 545 | 84.9 | globlastp |
| 1204 | LAB166 | maize|gb170|AI444676 | 5881 | 546 | 91.9 | globlastp |
| 1205 | LAB166 | rice|gb170|OS10G36390 | 5882 | 546 | 82.2 | globlastp |
| 1206 | LAB167 | sugarcane|gb157.3|CA070500 | 5883 | 547 | 87.84 | globlastp |
| 1207 | LAB167 | sorghum|09v1|SB09G001020 | 5884 | 547 | 87.8 | globlastp |
| 1208 | LAB167 | sorghum|gb161.crp|AI723995 | 5884 | 547 | 87.8 | globlastp |
| 1209 | LAB167 | wheat|gb164|CA484885 | 5885 | 547 | 86.5 | globlastp |
| 1210 | LAB167 | switchgrass|gb167|FL825143 | 5886 | 547 | 83.8 | globlastp |
| 1211 | LAB167 | sugarcane|10v1|BQ534981 | 5887 | 547 | 83.6 | globlastp |
| 1212 | LAB167 | sugarcane|gb157.3|BQ534981 | 5887 | 547 | 83.6 | globlastp |
| 1213 | LAB167 | sugarcane|10v1|C0373473 | 5888 | 547 | 82.43 | glotblastn |
| 1214 | LAB167 | sugarcane|gb157.3|C0373473 | 5888 | 547 | 82.43 | glotblastn |
| 1215 | LAB167 | sugarcane|10v1|BQ534583 | 5889 | 547 | 82.4 | globlastp |
| 1216 | LAB167 | sugarcane|gb157.3|BQ534583 | 5889 | 547 | 82.4 | globlastp |
| 1217 | LAB167 | maize|gb170|LLAW202534 | 5890 | 547 | 82.2 | globlastp |
| 1218 | LAB167 | maize|gb170|T23379 | 5890 | 547 | 82.2 | globlastp |
| 1219 | LAB167 | sugarcane|10v1|CA277083 | 5891 | 547 | 80.8 | globlastp |
| 1220 | LAB167 | sugarcane|10v1|CA297188 | 5892 | 547 | 80 | globlastp |
| 1221 | LAB169 | maize|gb170|AW053133 | 5893 | 548 | 97.5 | globlastp |
| 1222 | LAB169 | switchgrass|gb167|FE613776 | 5894 | 548 | 95.9 | globlastp |
| 1223 | LAB169 | rice|gb170|OS04G44890 | 5895 | 548 | 91.6 | globlastp |
| 1224 | LAB169 | brachypodium|09v1|DV487916 | 5896 | 548 | 89.1 | globlastp |
| 1225 | LAB169 | brachypodium|gb169|BF202199 | 5896 | 548 | 89.1 | globlastp |
| 1226 | LAB169 | barley|10v1|BI955502 | 5897 | 548 | 85.9 | globlastp |
| 1227 | LAB169 | wheat|gb164|BF202199 | 5898 | 548 | 85 | globlastp |
| 1228 | LAB169 | castorbean|09v1|XM002528859 | 5899 | 548 | 82.81 | glotblastn |
| 1229 | LAB169 | coffea|10v1|DV691567 | 5900 | 548 | 80.94 | glotblastn |
| 1230 | LAB169 | tomato|09v1|BG135211 | 5901 | 548 | 80.62 | glotblastn |
| 1231 | LAB169 | cassava|09v1|JGICASSAVA19698M1 | 5902 | 548 | 80.31 | glotblastn |
| 1232 | LAB169 | solanum_phureja|09v1|SPHBG135211 | 5903 | 548 | 80 | glotblastn |
| 1233 | LAB169 | potato|gb157.2|BI405380 | 5904 | 548 | 80 | glotblastn |
| 1234 | LAB170 | sugarcane|10v1|BU103703 | 5905 | 549 | 97.1 | globlastp |
| 1235 | LAB170 | sugarcane|gb157.3|BU103703 | 5906 | 549 | 97 | globlastp |
| 1236 | LAB170 | maize|gb170|AW066983 | 5907 | 549 | 94.1 | globlastp |
| 1237 | LAB170 | switchgrass|gb167|FL704262 | 5908 | 549 | 94.1 | globlastp |
| 1238 | LAB170 | barley|10v1|AV833506 | 5909 | 549 | 88.8 | globlastp |
| 1239 | LAB170 | barley|gb157SOLEXA|AV833506 | 5909 | 549 | 88.8 | globlastp |
| 1240 | LAB170 | rice|gb170|OS01G62900 | 5910 | 549 | 88.3 | globlastp |
| 1241 | LAB170 | brachypodium|09v1|DV484814 | 5911 | 549 | 87.7 | globlastp |
| 1242 | LAB170 | brachypodium|gb169|AF022914 | 5911 | 549 | 87.7 | globlastp |
| 1243 | LAB170 | wheat|gb164|BE403675 | 5912 | 549 | 84.5 | globlastp |
| 1244 | LAB170 | millet|09v1|EVO454PM003201 | 5913 | 549 | 82.2 | globlastp |
| 1245 | LAB171 | maize|gb170|AI941956 | 5914 | 550 | 95.6 | globlastp |
| 1246 | LAB171 | switchgrass|gb167|FL777596 | 5915 | 550 | 89.9 | globlastp |
| 1246 | LAB179 | switchgrass|gb167|FL777596 | 5915 | 557 | 81.1 | globlastp |
| 1247 | LAB171 | millet|09v1|EVO454PM014599 | 5916 | 550 | 86.3 | globlastp |
| 1248 | LAB171 | switchgrass|gb167|FL724893 | 5917 | 550 | 86.29 | glotblastn |
| 1249 | LAB171 | brachypodium|09v1|GT862474 | 5918 | 550 | 83.1 | globlastp |
| 1249 | LAB179 | brachypodium|09v1|GT862474 | 5918 | 557 | 86.7 | globlastp |
| 1250 | LAB171 | oat|10v1|GO596792 | 5919 | 550 | 81 | globlastp |
| 1250 | LAB179 | oat|10v1|GO596792 | 5919 | 557 | 87.6 | globlastp |
| 1251 | LAB172 | sugarcane|gb157.3|CA081142 | 5920 | 551 | 97.3 | globlastp |
| 1252 | LAB172 | sugarcane|10v1|CA081142 | 5921 | 551 | 97 | globlastp |
| 1253 | LAB172 | maize|gb170|AW360590 | 5922 | 551 | 94.4 | globlastp |
| 1254 | LAB172 | brachypodium|09v1|DV470791 | 5923 | 551 | 80.7 | globlastp |
| 1255 | LAB172 | brachypodium|gb169|BQ801920 | 5923 | 551 | 80.7 | globlastp |
| 1256 | LAB172 | barley|gb157SOLEXA|AL508671 | 5924 | 551 | 80.5 | globlastp |
| 1257 | LAB172 | pseudoroegneria|gb167|FF357868 | 5925 | 551 | 80.5 | globlastp |
| 1258 | LAB172 | wheat|gb164|BE428307 | 5926 | 551 | 80.4 | glotblastn |
| 1259 | LAB172 | rice|gb170|OS10G37830 | 5927 | 551 | 80.1 | globlastp |
| 1260 | LAB178 | solanum_phureja|09v1|SPHAI490504 | 5928 | 556 | 91 | globlastp |
| 1261 | LAB178 | solanum_phureja|09v1|SPHAI899607 | 5929 | 556 | 90.3 | globlastp |
| 1262 | LAB178 | solanum_phureja|09v1|SPHAW030648 | 5930 | 556 | 86.3 | globlastp |
| 1263 | LAB178 | solanum_phureja|09v1|SPHFS190963 | 5931 | 556 | 82.95 | glotblastn |
| 1264 | LAB181 | arabidopsis_lyrata|09v1|JGIAL003163 | 5932 | 558 | 90.7 | globlastp |
| 1265 | LAB182 | arabidopsis_lyrata|09v1|JGIAL004937 | 5933 | 559 | 91.9 | globlastp |
| 1266 | LAB183 | arabidopsis_lyrata|09v1|JGIAL012211 | 5934 | 560 | 97.2 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1267 | LAB185 | arabidopsis_lyrata|09v1|JGIAL013760 | 5935 | 561 | 92.1 | globlastp |
| 1268 | LAB185 | canola|10v1|DW999895 | 5936 | 561 | 81.4 | globlastp |
| 1269 | LAB186 | arabidopsis_lyrata|09v1|JGIAL015590 | 5937 | 562 | 97.5 | globlastp |
| 1270 | LAB186 | arabidopsis_lyrata|09v1|JGIAL019152 | 5938 | 562 | 83.3 | globlastp |
| 1271 | LAB186 | arabidopsis|gb165|AT3G58510 | 5939 | 562 | 83.3 | globlastp |
| 1272 | LAB187 | arabidopsis_lyrata|09v1|JGIAL009567 | 5940 | 563 | 94.1 | globlastp |
| 1273 | LAB187 | canola|gb161|H74489 | 5941 | 563 | 81.2 | globlastp |
| 1274 | LAB187 | canola|10v1|CD824785 | 5942 | 563 | 81.2 | globlastp |
| 1275 | LAB187 | canola|gb161|CD824785 | 5943 | 563 | 80.7 | globlastp |
| 1276 | LAB187 | b_rapa|gb162|BG543902 | 5944 | 563 | 80.3 | globlastp |
| 1277 | LAB187 | canola|10v1|CD832364 | 5945 | 563 | 80.2 | globlastp |
| 1278 | LAB187 | canola|gb161|CD832364 | 5945 | 563 | 80.2 | globlastp |
| 1279 | LAB188 | arabidopsis_lyrata|09v1|JGIAL017529 | 5946 | 564 | 96.3 | globlastp |
| 1280 | LAB188 | canola|10v1|CN829728 | 5947 | 564 | 93.1 | globlastp |
| 1281 | LAB188 | canola|10v1|DQ388372 | 5948 | 564 | 92.8 | globlastp |
| 1282 | LAB188 | canola|gb161|DQ388372 | 5949 | 564 | 91.4 | globlastp |
| 1283 | LAB188 | b_rapa|gb162|DN965719 | 5950 | 564 | 87.6 | globlastp |
| 1284 | LAB189 | arabidopsis_lyrata|09v1|JGIAL019157 | 5951 | 565 | 97.7 | globlastp |
| 1285 | LAB191 | arabidopsis_lyrata|09v1|JGIAL028028 | 5952 | 567 | 97.9 | globlastp |
| 1286 | LAB191 | arabidopsis_lyrata|09v1|JGIAL028027 | 5953 | 567 | 91.05 | glotblastn |
| 1287 | LAB191 | canola|10v1|H07767 | 5954 | 567 | 90.62 | glotblastn |
| 1288 | LAB191 | canola|gb161|EV061394 | 5955 | 567 | 90.1 | globlastp |
| 1289 | LAB191 | canola|gb161|EV215362 | 5956 | 567 | 90.1 | globlastp |
| 1290 | LAB191 | radish|gb164|EV526745 | 5957 | 567 | 89.6 | globlastp |
| 1291 | LAB191 | b_rapa|gb162|EX068278 | 5958 | 567 | 89.5 | globlastp |
| 1292 | LAB191 | radish|gb164|EX746054 | 5959 | 567 | 88 | globlastp |
| 1293 | LAB191 | radish|gb164|EV543483 | 5960 | 567 | 84.21 | glotblastn |
| 1294 | LAB195 | brachypodium|09v1|GT845006 | 5961 | 569 | 90.81 | glotblastn |
| 1295 | LAB195 | oat|10v1|GO588363 | 5962 | 569 | 88.24 | glotblastn |
| 1296 | LAB195 | maize|gb170|AI670624 | 5963 | 569 | 84.56 | glotblastn |
| 1297 | LAB195 | rice|gb170|OS09G34910 | 5964 | 569 | 83.82 | glotblastn |
| 1298 | LAB195 | sorghum|09v1|SB02G030210 | 5965 | 569 | 83.82 | glotblastn |
| 1299 | LAB195 | sorghum|gb161.crp|AW282915 | 5965 | 569 | 83.82 | glotblastn |
| 1300 | LAB195 | maize|gb170|AW052938 | 5966 | 569 | 83.46 | glotblastn |
| 1301 | LAB195 | sugarcane|10v1|CA081151 | 5967 | 569 | 83.46 | glotblastn |
| 1302 | LAB195 | sugarcane|gb157.3|CA081151 | 5967 | 569 | 83.46 | glotblastn |
| 1303 | LAB195 | switchgrass|gb167|FE630684 | 5968 | 569 | 83.46 | glotblastn |
| 1304 | LAB197 | wheat|gb164|BE402477 | 5969 | 570 | 96.31 | glotblastn |
| 1305 | LAB197 | pseudoroegneria|gb167|FF344208 | 5970 | 570 | 95.1 | globlastp |
| 1306 | LAB197 | oat|10v1|GR346117 | 5971 | 570 | 86.8 | globlastp |
| 1307 | LAB197 | wheat|gb164|AL818272 | 5972 | 570 | 84.2 | globlastp |
| 1308 | LAB197 | brachypodium|09v1|DV469420 | 5973 | 570 | 82.7 | globlastp |
| 1309 | LAB197 | wheat|gb164|BE427619 | 5974 | 570 | 80.3 | globlastp |
| 1310 | LAB204 | brachypodium|09v1|DV475244 | 571 | 571 | 100 | globlastp |
| 1311 | LAB204 | brachypodium|gb169|BE415626 | 571 | 571 | 100 | globlastp |
| 1312 | LAB204 | wheat|gb164|AL829402 | 571 | 571 | 100 | globlastp |
| 1313 | LAB204 | wheat|gb164|BE415626 | 571 | 571 | 100 | globlastp |
| 1314 | LAB204 | wheat|gb164|BE415779 | 5975 | 571 | 100 | glotblastn |
| 1315 | LAB204 | wheat|gb164|BE493037 | 5976 | 571 | 100 | glotblastn |
| 1316 | LAB204 | wheat|gb164|CA610936 | 5977 | 571 | 100 | glotblastn |
| 1317 | LAB204 | leymus|gb166|AB161676 | 5978 | 571 | 96.4 | globlastp |
| 1318 | LAB204 | rice|gb170|OS05G04700 | 5979 | 571 | 96.4 | globlastp |
| 1319 | LAB204 | wheat|gb164|CA502718 | 5979 | 571 | 96.4 | globlastp |
| 1320 | LAB204 | pseudoroegneria|gb167|FF340236 | 5980 | 571 | 94.5 | globlastp |
| 1321 | LAB204 | nasturtium|10v1|GH164512 | 5981 | 571 | 92.7 | globlastp |
| 1322 | LAB204 | barley|gb157SOLEXA|DN182019 | 5982 | 571 | 90.9 | globlastp |
| 1323 | LAB204 | leymus|gb166|AB161677 | 5983 | 571 | 90.9 | globlastp |
| 1324 | LAB204 | banana|gb167|DN238253 | 5984 | 571 | 89.5 | globlastp |
| 1325 | LAB204 | banana|gb167|FL657642 | 5984 | 571 | 89.5 | globlastp |
| 1326 | LAB204 | orobanche|10v1|SRR023189S0012323 | 5985 | 571 | 89.3 | globlastp |
| 1327 | LAB204 | flax|09v1|CV478078 | 5986 | 571 | 89.1 | globlastp |
| 1328 | LAB204 | millet|09v1|EVO454PM008364 | 5987 | 571 | 89.1 | globlastp |
| 1329 | LAB204 | oat|10v1|GR359931 | 5988 | 571 | 89.1 | globlastp |
| 1330 | LAB204 | flax|gb157.3|CV478078 | 5986 | 571 | 89.1 | globlastp |
| 1331 | LAB204 | switchgrass|gb167|DN145053 | 5989 | 571 | 89.1 | globlastp |
| 1332 | LAB204 | ginger|gb164|DY355348 | 5990 | 571 | 87.7 | globlastp |
| 1333 | LAB204 | poplar|10v1|BI069568 | 5991 | 571 | 87.7 | globlastp |
| 1334 | LAB204 | poplar|gb170|BI069568 | 5992 | 571 | 87.7 | globlastp |
| 1335 | LAB204 | sugarcane|gb157.3|BQ535255 | 5993 | 571 | 87.7 | globlastp |
| 1336 | LAB204 | lovegrass|gb167|DN481436 | 5994 | 571 | 87.5 | globlastp |
| 1337 | LAB204 | sugarcane|gb157.3|BQ534432 | 5995 | 571 | 87.5 | globlastp |
| 1338 | LAB204 | sugarcane|gb157.3|BQ534680 | 5995 | 571 | 87.5 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1339 | LAB204 | sugarcane\|10v1\|BQ535088 | 5995 | 571 | 87.5 | globlastp |
| 1340 | LAB204 | sugarcane\|gb157.3\|BQ535088 | 5995 | 571 | 87.5 | globlastp |
| 1341 | LAB204 | sugarcane\|gb157.3\|CA096029 | 5995 | 571 | 87.5 | globlastp |
| 1342 | LAB204 | sugarcane\|gb157.3\|CA286362 | 5995 | 571 | 87.5 | globlastp |
| 1343 | LAB204 | sugarcane\|gb157.3\|CF576753 | 5996 | 571 | 87.5 | globlastp |
| 1344 | LAB204 | switchgrass\|gb167\|DN150647 | 5997 | 571 | 87.5 | globlastp |
| 1345 | LAB204 | switchgrass\|gb167\|FL772644 | 5998 | 571 | 87.5 | globlastp |
| 1346 | LAB204 | sugarcane\|10v1\|BQ534432 | 5995 | 571 | 87.5 | globlastp |
| 1347 | LAB204 | sugarcane\|10v1\|BQ534516 | 5995 | 571 | 87.5 | globlastp |
| 1348 | LAB204 | triphysaria\|10v1\|SRR023500S0003316 | 5999 | 571 | 87.3 | globlastp |
| 1349 | LAB204 | triphysaria\|10v1\|SRR023500S0037696 | 5999 | 571 | 87.3 | globlastp |
| 1350 | LAB204 | rye\|gb164\|BF145228 | 6000 | 571 | 87.3 | globlastp |
| 1351 | LAB204 | spurge\|gb161\|DV123416 | 6001 | 571 | 87.3 | globlastp |
| 1352 | LAB204 | canola\|gb161\|ES902627 | 6002 | 571 | 87.27 | glotblastn |
| 1353 | LAB204 | cryptomeria\|gb166\|BJ937299 | 6003 | 571 | 87.27 | glotblastn |
| 1354 | LAB204 | spurge\|gb161\|DV112180 | 6004 | 571 | 87.27 | glotblastn |
| 1355 | LAB204 | banana\|gb167\|DN239184 | 6005 | 571 | 86 | globlastp |
| 1356 | LAB204 | eucalyptus\|gb166\|CD668637 | 6006 | 571 | 85.5 | globlastp |
| 1357 | LAB204 | liriodendron\|gb166\|CK747388 | 6007 | 571 | 85.5 | globlastp |
| 1358 | LAB204 | lotus\|09v1\|CB828766 | 6008 | 571 | 85.5 | globlastp |
| 1359 | LAB204 | lotus\|gb157.2\|CB828766 | 6008 | 571 | 85.5 | globlastp |
| 1360 | LAB204 | medicago\|09v1\|BE323170 | 6009 | 571 | 85.5 | globlastp |
| 1361 | LAB204 | medicago\|gb157.2\|BE323170 | 6009 | 571 | 85.5 | globlastp |
| 1362 | LAB204 | spruce\|gb162\|CO215808 | 6010 | 571 | 85.5 | globlastp |
| 1363 | LAB204 | cryptomeria\|gb166\|BB940612 | 6011 | 571 | 85.45 | glotblastn |
| 1364 | LAB204 | cryptomeria\|gb166\|BP173716 | 6012 | 571 | 85.45 | glotblastn |
| 1365 | LAB204 | spruce\|gb162\|CO241929 | 6013 | 571 | 85.45 | glotblastn |
| 1366 | LAB204 | spruce\|gb162\|EX402169 | 6014 | 571 | 85.45 | glotblastn |
| 1367 | LAB204 | citrus\|gb166\|CB610761 | 6015 | 571 | 84.5 | globlastp |
| 1368 | LAB204 | citrus\|gb166\|CX635312 | 6015 | 571 | 84.5 | globlastp |
| 1369 | LAB204 | maize\|gb170\|LLT23394 | 6016 | 571 | 84.5 | globlastp |
| 1370 | LAB204 | maize\|gb170\|T14760 | 6016 | 571 | 84.5 | globlastp |
| 1371 | LAB204 | banana\|gb167\|FF560276 | 6017 | 571 | 84.2 | globlastp |
| 1372 | LAB204 | liquorice\|gb171\|FS240532 | 6018 | 571 | 84.2 | globlastp |
| 1373 | LAB204 | salvia\|10v1\|CV163287 | 6019 | 571 | 83.9 | globlastp |
| 1374 | LAB204 | maize\|gb170\|AI396387 | 6020 | 571 | 83.9 | globlastp |
| 1375 | LAB204 | millet\|09v1\|AY823549 | 6021 | 571 | 83.9 | globlastp |
| 1376 | LAB204 | millet\|gb161\|AY823549 | 6021 | 571 | 83.9 | globlastp |
| 1377 | LAB204 | wheat\|gb164\|CA486803 | 6022 | 571 | 83.9 | globlastp |
| 1378 | LAB204 | monkeyflower\|10v1\|SRR037228S0018011 | 6023 | 571 | 83.64 | glotblastn |
| 1379 | LAB204 | nasturtium\|10v1\|SRR032558S0000444 | 6024 | 571 | 83.64 | glotblastn |
| 1380 | LAB204 | lettuce\|gb157.2\|DW048006 | 6025 | 571 | 83.64 | glotblastn |
| 1381 | LAB204 | peanut\|gb171\|CX128241 | 6026 | 571 | 83.64 | glotblastn |
| 1382 | LAB204 | spruce\|gb162\|CO222473 | 6027 | 571 | 83.64 | glotblastn |
| 1383 | LAB204 | spruce\|gb162\|DR510117 | 6028 | 571 | 83.64 | glotblastn |
| 1384 | LAB204 | wheat\|gb164\|CA484233 | 6029 | 571 | 83.64 | glotblastn |
| 1385 | LAB204 | cichorium\|gb171\|EL369595 | — | 571 | 83.64 | glotblastn |
| 1386 | LAB204 | chickpea\|09v2\|FE672441 | 6030 | 571 | 83.6 | globlastp |
| 1387 | LAB204 | banana\|gb167\|FF558319 | 6031 | 571 | 83.6 | globlastp |
| 1388 | LAB204 | poplar\|10v1\|BI122249 | 6032 | 571 | 83.6 | globlastp |
| 1389 | LAB204 | poplar\|gb170\|BI122249 | 6032 | 571 | 83.6 | globlastp |
| 1390 | LAB204 | poplar\|10v1\|BU811582 | 6033 | 571 | 83.6 | globlastp |
| 1391 | LAB204 | poplar\|gb170\|BU811582 | 6033 | 571 | 83.6 | globlastp |
| 1392 | LAB204 | lettuce\|10v1\|DW048006 | 6034 | 571 | 83.6 | globlastp |
| 1393 | LAB204 | cucumber\|09v1\|EB715890 | 6035 | 571 | 82.5 | globlastp |
| 1394 | LAB204 | barley\|gb157SOLEXA\|BE413132 | 6036 | 571 | 82.5 | globlastp |
| 1395 | LAB204 | barley\|10v1\|BE413132 | 6036 | 571 | 82.5 | globlastp |
| 1396 | LAB204 | barley\|gb157SOLEXA\|BF257032 | 6036 | 571 | 82.5 | globlastp |
| 1397 | LAB204 | bean\|gb167\|CV540757 | 6037 | 571 | 82.5 | globlastp |
| 1398 | LAB204 | beech\|gb170\|SRR006293S0011201 | 6038 | 571 | 82.5 | globlastp |
| 1399 | LAB204 | chestnut\|gb170\|SRR006295S0007559 | 6039 | 571 | 82.5 | globlastp |
| 1400 | LAB204 | chestnut\|gb170\|SRR006295S0017671 | 6039 | 571 | 82.5 | globlastp |
| 1401 | LAB204 | eucalyptus\|gb166\|CD668872 | 6040 | 571 | 82.5 | globlastp |
| 1402 | LAB204 | kiwi\|gb166\|FG437405 | 6041 | 571 | 82.5 | globlastp |
| 1403 | LAB204 | oak\|gb170\|CU639520 | 6039 | 571 | 82.5 | globlastp |
| 1404 | LAB204 | sorghum\|09v1\|SB09G003060 | 6042 | 571 | 82.5 | globlastp |
| 1405 | LAB204 | sorghum\|gb161.crp\|CD231944 | 6042 | 571 | 82.5 | globlastp |
| 1406 | LAB204 | soybean\|gb168\|BE323170 | 6043 | 571 | 82.5 | globlastp |
| 1407 | LAB204 | sugarcane\|gb157.3\|BQ536812 | 6044 | 571 | 82.5 | globlastp |
| 1408 | LAB204 | walnuts\|gb166\|EL894694 | 6045 | 571 | 82.5 | globlastp |
| 1409 | LAB204 | wheat\|gb164\|BE418414 | 6036 | 571 | 82.5 | globlastp |
| 1410 | LAB204 | wheat\|gb164\|BE637945 | 6046 | 571 | 82.46 | glotblastn |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1411 | LAB204 | wheat\|gb164\|BE425311 | 6047 | 571 | 82.46 | glotblastn |
| 1412 | LAB204 | flax\|09v1\|EU830057 | 6048 | 571 | 82.1 | globlastp |
| 1413 | LAB204 | rhizophora\|10v1\|SRR005792S0007548 | 6049 | 571 | 82.1 | globlastp |
| 1414 | LAB204 | salvia\|10v1\|SRR014553S0009878 | 6050 | 571 | 82.1 | globlastp |
| 1415 | LAB204 | bruguiera\|gb166\|BP940238 | 6051 | 571 | 82.1 | globlastp |
| 1416 | LAB204 | catharanthus\|gb166\|EG560916 | 6052 | 571 | 82.1 | globlastp |
| 1417 | LAB204 | cenchrus\|gb166\|BM084728 | 6053 | 571 | 82.1 | globlastp |
| 1418 | LAB204 | millet\|09v1\|CD724750 | 6054 | 571 | 82.1 | globlastp |
| 1419 | LAB204 | millet\|gb161\|CD726612 | 6054 | 571 | 82.1 | globlastp |
| 1420 | LAB204 | rice\|gb170\|OS07G44180 | 6055 | 571 | 82.1 | globlastp |
| 1421 | LAB204 | sugarcane\|10v1\|BQ537279 | 6056 | 571 | 82.1 | globlastp |
| 1422 | LAB204 | sugarcane\|gb157.3\|BQ537279 | 6056 | 571 | 82.1 | globlastp |
| 1423 | LAB204 | sugarcane\|10v1\|CA155635 | 6056 | 571 | 82.1 | globlastp |
| 1424 | LAB204 | sugarcane\|gb157.3\|CA155635 | 6056 | 571 | 82.1 | globlastp |
| 1425 | LAB204 | switchgrass\|gb167\|DN143186 | 6057 | 571 | 82.1 | globlastp |
| 1426 | LAB204 | switchgrass\|gb167\|DN151023 | 6057 | 571 | 82.1 | globlastp |
| 1427 | LAB204 | switchgrass\|gb167\|FE629432 | 6057 | 571 | 82.1 | globlastp |
| 1428 | LAB204 | switchgrass\|gb167\|FL986616 | 6058 | 571 | 82.1 | globlastp |
| 1429 | LAB204 | artemisia\|10v1\|ES582125 | 6059 | 571 | 81.82 | glotblastn |
| 1430 | LAB204 | sugarcane\|10v1\|DV731065 | 6060 | 571 | 81.82 | glotblastn |
| 1431 | LAB204 | artemisia\|gb164\|ES582125 | 6061 | 571 | 81.82 | glotblastn |
| 1432 | LAB204 | fescue\|gb161\|DT678660 | 6062 | 571 | 81.82 | glotblastn |
| 1433 | LAB204 | maize\|gb170\|AI855258 | 6063 | 571 | 81.82 | glotblastn |
| 1434 | LAB204 | maize\|gb170\|CD990565 | 6060 | 571 | 81.82 | glotblastn |
| 1435 | LAB204 | pine\|10v1\|BG319022 | 6064 | 571 | 81.82 | glotblastn |
| 1436 | LAB204 | pine\|gb157.2\|BG319022 | 6064 | 571 | 81.82 | glotblastn |
| 1437 | LAB204 | rice\|gb170\|CB678398 | 6065 | 571 | 81.82 | glotblastn |
| 1438 | LAB204 | sorghum\|09v1\|SB03G011700 | 6060 | 571 | 81.82 | glotblastn |
| 1439 | LAB204 | sorghum\|gb161.crp\|AW564566 | 6060 | 571 | 81.82 | glotblastn |
| 1440 | LAB204 | strawberry\|gb164\|CO378683 | 6066 | 571 | 81.82 | glotblastn |
| 1441 | LAB204 | wheat\|gb164\|CA618246 | 6067 | 571 | 81.82 | glotblastn |
| 1442 | LAB204 | artemisia\|10v1\|GW331462 | 6068 | 571 | 81.8 | globlastp |
| 1443 | LAB204 | ginseng\|10v1\|GR873554 | 6069 | 571 | 81.8 | globlastp |
| 1444 | LAB204 | sorghum\|09v1\|SB09G003050 | 6070 | 571 | 81.8 | globlastp |
| 1445 | LAB204 | clover\|gb162\|BB909236 | 6071 | 571 | 81.8 | globlastp |
| 1446 | LAB204 | fescue\|gb161\|DT679002 | 6072 | 571 | 81.8 | globlastp |
| 1447 | LAB204 | lettuce\|10v1\|DW078717 | 6073 | 571 | 81.8 | globlastp |
| 1448 | LAB204 | lettuce\|gb157.2\|DW078717 | 6073 | 571 | 81.8 | globlastp |
| 1449 | LAB204 | sugarcane\|gb157.3\|BQ534516 | 6070 | 571 | 81.8 | globlastp |
| 1450 | LAB204 | sugarcane\|10v1\|BQ535033 | 6070 | 571 | 81.8 | globlastp |
| 1451 | LAB204 | sugarcane\|gb157.3\|BQ534594 | 6070 | 571 | 81.8 | globlastp |
| 1452 | LAB204 | walnuts\|gb166\|CB303483 | 6074 | 571 | 81.4 | globlastp |
| 1453 | LAB204 | walnuts\|gb166\|EL895529 | 6074 | 571 | 81.4 | globlastp |
| 1454 | LAB204 | heritiera\|10v1\|SRR005794S0002184 | 6075 | 571 | 80.7 | globlastp |
| 1455 | LAB204 | jatropha\|09v1\|GO246525 | 6076 | 571 | 80.7 | globlastp |
| 1456 | LAB204 | oat\|10v1\|CN821388 | 6077 | 571 | 80.7 | globlastp |
| 1457 | LAB204 | barley\|gb157SOLEXA\|BF253394 | 6078 | 571 | 80.7 | globlastp |
| 1458 | LAB204 | brachypodium\|09v1\|DV482704 | 6077 | 571 | 80.7 | globlastp |
| 1459 | LAB204 | brachypodium\|gb169\|BE413132 | 6077 | 571 | 80.7 | globlastp |
| 1460 | LAB204 | cassava\|09v1\|DR086796 | 6079 | 571 | 80.7 | globlastp |
| 1461 | LAB204 | cassava\|gb164\|DR086796 | 6079 | 571 | 80.7 | globlastp |
| 1462 | LAB204 | citrus\|gb166\|CB290651 | 6080 | 571 | 80.7 | glotblastn |
| 1463 | LAB204 | cotton\|gb164\|BE055465 | 6081 | 571 | 80.7 | glotblastn |
| 1464 | LAB204 | cowpea\|gb166\|FF390328 | 6082 | 571 | 80.7 | globlastp |
| 1465 | LAB204 | cowpea\|gb166\|FG844338 | 6083 | 571 | 80.7 | globlastp |
| 1466 | LAB204 | melon\|gb165\|EB715890 | 6084 | 571 | 80.7 | globlastp |
| 1467 | LAB204 | oat\|10v1\|CN816104 | 6077 | 571 | 80.7 | globlastp |
| 1468 | LAB204 | oat\|gb164\|CN816104 | 6085 | 571 | 80.7 | glotblastn |
| 1469 | LAB204 | rye\|gb164\|BE587105 | 6086 | 571 | 80.7 | glotblastn |
| 1470 | LAB204 | gerbera\|09v1\|AJ750828 | 6087 | 571 | 80.4 | globlastp |
| 1471 | LAB204 | ginseng\|10v1\|GR874639 | 6088 | 571 | 80.4 | globlastp |
| 1472 | LAB204 | tragopogon\|10v1\|SRR020205S0037758 | 6089 | 571 | 80.4 | globlastp |
| 1473 | LAB204 | castorbean\|09v1\|EE258813 | 6090 | 571 | 80.4 | globlastp |
| 1474 | LAB204 | castorbean\|gb160\|EE258813 | 6090 | 571 | 80.4 | globlastp |
| 1475 | LAB204 | nuphar\|gb166\|CD475184 | 6091 | 571 | 80.4 | globlastp |
| 1476 | LAB204 | peanut\|gb171\|CD037685 | 6092 | 571 | 80.4 | globlastp |
| 1477 | LAB204 | switchgrass\|gb167\|FL876572 | 6093 | 571 | 80.4 | globlastp |
| 1478 | LAB204 | medicago\|09v1\|LLCO512569 | 6094 | 571 | 80 | globlastp |
| 1479 | LAB204 | pine\|10v1\|BF778634 | 6095 | 571 | 80 | glotblastn |
| 1480 | LAB204 | b_oleracea\|gb161\|AM059255 | 6096 | 571 | 80 | globlastp |
| 1481 | LAB204 | centaurea\|gb166\|EH738262 | 6097 | 571 | 80 | globlastp |
| 1482 | LAB204 | chestnut\|gb170\|SRR006296S0016630 | 6098 | 571 | 80 | glotblastn |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1483 | LAB204 | lettuce\|gb157.2\|DW121013 | 6099 | 571 | 80 | globlastp |
| 1484 | LAB204 | lettuce\|10v1\|DW146833 | 6097 | 571 | 80 | globlastp |
| 1485 | LAB204 | lettuce\|gb157.2\|DW146833 | 6097 | 571 | 80 | globlastp |
| 1486 | LAB204 | lovegrass\|gb167\|DN481408 | 6100 | 571 | 80 | glotblastn |
| 1487 | LAB204 | lovegrass\|gb167\|EH186434 | 6101 | 571 | 80 | glotblastn |
| 1488 | LAB204 | maize\|gb170\|LLCD940855 | 6102 | 571 | 80 | glotblastn |
| 1489 | LAB204 | pine\|gb157.2\|BF778634 | 6103 | 571 | 80 | glotblastn |
| 1490 | LAB204 | pine\|10v1\|CR393204 | 6104 | 571 | 80 | glotblastn |
| 1491 | LAB204 | pine\|gb157.2\|CR393204 | 6104 | 571 | 80 | glotblastn |
| 1492 | LAB204 | prunus\|gb167\|BU040273 | 6105 | 571 | 80 | glotblastn |
| 1493 | LAB204 | prunus\|gb167\|CB819364 | 6106 | 571 | 80 | glotblastn |
| 1494 | LAB204 | safflower\|gb162\|EL402061 | 6107 | 571 | 80 | glotblastn |
| 1495 | LAB204 | spruce\|gb162\|CO490368 | 6108 | 571 | 80 | globlastp |
| 1496 | LAB204 | sunflower\|gb162\|CD853978 | 6109 | 571 | 80 | glotblastn |
| 1497 | LAB204 | sunflower\|gb162\|DY954887 | 6109 | 571 | 80 | glotblastn |
| 1498 | LAB204 | sunflower\|gb162\|EE655129 | 6110 | 571 | 80 | glotblastn |
| 1499 | LAB204 | switchgrass\|gb167\|FE644351 | 6111 | 571 | 80 | glotblastn |
| 1500 | LAB210 | barley\|10v1\|BE412504 | 6112 | 574 | 84.1 | globlastp |
| 1501 | LAB210 | wheat\|gb164\|BQ788771 | 6113 | 574 | 82.2 | globlastp |
| 1502 | LAB210 | oat\|10v1\|GO587376 | 6114 | 574 | 80.7 | globlastp |
| 1503 | LAB211 | pseudoroegneria\|gb167\|FF348619 | 6115 | 575 | 95.6 | globlastp |
| 1504 | LAB211 | wheat\|gb164\|BE413647 | 6116 | 575 | 95.1 | globlastp |
| 1505 | LAB211 | brachypodium\|09v1\|GT809811 | 6117 | 575 | 86.6 | globlastp |
| 1506 | LAB211 | brachypodium\|gb169\|BE413647 | 6118 | 575 | 86.1 | glotblastn |
| 1507 | LAB211 | switchgrass\|gb167\|FE632800 | 6119 | 575 | 84.8 | globlastp |
| 1508 | LAB211 | cenchrus\|gb166\|EB654815 | 6120 | 575 | 84.7 | globlastp |
| 1509 | LAB211 | sorghum\|09v1\|SB09G022810 | 6121 | 575 | 84.7 | globlastp |
| 1510 | LAB211 | maize\|gb170\|BM332575 | 6122 | 575 | 84.2 | globlastp |
| 1511 | LAB211 | sorghum\|gb161.crp\|BE356560 | 6123 | 575 | 84.2 | globlastp |
| 1512 | LAB211 | maize\|gb170\|T15302 | 6124 | 575 | 83.7 | globlastp |
| 1513 | LAB211 | rice\|gb170\|OS05G38820 | 6125 | 575 | 81.58 | glotblastn |
| 1514 | LAB212 | leymus\|gb166\|EG375667 | 6126 | 576 | 94.2 | globlastp |
| 1515 | LAB212 | wheat\|gb164\|BE515978 | 6127 | 576 | 94 | globlastp |
| 1516 | LAB212 | pseudoroegneria\|gb167\|FF352847 | 6128 | 576 | 93.5 | globlastp |
| 1517 | LAB212 | wheat\|gb164\|BE429733 | 6129 | 576 | 92.7 | globlastp |
| 1518 | LAB212 | wheat\|gb164\|BE427710 | 6130 | 576 | 88.9 | globlastp |
| 1519 | LAB212 | brachypodium\|09v1\|DV478766 | 6131 | 576 | 88.3 | globlastp |
| 1520 | LAB212 | brachypodium\|gb169\|BG418029 | 6132 | 576 | 88 | globlastp |
| 1521 | LAB212 | switchgrass\|gb167\|FE619498 | 6133 | 576 | 85.2 | globlastp |
| 1522 | LAB212 | switchgrass\|gb167\|DN142544 | 6134 | 576 | 84.6 | globlastp |
| 1523 | LAB212 | maize\|gb170\|AW066846 | 6135 | 576 | 82.9 | globlastp |
| 1524 | LAB212 | sorghum\|gb161.crp\|AW679903 | 6136 | 576 | 82.7 | globlastp |
| 1525 | LAB212 | sorghum\|09v1\|SB10G027540 | 6136 | 576 | 82.7 | globlastp |
| 1526 | LAB212 | sugarcane\|10v1\|CA110713 | 6137 | 576 | 81.9 | globlastp |
| 1527 | LAB212 | sugarcane\|gb157.3\|CA110713 | 6137 | 576 | 81.9 | globlastp |
| 1528 | LAB217 | cotton\|gb164\|AI725612 | 6138 | 578 | 82.6 | globlastp |
| 1529 | LAB217 | clover\|gb162\|BB907588 | 6139 | 578 | 82.58 | glotblastn |
| 1530 | LAB217 | papaya\|gb165\|EX275064 | 6140 | 578 | 82.58 | glotblastn |
| 1531 | LAB217 | bean\|gb167\|CA902400 | 6141 | 578 | 82.1 | globlastp |
| 1532 | LAB217 | medicago\|09v1\|AW775623 | 6142 | 578 | 82.02 | glotblastn |
| 1533 | LAB217 | chestnut\|gb170\|SRR006295S0010554 | 6143 | 578 | 81.46 | glotblastn |
| 1534 | LAB217 | melon\|gb165\|AM714820 | 6144 | 578 | 81.46 | glotblastn |
| 1535 | LAB217 | poplar\|gb170\|CV243355 | 6145 | 578 | 81.11 | glotblastn |
| 1536 | LAB217 | cucumber\|09v1\|CO995825 | 6146 | 578 | 80.9 | glotblastn |
| 1537 | LAB217 | prunus\|gb167\|AJ823322 | 6147 | 578 | 80.9 | globlastp |
| 1538 | LAB217 | poplar\|10v1\|CV243355 | 6148 | 578 | 80.7 | globlastp |
| 1539 | LAB217 | spurge\|gb161\|DV112896 | 6149 | 578 | 80.56 | glotblastn |
| 1540 | LAB217 | lotus\|09v1\|AV420653 | 6150 | 578 | 80.45 | glotblastn |
| 1541 | LAB217 | medicago\|gb157.2\|AW775623 | 6151 | 578 | 80.4 | globlastp |
| 1542 | LAB217 | soybean\|gb168\|BI970816 | 6152 | 578 | 80.4 | globlastp |
| 1543 | LAB217 | soybean\|gb168\|CA902400 | 6153 | 578 | 80.4 | globlastp |
| 1544 | LAB217 | tobacco\|gb162\|EB444355 | 6154 | 578 | 80.22 | glotblastn |
| 1545 | LAB220 | switchgrass\|gb167\|DN147462 | 6155 | 580 | 80.6 | globlastp |
| 1546 | LAB225 | sugarcane\|10v1\|BQ535168 | 6156 | 584 | 86.4 | globlastp |
| 1547 | LAB225 | sorghum\|09v1\|SB03G033040 | 6157 | 584 | 86.1 | globlastp |
| 1548 | LAB225 | sorghum\|gb161.crp\|AW331066 | 6157 | 584 | 86.1 | globlastp |
| 1549 | LAB225 | millet\|09v1\|EVO454PM001578 | 6158 | 584 | 85.8 | globlastp |
| 1550 | LAB225 | switchgrass\|gb167\|DN144268 | 6159 | 584 | 85.4 | globlastp |
| 1551 | LAB225 | switchgrass\|gb167\|FE640178 | 6160 | 584 | 85.4 | globlastp |
| 1552 | LAB225 | maize\|gb170\|T15331 | 6161 | 584 | 85.1 | globlastp |
| 1553 | LAB225 | brachypodium\|09v1\|DV469255 | 6162 | 584 | 82.5 | globlastp |
| 1554 | LAB225 | wheat\|gb164\|BE406587 | 6163 | 584 | 82.1 | globlastp |

TABLE 54-continued

Homologues of the identified genes/polypeptides for increasing abiotic stress
tolerance, water use efficiency, yield, growth rate, vigor, oil content, biomass, growth
rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1555 | LAB225 | brachypodium\|gb169\|BE406587 | 6164 | 584 | 81.46 | glotblastn |
| 1556 | LAB225 | wheat\|gb164\|BE497128 | 6165 | 584 | 80.8 | globlastp |
| 1557 | LAB225 | barley\|10v1\|BI950307 | 6166 | 584 | 80.5 | globlastp |
| 1558 | LAB225 | barley\|gb157SOLEXA\|AL505025 | 6166 | 584 | 80.5 | globlastp |
| 1559 | LAB228 | brachypodium\|09v1\|DV470077 | 6167 | 585 | 87.9 | globlastp |
| 1560 | LAB228 | sorghum\|gb161.crp\|BM325428 | 6168 | 585 | 87.8 | globlastp |
| 1561 | LAB228 | maize\|gb170\|AW267639 | 6169 | 585 | 87.6 | globlastp |
| 1562 | LAB228 | switchgrass\|gb167\|FE615121 | 6170 | 585 | 87.02 | glotblastn |
| 1563 | LAB228 | barley\|gb157SOLEXA\|BE412583 | 6171 | 585 | 85.6 | globlastp |
| 1564 | LAB228 | oat\|10v1\|CN818930 | 6172 | 585 | 85.2 | globlastp |
| 1565 | LAB231 | sorghum\|09v1\|SB03G043730 | 6173 | 588 | 90.1 | globlastp |
| 1566 | LAB231 | sorghum\|gb161.crp\|AW677963 | 6173 | 588 | 90.1 | globlastp |
| 1567 | LAB231 | brachypodium\|09v1\|GT814580 | 6174 | 588 | 88.4 | globlastp |
| 1568 | LAB231 | maize\|gb170\|BE638867 | 6175 | 588 | 88.3 | globlastp |
| 1569 | LAB231 | barley\|10v1\|AV834675 | 6176 | 588 | 87.6 | globlastp |
| 1570 | LAB231 | brachypodium\|gb169\|BE591738 | 6177 | 588 | 87.33 | glotblastn |
| 1571 | LAB231 | maize\|gb170\|AW171971 | 6178 | 588 | 86.3 | globlastp |
| 1572 | LAB233 | brachypodium\|09v1\|TMPLOS01G68810T1 | 6179 | 590 | 99.4 | globlastp |
| 1573 | LAB233 | brachypodium\|09v1\|GT772015 | 6180 | 590 | 82.3 | globlastp |
| 1574 | LAB233 | brachypodium\|09v1\|DV478709 | 6181 | 590 | 82.01 | glotblastn |
| 1575 | LAB233 | sorghum\|09v1\|SB03G043780 | 6182 | 590 | 80 | globlastp |
| 1576 | LAB235 | oat\|10v1\|BE439122 | 6183 | 592 | 83.8 | globlastp |
| 1577 | LAB235 | wheat\|gb164\|BE419355 | 6184 | 592 | 83.7 | globlastp |
| 1578 | LAB235 | barley\|10v1\|BI946772 | 6185 | 592 | 83.5 | globlastp |
| 1579 | LAB235 | barley\|gb157SOLEXA\|BI946772 | 6185 | 592 | 83.5 | globlastp |
| 1580 | LAB235 | switchgrass\|gb167\|DN146646 | 6186 | 592 | 82.8 | globlastp |
| 1581 | LAB235 | brachypodium\|09v1\|DV486036 | 6187 | 592 | 82.7 | globlastp |
| 1582 | LAB235 | sorghum\|09v1\|SB03G043810 | 6188 | 592 | 81.9 | globlastp |
| 1583 | LAB235 | sorghum\|gb161.crp\|AW745048 | 6188 | 592 | 81.9 | globlastp |
| 1584 | LAB235 | sugarcane\|10v1\|CA081661 | 6189 | 592 | 81.2 | globlastp |
| 1585 | LAB235 | sugarcane\|gb157.3\|CA081661 | 6190 | 592 | 81.2 | globlastp |
| 1586 | LAB235 | maize\|gb170\|AI372227 | 6191 | 592 | 80 | glotblastn |
| 1587 | LAB237 | brachypodium\|09v1\|DV474202 | 6192 | 594 | 86.8 | globlastp |
| 1588 | LAB237 | sorghum\|09v1\|SB04G021410 | 6193 | 594 | 85.3 | globlastp |
| 1589 | LAB237 | maize\|gb170\|AW787360 | 6194 | 594 | 82.2 | globlastp |
| 1590 | LAB237 | sorghum\|gb161.crp\|BE345738 | 6195 | 594 | 82.1 | globlastp |
| 1591 | LAB237 | oat\|10v1\|CN816886 | 6196 | 594 | 81.2 | globlastp |
| 1592 | LAB238 | brachypodium\|09v1\|GT767992 | 6197 | 595 | 91.7 | globlastp |
| 1593 | LAB238 | brachypodium\|gb169\|BE406876 | 6197 | 595 | 91.7 | globlastp |
| 1594 | LAB238 | fescue\|gb161\|DT675438 | 6198 | 595 | 90.5 | globlastp |
| 1595 | LAB238 | leymus\|gb166\|EG393183 | 6199 | 595 | 90.2 | globlastp |
| 1596 | LAB238 | maize\|gb170\|AI438615 | 6200 | 595 | 89.8 | globlastp |
| 1597 | LAB238 | sugarcane\|10v1\|CA087915 | 6201 | 595 | 89.8 | globlastp |
| 1598 | LAB238 | sorghum\|09v1\|SB04G027590 | 6202 | 595 | 89.5 | globlastp |
| 1599 | LAB238 | sorghum\|gb161.crp\|AI920758 | 6202 | 595 | 89.5 | globlastp |
| 1600 | LAB238 | sugarcane\|gb157.3\|CA141903 | 6203 | 595 | 89.5 | globlastp |
| 1601 | LAB238 | pseudoroegneria\|gb167\|FF346705 | 6204 | 595 | 88.6 | globlastp |
| 1602 | LAB238 | barley\|gb157SOLEXA\|BE412737 | 6205 | 595 | 87.9 | globlastp |
| 1603 | LAB238 | oat\|10v1\|CN820263 | 6206 | 595 | 87.6 | globlastp |
| 1604 | LAB238 | wheat\|gb164\|BE415762 | 6207 | 595 | 87.3 | globlastp |
| 1605 | LAB238 | wheat\|gb164\|BE406876 | 6208 | 595 | 86.7 | globlastp |
| 1606 | LAB238 | barley\|10v1\|BE412737 | 6209 | 595 | 85.99 | glotblastn |
| 1607 | LAB238 | brachypodium\|09v1\|GT792040 | 6210 | 595 | 84.1 | globlastp |
| 1608 | LAB238 | brachypodium\|gb169\|BE445674 | 6210 | 595 | 84.1 | globlastp |
| 1609 | LAB238 | sugarcane\|gb157.3\|BQ536599 | 6211 | 595 | 84.1 | globlastp |
| 1610 | LAB238 | sorghum\|gb161.crp\|AW091473 | 6212 | 595 | 84.1 | globlastp |
| 1611 | LAB238 | rice\|gb170\|OS06G11800 | 6213 | 595 | 83.9 | globlastp |
| 1612 | LAB238 | sorghum\|09v1\|SB10G007760 | 6214 | 595 | 83.8 | globlastp |
| 1613 | LAB238 | maize\|gb170\|AW091473 | 6215 | 595 | 83.4 | globlastp |
| 1614 | LAB238 | switchgrass\|gb167\|DN144426 | 6216 | 595 | 83.1 | globlastp |
| 1615 | LAB238 | oat\|10v1\|GR344417 | 6217 | 595 | 81.2 | globlastp |
| 1616 | LAB238 | barley\|10v1\|BI947155 | 6218 | 595 | 81.2 | globlastp |
| 1617 | LAB238 | barley\|gb157SOLEXA\|AL450690 | 6218 | 595 | 81.2 | globlastp |
| 1618 | LAB238 | pseudoroegneria\|gb167\|FF341263 | 6219 | 595 | 81.2 | globlastp |
| 1619 | LAB238 | leymus\|gb166\|EG374932 | 6220 | 595 | 80.3 | globlastp |
| 1620 | LAB240 | switchgrass\|gb167\|DN142418 | 6221 | 596 | 85.5 | globlastp |
| 1621 | LAB240 | sorghum\|09v1\|SB01G047500 | 6222 | 596 | 84.5 | globlastp |
| 1622 | LAB240 | sorghum\|gb161.crp\|AW621098 | 6222 | 596 | 84.5 | globlastp |
| 1623 | LAB240 | maize\|gb170\|AW061639 | 6223 | 596 | 84 | globlastp |
| 1624 | LAB240 | wheat\|gb164\|BE498578 | 6224 | 596 | 80.2 | globlastp |
| 1625 | LAB252 | brachypodium\|09v1\|DV469506 | 6225 | 603 | 89.6 | globlastp |
| 1626 | LAB252 | brachypodium\|gb169\|DT715392 | 6226 | 603 | 85 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1627 | LAB254 | brachypodium\|gb169\|CA679165 | 6227 | 605 | 84.3 | globlastp |
| 1628 | LAB254 | rice\|gb170\|OS09G27930 | 6228 | 605 | 83 | globlastp |
| 1629 | LAB254 | barley\|gb157SOLEXA\|BI948415 | 6229 | 605 | 82.14 | glotblastn |
| 1630 | LAB254 | wheat\|gb164\|CJ655025 | 6230 | 605 | 82.1 | globlastp |
| 1631 | LAB254 | barley\|gb157SOLEXA\|BI952431 | 6231 | 605 | 81.43 | glotblastn |
| 1632 | LAB254 | barley\|10v1\|BI948415 | 6232 | 605 | 81 | globlastp |
| 1633 | LAB254 | brachypodium\|09v1\|GT778632 | 6233 | 605 | 80.85 | glotblastn |
| 1634 | LAB254 | sorghum\|09v1\|SB02G032360 | 6234 | 605 | 80.4 | globlastp |
| 1635 | LAB254 | wheat\|gb164\|AL830764 | 6235 | 605 | 80.14 | glotblastn |
| 1636 | LAB254 | rice\|gb170\|OS07G30640 | 6236 | 605 | 80 | globlastp |
| 1637 | LAB259 | switchgrass\|gb167\|FE633179 | 6237 | 608 | 84.2 | globlastp |
| 1638 | LAB259 | maize\|gb170\|AI491620 | 6238 | 608 | 83.7 | globlastp |
| 1639 | LAB259 | switchgrass\|gb167\|FE658096 | 6239 | 608 | 83.6 | globlastp |
| 1640 | LAB259 | brachypodium\|09v1\|SRR031795S0049444 | 6240 | 608 | 83.3 | globlastp |
| 1641 | LAB259 | brachypodium\|gb169\|BE488380 | 6241 | 608 | 82.7 | globlastp |
| 1642 | LAB259 | cenchrus\|gb166\|EB653342 | 6242 | 608 | 82.7 | globlastp |
| 1643 | LAB259 | pseudoroegneria\|gb167\|FF343851 | 6243 | 608 | 82.6 | globlastp |
| 1644 | LAB259 | sorghum\|gb161.crp\|BE594723 | 6244 | 608 | 82.6 | globlastp |
| 1645 | LAB259 | wheat\|gb164\|BE400850 | 6245 | 608 | 82.49 | glotblastn |
| 1646 | LAB259 | sugarcane\|gb157.3\|CA099266 | 6246 | 608 | 82.27 | glotblastn |
| 1647 | LAB259 | wheat\|gb164\|BE497098 | 6247 | 608 | 82.21 | glotblastn |
| 1648 | LAB259 | oat\|10v1\|GO582575 | 6248 | 608 | 82.2 | globlastp |
| 1649 | LAB259 | barley\|10v1\|BF622384 | 6249 | 608 | 81.14 | glotblastn |
| 1650 | LAB261 | sorghum\|09v1\|SB01G021890 | 6250 | 610 | 96.8 | globlastp |
| 1651 | LAB261 | sorghum\|gb161.crp\|AA979985 | 6250 | 610 | 96.8 | globlastp |
| 1652 | LAB261 | maize\|gb170\|AA979985 | 6251 | 610 | 96.6 | globlastp |
| 1653 | LAB261 | sugarcane\|10v1\|CA089729 | 6252 | 610 | 96.6 | globlastp |
| 1654 | LAB261 | sugarcane\|gb157.3\|CA089729 | 6253 | 610 | 96.3 | globlastp |
| 1655 | LAB261 | switchgrass\|gb167\|FE613678 | 6254 | 610 | 96.3 | globlastp |
| 1656 | LAB261 | switchgrass\|gb167\|FE612491 | 6255 | 610 | 96.1 | globlastp |
| 1657 | LAB261 | millet\|09v1\|EVO454PM012321 | 6256 | 610 | 95.3 | globlastp |
| 1658 | LAB261 | brachypodium\|09v1\|DV475368 | 6257 | 610 | 94.7 | globlastp |
| 1659 | LAB261 | brachypodium\|gb169\|BE403608 | 6257 | 610 | 94.7 | globlastp |
| 1660 | LAB261 | oak\|gb170\|CU639846 | 6258 | 610 | 94.2 | globlastp |
| 1661 | LAB261 | cenchrus\|gb166\|EB657433 | 6259 | 610 | 94 | globlastp |
| 1662 | LAB261 | chestnut\|gb170\|SRR006295S0002108 | 6260 | 610 | 93.9 | globlastp |
| 1663 | LAB261 | castorbean\|09v1\|EG657682 | 6261 | 610 | 93.7 | globlastp |
| 1664 | LAB261 | castorbean\|gb160\|EG657682 | 6261 | 610 | 93.7 | globlastp |
| 1665 | LAB261 | citrus\|gb166\|CB292297 | 6262 | 610 | 93.7 | globlastp |
| 1666 | LAB261 | barley\|10v1\|BI951489 | 6263 | 610 | 93.4 | globlastp |
| 1667 | LAB261 | barley\|gb157SOLEXA\|BI951489 | 6263 | 610 | 93.4 | globlastp |
| 1668 | LAB261 | cacao\|gb167\|CF974396 | 6264 | 610 | 93.4 | globlastp |
| 1669 | LAB261 | eschscholzia\|10v1\|CD476664 | 6265 | 610 | 93.1 | globlastp |
| 1670 | LAB261 | petunia\|gb171\|DY395574 | 6266 | 610 | 93.1 | globlastp |
| 1671 | LAB261 | cleome_gynandra\|10v1\|SRR015532S0007556 | 6267 | 610 | 92.9 | globlastp |
| 1672 | LAB261 | cotton\|gb164\|BF276437 | 6268 | 610 | 92.9 | globlastp |
| 1673 | LAB261 | grape\|gb160\|BM436812 | 6269 | 610 | 92.9 | globlastp |
| 1674 | LAB261 | papaya\|gb165\|EX245895 | 6270 | 610 | 92.9 | globlastp |
| 1675 | LAB261 | wheat\|gb164\|AL828650 | 6271 | 610 | 92.9 | globlastp |
| 1676 | LAB261 | wheat\|gb164\|BE403608 | 6271 | 610 | 92.9 | globlastp |
| 1677 | LAB261 | wheat\|gb164\|BE471112 | 6271 | 610 | 92.9 | globlastp |
| 1678 | LAB261 | grape\|gb160\|BQ798967 | 6272 | 610 | 92.6 | globlastp |
| 1679 | LAB261 | cassava\|09v1\|CK644886 | 6273 | 610 | 92.3 | globlastp |
| 1680 | LAB261 | cycas\|gb166\|CB088840 | 6274 | 610 | 92.3 | globlastp |
| 1681 | LAB261 | kiwi\|gb166\|FG404410 | 6275 | 610 | 92.3 | globlastp |
| 1682 | LAB261 | cucumber\|09v1\|DV633870 | 6276 | 610 | 92.1 | globlastp |
| 1683 | LAB261 | cassava\|09v1\|CK645201 | 6277 | 610 | 92.1 | globlastp |
| 1684 | LAB261 | cassava\|gb164\|CK645201 | 6277 | 610 | 92.1 | globlastp |
| 1685 | LAB261 | bean\|gb167\|CA900293 | 6278 | 610 | 91.8 | globlastp |
| 1686 | LAB261 | peanut\|gb171\|CD037806 | 6279 | 610 | 91.8 | globlastp |
| 1687 | LAB261 | poplar\|10v1\|BI138784 | 6280 | 610 | 91.8 | globlastp |
| 1688 | LAB261 | prunus\|gb167\|BU039320 | 6281 | 610 | 91.8 | globlastp |
| 1689 | LAB261 | tobacco\|gb162\|CV016319 | 6282 | 610 | 91.8 | globlastp |
| 1690 | LAB261 | cotton\|gb164\|BM359655 | 6283 | 610 | 91.5 | globlastp |
| 1691 | LAB261 | cowpea\|gb166\|FF382735 | 6284 | 610 | 91.5 | globlastp |
| 1692 | LAB261 | pepper\|gb171\|BM063583 | 6285 | 610 | 91.5 | globlastp |
| 1693 | LAB261 | pine\|10v1\|AA739737 | 6286 | 610 | 91.5 | globlastp |
| 1694 | LAB261 | pine\|gb157.2\|AA739737 | 6286 | 610 | 91.5 | globlastp |
| 1695 | LAB261 | poplar\|gb170\|BI138784 | 6287 | 610 | 91.5 | globlastp |
| 1696 | LAB261 | strawberry\|gb164\|CO816775 | 6288 | 610 | 91.5 | globlastp |
| 1697 | LAB261 | tobacco\|gb162\|DW002414 | 6289 | 610 | 91.5 | globlastp |
| 1698 | LAB261 | tobacco\|gb162\|EB444412 | 6290 | 610 | 91.5 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1699 | LAB261 | ipomoea\|gb157.2\|BJ553883 | 6291 | 610 | 91.3 | globlastp |
| 1700 | LAB261 | soybean\|gb168\|AW720478 | 6292 | 610 | 91.3 | globlastp |
| 1701 | LAB261 | tomato\|09v1\|BG124641 | 6293 | 610 | 91.3 | globlastp |
| 1702 | LAB261 | tomato\|gb164\|BG124641 | 6293 | 610 | 91.3 | globlastp |
| 1703 | LAB261 | triphysaria\|gb164\|EY179701 | 6294 | 610 | 91.3 | globlastp |
| 1704 | LAB261 | millet\|09v1\|EVO454PM004697 | 6295 | 610 | 91 | globlastp |
| 1705 | LAB261 | nasturtium\|10v1\|SRR032558S0011340 | 6296 | 610 | 91 | globlastp |
| 1706 | LAB261 | solanum_phureja\|09v1\|SPHBG124641 | 6297 | 610 | 91 | globlastp |
| 1707 | LAB261 | pine\|10v1\|AA739586 | 6298 | 610 | 91 | globlastp |
| 1708 | LAB261 | pine\|gb157.2\|AA739586 | 6298 | 610 | 91 | globlastp |
| 1709 | LAB261 | poplar\|10v1\|BI121493 | 6299 | 610 | 91 | globlastp |
| 1710 | LAB261 | poplar\|gb170\|BI121493 | 6299 | 610 | 91 | globlastp |
| 1711 | LAB261 | potato\|10v1\|BF153891 | 6297 | 610 | 91 | globlastp |
| 1712 | LAB261 | potato\|gb157.2\|BF153891 | 6297 | 610 | 91 | globlastp |
| 1713 | LAB261 | rice\|gb170\|OS11G37890 | 6300 | 610 | 91 | globlastp |
| 1714 | LAB261 | spruce\|gb162\|CO227086 | 6301 | 610 | 91 | globlastp |
| 1715 | LAB261 | switchgrass\|gb167\|DN140657 | 6295 | 610 | 91 | globlastp |
| 1716 | LAB261 | triphysaria\|10v1\|EY179701 | 6302 | 610 | 91 | globlastp |
| 1717 | LAB261 | aquilegia\|10v1\|DR926102 | 6303 | 610 | 90.8 | globlastp |
| 1718 | LAB261 | aquilegia\|gb157.3\|DR926102 | 6303 | 610 | 90.8 | globlastp |
| 1719 | LAB261 | sugarcane\|10v1\|CA070225 | 6304 | 610 | 90.8 | globlastp |
| 1720 | LAB261 | sugarcane\|gb157.3\|CA070225 | 6304 | 610 | 90.8 | globlastp |
| 1721 | LAB261 | eggplant\|10v1\|FS012567 | 6305 | 610 | 90.7 | globlastp |
| 1722 | LAB261 | monkeyflower\|10v1\|DV207215 | 6306 | 610 | 90.7 | globlastp |
| 1723 | LAB261 | monkeyflower\|10v1\|GO993454 | 6307 | 610 | 90.7 | globlastp |
| 1724 | LAB261 | bean\|gb167\|CA900782 | 6308 | 610 | 90.7 | globlastp |
| 1725 | LAB261 | petunia\|gb171\|FN001638 | 6309 | 610 | 90.7 | globlastp |
| 1726 | LAB261 | soybean\|gb168\|BE943442 | 6310 | 610 | 90.7 | globlastp |
| 1727 | LAB261 | spruce\|gb162\|CO230551 | 6311 | 610 | 90.7 | globlastp |
| 1728 | LAB261 | nasturtium\|10v1\|SRR032558S0012367 | 6312 | 610 | 90.5 | globlastp |
| 1729 | LAB261 | salvia\|10v1\|SRR014553S0011018 | 6313 | 610 | 90.5 | globlastp |
| 1730 | LAB261 | sorghum\|09v1\|SB05G022890 | 6314 | 610 | 90.5 | globlastp |
| 1731 | LAB261 | apple\|gb171\|CN489582 | 6315 | 610 | 90.5 | globlastp |
| 1732 | LAB261 | cowpea\|gb166\|FF548366 | 6316 | 610 | 90.5 | globlastp |
| 1733 | LAB261 | lotus\|09v1\|LLAF000387 | 6317 | 610 | 90.5 | globlastp |
| 1734 | LAB261 | lotus\|gb157.2\|AF000387 | 6317 | 610 | 90.5 | globlastp |
| 1735 | LAB261 | medicago\|09v1\|AW684320 | 6318 | 610 | 90.5 | globlastp |
| 1736 | LAB261 | medicago\|gb157.2\|AW684320 | 6318 | 610 | 90.5 | globlastp |
| 1737 | LAB261 | pepper\|gb171\|CA847567 | 6319 | 610 | 90.5 | globlastp |
| 1738 | LAB261 | soybean\|gb168\|AW720589 | 6320 | 610 | 90.5 | glotblastn |
| 1739 | LAB261 | sorghum\|gb161.crp\|AI621789 | 6314 | 610 | 90.5 | globlastp |
| 1740 | LAB261 | medicago\|09v1\|LLAW287978 | 6321 | 610 | 90.3 | globlastp |
| 1741 | LAB261 | medicago\|gb157.2\|AW287978 | 6321 | 610 | 90.3 | globlastp |
| 1742 | LAB261 | apple\|gb171\|CN491348 | 6322 | 610 | 90.2 | globlastp |
| 1743 | LAB261 | arabidopsis\|gb165\|AT5G28840 | 6323 | 610 | 90.2 | globlastp |
| 1744 | LAB261 | artemisia\|10v1\|EY051556 | 6324 | 610 | 90.2 | globlastp |
| 1745 | LAB261 | potato\|10v1\|BG096609 | 6325 | 610 | 90.2 | globlastp |
| 1746 | LAB261 | potato\|gb157.2\|BG096609 | 6325 | 610 | 90.2 | globlastp |
| 1747 | LAB261 | sunflower\|gb162\|CD851148 | 6326 | 610 | 90.2 | globlastp |
| 1748 | LAB261 | tomato\|09v1\|BG124848 | 6327 | 610 | 90.2 | globlastp |
| 1749 | LAB261 | tomato\|gb164\|BG124848 | 6327 | 610 | 90.2 | globlastp |
| 1750 | LAB261 | lettuce\|10v1\|DW145532 | 6328 | 610 | 89.9 | globlastp |
| 1751 | LAB261 | solanum_phureja\|09v1\|SPHBG124848 | 6329 | 610 | 89.9 | globlastp |
| 1752 | LAB261 | artemisia\|gb164\|EY051556 | 6330 | 610 | 89.9 | globlastp |
| 1753 | LAB261 | lettuce\|gb157.2\|DW104433 | 6328 | 610 | 89.9 | globlastp |
| 1754 | LAB261 | lettuce\|gb157.2\|DW145532 | 6328 | 610 | 89.9 | globlastp |
| 1755 | LAB261 | sunflower\|gb162\|DY905774 | 6331 | 610 | 89.9 | globlastp |
| 1756 | LAB261 | lettuce\|10v1\|DW057783 | 6328 | 610 | 89.9 | globlastp |
| 1757 | LAB261 | arabidopsis_lyrata\|09v1\|JGIAL022633 | 6332 | 610 | 89.7 | globlastp |
| 1758 | LAB261 | lettuce\|gb157.2\|DW044085 | 6333 | 610 | 89.7 | globlastp |
| 1759 | LAB261 | radish\|gb164\|EV537961 | 6334 | 610 | 89.7 | globlastp |
| 1760 | LAB261 | b_rapa\|gb162\|CO750452 | 6335 | 610 | 89.4 | globlastp |
| 1761 | LAB261 | canola\|gb161\|BQ704449 | 6335 | 610 | 89.4 | globlastp |
| 1762 | LAB261 | canola\|10v1\|BQ704449 | 6335 | 610 | 89.4 | globlastp |
| 1763 | LAB261 | canola\|gb161\|CD830432 | 6335 | 610 | 89.4 | globlastp |
| 1764 | LAB261 | centaurea\|gb166\|EH738056 | 6336 | 610 | 89.2 | globlastp |
| 1765 | LAB261 | cichorium\|gb171\|EH675975 | 6337 | 610 | 89.2 | globlastp |
| 1766 | LAB261 | safflower\|gb162\|EL377966 | 6338 | 610 | 89.2 | globlastp |
| 1767 | LAB261 | tragopogon\|10v1\|SRR020205S0000342 | 6339 | 610 | 89.15 | glotblastn |
| 1768 | LAB261 | brachypodium\|09v1\|DV472085 | 6340 | 610 | 88.9 | globlastp |
| 1769 | LAB261 | brachypodium\|gb169\|BE412805 | 6340 | 610 | 88.9 | globlastp |
| 1770 | LAB261 | barley\|10v1\|BE412761 | 6341 | 610 | 88.7 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1771 | LAB261 | barley\|gb157SOLEXA\|BE412805 | 6341 | 610 | 88.7 | globlastp |
| 1772 | LAB261 | maize\|gb170\|AI621789 | 6342 | 610 | 88.7 | globlastp |
| 1773 | LAB261 | radish\|gb164\|EY935796 | 6343 | 610 | 88.7 | globlastp |
| 1774 | LAB261 | b_oleracea\|gb161\|AM395321 | 6344 | 610 | 88.65 | glotblastn |
| 1775 | LAB261 | soybean\|gb168\|AW719861 | 6345 | 610 | 88.17 | globlastp |
| 1776 | LAB261 | wheat\|gb164\|BE470986 | 6346 | 610 | 88.13 | glotblastn |
| 1777 | LAB261 | wheat\|gb164\|BE415328 | 6347 | 610 | 87.57 | glotblastn |
| 1778 | LAB261 | lolium\|10v1\|AU246974 | 6348 | 610 | 87.3 | globlastp |
| 1779 | LAB261 | oat\|10v1\|CN815416 | 6349 | 610 | 87.3 | globlastp |
| 1780 | LAB261 | cassava\|09v1\|JGICASSAVA38534M1 | 6350 | 610 | 87 | globlastp |
| 1781 | LAB261 | spikemoss\|gb165\|DN838866 | 6351 | 610 | 86.3 | globlastp |
| 1782 | LAB261 | spikemoss\|gb165\|FE443875 | 6352 | 610 | 86.3 | globlastp |
| 1783 | LAB261 | banana\|gb167\|DN240198 | 6353 | 610 | 85.8 | globlastp |
| 1784 | LAB261 | physcomitrella\|10v1\|AW145217 | 6354 | 610 | 85.3 | globlastp |
| 1785 | LAB261 | physcomitrella\|gb157\|AW145217 | 6354 | 610 | 85.3 | globlastp |
| 1786 | LAB261 | physcomitrella\|10v1\|BJ176425 | 6355 | 610 | 84.2 | globlastp |
| 1787 | LAB261 | gerbera\|09v1\|AJ753310 | 6356 | 610 | 84.13 | glotblastn |
| 1788 | LAB261 | coffea\|10v1\|DV685976 | 6357 | 610 | 84.1 | globlastp |
| 1789 | LAB261 | physcomitrella\|10v1\|BJ172060 | 6358 | 610 | 84 | globlastp |
| 1790 | LAB261 | fescue\|gb161\|DT680485 | 6359 | 610 | 83.7 | globlastp |
| 1791 | LAB261 | marchantia\|gb166\|BJ840495 | 6360 | 610 | 83.4 | globlastp |
| 1792 | LAB261 | spikemoss\|gb165\|FE449379 | 6361 | 610 | 82.6 | globlastp |
| 1793 | LAB261 | avocado\|10v1\|CK754925 | 6362 | 610 | 81 | globlastp |
| 1794 | LAB261 | avocado\|gb164\|CK754925 | 6362 | 610 | 81 | globlastp |
| 1795 | LAB263 | millet\|09v1\|EVO454PM004666 | 6363 | 612 | 95.1 | globlastp |
| 1796 | LAB263 | switchgrass\|gb167\|DN144095 | 6364 | 612 | 94.4 | globlastp |
| 1797 | LAB263 | switchgrass\|gb167\|FL896428 | 6364 | 612 | 94.4 | globlastp |
| 1798 | LAB263 | sugarcane\|10v1\|CA073725 | 6365 | 612 | 93.7 | globlastp |
| 1799 | LAB263 | cenchrus\|gb166\|EB657377 | 6366 | 612 | 93.7 | globlastp |
| 1800 | LAB263 | sorghum\|09v1\|SB01G017460 | 6365 | 612 | 93.7 | globlastp |
| 1801 | LAB263 | sorghum\|gb161.crp\|BE345577 | 6365 | 612 | 93.7 | globlastp |
| 1802 | LAB263 | sugarcane\|gb157.3\|CA069290 | 6365 | 612 | 93.7 | globlastp |
| 1803 | LAB263 | wheat\|gb164\|AL821110 | 6367 | 612 | 90.9 | globlastp |
| 1804 | LAB263 | wheat\|gb164\|BG262576 | 6368 | 612 | 90.9 | globlastp |
| 1805 | LAB263 | barley\|10v1\|BF254790 | 6369 | 612 | 90.2 | globlastp |
| 1806 | LAB263 | barley\|gb157SOLEXA\|AL505544 | 6369 | 612 | 90.2 | globlastp |
| 1807 | LAB263 | brachypodium\|09v1\|DV478084 | 6370 | 612 | 89.6 | globlastp |
| 1808 | LAB263 | brachypodium\|gb169\|BF293509 | 6370 | 612 | 89.6 | globlastp |
| 1809 | LAB263 | lovegrass\|gb167\|EH189807 | 6371 | 612 | 89.51 | glotblastn |
| 1810 | LAB263 | oat\|10v1\|GO591788 | 6372 | 612 | 89.5 | globlastp |
| 1811 | LAB263 | fescue\|gb161\|DT680080 | 6373 | 612 | 89.5 | globlastp |
| 1812 | LAB263 | wheat\|gb164\|BF293509 | 6374 | 612 | 88.9 | globlastp |
| 1813 | LAB263 | banana\|gb167\|FF561386 | 6375 | 612 | 83.2 | globlastp |
| 1814 | LAB264 | barley\|10v1\|BF621209 | 6376 | 613 | 86.7 | globlastp |
| 1815 | LAB264 | wheat\|gb164\|BF293634 | 6377 | 613 | 86.42 | glotblastn |
| 1816 | LAB264 | barley\|gb157SOLEXA\|AL506359 | 6378 | 613 | 86.3 | globlastp |
| 1817 | LAB264 | leymus\|gb166\|EG377220 | 6379 | 613 | 86.2 | globlastp |
| 1818 | LAB264 | maize\|gb170\|AI664956 | 6380 | 613 | 86.1 | globlastp |
| 1819 | LAB264 | switchgrass\|gb167\|DN142147 | 6381 | 613 | 86.1 | globlastp |
| 1820 | LAB264 | sorghum\|09v1\|SB01G017060 | 6382 | 613 | 84.4 | globlastp |
| 1821 | LAB264 | sorghum\|gb161.crp\|BE355313 | 6382 | 613 | 84.4 | globlastp |
| 1822 | LAB264 | brachypodium\|09v1\|DV472183 | 6383 | 613 | 83.8 | globlastp |
| 1823 | LAB264 | brachypodium\|gb169\|BE490826 | 6384 | 613 | 83.5 | globlastp |
| 1824 | LAB264 | maize\|gb170\|CRPZM2N054279 | 6385 | 613 | 83.3 | globlastp |
| 1825 | LAB264 | sugarcane\|gb157.3\|CA065380 | 6386 | 613 | 81.16 | glotblastn |
| 1826 | LAB265 | switchgrass\|gb167\|FL765838 | 6387 | 614 | 80.2 | globlastp |
| 1827 | LAB267 | maize\|gb170\|AF083327 | 6388 | 615 | 97.5 | globlastp |
| 1828 | LAB267 | rice\|gb170\|OS05G44340 | 6389 | 615 | 96.5 | globlastp |
| 1829 | LAB267 | brachypodium\|gb169\|AF083344 | 6390 | 615 | 95.1 | globlastp |
| 1830 | LAB267 | brachypodium\|09v1\|SRR031797S0356808 | 6391 | 615 | 95 | globlastp |
| 1831 | LAB267 | barley\|10v1\|BG367325 | 6392 | 615 | 94.1 | globlastp |
| 1832 | LAB267 | wheat\|gb164\|AF083344 | 6393 | 615 | 93.8 | globlastp |
| 1833 | LAB267 | wheat\|gb164\|BE515416 | 6394 | 615 | 91.6 | globlastp |
| 1834 | LAB267 | brachypodium\|09v1\|GT777326 | 6395 | 615 | 91.1 | globlastp |
| 1835 | LAB267 | sorghum\|09v1\|SB03G034390 | 6396 | 615 | 88.2 | globlastp |
| 1836 | LAB267 | sorghum\|gb161.crp\|CD204325 | 6396 | 615 | 88.2 | globlastp |
| 1837 | LAB267 | cucumber\|09v1\|CV003331 | 6397 | 615 | 86.3 | globlastp |
| 1838 | LAB267 | grape\|gb160\|BM437943 | 6398 | 615 | 85.7 | globlastp |
| 1839 | LAB267 | chestnut\|gb170\|SRR006296S0007369 | 6399 | 615 | 85.2 | globlastp |
| 1840 | LAB267 | brachypodium\|gb169\|AV934943 | 6400 | 615 | 84.7 | globlastp |
| 1841 | LAB267 | soybean\|gb168\|SOYSB100HS | 6401 | 615 | 84.6 | globlastp |
| 1842 | LAB267 | lotus\|09v1\|BW598183 | 6402 | 615 | 84.5 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1843 | LAB267 | arabidopsis\|gb165\|AT1G74310 | 6403 | 615 | 84.2 | globlastp |
| 1844 | LAB267 | poplar\|10v1\|AI162541 | 6404 | 615 | 84.1 | globlastp |
| 1845 | LAB267 | arabidopsis_lyrata\|09v1\|JGIAL007701 | 6405 | 615 | 84 | globlastp |
| 1846 | LAB267 | poplar\|gb170\|AI162541 | 6406 | 615 | 84 | globlastp |
| 1847 | LAB267 | cassava\|09v1\|DV445651 | 6407 | 615 | 83.7 | globlastp |
| 1848 | LAB267 | castorbean\|09v1\|EG656629 | 6408 | 615 | 83.6 | globlastp |
| 1849 | LAB267 | castorbean\|gb160\|EG656629 | 6408 | 615 | 83.6 | globlastp |
| 1850 | LAB267 | pine\|10v1\|AA566965 | 6409 | 615 | 82.8 | globlastp |
| 1851 | LAB267 | tobacco\|gb162\|AF083343 | 6410 | 615 | 82.5 | globlastp |
| 1852 | LAB267 | monkeyflower\|10v1\|SRR037227S0004657 | 6411 | 615 | 82.3 | globlastp |
| 1853 | LAB267 | tomato\|09v1\|BG126435 | 6412 | 615 | 82.2 | globlastp |
| 1854 | LAB267 | solanum_phureja\|09v1\|SPHBG126435 | 6413 | 615 | 81.9 | globlastp |
| 1855 | LAB268 | arabidopsis_lyrata\|09v1\|CRPALE000200 | 616 | 616 | 100 | globlastp |
| 1856 | LAB268 | arabidopsis_lyrata\|09v1\|JGIAL000723 | 616 | 616 | 100 | globlastp |
| 1857 | LAB268 | arabidopsis_lyrata\|09v1\|JGIAL000743 | 616 | 616 | 100 | globlastp |
| 1858 | LAB268 | arabidopsis_lyrata\|09v1\|JGIAL017658 | 616 | 616 | 100 | globlastp |
| 1859 | LAB268 | arabidopsis_lyrata\|09v1\|JGIAL017717 | 616 | 616 | 100 | globlastp |
| 1860 | LAB268 | arabidopsis_lyrata\|09v1\|JGIAL018619 | 616 | 616 | 100 | globlastp |
| 1861 | LAB268 | arabidopsis_lyrata\|09v1\|JGIAL030589 | 616 | 616 | 100 | globlastp |
| 1862 | LAB268 | arabidopsis_lyrata\|09v1\|JGIAL030619 | 616 | 616 | 100 | globlastp |
| 1863 | LAB268 | arabidopsis_lyrata\|09v1\|JGIAL032285 | 616 | 616 | 100 | globlastp |
| 1864 | LAB268 | artemisia\|10v1\|EF549583 | 616 | 616 | 100 | globlastp |
| 1865 | LAB268 | artemisia\|10v1\|EY034318 | 616 | 616 | 100 | globlastp |
| 1866 | LAB268 | artemisia\|10v1\|EY039119 | 616 | 616 | 100 | globlastp |
| 1867 | LAB268 | artemisia\|10v1\|EY042941 | 616 | 616 | 100 | globlastp |
| 1868 | LAB268 | artemisia\|10v1\|EY043355 | 616 | 616 | 100 | globlastp |
| 1869 | LAB268 | artemisia\|10v1\|EY053904 | 616 | 616 | 100 | globlastp |
| 1870 | LAB268 | artemisia\|10v1\|EY053905 | 616 | 616 | 100 | globlastp |
| 1871 | LAB268 | artemisia\|10v1\|EY054470 | 616 | 616 | 100 | globlastp |
| 1872 | LAB268 | artemisia\|10v1\|EY055002 | 616 | 616 | 100 | globlastp |
| 1873 | LAB268 | artemisia\|10v1\|EY058090 | 616 | 616 | 100 | globlastp |
| 1874 | LAB268 | artemisia\|10v1\|EY059748 | 616 | 616 | 100 | globlastp |
| 1875 | LAB268 | artemisia\|10v1\|EY094034 | 616 | 616 | 100 | globlastp |
| 1876 | LAB268 | artemisia\|10v1\|EY112179 | 616 | 616 | 100 | globlastp |
| 1877 | LAB268 | artemisia\|10v1\|GW328652 | 616 | 616 | 100 | globlastp |
| 1878 | LAB268 | artemisia\|10v1\|GW328923 | 616 | 616 | 100 | globlastp |
| 1879 | LAB268 | artemisia\|10v1\|GW328962 | 616 | 616 | 100 | globlastp |
| 1880 | LAB268 | artemisia\|10v1\|GW329063 | 616 | 616 | 100 | globlastp |
| 1881 | LAB268 | artemisia\|10v1\|GW329182 | 616 | 616 | 100 | globlastp |
| 1882 | LAB268 | artemisia\|10v1\|GW329192 | 616 | 616 | 100 | globlastp |
| 1883 | LAB268 | artemisia\|10v1\|GW329412 | 616 | 616 | 100 | globlastp |
| 1884 | LAB268 | artemisia\|10v1\|GW330388 | 616 | 616 | 100 | globlastp |
| 1885 | LAB268 | artemisia\|10v1\|GW331835 | 616 | 616 | 100 | globlastp |
| 1886 | LAB268 | artemisia\|10v1\|SRR019254S0000375 | 616 | 616 | 100 | globlastp |
| 1887 | LAB268 | artemisia\|10v1\|SRR019254S0000380 | 616 | 616 | 100 | globlastp |
| 1888 | LAB268 | artemisia\|10v1\|SRR019254S0000431 | 616 | 616 | 100 | globlastp |
| 1889 | LAB268 | artemisia\|10v1\|SRR019254S0000460 | 616 | 616 | 100 | globlastp |
| 1890 | LAB268 | artemisia\|10v1\|SRR019254S0000626 | 616 | 616 | 100 | globlastp |
| 1891 | LAB268 | artemisia\|10v1\|SRR019254S0001178 | 616 | 616 | 100 | globlastp |
| 1892 | LAB268 | artemisia\|10v1\|SRR019254S0001487 | 616 | 616 | 100 | globlastp |
| 1893 | LAB268 | artemisia\|10v1\|SRR019254S0001518 | 616 | 616 | 100 | globlastp |
| 1894 | LAB268 | artemisia\|10v1\|SRR019254S0003786 | 616 | 616 | 100 | globlastp |
| 1895 | LAB268 | artemisia\|10v1\|SRR019254S0004038 | 616 | 616 | 100 | globlastp |
| 1896 | LAB268 | artemisia\|10v1\|SRR019254S0004262 | 616 | 616 | 100 | globlastp |
| 1897 | LAB268 | artemisia\|10v1\|SRR019254S0005211 | 616 | 616 | 100 | globlastp |
| 1898 | LAB268 | artemisia\|10v1\|SRR019254S0005860 | 616 | 616 | 100 | globlastp |
| 1899 | LAB268 | artemisia\|10v1\|SRR019254S0005963 | 616 | 616 | 100 | globlastp |
| 1900 | LAB268 | artemisia\|10v1\|SRR019254S0006055 | 616 | 616 | 100 | globlastp |
| 1901 | LAB268 | artemisia\|10v1\|SRR019254S0008243 | 616 | 616 | 100 | globlastp |
| 1902 | LAB268 | artemisia\|10v1\|SRR019254S0008256 | 616 | 616 | 100 | globlastp |
| 1903 | LAB268 | artemisia\|10v1\|SRR019254S0009721 | 616 | 616 | 100 | globlastp |
| 1904 | LAB268 | artemisia\|10v1\|SRR019254S0011742 | 616 | 616 | 100 | globlastp |
| 1905 | LAB268 | artemisia\|10v1\|SRR019254S0012498 | 616 | 616 | 100 | globlastp |
| 1906 | LAB268 | artemisia\|10v1\|SRR019254S0013446 | 616 | 616 | 100 | globlastp |
| 1907 | LAB268 | artemisia\|10v1\|SRR019254S0013783 | 616 | 616 | 100 | globlastp |
| 1908 | LAB268 | artemisia\|10v1\|SRR019254S0015995 | 616 | 616 | 100 | globlastp |
| 1909 | LAB268 | artemisia\|10v1\|SRR019254S0017378 | 616 | 616 | 100 | globlastp |
| 1910 | LAB268 | artemisia\|10v1\|SRR019254S0019913 | 616 | 616 | 100 | globlastp |
| 1911 | LAB268 | artemisia\|10v1\|SRR019254S0020607 | 616 | 616 | 100 | globlastp |
| 1912 | LAB268 | artemisia\|10v1\|SRR019254S0022185 | 616 | 616 | 100 | globlastp |
| 1913 | LAB268 | artemisia\|10v1\|SRR019254S0022238 | 616 | 616 | 100 | globlastp |
| 1914 | LAB268 | artemisia\|10v1\|SRR019254S0024032 | 616 | 616 | 100 | globlastp |

TABLE 54-continued

Homologues of the identified genes/polypeptides for increasing abiotic stress
tolerance, water use efficiency, yield, growth rate, vigor, oil content, biomass, growth
rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1915 | LAB268 | artemisia\|10v1\|SRR019254S0024180 | 616 | 616 | 100 | globlastp |
| 1916 | LAB268 | artemisia\|10v1\|SRR019254S0025912 | 616 | 616 | 100 | globlastp |
| 1917 | LAB268 | artemisia\|10v1\|SRR019254S0026259 | 616 | 616 | 100 | globlastp |
| 1918 | LAB268 | artemisia\|10v1\|SRR019254S0029317 | 616 | 616 | 100 | globlastp |
| 1919 | LAB268 | artemisia\|10v1\|SRR019254S0029360 | 616 | 616 | 100 | globlastp |
| 1920 | LAB268 | artemisia\|10v1\|SRR019254S0030218 | 616 | 616 | 100 | globlastp |
| 1921 | LAB268 | artemisia\|10v1\|SRR019254S0030358 | 616 | 616 | 100 | globlastp |
| 1922 | LAB268 | artemisia\|10v1\|SRR019254S0032259 | 616 | 616 | 100 | globlastp |
| 1923 | LAB268 | artemisia\|10v1\|SRR019254S0051179 | 616 | 616 | 100 | globlastp |
| 1924 | LAB268 | artemisia\|10v1\|SRR019254S0052017 | 616 | 616 | 100 | globlastp |
| 1925 | LAB268 | artemisia\|10v1\|SRR019254S0061794 | 616 | 616 | 100 | globlastp |
| 1926 | LAB268 | artemisia\|10v1\|SRR019254S0069114 | 616 | 616 | 100 | globlastp |
| 1927 | LAB268 | artemisia\|10v1\|SRR019254S0074817 | 616 | 616 | 100 | globlastp |
| 1928 | LAB268 | artemisia\|10v1\|SRR019254S0076339 | 616 | 616 | 100 | globlastp |
| 1929 | LAB268 | artemisia\|10v1\|SRR019254S0079662 | 616 | 616 | 100 | globlastp |
| 1930 | LAB268 | artemisia\|10v1\|SRR019254S0105221 | 616 | 616 | 100 | globlastp |
| 1931 | LAB268 | artemisia\|10v1\|SRR019254S0114141 | 616 | 616 | 100 | globlastp |
| 1932 | LAB268 | artemisia\|10v1\|SRR019254S0120013 | 616 | 616 | 100 | globlastp |
| 1933 | LAB268 | artemisia\|10v1\|SRR019254S0127473 | 616 | 616 | 100 | globlastp |
| 1934 | LAB268 | artemisia\|10v1\|SRR019254S0130786 | 616 | 616 | 100 | globlastp |
| 1935 | LAB268 | artemisia\|10v1\|SRR019254S0140955 | 616 | 616 | 100 | globlastp |
| 1936 | LAB268 | artemisia\|10v1\|SRR019254S0143768 | 616 | 616 | 100 | globlastp |
| 1937 | LAB268 | artemisia\|10v1\|SRR019254S0147045 | 616 | 616 | 100 | globlastp |
| 1938 | LAB268 | artemisia\|10v1\|SRR019254S0266839 | 616 | 616 | 100 | globlastp |
| 1939 | LAB268 | artemisia\|10v1\|SRR019254S0270614 | 616 | 616 | 100 | globlastp |
| 1940 | LAB268 | artemisia\|10v1\|SRR019254S0279002 | 616 | 616 | 100 | globlastp |
| 1941 | LAB268 | artemisia\|10v1\|SRR019254S0387282 | 616 | 616 | 100 | globlastp |
| 1942 | LAB268 | artemisia\|10v1\|SRR019254S0579805 | 616 | 616 | 100 | globlastp |
| 1943 | LAB268 | artemisia\|10v1\|SRR019546S0035668 | 616 | 616 | 100 | globlastp |
| 1944 | LAB268 | artemisia\|10v1\|SRR019546S0183437 | 616 | 616 | 100 | globlastp |
| 1945 | LAB268 | artemisia\|10v1\|SRR019550S0048076 | 616 | 616 | 100 | globlastp |
| 1946 | LAB268 | artemisia\|10v1\|SRR019550S0262313 | 616 | 616 | 100 | globlastp |
| 1947 | LAB268 | artemisia\|10v1\|SRR019550S0292384 | 616 | 616 | 100 | globlastp |
| 1948 | LAB268 | barley\|10v1\|BE412942 | 616 | 616 | 100 | globlastp |
| 1949 | LAB268 | barley\|10v1\|BF622067 | 616 | 616 | 100 | globlastp |
| 1950 | LAB268 | barley\|10v1\|BF626567 | 616 | 616 | 100 | globlastp |
| 1951 | LAB268 | barley\|10v1\|BI949272 | 616 | 616 | 100 | globlastp |
| 1952 | LAB268 | brachypodium\|09v1\|GT779131 | 616 | 616 | 100 | globlastp |
| 1953 | LAB268 | canola\|10v1\|CD812149 | 616 | 616 | 100 | globlastp |
| 1954 | LAB268 | canola\|10v1\|CD822786 | 616 | 616 | 100 | globlastp |
| 1955 | LAB268 | canola\|10v1\|CN736543 | 616 | 616 | 100 | globlastp |
| 1956 | LAB268 | canola\|10v1\|CX187745 | 616 | 616 | 100 | globlastp |
| 1957 | LAB268 | cassava\|09v1\|BI325167 | 616 | 616 | 100 | globlastp |
| 1958 | LAB268 | cassava\|09v1\|JGICASSAVA41199M1 | 616 | 616 | 100 | globlastp |
| 1959 | LAB268 | cassava\|09v1\|JGICASSAVA46265M1 | 616 | 616 | 100 | globlastp |
| 1960 | LAB268 | chickpea\|09v2\|GR392086 | 616 | 616 | 100 | globlastp |
| 1961 | LAB268 | chickpea\|09v2\|GR398679 | 616 | 616 | 100 | globlastp |
| 1962 | LAB268 | cleome_gynandra\|10v1\|SRR015532S0007899 | 616 | 616 | 100 | globlastp |
| 1963 | LAB268 | cleome_gynandra\|10v1\|SRR015532S0022381 | 616 | 616 | 100 | globlastp |
| 1964 | LAB268 | cleome_gynandra\|10v1\|SRR015532S0062423 | 616 | 616 | 100 | globlastp |
| 1965 | LAB268 | cleome_gynandra\|10v1\|SRR015532S0098412 | 616 | 616 | 100 | globlastp |
| 1966 | LAB268 | cleome_gynandra\|10v1\|SRR015532S0197501 | 616 | 616 | 100 | globlastp |
| 1967 | LAB268 | cleome_spinosa\|10v1\|GR931018 | 616 | 616 | 100 | globlastp |
| 1968 | LAB268 | cleome_spinosa\|10v1\|GR932515 | 616 | 616 | 100 | globlastp |
| 1969 | LAB268 | cleome_spinosa\|10v1\|SRR015531S0001363 | 616 | 616 | 100 | globlastp |
| 1970 | LAB268 | cucumber\|09v1\|AM732498 | 616 | 616 | 100 | globlastp |
| 1971 | LAB268 | cucumber\|09v1\|BGI454H0122642 | 616 | 616 | 100 | globlastp |
| 1972 | LAB268 | cucumber\|09v1\|BI740176 | 616 | 616 | 100 | globlastp |
| 1973 | LAB268 | cucumber\|09v1\|CK085478 | 616 | 616 | 100 | globlastp |
| 1974 | LAB268 | cucumber\|09v1\|CK085975 | 616 | 616 | 100 | globlastp |
| 1975 | LAB268 | cucumber\|09v1\|CK755431 | 616 | 616 | 100 | globlastp |
| 1976 | LAB268 | cucumber\|09v1\|DV633267 | 616 | 616 | 100 | globlastp |
| 1977 | LAB268 | eggplant\|10v1\|AB018245 | 616 | 616 | 100 | globlastp |
| 1978 | LAB268 | eggplant\|10v1\|FS000621 | 616 | 616 | 100 | globlastp |
| 1979 | LAB268 | eggplant\|10v1\|FS001270 | 616 | 616 | 100 | globlastp |
| 1980 | LAB268 | eggplant\|10v1\|FS001671 | 616 | 616 | 100 | globlastp |
| 1981 | LAB268 | eggplant\|10v1\|FS002906 | 616 | 616 | 100 | globlastp |
| 1982 | LAB268 | eggplant\|10v1\|FS003423 | 616 | 616 | 100 | globlastp |
| 1983 | LAB268 | eggplant\|10v1\|FS013921 | 616 | 616 | 100 | globlastp |
| 1984 | LAB268 | eschscholzia\|10v1\|CD481738 | 616 | 616 | 100 | globlastp |
| 1985 | LAB268 | eschscholzia\|10v1\|SRR014116S0018648 | 6414 | 616 | 100 | glotblastn |
| 1986 | LAB268 | flax\|09v1\|EH791223 | 616 | 616 | 100 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 1987 | LAB268 | gerbera\|09v1\|AJ750671 | 616 | 616 | 100 | globlastp |
| 1988 | LAB268 | gerbera\|09v1\|AJ751622 | 616 | 616 | 100 | globlastp |
| 1989 | LAB268 | gerbera\|09v1\|AJ752458 | 616 | 616 | 100 | globlastp |
| 1990 | LAB268 | gerbera\|09v1\|AJ752576 | 616 | 616 | 100 | globlastp |
| 1991 | LAB268 | gerbera\|09v1\|AJ752839 | 616 | 616 | 100 | globlastp |
| 1992 | LAB268 | gerbera\|09v1\|AJ752885 | 616 | 616 | 100 | globlastp |
| 1993 | LAB268 | gerbera\|09v1\|AJ752992 | 616 | 616 | 100 | globlastp |
| 1994 | LAB268 | ginseng\|10v1\|GR871062 | 616 | 616 | 100 | globlastp |
| 1995 | LAB268 | heritiera\|10v1\|SRR005795S0006089 | 616 | 616 | 100 | globlastp |
| 1996 | LAB268 | ipomoea_batatas\|10v1\|CB330659 | 616 | 616 | 100 | globlastp |
| 1997 | LAB268 | ipomoea_batatas\|10v1\|CB330711 | 616 | 616 | 100 | globlastp |
| 1997 | LAB268 | ipomoea\|gb157.2\|CB330711 | 616 | 616 | 100 | globlastp |
| 1998 | LAB268 | ipomoea_batatas\|10v1\|CB330950 | 616 | 616 | 100 | globlastp |
| 1999 | LAB268 | ipomoea_batatas\|10v1\|DV034788 | 616 | 616 | 100 | globlastp |
| 2000 | LAB268 | ipomoea_nil\|10v1\|BJ553415 | 616 | 616 | 100 | globlastp |
| 2001 | LAB268 | ipomoea_nil\|10v1\|BJ553690 | 616 | 616 | 100 | globlastp |
| 2002 | LAB268 | ipomoea_nil\|10v1\|BJ555300 | 616 | 616 | 100 | globlastp |
| 2003 | LAB268 | ipomoea_nil\|10v1\|BJ556362 | 616 | 616 | 100 | globlastp |
| 2004 | LAB268 | ipomoea_nil\|10v1\|BJ556445 | 616 | 616 | 100 | globlastp |
| 2005 | LAB268 | ipomoea_nil\|10v1\|BJ558611 | 616 | 616 | 100 | globlastp |
| 2006 | LAB268 | ipomoea_nil\|10v1\|BJ560747 | 616 | 616 | 100 | globlastp |
| 2007 | LAB268 | ipomoea_nil\|10v1\|CJ738107 | 616 | 616 | 100 | globlastp |
| 2008 | LAB268 | jatropha\|09v1\|FM887562 | 616 | 616 | 100 | globlastp |
| 2009 | LAB268 | jatropha\|09v1\|GT228453 | 616 | 616 | 100 | globlastp |
| 2010 | LAB268 | lettuce\|10v1\|DW047742 | 616 | 616 | 100 | globlastp |
| 2011 | LAB268 | lettuce\|10v1\|DW073761 | 616 | 616 | 100 | globlastp |
| 2012 | LAB268 | lettuce\|10v1\|DW075639 | 616 | 616 | 100 | globlastp |
| 2013 | LAB268 | lettuce\|10v1\|DW104254 | 616 | 616 | 100 | globlastp |
| 2014 | LAB268 | lettuce\|10v1\|DW121060 | 616 | 616 | 100 | globlastp |
| 2015 | LAB268 | lettuce\|10v1\|DW163248 | 616 | 616 | 100 | globlastp |
| 2016 | LAB268 | lolium\|10v1\|AU247171 | 616 | 616 | 100 | globlastp |
| 2017 | LAB268 | lolium\|10v1\|X79715 | 616 | 616 | 100 | globlastp |
| 2018 | LAB268 | lotus\|09v1\|BE122552 | 616 | 616 | 100 | globlastp |
| 2019 | LAB268 | lotus\|09v1\|CB828743 | 616 | 616 | 100 | globlastp |
| 2020 | LAB268 | lotus\|09v1\|CRPLJ031736 | 616 | 616 | 100 | globlastp |
| 2021 | LAB268 | lotus\|09v1\|CRPLJ032446 | 616 | 616 | 100 | globlastp |
| 2022 | LAB268 | medicago\|09v1\|AL366317 | 616 | 616 | 100 | globlastp |
| 2023 | LAB268 | medicago\|09v1\|LLCO514535 | 616 | 616 | 100 | globlastp |
| 2024 | LAB268 | monkeyflower\|10v1\|DV206763 | 616 | 616 | 100 | globlastp |
| 2025 | LAB268 | monkeyflower\|10v1\|DV207134 | 616 | 616 | 100 | globlastp |
| 2026 | LAB268 | monkeyflower\|10v1\|DV207153 | 616 | 616 | 100 | globlastp |
| 2027 | LAB268 | monkeyflower\|10v1\|DV207802 | 616 | 616 | 100 | globlastp |
| 2028 | LAB268 | monkeyflower\|10v1\|DV209939 | 6415 | 616 | 100 | glotblastn |
| 2029 | LAB268 | monkeyflower\|10v1\|GO967795 | 616 | 616 | 100 | globlastp |
| 2030 | LAB268 | monkeyflower\|10v1\|GR008873 | 616 | 616 | 100 | globlastp |
| 2031 | LAB268 | nasturtium\|10v1\|GH167522 | 616 | 616 | 100 | globlastp |
| 2032 | LAB268 | nasturtium\|10v1\|SRR032558S0008057 | 616 | 616 | 100 | globlastp |
| 2033 | LAB268 | nasturtium\|10v1\|SRR032558S0034910 | 616 | 616 | 100 | globlastp |
| 2034 | LAB268 | nasturtium\|10v1\|SRR032558S0046943 | 616 | 616 | 100 | globlastp |
| 2035 | LAB268 | nasturtium\|10v1\|SRR032558S0089537 | 616 | 616 | 100 | globlastp |
| 2036 | LAB268 | nasturtium\|10v1\|SRR032558S0209453 | 616 | 616 | 100 | globlastp |
| 2037 | LAB268 | nasturtium\|10v1\|SRR032558S0317266 | 616 | 616 | 100 | globlastp |
| 2038 | LAB268 | nasturtium\|10v1\|SRR032562S0059705 | 616 | 616 | 100 | globlastp |
| 2039 | LAB268 | orobanche\|10v1\|SRR023189S0000081 | 616 | 616 | 100 | globlastp |
| 2040 | LAB268 | orobanche\|10v1\|SRR023189S0000767 | 616 | 616 | 100 | globlastp |
| 2041 | LAB268 | orobanche\|10v1\|SRR023189S0001936 | 616 | 616 | 100 | globlastp |
| 2042 | LAB268 | orobanche\|10v1\|SRR023189S0004131 | 616 | 616 | 100 | globlastp |
| 2043 | LAB268 | orobanche\|10v1\|SRR023189S0004660 | 616 | 616 | 100 | globlastp |
| 2044 | LAB268 | orobanche\|10v1\|SRR023189S0006888 | 616 | 616 | 100 | globlastp |
| 2045 | LAB268 | orobanche\|10v1\|SRR023189S0009928 | 616 | 616 | 100 | globlastp |
| 2046 | LAB268 | orobanche\|10v1\|SRR023189S0011568 | 616 | 616 | 100 | globlastp |
| 2047 | LAB268 | orobanche\|10v1\|SRR023189S0013200 | 616 | 616 | 100 | globlastp |
| 2048 | LAB268 | orobanche\|10v1\|SRR023189S0014259 | 616 | 616 | 100 | globlastp |
| 2049 | LAB268 | orobanche\|10v1\|SRR023189S0014732 | 616 | 616 | 100 | globlastp |
| 2050 | LAB268 | orobanche\|10v1\|SRR023189S0015759 | 616 | 616 | 100 | globlastp |
| 2051 | LAB268 | orobanche\|10v1\|SRR023189S0016379 | 616 | 616 | 100 | globlastp |
| 2052 | LAB268 | orobanche\|10v1\|SRR023189S0022127 | 616 | 616 | 100 | globlastp |
| 2053 | LAB268 | orobanche\|10v1\|SRR023189S0032223 | 616 | 616 | 100 | globlastp |
| 2054 | LAB268 | orobanche\|10v1\|SRR023189S0032511 | 616 | 616 | 100 | globlastp |
| 2055 | LAB268 | orobanche\|10v1\|SRR023189S0046559 | 616 | 616 | 100 | globlastp |
| 2056 | LAB268 | orobanche\|10v1\|SRR023189S0052369 | 616 | 616 | 100 | globlastp |
| 2057 | LAB268 | orobanche\|10v1\|SRR023189S0105273 | 616 | 616 | 100 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2058 | LAB268 | pea\|09v1\|EX568819 | 616 | 616 | 100 | globlastp |
| 2059 | LAB268 | pea\|09v1\|EX568820 | 616 | 616 | 100 | globlastp |
| 2060 | LAB268 | pea\|09v1\|EX568868 | 616 | 616 | 100 | globlastp |
| 2061 | LAB268 | pea\|09v1\|EX569051 | 616 | 616 | 100 | globlastp |
| 2062 | LAB268 | pea\|09v1\|EX570280 | 616 | 616 | 100 | globlastp |
| 2063 | LAB268 | pea\|09v1\|EX570347 | 616 | 616 | 100 | globlastp |
| 2064 | LAB268 | pea\|09v1\|EX571335 | 616 | 616 | 100 | globlastp |
| 2065 | LAB268 | pea\|09v1\|EX571343 | 616 | 616 | 100 | globlastp |
| 2066 | LAB268 | pea\|09v1\|FG533048 | 616 | 616 | 100 | globlastp |
| 2067 | LAB268 | pea\|09v1\|PSU10042 | 616 | 616 | 100 | globlastp |
| 2068 | LAB268 | physcomitrella\|10v1\|DC934350 | 616 | 616 | 100 | globlastp |
| 2069 | LAB268 | physcomitrella\|10v1\|FC374737 | 616 | 616 | 100 | globlastp |
| 2070 | LAB268 | physcomitrella\|10v1\|FC381484 | 616 | 616 | 100 | globlastp |
| 2071 | LAB268 | physcomitrella\|10v1\|FC411388 | 616 | 616 | 100 | globlastp |
| 2072 | LAB268 | physcomitrella\|10v1\|XM001751677 | 616 | 616 | 100 | globlastp |
| 2073 | LAB268 | physcomitrella\|10v1\|XM001766297 | 616 | 616 | 100 | globlastp |
| 2074 | LAB268 | physcomitrella\|10v1\|XM001768151 | 616 | 616 | 100 | globlastp |
| 2075 | LAB268 | physcomitrella\|10v1\|XM001769639 | 616 | 616 | 100 | globlastp |
| 2076 | LAB268 | physcomitrella\|10v1\|XM001779929 | 616 | 616 | 100 | globlastp |
| 2077 | LAB268 | physcomitrella\|10v1\|XM001783766 | 616 | 616 | 100 | globlastp |
| 2078 | LAB268 | pigeonpea\|gb171\|GR471003 | 616 | 616 | 100 | globlastp |
| 2079 | LAB268 | pine\|10v1\|AL750508 | 616 | 616 | 100 | globlastp |
| 2080 | LAB268 | pine\|10v1\|AW697623 | 616 | 616 | 100 | globlastp |
| 2081 | LAB268 | poplar\|10v1\|BI119654 | 616 | 616 | 100 | globlastp |
| 2082 | LAB268 | poplar\|10v1\|BI119694 | 616 | 616 | 100 | globlastp |
| 2083 | LAB268 | poplar\|10v1\|CA823688 | 616 | 616 | 100 | globlastp |
| 2084 | LAB268 | rhizophora\|10v1\|SRR005793S0007192 | 616 | 616 | 100 | globlastp |
| 2085 | LAB268 | rose\|10v1\|EC586164 | 616 | 616 | 100 | globlastp |
| 2086 | LAB268 | salvia\|10v1\|SRR014553S0011349 | 616 | 616 | 100 | globlastp |
| 2087 | LAB268 | solanum_phureja\|09v1\|SPHBG124775 | 616 | 616 | 100 | globlastp |
| 2088 | LAB268 | sugarcane\|10v1\|CA073794 | 616 | 616 | 100 | globlastp |
| 2089 | LAB268 | sugarcane\|10v1\|CA078899 | 616 | 616 | 100 | globlastp |
| 2090 | LAB268 | tragopogon\|10v1\|SRR020205S0059721 | 616 | 616 | 100 | globlastp |
| 2091 | LAB268 | tragopogon\|10v1\|SRR020205S0133874 | 616 | 616 | 100 | globlastp |
| 2092 | LAB268 | triphysaria\|10v1\|CB815020 | 616 | 616 | 100 | globlastp |
| 2093 | LAB268 | triphysaria\|10v1\|DR171915 | 616 | 616 | 100 | globlastp |
| 2094 | LAB268 | triphysaria\|10v1\|EX999454 | 616 | 616 | 100 | globlastp |
| 2095 | LAB268 | triphysaria\|10v1\|EY151225 | 616 | 616 | 100 | globlastp |
| 2096 | LAB268 | triphysaria\|10v1\|SRR023500S0026363 | 616 | 616 | 100 | globlastp |
| 2097 | LAB268 | triphysaria\|10v1\|SRR023500S0047657 | 616 | 616 | 100 | globlastp |
| 2098 | LAB268 | amborella\|gb166\|CK766783 | 6416 | 616 | 100 | glotblastn |
| 2099 | LAB268 | amborella\|gb166\|FD441330 | 616 | 616 | 100 | globlastp |
| 2100 | LAB268 | antirrhinum\|gb166\|AJ558339 | 616 | 616 | 100 | globlastp |
| 2101 | LAB268 | antirrhinum\|gb166\|AJ558802 | 616 | 616 | 100 | globlastp |
| 2102 | LAB268 | antirrhinum\|gb166\|AJ559512 | 616 | 616 | 100 | globlastp |
| 2103 | LAB268 | antirrhinum\|gb166\|AJ787885 | 616 | 616 | 100 | globlastp |
| 2104 | LAB268 | antirrhinum\|gb166\|AJ790005 | 616 | 616 | 100 | globlastp |
| 2105 | LAB268 | antirrhinum\|gb166\|AJ791274 | 616 | 616 | 100 | globlastp |
| 2106 | LAB268 | antirrhinum\|gb166\|AJ799867 | 616 | 616 | 100 | globlastp |
| 2107 | LAB268 | apple\|gb171\|CO418311 | 616 | 616 | 100 | globlastp |
| 2108 | LAB268 | arabidopsis\|gb165\|AT1G07660 | 616 | 616 | 100 | globlastp |
| 2109 | LAB268 | arabidopsis\|gb165\|AT1G07820 | 616 | 616 | 100 | globlastp |
| 2110 | LAB268 | arabidopsis\|gb165\|AT3G45930 | 616 | 616 | 100 | globlastp |
| 2111 | LAB268 | arabidopsis\|gb165\|AT3G46320 | 616 | 616 | 100 | globlastp |
| 2112 | LAB268 | arabidopsis\|gb165\|AT3G53730 | 616 | 616 | 100 | globlastp |
| 2113 | LAB268 | arabidopsis\|gb165\|AT5G59690 | 616 | 616 | 100 | globlastp |
| 2114 | LAB268 | arabidopsis\|gb165\|BP850938 | 616 | 616 | 100 | globlastp |
| 2115 | LAB268 | artemisia\|10v1\|SRR019254S0004605 | 616 | 616 | 100 | globlastp |
| 2116 | LAB268 | artemisia\|gb164\|EF549583 | 616 | 616 | 100 | globlastp |
| 2117 | LAB268 | artemisia\|gb164\|EY032843 | 616 | 616 | 100 | globlastp |
| 2118 | LAB268 | artemisia\|10v1\|EY064628 | 616 | 616 | 100 | globlastp |
| 2119 | LAB268 | artemisia\|10v1\|EY035013 | 616 | 616 | 100 | globlastp |
| 2120 | LAB268 | artemisia\|10v1\|EY037977 | 616 | 616 | 100 | globlastp |
| 2121 | LAB268 | artemisia\|10v1\|SRR019254S0006003 | 616 | 616 | 100 | globlastp |
| 2122 | LAB268 | artemisia\|gb164\|EY043355 | 616 | 616 | 100 | globlastp |
| 2123 | LAB268 | artemisia\|10v1\|SRR019254S0020909 | 616 | 616 | 100 | globlastp |
| 2124 | LAB268 | artemisia\|10v1\|EY050092 | 616 | 616 | 100 | globlastp |
| 2125 | LAB268 | artemisia\|gb164\|EY050092 | 616 | 616 | 100 | globlastp |
| 2126 | LAB268 | artemisia\|10v1\|SRR019254S0044441 | 616 | 616 | 100 | globlastp |
| 2127 | LAB268 | avocado\|10v1\|CV459682 | 616 | 616 | 100 | globlastp |
| 2128 | LAB268 | avocado\|gb164\|CV459682 | 616 | 616 | 100 | globlastp |
| 2129 | LAB268 | b_juncea\|gb164\|EVGN00228021432997 | 6417 | 616 | 100 | glotblastn |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2130 | LAB268 | b_juncea|gb164|EVGN00270107220245 | 616 | 616 | 100 | globlastp |
| 2131 | LAB268 | b_juncea|gb164|EVGN00435218160732 | 616 | 616 | 100 | globlastp |
| 2132 | LAB268 | b_juncea|gb164|EVGN01147913980907 | 616 | 616 | 100 | globlastp |
| 2133 | LAB268 | b_juncea|gb164|EVGN01210625941088 | 616 | 616 | 100 | globlastp |
| 2134 | LAB268 | b_juncea|gb164|EVGN01304119480487 | 616 | 616 | 100 | globlastp |
| 2135 | LAB268 | b_juncea|gb164|EVGN01378815060926 | 616 | 616 | 100 | globlastp |
| 2136 | LAB268 | b_juncea|gb164|EVGN05791522303266 | 616 | 616 | 100 | globlastp |
| 2137 | LAB268 | b_juncea|gb164|EVGN06271024963259 | 616 | 616 | 100 | globlastp |
| 2138 | LAB268 | b_juncea|gb164|EVGN07020809011906 | 6418 | 616 | 100 | glotblastn |
| 2139 | LAB268 | b_oleracea|gb161|AM057682 | 616 | 616 | 100 | globlastp |
| 2140 | LAB268 | b_oleracea|gb161|AM058666 | 616 | 616 | 100 | globlastp |
| 2141 | LAB268 | b_oleracea|gb161|DY026989 | 616 | 616 | 100 | globlastp |
| 2142 | LAB268 | b_oleracea|gb161|DY027228 | 616 | 616 | 100 | globlastp |
| 2143 | LAB268 | b_oleracea|gb161|DY029054 | 616 | 616 | 100 | globlastp |
| 2144 | LAB268 | b_oleracea|gb161|DY029685 | 616 | 616 | 100 | globlastp |
| 2145 | LAB268 | b_oleracea|gb161|EE530587 | 616 | 616 | 100 | globlastp |
| 2146 | LAB268 | b_oleracea|gb161|EE534424 | 6419 | 616 | 100 | glotblastn |
| 2147 | LAB268 | b_rapa|gb162|CV432481 | 616 | 616 | 100 | globlastp |
| 2148 | LAB268 | b_rapa|gb162|CV433459 | 616 | 616 | 100 | globlastp |
| 2149 | LAB268 | b_rapa|gb162|CV544582 | 6420 | 616 | 100 | glotblastn |
| 2150 | LAB268 | b_rapa|gb162|CX269758 | 616 | 616 | 100 | globlastp |
| 2151 | LAB268 | b_rapa|gb162|CX270371 | 616 | 616 | 100 | globlastp |
| 2152 | LAB268 | b_rapa|gb162|CX270560 | 616 | 616 | 100 | globlastp |
| 2153 | LAB268 | b_rapa|gb162|DN191676 | 616 | 616 | 100 | globlastp |
| 2154 | LAB268 | b_rapa|gb162|DY009323 | 616 | 616 | 100 | globlastp |
| 2155 | LAB268 | b_rapa|gb162|EE519316 | 616 | 616 | 100 | globlastp |
| 2156 | LAB268 | banana|gb167|ES433914 | 616 | 616 | 100 | globlastp |
| 2157 | LAB268 | banana|gb167|FL651053 | 616 | 616 | 100 | globlastp |
| 2158 | LAB268 | banana|gb167|FL658965 | 616 | 616 | 100 | globlastp |
| 2159 | LAB268 | banana|gb167|FL659545 | 616 | 616 | 100 | globlastp |
| 2160 | LAB268 | barley|gb157SOLEXA|AJ434102 | 616 | 616 | 100 | globlastp |
| 2161 | LAB268 | barley|gb157SOLEXA|AJ434845 | 616 | 616 | 100 | globlastp |
| 2162 | LAB268 | barley|10v1|BE421722 | 616 | 616 | 100 | globlastp |
| 2163 | LAB268 | barley|gb157SOLEXA|AJ474132 | 616 | 616 | 100 | globlastp |
| 2164 | LAB268 | barley|gb157SOLEXA|AL503078 | 616 | 616 | 100 | globlastp |
| 2165 | LAB268 | barley|gb157SOLEXA|AL503135 | 616 | 616 | 100 | globlastp |
| 2166 | LAB268 | barley|gb157SOLEXA|AL506117 | 616 | 616 | 100 | globlastp |
| 2167 | LAB268 | barley|gb157SOLEXA|AL507050 | 616 | 616 | 100 | globlastp |
| 2168 | LAB268 | barley|gb157SOLEXA|AL508394 | 616 | 616 | 100 | globlastp |
| 2169 | LAB268 | barley|10v1|AJ434816 | 616 | 616 | 100 | globlastp |
| 2170 | LAB268 | barley|gb157SOLEXA|AL508696 | 616 | 616 | 100 | globlastp |
| 2171 | LAB268 | barley|gb157SOLEXA|AL511720 | 616 | 616 | 100 | globlastp |
| 2172 | LAB268 | barley|gb157SOLEXA|AV914119 | 616 | 616 | 100 | globlastp |
| 2173 | LAB268 | barley|gb157SOLEXA|AV916515 | 616 | 616 | 100 | globlastp |
| 2174 | LAB268 | barley|gb157SOLEXA|AW983193 | 616 | 616 | 100 | globlastp |
| 2175 | LAB268 | barley|gb157SOLEXA|AW983479 | 616 | 616 | 100 | globlastp |
| 2176 | LAB268 | barley|gb157SOLEXA|BE060192 | 616 | 616 | 100 | globlastp |
| 2177 | LAB268 | barley|10v1|BE060318 | 616 | 616 | 100 | globlastp |
| 2178 | LAB268 | barley|gb157SOLEXA|BE060318 | 616 | 616 | 100 | globlastp |
| 2179 | LAB268 | barley|gb157SOLEXA|BE060796 | 616 | 616 | 100 | globlastp |
| 2180 | LAB268 | barley|gb157SOLEXA|BE060939 | 616 | 616 | 100 | globlastp |
| 2181 | LAB268 | barley|10v1|AW982907 | 616 | 616 | 100 | globlastp |
| 2182 | LAB268 | barley|gb157SOLEXA|BI94743 | 616 | 616 | 100 | globlastp |
| 2183 | LAB268 | barley|gb157SOLEXA|BI96153 | 616 | 616 | 100 | globlastp |
| 2184 | LAB268 | barley|gb157SOLEXA|BE231189 | 616 | 616 | 100 | globlastp |
| 2185 | LAB268 | barley|gb157SOLEXA|BE412620 | 616 | 616 | 100 | globlastp |
| 2186 | LAB268 | barley|gb157SOLEXA|BE412942 | 616 | 616 | 100 | globlastp |
| 2187 | LAB268 | barley|gb157SOLEXA|BE413182 | 616 | 616 | 100 | globlastp |
| 2188 | LAB268 | barley|10v1|BE413201 | 616 | 616 | 100 | globlastp |
| 2189 | LAB268 | barley|gb157SOLEXA|BE413201 | 616 | 616 | 100 | globlastp |
| 2190 | LAB268 | barley|gb157SOLEXA|BE421722 | 616 | 616 | 100 | globlastp |
| 2191 | LAB268 | barley|gb157SOLEXA|BE421883 | 616 | 616 | 100 | globlastp |
| 2192 | LAB268 | barley|gb157SOLEXA|BE601752 | 616 | 616 | 100 | globlastp |
| 2193 | LAB268 | barley|10v1|BF624980 | 616 | 616 | 100 | globlastp |
| 2194 | LAB268 | barley|gb157SOLEXA|BF254330 | 616 | 616 | 100 | globlastp |
| 2195 | LAB268 | barley|10v1|BF624368 | 616 | 616 | 100 | globlastp |
| 2196 | LAB268 | barley|gb157SOLEXA|BF624368 | 616 | 616 | 100 | globlastp |
| 2197 | LAB268 | barley|gb157SOLEXA|BF624674 | 6421 | 616 | 100 | glotblastn |
| 2198 | LAB268 | barley|10v1|BG299458 | 616 | 616 | 100 | globlastp |
| 2199 | LAB268 | barley|gb157SOLEXA|BG299458 | 616 | 616 | 100 | globlastp |
| 2200 | LAB268 | barley|gb157SOLEXA|BG299823 | 616 | 616 | 100 | globlastp |
| 2201 | LAB268 | barley|gb157SOLEXA|BG342998 | 616 | 616 | 100 | globlastp |

TABLE 54-continued

Homologues of the identified genes/polypeptides for increasing abiotic stress
tolerance, water use efficiency, yield, growth rate, vigor, oil content, biomass, growth
rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2202 | LAB268 | barley\|gb157SOLEXA\|BG415908 | 616 | 616 | 100 | globlastp |
| 2203 | LAB268 | barley\|gb157SOLEXA\|BI778954 | 616 | 616 | 100 | globlastp |
| 2204 | LAB268 | barley\|gb157SOLEXA\|BI950815 | 616 | 616 | 100 | globlastp |
| 2205 | LAB268 | barley\|gb157SOLEXA\|BI958139 | 616 | 616 | 100 | globlastp |
| 2206 | LAB268 | barley\|gb157SOLEXA\|BM099991 | 616 | 616 | 100 | globlastp |
| 2207 | LAB268 | barley\|gb157SOLEXA\|BM374416 | 616 | 616 | 100 | globlastp |
| 2208 | LAB268 | barley\|gb157SOLEXA\|BQ459166 | 616 | 616 | 100 | globlastp |
| 2209 | LAB268 | barley\|gb157SOLEXA\|BQ460747 | 616 | 616 | 100 | globlastp |
| 2210 | LAB268 | barley\|gb157SOLEXA\|BQ470488 | 616 | 616 | 100 | globlastp |
| 2211 | LAB268 | barley\|gb157SOLEXA\|BQ658061 | 616 | 616 | 100 | globlastp |
| 2212 | LAB268 | barley\|gb157SOLEXA\|CV054877 | 616 | 616 | 100 | globlastp |
| 2213 | LAB268 | basilicum\|10v1\|DY329949 | 616 | 616 | 100 | globlastp |
| 2214 | LAB268 | basilicum\|gb157.3\|DY329949 | 616 | 616 | 100 | globlastp |
| 2215 | LAB268 | bean\|gb167\|CA898697 | 616 | 616 | 100 | globlastp |
| 2216 | LAB268 | bean\|gb167\|CA898701 | 616 | 616 | 100 | globlastp |
| 2217 | LAB268 | bean\|gb167\|CA898715 | 616 | 616 | 100 | globlastp |
| 2218 | LAB268 | bean\|gb167\|CA898716 | 616 | 616 | 100 | globlastp |
| 2219 | LAB268 | bean\|gb167\|CA898718 | 616 | 616 | 100 | globlastp |
| 2220 | LAB268 | bean\|gb167\|CA898722 | 616 | 616 | 100 | globlastp |
| 2221 | LAB268 | bean\|gb167\|CA908438 | 616 | 616 | 100 | globlastp |
| 2222 | LAB268 | bean\|gb167\|CA908452 | 616 | 616 | 100 | globlastp |
| 2223 | LAB268 | bean\|gb167\|CA908482 | 616 | 616 | 100 | globlastp |
| 2224 | LAB268 | bean\|gb167\|CV532208 | 616 | 616 | 100 | globlastp |
| 2225 | LAB268 | bean\|gb167\|CV539314 | 616 | 616 | 100 | globlastp |
| 2226 | LAB268 | bean\|gb167\|CV539770 | 616 | 616 | 100 | globlastp |
| 2227 | LAB268 | bean\|gb167\|FD785198 | 616 | 616 | 100 | globlastp |
| 2228 | LAB268 | brachypodium\|09v1\|DV488531 | 616 | 616 | 100 | globlastp |
| 2229 | LAB268 | brachypodium\|gb169\|AL829713 | 616 | 616 | 100 | globlastp |
| 2230 | LAB268 | brachypodium\|09v1\|SRR031796S0015969 | 616 | 616 | 100 | globlastp |
| 2231 | LAB268 | brachypodium\|gb169\|BE398313 | 616 | 616 | 100 | globlastp |
| 2232 | LAB268 | brachypodium\|09v1\|GT777837 | 616 | 616 | 100 | globlastp |
| 2233 | LAB268 | brachypodium\|gb169\|BE399369 | 616 | 616 | 100 | globlastp |
| 2234 | LAB268 | brachypodium\|09v1\|DV469193 | 616 | 616 | 100 | globlastp |
| 2235 | LAB268 | brachypodium\|gb169\|BE399555 | 616 | 616 | 100 | globlastp |
| 2236 | LAB268 | brachypodium\|09v1\|DV470129 | 616 | 616 | 100 | globlastp |
| 2237 | LAB268 | brachypodium\|gb169\|BE399592 | 616 | 616 | 100 | globlastp |
| 2238 | LAB268 | brachypodium\|09v1\|DV477960 | 616 | 616 | 100 | globlastp |
| 2239 | LAB268 | brachypodium\|gb169\|BE400757 | 616 | 616 | 100 | globlastp |
| 2240 | LAB268 | brachypodium\|09v1\|GT763632 | 616 | 616 | 100 | globlastp |
| 2241 | LAB268 | brachypodium\|gb169\|BE403687 | 616 | 616 | 100 | globlastp |
| 2242 | LAB268 | brachypodium\|09v1\|DV471468 | 616 | 616 | 100 | globlastp |
| 2243 | LAB268 | brachypodium\|gb169\|BE413182 | 616 | 616 | 100 | globlastp |
| 2244 | LAB268 | brachypodium\|09v1\|GT767460 | 616 | 616 | 100 | globlastp |
| 2245 | LAB268 | brachypodium\|gb169\|BE415858 | 616 | 616 | 100 | globlastp |
| 2246 | LAB268 | brachypodium\|09v1\|BRADI4G30960 | 616 | 616 | 100 | globlastp |
| 2247 | LAB268 | brachypodium\|gb169\|BE417523 | 616 | 616 | 100 | globlastp |
| 2248 | LAB268 | brachypodium\|09v1\|SRR031795S0025245 | 616 | 616 | 100 | globlastp |
| 2249 | LAB268 | brachypodium\|gb169\|BM377866 | 616 | 616 | 100 | globlastp |
| 2250 | LAB268 | brachypodium\|09v1\|GT814284 | 616 | 616 | 100 | globlastp |
| 2251 | LAB268 | brachypodium\|gb169\|CA032073 | 616 | 616 | 100 | globlastp |
| 2252 | LAB268 | bruguiera\|gb166\|BP945440 | 616 | 616 | 100 | globlastp |
| 2253 | LAB268 | cacao\|gb167\|CA794917 | 616 | 616 | 100 | globlastp |
| 2254 | LAB268 | cacao\|gb167\|CA796173 | 616 | 616 | 100 | globlastp |
| 2255 | LAB268 | cacao\|gb167\|CU471543 | 616 | 616 | 100 | globlastp |
| 2256 | LAB268 | cacao\|gb167\|CU471645 | 616 | 616 | 100 | globlastp |
| 2257 | LAB268 | cacao\|gb167\|CU471805 | 616 | 616 | 100 | globlastp |
| 2258 | LAB268 | cacao\|gb167\|CU472042 | 616 | 616 | 100 | globlastp |
| 2259 | LAB268 | cacao\|gb167\|CU475022 | 616 | 616 | 100 | globlastp |
| 2260 | LAB268 | canola\|10v1\|CD811780 | 616 | 616 | 100 | globlastp |
| 2261 | LAB268 | canola\|gb161\|CD811780 | 616 | 616 | 100 | globlastp |
| 2262 | LAB268 | canola\|10v1\|CD844108 | 616 | 616 | 100 | globlastp |
| 2263 | LAB268 | canola\|gb161\|CD812149 | 616 | 616 | 100 | globlastp |
| 2264 | LAB268 | canola\|10v1\|CD812235 | 616 | 616 | 100 | globlastp |
| 2265 | LAB268 | canola\|10v1\|CD812364 | 616 | 616 | 100 | globlastp |
| 2266 | LAB268 | canola\|10v1\|CD817281 | 616 | 616 | 100 | globlastp |
| 2267 | LAB268 | canola\|gb161\|CD817281 | 616 | 616 | 100 | globlastp |
| 2268 | LAB268 | canola\|gb161\|CD818240 | 616 | 616 | 100 | globlastp |
| 2269 | LAB268 | canola\|gb161\|CD819612 | 616 | 616 | 100 | globlastp |
| 2270 | LAB268 | canola\|10v1\|CD820828 | 616 | 616 | 100 | globlastp |
| 2271 | LAB268 | canola\|gb161\|CD820828 | 616 | 616 | 100 | globlastp |
| 2272 | LAB268 | canola\|10v1\|CD822433 | 616 | 616 | 100 | globlastp |
| 2273 | LAB268 | canola\|gb161\|CD822433 | 616 | 616 | 100 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2274 | LAB268 | canola\|gb161\|CD822786 | 6422 | 616 | 100 | glotblastn |
| 2275 | LAB268 | canola\|10v1\|CD824033 | 616 | 616 | 100 | globlastp |
| 2276 | LAB268 | canola\|gb161\|CD824033 | 616 | 616 | 100 | globlastp |
| 2277 | LAB268 | canola\|10v1\|CD837998 | 616 | 616 | 100 | globlastp |
| 2278 | LAB268 | canola\|gb161\|CD837998 | 616 | 616 | 100 | globlastp |
| 2279 | LAB268 | canola\|10v1\|CD839108 | 616 | 616 | 100 | globlastp |
| 2280 | LAB268 | canola\|gb161\|CD839108 | 616 | 616 | 100 | globlastp |
| 2281 | LAB268 | canola\|10v1\|CD842271 | 616 | 616 | 100 | globlastp |
| 2282 | LAB268 | canola\|gb161\|CD842271 | 6423 | 616 | 100 | glotblastn |
| 2283 | LAB268 | canola\|10v1\|CN730085 | 616 | 616 | 100 | globlastp |
| 2284 | LAB268 | canola\|gb161\|CN730085 | 616 | 616 | 100 | globlastp |
| 2285 | LAB268 | canola\|10v1\|CN730459 | 616 | 616 | 100 | globlastp |
| 2286 | LAB268 | canola\|10v1\|CN730487 | 616 | 616 | 100 | globlastp |
| 2287 | LAB268 | canola\|gb161\|CN735734 | 616 | 616 | 100 | globlastp |
| 2288 | LAB268 | canola\|gb161\|CN736543 | 616 | 616 | 100 | globlastp |
| 2289 | LAB268 | canola\|gb161\|CN737593 | 616 | 616 | 100 | globlastp |
| 2290 | LAB268 | canola\|gb161\|CX187745 | 616 | 616 | 100 | globlastp |
| 2291 | LAB268 | canola\|10v1\|CX195068 | 616 | 616 | 100 | globlastp |
| 2292 | LAB268 | canola\|gb161\|CX195068 | 616 | 616 | 100 | globlastp |
| 2293 | LAB268 | canola\|gb161\|EE474117 | 6424 | 616 | 100 | glotblastn |
| 2294 | LAB268 | canola\|10v1\|EE477324 | 616 | 616 | 100 | globlastp |
| 2295 | LAB268 | canola\|gb161\|EE477324 | 616 | 616 | 100 | globlastp |
| 2296 | LAB268 | canola\|10v1\|CD819612 | 616 | 616 | 100 | globlastp |
| 2297 | LAB268 | canola\|10v1\|CN735734 | 616 | 616 | 100 | globlastp |
| 2298 | LAB268 | canola\|gb161\|EL592798 | 616 | 616 | 100 | globlastp |
| 2299 | LAB268 | canola\|gb161\|EV162827 | 616 | 616 | 100 | globlastp |
| 2300 | LAB268 | cassava\|09v1\|BM259658 | 616 | 616 | 100 | globlastp |
| 2301 | LAB268 | cassava\|gb164\|BM259658 | 616 | 616 | 100 | globlastp |
| 2302 | LAB268 | cassava\|09v1\|BM259754 | 616 | 616 | 100 | globlastp |
| 2303 | LAB268 | cassava\|09v1\|BM260241 | 616 | 616 | 100 | globlastp |
| 2304 | LAB268 | cassava\|09v1\|BM260294 | 616 | 616 | 100 | globlastp |
| 2305 | LAB268 | cassava\|gb164\|BM260294 | 616 | 616 | 100 | globlastp |
| 2306 | LAB268 | cassava\|09v1\|CK645687 | 616 | 616 | 100 | globlastp |
| 2307 | LAB268 | cassava\|gb164\|CK645687 | 616 | 616 | 100 | globlastp |
| 2308 | LAB268 | cassava\|09v1\|CK650665 | 616 | 616 | 100 | globlastp |
| 2309 | LAB268 | cassava\|gb164\|CK650665 | 6425 | 616 | 100 | glotblastn |
| 2310 | LAB268 | cassava\|09v1\|BM260125 | 616 | 616 | 100 | globlastp |
| 2311 | LAB268 | castorbean\|09v1\|EE257352 | 616 | 616 | 100 | globlastp |
| 2312 | LAB268 | castorbean\|gb160\|EE257352 | 616 | 616 | 100 | globlastp |
| 2313 | LAB268 | castorbean\|09v1\|XM002531608 | 616 | 616 | 100 | globlastp |
| 2314 | LAB268 | castorbean\|gb160\|MDL29582M000246 | 616 | 616 | 100 | globlastp |
| 2315 | LAB268 | castorbean\|09v1\|XM002531610 | 616 | 616 | 100 | globlastp |
| 2316 | LAB268 | castorbean\|gb160\|MDL29582M000248 | 616 | 616 | 100 | globlastp |
| 2317 | LAB268 | castorbean\|09v1\|XM002532762 | 616 | 616 | 100 | globlastp |
| 2318 | LAB268 | castorbean\|gb160\|MDL30039M000231 | 616 | 616 | 100 | globlastp |
| 2319 | LAB268 | castorbean\|09v1\|XM002518894 | 616 | 616 | 100 | globlastp |
| 2320 | LAB268 | castorbean\|gb160\|MDL30068M002607 | 616 | 616 | 100 | globlastp |
| 2321 | LAB268 | castorbean\|09v1\|T15087 | 616 | 616 | 100 | globlastp |
| 2322 | LAB268 | castorbean\|gb160\|T15087 | 616 | 616 | 100 | globlastp |
| 2323 | LAB268 | catharanthus\|gb166\|EG556351 | 616 | 616 | 100 | globlastp |
| 2324 | LAB268 | catharanthus\|gb166\|FD415203 | 616 | 616 | 100 | globlastp |
| 2325 | LAB268 | cenchrus\|gb166\|BM084286 | 616 | 616 | 100 | globlastp |
| 2326 | LAB268 | cenchrus\|gb166\|EB652615 | 616 | 616 | 100 | globlastp |
| 2327 | LAB268 | cenchrus\|gb166\|EB653521 | 616 | 616 | 100 | globlastp |
| 2328 | LAB268 | cenchrus\|gb166\|EB654271 | 616 | 616 | 100 | globlastp |
| 2329 | LAB268 | centaurea\|gb166\|EH741190 | 616 | 616 | 100 | globlastp |
| 2330 | LAB268 | centaurea\|gb166\|EH760516 | 616 | 616 | 100 | globlastp |
| 2331 | LAB268 | chestnut\|gb170\|SRR006295S0000023 | 616 | 616 | 100 | globlastp |
| 2332 | LAB268 | chestnut\|gb170\|SRR006295S0014296 | 616 | 616 | 100 | globlastp |
| 2333 | LAB268 | chestnut\|gb170\|SRR006295S0026768 | 616 | 616 | 100 | globlastp |
| 2334 | LAB268 | chestnut\|gb170\|SRR006295S0027790 | 616 | 616 | 100 | globlastp |
| 2335 | LAB268 | chestnut\|gb170\|SRR006295S0092156 | 616 | 616 | 100 | globlastp |
| 2336 | LAB268 | cichorium\|gb171\|EH700759 | 616 | 616 | 100 | globlastp |
| 2337 | LAB268 | cichorium\|gb171\|EH701323 | 616 | 616 | 100 | globlastp |
| 2338 | LAB268 | cichorium\|gb171\|EH702007 | 616 | 616 | 100 | globlastp |
| 2339 | LAB268 | cichorium\|gb171\|EH705029 | 616 | 616 | 100 | globlastp |
| 2340 | LAB268 | cichorium\|gb171\|EL365514 | 616 | 616 | 100 | globlastp |
| 2341 | LAB268 | citrus\|gb166\|BQ623154 | 616 | 616 | 100 | globlastp |
| 2342 | LAB268 | citrus\|gb166\|BQ623438 | 616 | 616 | 100 | globlastp |
| 2343 | LAB268 | citrus\|gb166\|CB611039 | 616 | 616 | 100 | globlastp |
| 2344 | LAB268 | citrus\|gb166\|CF417550 | 616 | 616 | 100 | globlastp |
| 2345 | LAB268 | clover\|gb162\|BB915510 | 616 | 616 | 100 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2346 | LAB268 | coffea\|10v1\|DV673331 | 616 | 616 | 100 | globlastp |
| 2347 | LAB268 | coffea\|gb157.2\|BQ448811 | 616 | 616 | 100 | globlastp |
| 2348 | LAB268 | coffea\|10v1\|DV664293 | 616 | 616 | 100 | globlastp |
| 2349 | LAB268 | coffea\|gb157.2\|DV664293 | 616 | 616 | 100 | globlastp |
| 2350 | LAB268 | coffea\|10v1\|DV675511 | 616 | 616 | 100 | globlastp |
| 2351 | LAB268 | coffea\|gb157.2\|DV675511 | 616 | 616 | 100 | globlastp |
| 2352 | LAB268 | coffea\|10v1\|EE193937 | 616 | 616 | 100 | globlastp |
| 2353 | LAB268 | coffea\|gb157.2\|EE193937 | 616 | 616 | 100 | globlastp |
| 2354 | LAB268 | cotton\|gb164\|AW187455 | 616 | 616 | 100 | globlastp |
| 2355 | LAB268 | cotton\|gb164\|BE052251 | 6426 | 616 | 100 | glotblastn |
| 2356 | LAB268 | cotton\|gb164\|BE052729 | 616 | 616 | 100 | globlastp |
| 2357 | LAB268 | cotton\|gb164\|BE054464 | 616 | 616 | 100 | globlastp |
| 2358 | LAB268 | cotton\|gb164\|BF271762 | 616 | 616 | 100 | globlastp |
| 2359 | LAB268 | cotton\|gb164\|BF272645 | 616 | 616 | 100 | globlastp |
| 2360 | LAB268 | cotton\|gb164\|BG441560 | 616 | 616 | 100 | globlastp |
| 2361 | LAB268 | cotton\|gb164\|BG444562 | 616 | 616 | 100 | globlastp |
| 2362 | LAB268 | cotton\|gb164\|DR462256 | 616 | 616 | 100 | globlastp |
| 2363 | LAB268 | cowpea\|gb166\|FC456858 | 616 | 616 | 100 | globlastp |
| 2364 | LAB268 | cowpea\|gb166\|FC457669 | 616 | 616 | 100 | globlastp |
| 2365 | LAB268 | cowpea\|gb166\|FC459715 | 6427 | 616 | 100 | glotblastn |
| 2366 | LAB268 | cowpea\|gb166\|FC461880 | 616 | 616 | 100 | globlastp |
| 2367 | LAB268 | cowpea\|gb166\|FF382232 | 616 | 616 | 100 | globlastp |
| 2368 | LAB268 | cowpea\|gb166\|FF383299 | 616 | 616 | 100 | globlastp |
| 2369 | LAB268 | cowpea\|gb166\|FF385079 | 616 | 616 | 100 | globlastp |
| 2370 | LAB268 | cowpea\|gb166\|FG810633 | 616 | 616 | 100 | globlastp |
| 2371 | LAB268 | cryptomeria\|gb166\|BP175287 | 616 | 616 | 100 | globlastp |
| 2372 | LAB268 | cryptomeria\|gb166\|BW994999 | 616 | 616 | 100 | globlastp |
| 2373 | LAB268 | cryptomeria\|gb166\|BW995093 | 616 | 616 | 100 | globlastp |
| 2374 | LAB268 | cycas\|gb166\|CB089451 | 616 | 616 | 100 | globlastp |
| 2375 | LAB268 | cycas\|gb166\|CB090291 | 616 | 616 | 100 | globlastp |
| 2376 | LAB268 | cycas\|gb166\|CB090429 | 616 | 616 | 100 | globlastp |
| 2377 | LAB268 | cycas\|gb166\|CB090486 | 616 | 616 | 100 | globlastp |
| 2378 | LAB268 | cycas\|gb166\|CB090617 | 616 | 616 | 100 | globlastp |
| 2379 | LAB268 | cynara\|gb167\|GE590379 | 616 | 616 | 100 | globlastp |
| 2380 | LAB268 | cynara\|gb167\|GE592628 | 616 | 616 | 100 | globlastp |
| 2381 | LAB268 | cynara\|gb167\|GE600719 | 616 | 616 | 100 | globlastp |
| 2382 | LAB268 | dandelion\|gb161\|DY811410 | 616 | 616 | 100 | globlastp |
| 2383 | LAB268 | dandelion\|gb161\|DY834572 | 616 | 616 | 100 | globlastp |
| 2384 | LAB268 | dandelion\|gb161\|DY834792 | 616 | 616 | 100 | globlastp |
| 2385 | LAB268 | dandelion\|gb161\|DY835769 | 616 | 616 | 100 | globlastp |
| 2386 | LAB268 | dandelion\|gb161\|DY837571 | 616 | 616 | 100 | globlastp |
| 2387 | LAB268 | dandelion\|gb161\|DY838255 | 616 | 616 | 100 | globlastp |
| 2388 | LAB268 | dandelion\|gb161\|DY839212 | 616 | 616 | 100 | globlastp |
| 2389 | LAB268 | eucalyptus\|gb166\|AJ627789 | 616 | 616 | 100 | globlastp |
| 2390 | LAB268 | eucalyptus\|gb166\|AY263810 | 616 | 616 | 100 | globlastp |
| 2391 | LAB268 | eucalyptus\|gb166\|CD668212 | 616 | 616 | 100 | globlastp |
| 2392 | LAB268 | fern\|gb171\|DK946600 | 616 | 616 | 100 | globlastp |
| 2393 | LAB268 | fern\|gb171\|DK953182 | 616 | 616 | 100 | globlastp |
| 2394 | LAB268 | fescue\|gb161\|DT687120 | 616 | 616 | 100 | globlastp |
| 2395 | LAB268 | ginger\|gb164\|DY353177 | 6428 | 616 | 100 | glotblastn |
| 2396 | LAB268 | ginger\|gb164\|DY356818 | 616 | 616 | 100 | globlastp |
| 2397 | LAB268 | ginger\|gb164\|DY358348 | 616 | 616 | 100 | globlastp |
| 2398 | LAB268 | grape\|gb160\|BQ792545 | 616 | 616 | 100 | globlastp |
| 2399 | LAB268 | grape\|gb160\|CB915320 | 616 | 616 | 100 | globlastp |
| 2400 | LAB268 | grape\|gb160\|CB918446 | 616 | 616 | 100 | globlastp |
| 2401 | LAB268 | grape\|gb160\|CB972888 | 616 | 616 | 100 | globlastp |
| 2402 | LAB268 | grape\|gb160\|CF215612 | 616 | 616 | 100 | globlastp |
| 2403 | LAB268 | iceplant\|gb164\|BE034500 | 616 | 616 | 100 | globlastp |
| 2404 | LAB268 | iceplant\|gb164\|BE035965 | 616 | 616 | 100 | globlastp |
| 2405 | LAB268 | ipomoea\|gb157.2\|BJ553415 | 6429 | 616 | 100 | glotblastn |
| 2406 | LAB268 | ipomoea\|gb157.2\|BJ553690 | 616 | 616 | 100 | globlastp |
| 2407 | LAB268 | ipomoea\|gb157.2\|BJ555300 | 616 | 616 | 100 | globlastp |
| 2408 | LAB268 | ipomoea\|gb157.2\|BJ556362 | 616 | 616 | 100 | globlastp |
| 2409 | LAB268 | ipomoea\|gb157.2\|BJ556445 | 616 | 616 | 100 | globlastp |
| 2410 | LAB268 | ipomoea\|gb157.2\|BJ558611 | 616 | 616 | 100 | globlastp |
| 2411 | LAB268 | ipomoea\|gb157.2\|BJ560747 | 616 | 616 | 100 | globlastp |
| 2412 | LAB268 | ipomoea\|gb157.2\|EE875704 | 6430 | 616 | 100 | glotblastn |
| 2413 | LAB268 | kiwi\|gb166\|FG404766 | 616 | 616 | 100 | globlastp |
| 2414 | LAB268 | kiwi\|gb166\|FG410628 | 616 | 616 | 100 | globlastp |
| 2415 | LAB268 | kiwi\|gb166\|FG411099 | 616 | 616 | 100 | globlastp |
| 2416 | LAB268 | kiwi\|gb166\|FG434602 | 616 | 616 | 100 | globlastp |
| 2417 | LAB268 | kiwi\|gb166\|FG467826 | 6431 | 616 | 100 | glotblastn |

TABLE 54-continued

Homologues of the identified genes/polypeptides for increasing abiotic stress
tolerance, water use efficiency, yield, growth rate, vigor, oil content, biomass, growth
rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2418 | LAB268 | kiwi\|gb166\|FG487075 | 616 | 616 | 100 | globlastp |
| 2419 | LAB268 | kiwi\|gb166\|FG487173 | 616 | 616 | 100 | globlastp |
| 2420 | LAB268 | kiwi\|gb166\|FG487653 | 616 | 616 | 100 | globlastp |
| 2421 | LAB268 | kiwi\|gb166\|FG490714 | 616 | 616 | 100 | globlastp |
| 2422 | LAB268 | lettuce\|10v1\|DW044689 | 616 | 616 | 100 | globlastp |
| 2423 | LAB268 | lettuce\|gb157.2\|DW044689 | 616 | 616 | 100 | globlastp |
| 2424 | LAB268 | lettuce\|gb157.2\|DW046019 | 616 | 616 | 100 | globlastp |
| 2425 | LAB268 | lettuce\|gb157.2\|DW046403 | 616 | 616 | 100 | globlastp |
| 2426 | LAB268 | lettuce\|10v1\|DW047728 | 616 | 616 | 100 | globlastp |
| 2427 | LAB268 | lettuce\|gb157.2\|DW047742 | 616 | 616 | 100 | globlastp |
| 2428 | LAB268 | lettuce\|10v1\|DW048625 | 616 | 616 | 100 | globlastp |
| 2428 | LAB268 | lettuce\|gb157.2\|DW048625 | 7030 | 616 | 83.7 | globlastp |
| 2429 | LAB268 | lettuce\|10v1\|DW049814 | 616 | 616 | 100 | globlastp |
| 2430 | LAB268 | lettuce\|gb157.2\|DW052505 | 616 | 616 | 100 | globlastp |
| 2431 | LAB268 | lettuce\|gb157.2\|DW054176 | 616 | 616 | 100 | globlastp |
| 2432 | LAB268 | lettuce\|10v1\|DW054329 | 616 | 616 | 100 | globlastp |
| 2433 | LAB268 | lettuce\|gb157.2\|DW057506 | 616 | 616 | 100 | globlastp |
| 2434 | LAB268 | lettuce\|gb157.2\|DW058399 | 616 | 616 | 100 | globlastp |
| 2435 | LAB268 | lettuce\|10v1\|DW059381 | 616 | 616 | 100 | globlastp |
| 2436 | LAB268 | lettuce\|10v1\|DW060992 | 616 | 616 | 100 | globlastp |
| 2437 | LAB268 | lettuce\|gb157.2\|DW060992 | 616 | 616 | 100 | globlastp |
| 2438 | LAB268 | lettuce\|gb157.2\|DW073761 | 616 | 616 | 100 | globlastp |
| 2439 | LAB268 | lettuce\|10v1\|DW075486 | 616 | 616 | 100 | globlastp |
| 2440 | LAB268 | lettuce\|gb157.2\|DW075886 | 616 | 616 | 100 | globlastp |
| 2441 | LAB268 | lettuce\|gb157.2\|DW076059 | 616 | 616 | 100 | globlastp |
| 2442 | LAB268 | lettuce\|10v1\|DW080660 | 616 | 616 | 100 | globlastp |
| 2443 | LAB268 | lettuce\|gb157.2\|DW080660 | 616 | 616 | 100 | globlastp |
| 2444 | LAB268 | lettuce\|10v1\|DW082101 | 616 | 616 | 100 | globlastp |
| 2445 | LAB268 | lettuce\|gb157.2\|DW082101 | 616 | 616 | 100 | globlastp |
| 2446 | LAB268 | lettuce\|10v1\|DW083055 | 616 | 616 | 100 | globlastp |
| 2447 | LAB268 | lettuce\|gb157.2\|DW083055 | 616 | 616 | 100 | globlastp |
| 2448 | LAB268 | lettuce\|gb157.2\|DW104254 | 616 | 616 | 100 | globlastp |
| 2449 | LAB268 | lettuce\|10v1\|DW104257 | 616 | 616 | 100 | globlastp |
| 2450 | LAB268 | lettuce\|gb157.2\|DW105285 | 616 | 616 | 100 | globlastp |
| 2451 | LAB268 | lettuce\|10v1\|DW105457 | 616 | 616 | 100 | globlastp |
| 2452 | LAB268 | lettuce\|10v1\|DW054334 | 616 | 616 | 100 | globlastp |
| 2453 | LAB268 | lettuce\|gb157.2\|DW107742 | 616 | 616 | 100 | globlastp |
| 2454 | LAB268 | lettuce\|gb157.2\|DW111256 | 616 | 616 | 100 | globlastp |
| 2455 | LAB268 | lettuce\|gb157.2\|DW122037 | 616 | 616 | 100 | globlastp |
| 2456 | LAB268 | lettuce\|10v1\|DW122298 | 616 | 616 | 100 | globlastp |
| 2457 | LAB268 | lettuce\|gb157.2\|DW122298 | 616 | 616 | 100 | globlastp |
| 2458 | LAB268 | lettuce\|gb157.2\|DW122562 | 616 | 616 | 100 | globlastp |
| 2459 | LAB268 | lettuce\|gb157.2\|DW122564 | 616 | 616 | 100 | globlastp |
| 2460 | LAB268 | lettuce\|10v1\|DW123180 | 616 | 616 | 100 | globlastp |
| 2461 | LAB268 | lettuce\|gb157.2\|DW146313 | 616 | 616 | 100 | globlastp |
| 2462 | LAB268 | lettuce\|10v1\|DW147673 | 616 | 616 | 100 | globlastp |
| 2463 | LAB268 | lettuce\|gb157.2\|DW149190 | 616 | 616 | 100 | globlastp |
| 2464 | LAB268 | lettuce\|10v1\|DW159071 | 616 | 616 | 100 | globlastp |
| 2465 | LAB268 | lettuce\|gb157.2\|DW159071 | 616 | 616 | 100 | globlastp |
| 2466 | LAB268 | leymus\|gb166\|EG386168 | 616 | 616 | 100 | globlastp |
| 2467 | LAB268 | liquorice\|gb171\|FS238682 | 616 | 616 | 100 | globlastp |
| 2468 | LAB268 | liquorice\|gb171\|FS240232 | 616 | 616 | 100 | globlastp |
| 2469 | LAB268 | liquorice\|gb171\|FS248125 | 616 | 616 | 100 | globlastp |
| 2470 | LAB268 | liquorice\|gb171\|FS252094 | 616 | 616 | 100 | globlastp |
| 2471 | LAB268 | liriodendron\|gb166\|CK753794 | 616 | 616 | 100 | globlastp |
| 2472 | LAB268 | liriodendron\|gb166\|FD489954 | 616 | 616 | 100 | globlastp |
| 2473 | LAB268 | lotus\|09v1\|AW163944 | 616 | 616 | 100 | globlastp |
| 2474 | LAB268 | lotus\|09v1\|AW719271 | 616 | 616 | 100 | globlastp |
| 2475 | LAB268 | lotus\|gb157.2\|AW719271 | 616 | 616 | 100 | globlastp |
| 2476 | LAB268 | lotus\|09v1\|BW597052 | 616 | 616 | 100 | globlastp |
| 2477 | LAB268 | lotus\|09v1\|CB828182 | 616 | 616 | 100 | globlastp |
| 2478 | LAB268 | lovegrass\|gb167\|EH188910 | 616 | 616 | 100 | globlastp |
| 2479 | LAB268 | lovegrass\|gb167\|EH191855 | 616 | 616 | 100 | globlastp |
| 2480 | LAB268 | lovegrass\|gb167\|EH194037 | 616 | 616 | 100 | globlastp |
| 2481 | LAB268 | maize\|gb170\|AA054815 | 616 | 616 | 100 | globlastp |
| 2482 | LAB268 | maize\|gb170\|AI372169 | 616 | 616 | 100 | globlastp |
| 2483 | LAB268 | maize\|gb170\|AI391767 | 616 | 616 | 100 | globlastp |
| 2484 | LAB268 | maize\|gb170\|AI391810 | 616 | 616 | 100 | globlastp |
| 2485 | LAB268 | maize\|gb170\|AI395923 | 616 | 616 | 100 | globlastp |
| 2486 | LAB268 | maize\|gb170\|AI395924 | 616 | 616 | 100 | globlastp |
| 2487 | LAB268 | maize\|gb170\|AI586817 | 616 | 616 | 100 | globlastp |
| 2488 | LAB268 | maize\|gb170\|AI586897 | 616 | 616 | 100 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2489 | LAB268 | maize\|gb170\|AI600290 | 616 | 616 | 100 | globlastp |
| 2490 | LAB268 | maize\|gb170\|AI600370 | 616 | 616 | 100 | globlastp |
| 2491 | LAB268 | maize\|gb170\|AI665063 | 616 | 616 | 100 | globlastp |
| 2492 | LAB268 | maize\|gb170\|AI737770 | 616 | 616 | 100 | globlastp |
| 2493 | LAB268 | maize\|gb170\|AW055622 | 616 | 616 | 100 | globlastp |
| 2494 | LAB268 | maize\|gb170\|CO452276 | 616 | 616 | 100 | globlastp |
| 2495 | LAB268 | maize\|gb170\|LLAI987314 | 616 | 616 | 100 | globlastp |
| 2496 | LAB268 | maize\|gb170\|LLBE639905 | 616 | 616 | 100 | globlastp |
| 2497 | LAB268 | maize\|gb170\|LLDQ244862 | 616 | 616 | 100 | globlastp |
| 2498 | LAB268 | maize\|gb170\|LLDQ245092 | 616 | 616 | 100 | globlastp |
| 2499 | LAB268 | maize\|gb170\|LLDQ245956 | 616 | 616 | 100 | globlastp |
| 2500 | LAB268 | maize\|gb170\|LLFL026515 | 616 | 616 | 100 | globlastp |
| 2501 | LAB268 | maize\|gb170\|LLFL123174 | 616 | 616 | 100 | globlastp |
| 2502 | LAB268 | maize\|gb170\|T70634 | 616 | 616 | 100 | globlastp |
| 2503 | LAB268 | maize\|gb170\|W59839 | 616 | 616 | 100 | globlastp |
| 2504 | LAB268 | medicago\|09v1\|AA660565 | 616 | 616 | 100 | globlastp |
| 2505 | LAB268 | medicago\|gb157.2\|AA660565 | 616 | 616 | 100 | globlastp |
| 2506 | LAB268 | medicago\|09v1\|AJ389014 | 616 | 616 | 100 | globlastp |
| 2507 | LAB268 | medicago\|gb157.2\|AJ389014 | 6432 | 616 | 100 | glotblastn |
| 2508 | LAB268 | medicago\|09v1\|LLAJ498325 | 616 | 616 | 100 | globlastp |
| 2509 | LAB268 | medicago\|09v1\|LLAL366664 | 616 | 616 | 100 | globlastp |
| 2510 | LAB268 | medicago\|09v1\|AL371855 | 616 | 616 | 100 | globlastp |
| 2511 | LAB268 | medicago\|gb157.2\|AL371855 | 616 | 616 | 100 | globlastp |
| 2512 | LAB268 | medicago\|gb157.2\|AL374021 | 616 | 616 | 100 | globlastp |
| 2513 | LAB268 | medicago\|09v1\|AL378431 | 616 | 616 | 100 | globlastp |
| 2514 | LAB268 | medicago\|09v1\|AL379622 | 616 | 616 | 100 | globlastp |
| 2515 | LAB268 | medicago\|09v1\|AL374021 | 616 | 616 | 100 | globlastp |
| 2516 | LAB268 | medicago\|gb157.2\|AL380165 | 6433 | 616 | 100 | glotblastn |
| 2517 | LAB268 | medicago\|09v1\|AW208199 | 616 | 616 | 100 | globlastp |
| 2518 | LAB268 | medicago\|gb157.2\|AW208199 | 616 | 616 | 100 | globlastp |
| 2519 | LAB268 | melon\|gb165\|DV633267 | 616 | 616 | 100 | globlastp |
| 2520 | LAB268 | melon\|gb165\|EB715433 | 6434 | 616 | 100 | glotblastn |
| 2521 | LAB268 | nicotiana_benthamiana\|gb162\|CN743227 | 616 | 616 | 100 | globlastp |
| 2522 | LAB268 | nicotiana_benthamiana\|gb162\|CN743475 | 616 | 616 | 100 | globlastp |
| 2523 | LAB268 | nicotiana_benthamiana\|gb162\|ES887469 | 616 | 616 | 100 | globlastp |
| 2524 | LAB268 | nuphar\|gb166\|CD473517 | 616 | 616 | 100 | globlastp |
| 2525 | LAB268 | nuphar\|gb166\|CD474514 | 616 | 616 | 100 | globlastp |
| 2526 | LAB268 | nuphar\|gb166\|CD475677 | 616 | 616 | 100 | globlastp |
| 2527 | LAB268 | nuphar\|gb166\|CK745661 | 616 | 616 | 100 | globlastp |
| 2528 | LAB268 | nuphar\|gb166\|CK767296 | 616 | 616 | 100 | globlastp |
| 2529 | LAB268 | oak\|gb170\|CR627506 | 616 | 616 | 100 | globlastp |
| 2530 | LAB268 | oak\|gb170\|DB997093 | 616 | 616 | 100 | globlastp |
| 2531 | LAB268 | oak\|gb170\|SRR006307S0007341 | 616 | 616 | 100 | globlastp |
| 2532 | LAB268 | oak\|gb170\|SRR006307S0010902 | 616 | 616 | 100 | globlastp |
| 2533 | LAB268 | oil_palm\|gb166\|DQ400915 | 616 | 616 | 100 | globlastp |
| 2534 | LAB268 | oil_palm\|gb166\|EL681105 | 616 | 616 | 100 | globlastp |
| 2535 | LAB268 | oil_palm\|gb166\|EL681189 | 616 | 616 | 100 | globlastp |
| 2536 | LAB268 | oil_palm\|gb166\|EL682446 | 616 | 616 | 100 | globlastp |
| 2537 | LAB268 | oil_palm\|gb166\|EL683758 | 616 | 616 | 100 | globlastp |
| 2538 | LAB268 | oil_palm\|gb166\|EL691023 | 6435 | 616 | 100 | glotblastn |
| 2539 | LAB268 | onion\|gb162\|CF444612 | 616 | 616 | 100 | globlastp |
| 2540 | LAB268 | papaya\|gb165\|EX276160 | 616 | 616 | 100 | globlastp |
| 2541 | LAB268 | papaya\|gb165\|EX278412 | 6436 | 616 | 100 | glotblastn |
| 2542 | LAB268 | papaya\|gb165\|EX283624 | 616 | 616 | 100 | globlastp |
| 2543 | LAB268 | peanut\|gb171\|CD037531 | 616 | 616 | 100 | globlastp |
| 2544 | LAB268 | peanut\|gb171\|CD038462 | 616 | 616 | 100 | globlastp |
| 2545 | LAB268 | peanut\|gb171\|EE124369 | 616 | 616 | 100 | globlastp |
| 2546 | LAB268 | peanut\|gb171\|EE124731 | 616 | 616 | 100 | globlastp |
| 2547 | LAB268 | peanut\|gb171\|EE125784 | 616 | 616 | 100 | globlastp |
| 2548 | LAB268 | peanut\|gb171\|EE126870 | 616 | 616 | 100 | globlastp |
| 2549 | LAB268 | peanut\|gb171\|EG373202 | 616 | 616 | 100 | globlastp |
| 2550 | LAB268 | peanut\|gb171\|EH044313 | 616 | 616 | 100 | globlastp |
| 2551 | LAB268 | pepper\|gb171\|BM066225 | 616 | 616 | 100 | globlastp |
| 2552 | LAB268 | petunia\|gb171\|DC241756 | 616 | 616 | 100 | globlastp |
| 2553 | LAB268 | pine\|10v1\|AW043330 | 616 | 616 | 100 | globlastp |
| 2554 | LAB268 | pine\|gb157.2\|AW043330 | 6437 | 616 | 100 | glotblastn |
| 2555 | LAB268 | pine\|10v1\|AW754808 | 616 | 616 | 100 | globlastp |
| 2556 | LAB268 | pine\|gb157.2\|AW754808 | 616 | 616 | 100 | globlastp |
| 2557 | LAB268 | pine\|10v1\|BX249832 | 616 | 616 | 100 | globlastp |
| 2558 | LAB268 | pine\|gb157.2\|BX249832 | 616 | 616 | 100 | globlastp |
| 2559 | LAB268 | pine\|10v1\|BX254626 | 616 | 616 | 100 | globlastp |
| 2560 | LAB268 | pine\|gb157.2\|BX254626 | 616 | 616 | 100 | globlastp |

TABLE 54-continued

Homologues of the identified genes/polypeptides for increasing abiotic stress
tolerance, water use efficiency, yield, growth rate, vigor, oil content, biomass, growth
rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2561 | LAB268 | poplar\|10v1\|AI166092 | 616 | 616 | 100 | globlastp |
| 2562 | LAB268 | poplar\|gb170\|AI166092 | 616 | 616 | 100 | globlastp |
| 2563 | LAB268 | poplar\|10v1\|BI071500 | 616 | 616 | 100 | globlastp |
| 2564 | LAB268 | poplar\|gb170\|BI071500 | 616 | 616 | 100 | globlastp |
| 2565 | LAB268 | poplar\|10v1\|BI119617 | 616 | 616 | 100 | globlastp |
| 2566 | LAB268 | poplar\|gb170\|BI119617 | 616 | 616 | 100 | globlastp |
| 2567 | LAB268 | poplar\|gb170\|BI119694 | 616 | 616 | 100 | globlastp |
| 2568 | LAB268 | poplar\|10v1\|BI121111 | 616 | 616 | 100 | globlastp |
| 2569 | LAB268 | poplar\|gb170\|BI121111 | 616 | 616 | 100 | globlastp |
| 2570 | LAB268 | poplar\|gb170\|BU819667 | 616 | 616 | 100 | globlastp |
| 2571 | LAB268 | poplar\|10v1\|BU819908 | 616 | 616 | 100 | globlastp |
| 2572 | LAB268 | poplar\|gb170\|BU825016 | 616 | 616 | 100 | globlastp |
| 2573 | LAB268 | poplar\|gb170\|BU825437 | 616 | 616 | 100 | globlastp |
| 2574 | LAB268 | poplar\|10v1\|BU829589 | 616 | 616 | 100 | globlastp |
| 2575 | LAB268 | poplar\|gb170\|BU829589 | 616 | 616 | 100 | globlastp |
| 2576 | LAB268 | poplar\|10v1\|BU831961 | 616 | 616 | 100 | globlastp |
| 2577 | LAB268 | poplar\|gb170\|BU831961 | 616 | 616 | 100 | globlastp |
| 2578 | LAB268 | poppy\|gb166\|FE967969 | 616 | 616 | 100 | globlastp |
| 2579 | LAB268 | poppy\|gb166\|FG609652 | 616 | 616 | 100 | globlastp |
| 2580 | LAB268 | potato\|gb157.2\|BM407657 | 616 | 616 | 100 | globlastp |
| 2581 | LAB268 | prunus\|gb167\|AJ873312 | 616 | 616 | 100 | globlastp |
| 2582 | LAB268 | prunus\|gb167\|FC865249 | 616 | 616 | 100 | globlastp |
| 2583 | LAB268 | pseudoroegneria\|gb167\|FF346105 | 616 | 616 | 100 | globlastp |
| 2584 | LAB268 | pseudoroegneria\|gb167\|FF365552 | 616 | 616 | 100 | globlastp |
| 2585 | LAB268 | pseudoroegneria\|gb167\|FF365632 | 616 | 616 | 100 | globlastp |
| 2586 | LAB268 | radish\|gb164\|EV524552 | 616 | 616 | 100 | globlastp |
| 2587 | LAB268 | radish\|gb164\|EV525864 | 616 | 616 | 100 | globlastp |
| 2588 | LAB268 | radish\|gb164\|EV529106 | 616 | 616 | 100 | globlastp |
| 2589 | LAB268 | radish\|gb164\|EW714954 | 616 | 616 | 100 | globlastp |
| 2590 | LAB268 | radish\|gb164\|EW722342 | 616 | 616 | 100 | globlastp |
| 2591 | LAB268 | radish\|gb164\|EW725439 | 6438 | 616 | 100 | glotblastn |
| 2592 | LAB268 | radish\|gb164\|EX764592 | 616 | 616 | 100 | globlastp |
| 2593 | LAB268 | radish\|gb164\|EX888362 | 616 | 616 | 100 | globlastp |
| 2594 | LAB268 | radish\|gb164\|EX895689 | 616 | 616 | 100 | globlastp |
| 2595 | LAB268 | radish\|gb164\|EX902730 | 616 | 616 | 100 | globlastp |
| 2596 | LAB268 | radish\|gb164\|EY909354 | 616 | 616 | 100 | globlastp |
| 2597 | LAB268 | rice\|gb170\|OS01G61920 | 616 | 616 | 100 | globlastp |
| 2598 | LAB268 | rice\|gb170\|OS02G45940 | 616 | 616 | 100 | globlastp |
| 2599 | LAB268 | rice\|gb170\|OS03G02780 | 616 | 616 | 100 | globlastp |
| 2600 | LAB268 | rice\|gb170\|OS05G38740 | 616 | 616 | 100 | globlastp |
| 2601 | LAB268 | rice\|gb170\|OS05G39050 | 616 | 616 | 100 | globlastp |
| 2602 | LAB268 | rice\|gb170\|OS07G36500 | 616 | 616 | 100 | globlastp |
| 2603 | LAB268 | rice\|gb170\|OS09G38020 | 616 | 616 | 100 | globlastp |
| 2604 | LAB268 | rice\|gb170\|OS10G39410 | 616 | 616 | 100 | globlastp |
| 2605 | LAB268 | rose\|gb157.2\|BI977531 | 616 | 616 | 100 | globlastp |
| 2606 | LAB268 | rose\|10v1\|BI978035 | 616 | 616 | 100 | globlastp |
| 2607 | LAB268 | rose\|gb157.2\|BI978035 | 616 | 616 | 100 | globlastp |
| 2608 | LAB268 | rye\|gb164\|BE495291 | 616 | 616 | 100 | globlastp |
| 2609 | LAB268 | rye\|gb164\|BE704952 | 616 | 616 | 100 | globlastp |
| 2610 | LAB268 | rye\|gb164\|CD453256 | 6439 | 616 | 100 | glotblastn |
| 2611 | LAB268 | senecio\|gb170\|DY658928 | 616 | 616 | 100 | globlastp |
| 2612 | LAB268 | senecio\|gb170\|DY659560 | 616 | 616 | 100 | globlastp |
| 2613 | LAB268 | senecio\|gb170\|DY662328 | 616 | 616 | 100 | globlastp |
| 2614 | LAB268 | senecio\|gb170\|DY662897 | 616 | 616 | 100 | globlastp |
| 2615 | LAB268 | senecio\|gb170\|SRR006592S0002545 | 616 | 616 | 100 | globlastp |
| 2616 | LAB268 | sesame\|gb157.2\|BU668605 | 616 | 616 | 100 | globlastp |
| 2617 | LAB268 | soybean\|gb168\|AW163944 | 616 | 616 | 100 | globlastp |
| 2618 | LAB268 | soybean\|gb168\|AW348393 | 616 | 616 | 100 | globlastp |
| 2619 | LAB268 | soybean\|gb168\|AW574238 | 616 | 616 | 100 | globlastp |
| 2620 | LAB268 | soybean\|gb168\|AW719271 | 616 | 616 | 100 | globlastp |
| 2621 | LAB268 | soybean\|gb168\|BE660076 | 616 | 616 | 100 | globlastp |
| 2622 | LAB268 | soybean\|gb168\|BE660077 | 616 | 616 | 100 | globlastp |
| 2623 | LAB268 | soybean\|gb168\|BE660078 | 616 | 616 | 100 | globlastp |
| 2624 | LAB268 | soybean\|gb168\|BM140223 | 616 | 616 | 100 | globlastp |
| 2625 | LAB268 | soybean\|gb168\|BQ152712 | 616 | 616 | 100 | globlastp |
| 2626 | LAB268 | soybean\|gb168\|BU548084 | 616 | 616 | 100 | globlastp |
| 2627 | LAB268 | soybean\|gb168\|CA898697 | 616 | 616 | 100 | globlastp |
| 2628 | LAB268 | soybean\|gb168\|CA908437 | 616 | 616 | 100 | globlastp |
| 2629 | LAB268 | soybean\|gb168\|CA908482 | 616 | 616 | 100 | globlastp |
| 2630 | LAB268 | soybean\|gb168\|CD393765 | 6440 | 616 | 100 | glotblastn |
| 2631 | LAB268 | soybean\|gb168\|CD418622 | 616 | 616 | 100 | globlastp |
| 2632 | LAB268 | soybean\|gb168\|CF921561 | 616 | 616 | 100 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2633 | LAB268 | spruce\|gb162\|CO217448 | 616 | 616 | 100 | globlastp |
| 2634 | LAB268 | spruce\|gb162\|CO222157 | 616 | 616 | 100 | globlastp |
| 2635 | LAB268 | spruce\|gb162\|CO228093 | 616 | 616 | 100 | globlastp |
| 2636 | LAB268 | spruce\|gb162\|CO229500 | 6441 | 616 | 100 | glotblastn |
| 2637 | LAB268 | spruce\|gb162\|ES253514 | 616 | 616 | 100 | globlastp |
| 2638 | LAB268 | spurge\|gb161\|DV112721 | 616 | 616 | 100 | globlastp |
| 2639 | LAB268 | spurge\|gb161\|DV113563 | 616 | 616 | 100 | globlastp |
| 2640 | LAB268 | strawberry\|gb164\|DV439019 | 616 | 616 | 100 | globlastp |
| 2641 | LAB268 | strawberry\|gb164\|EX657115 | 616 | 616 | 100 | globlastp |
| 2642 | LAB268 | strawberry\|gb164\|EX665332 | 616 | 616 | 100 | globlastp |
| 2643 | LAB268 | sugarcane\|gb157.3\|BQ530407 | 616 | 616 | 100 | globlastp |
| 2644 | LAB268 | sugarcane\|gb157.3\|BQ531627 | 616 | 616 | 100 | globlastp |
| 2645 | LAB268 | sugarcane\|gb157.3\|BQ533111 | 616 | 616 | 100 | globlastp |
| 2646 | LAB268 | sugarcane\|gb157.3\|BQ535723 | 616 | 616 | 100 | globlastp |
| 2647 | LAB268 | sugarcane\|gb157.3\|CA067964 | 616 | 616 | 100 | globlastp |
| 2648 | LAB268 | sugarcane\|gb157.3\|CA070996 | 616 | 616 | 100 | globlastp |
| 2649 | LAB268 | sugarcane\|gb157.3\|CA071679 | 616 | 616 | 100 | globlastp |
| 2650 | LAB268 | sugarcane\|gb157.3\|CA071683 | 616 | 616 | 100 | globlastp |
| 2651 | LAB268 | sugarcane\|gb157.3\|CA072002 | 616 | 616 | 100 | globlastp |
| 2652 | LAB268 | sugarcane\|gb157.3\|CA072206 | 616 | 616 | 100 | globlastp |
| 2653 | LAB268 | sugarcane\|gb157.3\|CA072927 | 616 | 616 | 100 | globlastp |
| 2654 | LAB268 | sugarcane\|gb157.3\|CA073794 | 616 | 616 | 100 | globlastp |
| 2655 | LAB268 | sugarcane\|gb157.3\|CA077203 | 616 | 616 | 100 | globlastp |
| 2656 | LAB268 | sugarcane\|gb157.3\|CA078899 | 616 | 616 | 100 | globlastp |
| 2657 | LAB268 | sugarcane\|gb157.3\|CA080676 | 616 | 616 | 100 | globlastp |
| 2658 | LAB268 | sugarcane\|gb157.3\|CA081168 | 616 | 616 | 100 | globlastp |
| 2659 | LAB268 | sugarcane\|gb157.3\|CA082484 | 616 | 616 | 100 | globlastp |
| 2660 | LAB268 | sugarcane\|gb157.3\|CA087335 | 616 | 616 | 100 | globlastp |
| 2661 | LAB268 | sugarcane\|gb157.3\|CA103542 | 616 | 616 | 100 | globlastp |
| 2662 | LAB268 | sugarcane\|gb157.3\|CA112851 | 616 | 616 | 100 | globlastp |
| 2663 | LAB268 | sugarcane\|gb157.3\|CA115229 | 616 | 616 | 100 | globlastp |
| 2664 | LAB268 | sugarcane\|gb157.3\|CA116498 | 616 | 616 | 100 | globlastp |
| 2665 | LAB268 | sugarcane\|gb157.3\|CA118584 | 616 | 616 | 100 | globlastp |
| 2666 | LAB268 | sugarcane\|gb157.3\|CA136886 | 616 | 616 | 100 | globlastp |
| 2667 | LAB268 | sugarcane\|gb157.3\|CA138849 | 616 | 616 | 100 | globlastp |
| 2668 | LAB268 | sugarcane\|10v1\|CA072927 | 616 | 616 | 100 | globlastp |
| 2669 | LAB268 | sugarcane\|gb157.3\|CA200867 | 616 | 616 | 100 | globlastp |
| 2670 | LAB268 | sugarcane\|gb157.3\|CA201018 | 616 | 616 | 100 | globlastp |
| 2671 | LAB268 | sugarcane\|gb157.3\|CA201422 | 616 | 616 | 100 | globlastp |
| 2672 | LAB268 | sugarcane\|gb157.3\|CA229803 | 616 | 616 | 100 | globlastp |
| 2673 | LAB268 | sugarcane\|10v1\|BQ531627 | 616 | 616 | 100 | globlastp |
| 2674 | LAB268 | sugarcane\|gb157.3\|CA230627 | 616 | 616 | 100 | globlastp |
| 2675 | LAB268 | sugarcane\|gb157.3\|CA236648 | 616 | 616 | 100 | globlastp |
| 2676 | LAB268 | sugarcane\|10v1\|CA067964 | 616 | 616 | 100 | globlastp |
| 2677 | LAB268 | sunflower\|gb162\|CD848675 | 616 | 616 | 100 | globlastp |
| 2678 | LAB268 | sunflower\|gb162\|CD848813 | 616 | 616 | 100 | globlastp |
| 2679 | LAB268 | sunflower\|gb162\|CD848833 | 616 | 616 | 100 | globlastp |
| 2680 | LAB268 | sunflower\|gb162\|CD850963 | 616 | 616 | 100 | globlastp |
| 2681 | LAB268 | sunflower\|gb162\|CD850965 | 616 | 616 | 100 | globlastp |
| 2682 | LAB268 | sunflower\|gb162\|CD851153 | 616 | 616 | 100 | globlastp |
| 2683 | LAB268 | sunflower\|gb162\|CD852601 | 616 | 616 | 100 | globlastp |
| 2684 | LAB268 | sunflower\|gb162\|CD854963 | 6442 | 616 | 100 | glotblastn |
| 2685 | LAB268 | sunflower\|gb162\|DY917401 | 6443 | 616 | 100 | glotblastn |
| 2686 | LAB268 | sunflower\|gb162\|DY930625 | 616 | 616 | 100 | globlastp |
| 2687 | LAB268 | sunflower\|gb162\|DY946300 | 616 | 616 | 100 | globlastp |
| 2688 | LAB268 | sunflower\|gb162\|DY954323 | 616 | 616 | 100 | globlastp |
| 2689 | LAB268 | sunflower\|gb162\|EL511221 | 616 | 616 | 100 | globlastp |
| 2690 | LAB268 | switchgrass\|gb167\|DN141043 | 616 | 616 | 100 | globlastp |
| 2691 | LAB268 | switchgrass\|gb167\|DN141570 | 616 | 616 | 100 | globlastp |
| 2692 | LAB268 | switchgrass\|gb167\|DN142502 | 616 | 616 | 100 | globlastp |
| 2693 | LAB268 | switchgrass\|gb167\|DN143038 | 616 | 616 | 100 | globlastp |
| 2694 | LAB268 | switchgrass\|gb167\|DN143717 | 616 | 616 | 100 | globlastp |
| 2695 | LAB268 | switchgrass\|gb167\|DN143995 | 616 | 616 | 100 | globlastp |
| 2696 | LAB268 | switchgrass\|gb167\|DN145911 | 616 | 616 | 100 | globlastp |
| 2697 | LAB268 | switchgrass\|gb167\|DN146220 | 616 | 616 | 100 | globlastp |
| 2698 | LAB268 | switchgrass\|gb167\|DN150951 | 616 | 616 | 100 | globlastp |
| 2699 | LAB268 | switchgrass\|gb167\|FE605474 | 616 | 616 | 100 | globlastp |
| 2700 | LAB268 | switchgrass\|gb167\|FE616525 | 616 | 616 | 100 | globlastp |
| 2701 | LAB268 | switchgrass\|gb167\|FE620768 | 616 | 616 | 100 | globlastp |
| 2702 | LAB268 | switchgrass\|gb167\|FE644523 | 616 | 616 | 100 | globlastp |
| 2703 | LAB268 | switchgrass\|gb167\|FE647208 | 616 | 616 | 100 | globlastp |
| 2704 | LAB268 | switchgrass\|gb167\|FL725907 | 616 | 616 | 100 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2705 | LAB268 | switchgrass\|gb167\|FL727674 | 616 | 616 | 100 | globlastp |
| 2706 | LAB268 | tamarix\|gb166\|CD151503 | 616 | 616 | 100 | globlastp |
| 2707 | LAB268 | tamarix\|gb166\|CF198776 | 616 | 616 | 100 | globlastp |
| 2708 | LAB268 | tamarix\|gb166\|EG970851 | 616 | 616 | 100 | globlastp |
| 2709 | LAB268 | tamarix\|gb166\|EG971166 | 616 | 616 | 100 | globlastp |
| 2710 | LAB268 | tea\|10v1\|CV013740 | 616 | 616 | 100 | globlastp |
| 2711 | LAB268 | tea\|gb171\|CV013740 | 616 | 616 | 100 | globlastp |
| 2712 | LAB268 | tea\|gb171\|CV013760 | 616 | 616 | 100 | globlastp |
| 2713 | LAB268 | tea\|10v1\|CV013858 | 616 | 616 | 100 | globlastp |
| 2714 | LAB268 | tea\|gb171\|CV013858 | 616 | 616 | 100 | globlastp |
| 2715 | LAB268 | tea\|gb171\|CV014033 | 616 | 616 | 100 | globlastp |
| 2716 | LAB268 | tea\|10v1\|CV014119 | 616 | 616 | 100 | globlastp |
| 2717 | LAB268 | tea\|gb171\|CV014119 | 616 | 616 | 100 | globlastp |
| 2718 | LAB268 | tea\|10v1\|CV014596 | 616 | 616 | 100 | globlastp |
| 2719 | LAB268 | tea\|gb171\|CV014596 | 616 | 616 | 100 | globlastp |
| 2720 | LAB268 | tea\|gb171\|FE861323 | 616 | 616 | 100 | globlastp |
| 2721 | LAB268 | thellungiella\|gb167\|BY809845 | 616 | 616 | 100 | globlastp |
| 2722 | LAB268 | thellungiella\|gb167\|EC599850 | 616 | 616 | 100 | globlastp |
| 2723 | LAB268 | tobacco\|gb162\|BQ842894 | 616 | 616 | 100 | globlastp |
| 2724 | LAB268 | tobacco\|gb162\|BQ843064 | 6444 | 616 | 100 | glotblastn |
| 2725 | LAB268 | tobacco\|gb162\|BQ843158 | 616 | 616 | 100 | globlastp |
| 2726 | LAB268 | tobacco\|gb162\|BQ843164 | 616 | 616 | 100 | globlastp |
| 2727 | LAB268 | tobacco\|gb162\|CV016805 | 616 | 616 | 100 | globlastp |
| 2728 | LAB268 | tobacco\|gb162\|CV017355 | 6445 | 616 | 100 | glotblastn |
| 2729 | LAB268 | tobacco\|gb162\|CV018990 | 616 | 616 | 100 | globlastp |
| 2730 | LAB268 | tobacco\|gb162\|CV021089 | 616 | 616 | 100 | globlastp |
| 2731 | LAB268 | tomato\|09v1\|BG124775 | 616 | 616 | 100 | globlastp |
| 2732 | LAB268 | tomato\|gb164\|BG124775 | 616 | 616 | 100 | globlastp |
| 2733 | LAB268 | triphysaria\|10v1\|BM357139 | 616 | 616 | 100 | globlastp |
| 2734 | LAB268 | triphysaria\|10v1\|BM357221 | 616 | 616 | 100 | globlastp |
| 2735 | LAB268 | triphysaria\|gb164\|BM357221 | 616 | 616 | 100 | globlastp |
| 2736 | LAB268 | triphysaria\|gb164\|DR170904 | 6446 | 616 | 100 | glotblastn |
| 2737 | LAB268 | triphysaria\|10v1\|CB815232 | 616 | 616 | 100 | globlastp |
| 2738 | LAB268 | triphysaria\|10v1\|EX991298 | 616 | 616 | 100 | globlastp |
| 2739 | LAB268 | triphysaria\|10v1\|EX994401 | 616 | 616 | 100 | globlastp |
| 2740 | LAB268 | triphysaria\|10v1\|EX999992 | 616 | 616 | 100 | globlastp |
| 2741 | LAB268 | triphysaria\|10v1\|EX999279 | 616 | 616 | 100 | globlastp |
| 2742 | LAB268 | triphysaria\|10v1\|EY011518 | 616 | 616 | 100 | globlastp |
| 2743 | LAB268 | triphysaria\|10v1\|EY019376 | 616 | 616 | 100 | globlastp |
| 2744 | LAB268 | triphysaria\|10v1\|EY018118 | 616 | 616 | 100 | globlastp |
| 2745 | LAB268 | walnuts\|gb166\|CB303972 | 616 | 616 | 100 | globlastp |
| 2746 | LAB268 | walnuts\|gb166\|EL894979 | 616 | 616 | 100 | globlastp |
| 2747 | LAB268 | walnuts\|gb166\|EL899822 | 616 | 616 | 100 | globlastp |
| 2748 | LAB268 | wheat\|gb164\|AL815485 | 6447 | 616 | 100 | glotblastn |
| 2749 | LAB268 | wheat\|gb164\|AL828423 | 6448 | 616 | 100 | glotblastn |
| 2750 | LAB268 | wheat\|gb164\|BE401770 | 6449 | 616 | 100 | glotblastn |
| 2751 | LAB268 | wheat\|gb164\|BE402303 | 616 | 616 | 100 | globlastp |
| 2752 | LAB268 | wheat\|gb164\|BE403687 | 616 | 616 | 100 | globlastp |
| 2753 | LAB268 | wheat\|gb164\|BE404081 | 6450 | 616 | 100 | glotblastn |
| 2754 | LAB268 | wheat\|gb164\|BE415777 | 6451 | 616 | 100 | glotblastn |
| 2755 | LAB268 | wheat\|gb164\|BE415858 | 616 | 616 | 100 | globlastp |
| 2756 | LAB268 | wheat\|gb164\|BE415872 | 6452 | 616 | 100 | glotblastn |
| 2757 | LAB268 | wheat\|gb164\|BE415923 | 6453 | 616 | 100 | glotblastn |
| 2758 | LAB268 | wheat\|gb164\|BE416155 | 6454 | 616 | 100 | glotblastn |
| 2759 | LAB268 | wheat\|gb164\|BE416248 | 6455 | 616 | 100 | glotblastn |
| 2760 | LAB268 | wheat\|gb164\|BE419530 | 616 | 616 | 100 | globlastp |
| 2761 | LAB268 | wheat\|gb164\|BE422926 | 616 | 616 | 100 | globlastp |
| 2762 | LAB268 | wheat\|gb164\|BE423286 | 6456 | 616 | 100 | glotblastn |
| 2763 | LAB268 | wheat\|gb164\|BE424653 | 6457 | 616 | 100 | glotblastn |
| 2764 | LAB268 | wheat\|gb164\|BE427669 | 6458 | 616 | 100 | glotblastn |
| 2765 | LAB268 | wheat\|gb164\|BE490213 | 6459 | 616 | 100 | glotblastn |
| 2766 | LAB268 | wheat\|gb164\|BE586199 | 6460 | 616 | 100 | glotblastn |
| 2767 | LAB268 | wheat\|gb164\|BF199955 | 6461 | 616 | 100 | glotblastn |
| 2768 | LAB268 | wheat\|gb164\|BF473518 | 616 | 616 | 100 | globlastp |
| 2769 | LAB268 | wheat\|gb164\|BF484151 | 616 | 616 | 100 | globlastp |
| 2770 | LAB268 | wheat\|gb164\|BI480019 | 6462 | 616 | 100 | glotblastn |
| 2771 | LAB268 | wheat\|gb164\|BQ295238 | 6463 | 616 | 100 | glotblastn |
| 2772 | LAB268 | wheat\|gb164\|CA498443 | 616 | 616 | 100 | globlastp |
| 2773 | LAB268 | wheat\|gb164\|CA499277 | 6464 | 616 | 100 | glotblastn |
| 2774 | LAB268 | wheat\|gb164\|CA593119 | 6465 | 616 | 100 | glotblastn |
| 2775 | LAB268 | wheat\|gb164\|CA603109 | 6466 | 616 | 100 | glotblastn |
| 2776 | LAB268 | wheat\|gb164\|CA649743 | 6467 | 616 | 100 | glotblastn |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2777 | LAB268 | wheat\|gb164\|CA703450 | 616 | 616 | 100 | globlastp |
| 2778 | LAB268 | wheat\|gb164\|CA703620 | 6468 | 616 | 100 | glotblastn |
| 2779 | LAB268 | wheat\|gb164\|CA707912 | 6469 | 616 | 100 | glotblastn |
| 2780 | LAB268 | wheat\|gb164\|CA728989 | 6470 | 616 | 100 | glotblastn |
| 2781 | LAB268 | wheat\|gb164\|CA730994 | 616 | 616 | 100 | globlastp |
| 2782 | LAB268 | wheat\|gb164\|CN009051 | 6471 | 616 | 100 | glotblastn |
| 2783 | LAB268 | zamia\|gb166\|DY030802 | 616 | 616 | 100 | globlastp |
| 2784 | LAB268 | zamia\|gb166\|DY032938 | 616 | 616 | 100 | globlastp |
| 2785 | LAB268 | zamia\|gb166\|FD767578 | 616 | 616 | 100 | globlastp |
| 2786 | LAB268 | tea\|10v1\|CV013760 | 616 | 616 | 100 | globlastp |
| 2787 | LAB268 | triphysaria\|10v1\|BM357495 | 616 | 616 | 100 | globlastp |
| 2788 | LAB268 | barley\|10v1\|BE413182 | 616 | 616 | 100 | globlastp |
| 2789 | LAB268 | barley\|10v1\|BE454254 | 616 | 616 | 100 | globlastp |
| 2790 | LAB268 | barley\|10v1\|BE060192 | 616 | 616 | 100 | globlastp |
| 2791 | LAB268 | barley\|10v1\|BF627774 | 616 | 616 | 100 | globlastp |
| 2792 | LAB268 | canola\|10v1\|CD818240 | 616 | 616 | 100 | globlastp |
| 2793 | LAB268 | canola\|10v1\|CN737593 | 616 | 616 | 100 | globlastp |
| 2794 | LAB268 | lettuce\|10v1\|DW044538 | 616 | 616 | 100 | globlastp |
| 2795 | LAB268 | lettuce\|10v1\|DW045072 | 616 | 616 | 100 | globlastp |
| 2796 | LAB268 | lettuce\|10v1\|DW045694 | 616 | 616 | 100 | globlastp |
| 2797 | LAB268 | lettuce\|10v1\|AB183301 | 616 | 616 | 100 | globlastp |
| 2798 | LAB268 | lettuce\|10v1\|DW046403 | 616 | 616 | 100 | globlastp |
| 2799 | LAB268 | lettuce\|10v1\|DW052423 | 616 | 616 | 100 | globlastp |
| 2800 | LAB268 | lettuce\|10v1\|DW054176 | 616 | 616 | 100 | globlastp |
| 2801 | LAB268 | lettuce\|10v1\|DW057506 | 616 | 616 | 100 | globlastp |
| 2802 | LAB268 | lettuce\|10v1\|DW058399 | 616 | 616 | 100 | globlastp |
| 2803 | LAB268 | lettuce\|10v1\|DW148044 | 616 | 616 | 100 | globlastp |
| 2804 | LAB268 | lettuce\|10v1\|DW075886 | 616 | 616 | 100 | globlastp |
| 2805 | LAB268 | poplar\|10v1\|BU825437 | 616 | 616 | 100 | globlastp |
| 2806 | LAB268 | poplar\|10v1\|BU819667 | 616 | 616 | 100 | globlastp |
| 2807 | LAB268 | rose\|10v1\|BI977531 | 616 | 616 | 100 | globlastp |
| 2808 | LAB268 | rose\|10v1\|EC587236 | 616 | 616 | 100 | globlastp |
| 2809 | LAB268 | sugarcane\|10v1\|BQ533111 | 616 | 616 | 100 | globlastp |
| 2810 | LAB268 | sugarcane\|10v1\|BQ530407 | 616 | 616 | 100 | globlastp |
| 2811 | LAB268 | sugarcane\|10v1\|CA071683 | 616 | 616 | 100 | globlastp |
| 2812 | LAB268 | sugarcane\|10v1\|CA070996 | 616 | 616 | 100 | globlastp |
| 2813 | LAB268 | sugarcane\|10v1\|CA072002 | 616 | 616 | 100 | globlastp |
| 2814 | LAB268 | canola\|10v1\|CD817261 | — | 616 | 100 | globlastp |
| 2815 | LAB268 | cichorium\|gb171\|EH698983 | — | 616 | 100 | globlastp |
| 2816 | LAB268 | maize\|gb170\|AI391820 | — | 616 | 100 | glotblastn |
| 2817 | LAB268 | peanut\|gb171\|EE124716 | — | 616 | 100 | globlastp |
| 2818 | LAB268 | poplar\|gb170\|BU819908 | — | 616 | 100 | globlastp |
| 2819 | LAB268 | artemisia\|10v1\|SRR019254S0012318 | 6472 | 616 | 99.03 | glotblastn |
| 2820 | LAB268 | artemisia\|10v1\|SRR019254S0027665 | 6473 | 616 | 99.03 | glotblastn |
| 2821 | LAB268 | artemisia\|10v1\|SRR019254S0111269 | 6474 | 616 | 99.03 | glotblastn |
| 2822 | LAB268 | lettuce\|10v1\|DW083199 | 6475 | 616 | 99.03 | glotblastn |
| 2823 | LAB268 | nasturtium\|10v1\|SRR032558S0010849 | 6476 | 616 | 99.03 | glotblastn |
| 2824 | LAB268 | antirrhinum\|gb166\|AJ792433 | 6477 | 616 | 99.03 | glotblastn |
| 2825 | LAB268 | apple\|gb171\|CN490774 | 6478 | 616 | 99.03 | glotblastn |
| 2826 | LAB268 | b_rapa\|gb162\|CX270308 | 6479 | 616 | 99.03 | glotblastn |
| 2827 | LAB268 | barley\|gb157SOLEXA\|BF259003 | 6480 | 616 | 99.03 | glotblastn |
| 2828 | LAB268 | lettuce\|gb157.2\|DW084329 | 6481 | 616 | 99.03 | glotblastn |
| 2829 | LAB268 | nicotiana_benthamiana\|gb162\|CK990179 | 6482 | 616 | 99.03 | glotblastn |
| 2830 | LAB268 | spikemoss\|gb165\|DN838885 | 6483 | 616 | 99.03 | glotblastn |
| 2831 | LAB268 | spruce\|gb162\|DR582087 | 6484 | 616 | 99.03 | glotblastn |
| 2832 | LAB268 | wheat\|gb164\|AW448482 | 6485 | 616 | 99.03 | glotblastn |
| 2833 | LAB268 | wheat\|gb164\|CD873027 | 6486 | 616 | 99.03 | glotblastn |
| 2834 | LAB268 | eschscholzia\|10v1\|SRR014116S0001279 | — | 616 | 99.03 | glotblastn |
| 2835 | LAB268 | orobanche\|10v1\|SRR023189S0057009 | — | 616 | 99.03 | glotblastn |
| 2836 | LAB268 | triphysaria\|10v1\|SRR023500S0028707 | — | 616 | 99.03 | glotblastn |
| 2837 | LAB268 | basilicum\|10v1\|DY336248 | — | 616 | 99.03 | glotblastn |
| 2838 | LAB268 | arabidopsis_lyrata\|09v1\|JGIAL013923 | 6487 | 616 | 99 | globlastp |
| 2839 | LAB268 | artemisia\|10v1\|GW329205 | 6488 | 616 | 99 | globlastp |
| 2840 | LAB268 | artemisia\|10v1\|SRR019254S0020910 | 6489 | 616 | 99 | globlastp |
| 2841 | LAB268 | artemisia\|10v1\|SRR019254S0048488 | 6489 | 616 | 99 | globlastp |
| 2842 | LAB268 | artemisia\|10v1\|SRR019546S0001094 | 6490 | 616 | 99 | globlastp |
| 2843 | LAB268 | artemisia\|10v1\|SRR019550S0074110 | 6489 | 616 | 99 | globlastp |
| 2844 | LAB268 | canola\|10v1\|CD811609 | 6491 | 616 | 99 | globlastp |
| 2845 | LAB268 | chickpea\|09v2\|GR396286 | 6492 | 616 | 99 | globlastp |
| 2846 | LAB268 | eggplant\|10v1\|FS000288 | 6493 | 616 | 99 | globlastp |
| 2847 | LAB268 | eggplant\|10v1\|FS001540 | 6493 | 616 | 99 | globlastp |
| 2848 | LAB268 | jatropha\|09v1\|GH295594 | 6494 | 616 | 99 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2849 | LAB268 | lotus\|09v1\|BW594671 | 6495 | 616 | 99 | globlastp |
| 2850 | LAB268 | lotus\|09v1\|LLGO012754 | 6496 | 616 | 99 | globlastp |
| 2851 | LAB268 | medicago\|09v1\|LLCO512253 | 6497 | 616 | 99 | globlastp |
| 2852 | LAB268 | medicago\|09v1\|LLCO513425 | 6498 | 616 | 99 | globlastp |
| 2853 | LAB268 | monkeyflower\|10v1\|GR010633 | 6499 | 616 | 99 | globlastp |
| 2854 | LAB268 | nasturtium\|10v1\|GH163637 | 6493 | 616 | 99 | globlastp |
| 2855 | LAB268 | nasturtium\|10v1\|SRR032558S0007001 | 6493 | 616 | 99 | globlastp |
| 2856 | LAB268 | nasturtium\|10v1\|SRR032558S0014888 | 6493 | 616 | 99 | globlastp |
| 2857 | LAB268 | nasturtium\|10v1\|SRR032558S0126068 | 6493 | 616 | 99 | globlastp |
| 2858 | LAB268 | orobanche\|10v1\|SRR023189S0015197 | 6493 | 616 | 99 | globlastp |
| 2859 | LAB268 | orobanche\|10v1\|SRR023189S0032180 | 6493 | 616 | 99 | globlastp |
| 2860 | LAB268 | orobanche\|10v1\|SRR023189S0073604 | 6493 | 616 | 99 | globlastp |
| 2861 | LAB268 | pea\|09v1\|EX571047 | 6500 | 616 | 99 | globlastp |
| 2862 | LAB268 | physcomitrella\|10v1\|XM001768153 | 6501 | 616 | 99 | globlastp |
| 2863 | LAB268 | physcomitrella\|10v1\|XM001782794 | 6502 | 616 | 99 | globlastp |
| 2864 | LAB268 | pigeonpea\|gb171\|GR471516 | 6503 | 616 | 99 | globlastp |
| 2865 | LAB268 | pine\|10v1\|DR682322 | 6504 | 616 | 99 | globlastp |
| 2866 | LAB268 | pine\|10v1\|GT259202 | 6504 | 616 | 99 | globlastp |
| 2867 | LAB268 | potato\|10v1\|BG595694 | 6493 | 616 | 99 | globlastp |
| 2868 | LAB268 | potato\|10v1\|BM403808 | 6493 | 616 | 99 | globlastp |
| 2869 | LAB268 | rhizophora\|10v1\|SRR005793S0017626 | 6505 | 616 | 99 | globlastp |
| 2870 | LAB268 | solanum_phureja\|09v1\|SPHBG123365 | 6493 | 616 | 99 | globlastp |
| 2871 | LAB268 | solanum_phureja\|09v1\|SPHBG123501 | 6493 | 616 | 99 | globlastp |
| 2872 | LAB268 | solanum_phureja\|09v1\|SPHBG123908 | 6493 | 616 | 99 | globlastp |
| 2873 | LAB268 | solanum_phureja\|09v1\|SPHBG124249 | 6493 | 616 | 99 | globlastp |
| 2874 | LAB268 | solanum_phureja\|09v1\|SPHBG125424 | 6493 | 616 | 99 | globlastp |
| 2875 | LAB268 | solanum_phureja\|09v1\|SPHBG125445 | 6493 | 616 | 99 | globlastp |
| 2876 | LAB268 | solanum_phureja\|09v1\|SPHBG126504 | 6493 | 616 | 99 | globlastp |
| 2877 | LAB268 | solanum_phureja\|09v1\|SPHBG130199 | 6493 | 616 | 99 | globlastp |
| 2878 | LAB268 | solanum_phureja\|09v1\|SPHBG627699 | 6493 | 616 | 99 | globlastp |
| 2879 | LAB268 | solanum_phureja\|09v1\|SPHCRPSP003816 | 6493 | 616 | 99 | globlastp |
| 2880 | LAB268 | solanum_phureja\|09v1\|SPHCRPSP036363 | 6493 | 616 | 99 | globlastp |
| 2881 | LAB268 | sugarcane\|10v1\|CA111726 | 6506 | 616 | 99 | globlastp |
| 2882 | LAB268 | tomato\|09v1\|BG123908 | 6493 | 616 | 99 | globlastp |
| 2883 | LAB268 | tomato\|09v1\|BG126504 | 6493 | 616 | 99 | globlastp |
| 2884 | LAB268 | tomato\|09v1\|CN216197 | 6493 | 616 | 99 | globlastp |
| 2885 | LAB268 | tragopogon\|10v1\|SRR020205S0007187 | 6507 | 616 | 99 | globlastp |
| 2886 | LAB268 | amborella\|gb166\|CK763863 | 6489 | 616 | 99 | globlastp |
| 2887 | LAB268 | antirrhinum\|gb166\|AJ799109 | 6508 | 616 | 99 | globlastp |
| 2888 | LAB268 | apple\|gb171\|CN443956 | 6509 | 616 | 99 | globlastp |
| 2889 | LAB268 | apple\|gb171\|CN489447 | 6509 | 616 | 99 | globlastp |
| 2890 | LAB268 | apple\|gb171\|CN490043 | 6509 | 616 | 99 | globlastp |
| 2891 | LAB268 | apple\|gb171\|CN491079 | 6509 | 616 | 99 | globlastp |
| 2892 | LAB268 | apple\|gb171\|CN997061 | 6509 | 616 | 99 | globlastp |
| 2893 | LAB268 | apple\|gb171\|CN997883 | 6509 | 616 | 99 | globlastp |
| 2894 | LAB268 | apple\|gb171\|CO065741 | 6509 | 616 | 99 | globlastp |
| 2895 | LAB268 | apple\|gb171\|CO415792 | 6509 | 616 | 99 | globlastp |
| 2896 | LAB268 | apple\|gb171\|CO416659 | 6509 | 616 | 99 | globlastp |
| 2897 | LAB268 | artemisia\|gb164\|EY053904 | 6510 | 616 | 99 | globlastp |
| 2898 | LAB268 | avocado\|gb164\|CK754635 | 6489 | 616 | 99 | globlastp |
| 2899 | LAB268 | b_rapa\|gb162\|CX271147 | 6511 | 616 | 99 | globlastp |
| 2900 | LAB268 | barley\|10v1\|BG342998 | 6512 | 616 | 99 | globlastp |
| 2901 | LAB268 | barley\|gb157SOLEXA\|AL505955 | 6512 | 616 | 99 | globlastp |
| 2902 | LAB268 | barley\|gb157SOLEXA\|BG416680 | 6513 | 616 | 99 | globlastp |
| 2903 | LAB268 | basilicum\|10v1\|DY323944 | 6489 | 616 | 99 | globlastp |
| 2904 | LAB268 | cenchrus\|gb166\|EB654992 | 6514 | 616 | 99 | globlastp |
| 2905 | LAB268 | cenchrus\|gb166\|EB665044 | 6515 | 616 | 99 | globlastp |
| 2906 | LAB268 | cynara\|gb167\|GE589503 | 6513 | 616 | 99 | globlastp |
| 2907 | LAB268 | cynara\|gb167\|GE601275 | 6516 | 616 | 99 | globlastp |
| 2908 | LAB268 | ginger\|gb164\|DY362774 | 6517 | 616 | 99 | globlastp |
| 2909 | LAB268 | kiwi\|gb166\|FG412369 | 6518 | 616 | 99 | globlastp |
| 2910 | LAB268 | kiwi\|gb166\|FG511349 | 6519 | 616 | 99 | globlastp |
| 2911 | LAB268 | lettuce\|10v1\|DW049144 | 6520 | 616 | 99 | globlastp |
| 2912 | LAB268 | lettuce\|gb157.2\|DW154476 | 6521 | 616 | 99 | globlastp |
| 2913 | LAB268 | marchantia\|gb166\|AU081695 | 6522 | 616 | 99 | globlastp |
| 2914 | LAB268 | marchantia\|gb166\|AU081848 | 6522 | 616 | 99 | globlastp |
| 2915 | LAB268 | marchantia\|gb166\|BJ849115 | 6522 | 616 | 99 | globlastp |
| 2916 | LAB268 | medicago\|gb157.2\|AJ498325 | 6523 | 616 | 99 | globlastp |
| 2917 | LAB268 | melon\|gb165\|AM732498 | 6524 | 616 | 99 | globlastp |
| 2918 | LAB268 | oil_palm\|gb166\|EY396434 | 6489 | 616 | 99 | globlastp |
| 2919 | LAB268 | onion\|gb162\|AA451589 | 6525 | 616 | 99 | globlastp |
| 2920 | LAB268 | ostreococcus\|gb162\|XM001415987 | 6526 | 616 | 99 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2921 | LAB268 | ostreococcus\|gb162\|XM001420298 | 6526 | 616 | 99 | globlastp |
| 2922 | LAB268 | pepper\|gb171\|AA840708 | 6493 | 616 | 99 | globlastp |
| 2923 | LAB268 | pepper\|gb171\|AA840801 | 6493 | 616 | 99 | globlastp |
| 2924 | LAB268 | pepper\|gb171\|BM065365 | 6493 | 616 | 99 | globlastp |
| 2925 | LAB268 | pepper\|gb171\|BM065900 | 6493 | 616 | 99 | globlastp |
| 2926 | LAB268 | pepper\|gb171\|BM066186 | 6493 | 616 | 99 | globlastp |
| 2927 | LAB268 | pepper\|gb171\|BM066215 | 6493 | 616 | 99 | globlastp |
| 2928 | LAB268 | pepper\|gb171\|BM068037 | 6493 | 616 | 99 | globlastp |
| 2929 | LAB268 | pepper\|gb171\|CA519950 | 6493 | 616 | 99 | globlastp |
| 2930 | LAB268 | pepper\|gb171\|GD058514 | 6493 | 616 | 99 | globlastp |
| 2931 | LAB268 | pepper\|gb171\|GD068989 | 6493 | 616 | 99 | globlastp |
| 2932 | LAB268 | pepper\|gb171\|GD109617 | 6493 | 616 | 99 | globlastp |
| 2933 | LAB268 | petunia\|gb171\|AY650011 | 6527 | 616 | 99 | globlastp |
| 2934 | LAB268 | petunia\|gb171\|FN003085 | 6528 | 616 | 99 | globlastp |
| 2935 | LAB268 | petunia\|gb171\|FN003987 | 6504 | 616 | 99 | globlastp |
| 2936 | LAB268 | pine\|10v1\|AA739509 | 6504 | 616 | 99 | globlastp |
| 2937 | LAB268 | pine\|gb157.2\|AA739509 | 6504 | 616 | 99 | globlastp |
| 2938 | LAB268 | pine\|10v1\|AW064813 | 6504 | 616 | 99 | globlastp |
| 2939 | LAB268 | pine\|gb157.2\|AW064813 | 6504 | 616 | 99 | globlastp |
| 2940 | LAB268 | pine\|gb157.2\|BX250390 | 6504 | 616 | 99 | globlastp |
| 2941 | LAB268 | pine\|10v1\|CX715301 | 6504 | 616 | 99 | globlastp |
| 2942 | LAB268 | pine\|gb157.2\|CX715301 | 6504 | 616 | 99 | globlastp |
| 2943 | LAB268 | pine\|10v1\|BX679616 | 6504 | 616 | 99 | globlastp |
| 2944 | LAB268 | potato\|gb157.2\|BE923376 | 6493 | 616 | 99 | globlastp |
| 2945 | LAB268 | potato\|10v1\|BF054460 | 6493 | 616 | 99 | globlastp |
| 2946 | LAB268 | potato\|gb157.2\|BF054460 | 6493 | 616 | 99 | globlastp |
| 2947 | LAB268 | potato\|10v1\|BM109083 | 6493 | 616 | 99 | globlastp |
| 2948 | LAB268 | potato\|gb157.2\|BM405205 | 6493 | 616 | 99 | globlastp |
| 2949 | LAB268 | potato\|10v1\|BM407657 | 6489 | 616 | 99 | globlastp |
| 2950 | LAB268 | potato\|10v1\|BQ512707 | 6493 | 616 | 99 | globlastp |
| 2951 | LAB268 | potato\|gb157.2\|BQ514906 | 6493 | 616 | 99 | globlastp |
| 2952 | LAB268 | potato\|10v1\|BQ518377 | 6493 | 616 | 99 | globlastp |
| 2953 | LAB268 | radish\|gb164\|EV536543 | 6529 | 616 | 99 | globlastp |
| 2954 | LAB268 | radish\|gb164\|EV546187 | 6530 | 616 | 99 | globlastp |
| 2955 | LAB268 | radish\|gb164\|EV567987 | 6508 | 616 | 99 | globlastp |
| 2956 | LAB268 | radish\|gb164\|EX762693 | 6531 | 616 | 99 | globlastp |
| 2957 | LAB268 | radish\|gb164\|EX902598 | 6532 | 616 | 99 | globlastp |
| 2958 | LAB268 | rye\|gb164\|BE493960 | 6489 | 616 | 99 | globlastp |
| 2959 | LAB268 | rye\|gb164\|BE494160 | 6489 | 616 | 99 | globlastp |
| 2960 | LAB268 | rye\|gb164\|BE494831 | 6489 | 616 | 99 | globlastp |
| 2961 | LAB268 | rye\|gb164\|BE495294 | 6533 | 616 | 99 | globlastp |
| 2962 | LAB268 | spruce\|gb162\|CO215151 | 6504 | 616 | 99 | globlastp |
| 2963 | LAB268 | spruce\|gb162\|CO237421 | 6504 | 616 | 99 | globlastp |
| 2964 | LAB268 | spruce\|gb162\|DR481285 | 6504 | 616 | 99 | globlastp |
| 2965 | LAB268 | spruce\|gb162\|DR495585 | 6504 | 616 | 99 | globlastp |
| 2966 | LAB268 | spruce\|gb162\|DR575192 | 6504 | 616 | 99 | globlastp |
| 2967 | LAB268 | spurge\|gb161\|DV113675 | 6534 | 616 | 99 | globlastp |
| 2968 | LAB268 | sugarcane\|gb157.3\|CA102127 | 6535 | 616 | 99 | globlastp |
| 2969 | LAB268 | sugarcane\|gb157.3\|CA127979 | 6536 | 616 | 99 | globlastp |
| 2970 | LAB268 | sugarcane\|gb157.3\|CA128041 | 6537 | 616 | 99 | globlastp |
| 2971 | LAB268 | sugarcane\|gb157.3\|CA241735 | 6538 | 616 | 99 | globlastp |
| 2972 | LAB268 | sunflower\|gb162\|CF090846 | 6491 | 616 | 99 | globlastp |
| 2973 | LAB268 | tamarix\|gb166\|EG971827 | 6539 | 616 | 99 | globlastp |
| 2974 | LAB268 | tobacco\|gb162\|BQ843074 | 6540 | 616 | 99 | globlastp |
| 2975 | LAB268 | tobacco\|gb162\|EB683839 | 6504 | 616 | 99 | globlastp |
| 2976 | LAB268 | tomato\|09v1\|BG123365 | 6493 | 616 | 99 | globlastp |
| 2977 | LAB268 | tomato\|09v1\|BG123501 | 6493 | 616 | 99 | globlastp |
| 2978 | LAB268 | tomato\|gb164\|BG123501 | 6493 | 616 | 99 | globlastp |
| 2979 | LAB268 | tomato\|gb164\|BG123908 | 6493 | 616 | 99 | globlastp |
| 2980 | LAB268 | tomato\|09v1\|BG124249 | 6493 | 616 | 99 | globlastp |
| 2981 | LAB268 | tomato\|gb164\|BG124249 | 6493 | 616 | 99 | globlastp |
| 2982 | LAB268 | tomato\|09v1\|BG125424 | 6493 | 616 | 99 | globlastp |
| 2983 | LAB268 | tomato\|09v1\|BG125445 | 6493 | 616 | 99 | globlastp |
| 2984 | LAB268 | tomato\|gb164\|BG125445 | 6493 | 616 | 99 | globlastp |
| 2985 | LAB268 | tomato\|09v1\|BG126455 | 6493 | 616 | 99 | globlastp |
| 2986 | LAB268 | tomato\|09v1\|BG130199 | 6493 | 616 | 99 | globlastp |
| 2987 | LAB268 | triphysaria\|gb164\|BM357139 | 6541 | 616 | 99 | globlastp |
| 2988 | LAB268 | walnuts\|gb166\|EL892095 | 6542 | 616 | 99 | globlastp |
| 2989 | LAB268 | lettuce\|10v1\|DW052505 | 6521 | 616 | 99 | globlastp |
| 2990 | LAB268 | potato\|10v1\|BQ514906 | 6493 | 616 | 99 | globlastp |
| 2991 | LAB268 | rose\|10v1\|EC586553 | 6543 | 616 | 99 | globlastp |
| 2992 | LAB268 | arabidopsis_lyrata\|09v1\|CRPALE018329 | 6544 | 616 | 98.1 | globlastp |

TABLE 54-continued

Homologues of the identified genes/polypeptides for increasing abiotic stress
tolerance, water use efficiency, yield, growth rate, vigor, oil content, biomass, growth
rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 2993 | LAB268 | artemisia\|10v1\|SRR019254S0005641 | 6545 | 616 | 98.1 | globlastp |
| 2994 | LAB268 | artemisia\|10v1\|SRR019254S0085816 | 6544 | 616 | 98.1 | globlastp |
| 2995 | LAB268 | gerbera\|09v1\|AJ753834 | 6544 | 616 | 98.1 | globlastp |
| 2996 | LAB268 | pine\|10v1\|GT260140 | 6546 | 616 | 98.1 | globlastp |
| 2997 | LAB268 | potato\|10v1\|BE923376 | 6547 | 616 | 98.1 | globlastp |
| 2998 | LAB268 | tomato\|09v1\|BF054460 | 6548 | 616 | 98.1 | globlastp |
| 2999 | LAB268 | artemisia\|gb164\|EY035013 | 6549 | 616 | 98.1 | globlastp |
| 3000 | LAB268 | artemisia\|gb164\|EY037977 | 6544 | 616 | 98.1 | globlastp |
| 3001 | LAB268 | artemisia\|gb164\|EY056079 | 6550 | 616 | 98.1 | globlastp |
| 3002 | LAB268 | banana\|gb167\|FL659268 | 6551 | 616 | 98.1 | globlastp |
| 3003 | LAB268 | barley\|gb157SOLEXA\|BG416840 | 6552 | 616 | 98.1 | globlastp |
| 3004 | LAB268 | cassava\|gb164\|BM259754 | 6553 | 616 | 98.1 | globlastp |
| 3005 | LAB268 | cryptomeria\|gb166\|AU299923 | 6554 | 616 | 98.1 | globlastp |
| 3006 | LAB268 | cynara\|gb167\|GE596075 | 6555 | 616 | 98.1 | globlastp |
| 3007 | LAB268 | lettuce\|gb157.2\|DW085444 | 6544 | 616 | 98.1 | globlastp |
| 3008 | LAB268 | lettuce\|gb157.2\|DW123180 | 6556 | 616 | 98.1 | globlastp |
| 3009 | LAB268 | lettuce\|gb157.2\|DW145765 | 6556 | 616 | 98.1 | globlastp |
| 3010 | LAB268 | lovegrass\|gb167\|EH187368 | 6557 | 616 | 98.1 | globlastp |
| 3011 | LAB268 | medicago\|gb157.2\|AL379622 | 6558 | 616 | 98.1 | globlastp |
| 3012 | LAB268 | nicotiana_benthamiana\|gb162\|CN746600 | 6559 | 616 | 98.1 | globlastp |
| 3013 | LAB268 | petunia\|gb171\|CV296942 | 6560 | 616 | 98.1 | globlastp |
| 3014 | LAB268 | petunia\|gb171\|FN008035 | 6561 | 616 | 98.1 | globlastp |
| 3015 | LAB268 | pine\|gb157.2\|DN611308 | 6562 | 616 | 98.1 | globlastp |
| 3016 | LAB268 | potato\|10v1\|CK249827 | 6554 | 616 | 98.1 | globlastp |
| 3016 | LAB268 | potato\|gb157.2\|CK249827 | 6673 | 616 | 93.5 | globlastp |
| 3017 | LAB268 | potato\|10v1\|CV475517 | 6563 | 616 | 98.1 | globlastp |
| 3018 | LAB268 | pseudoroegneria\|gb167\|FF366172 | 6564 | 616 | 98.1 | globlastp |
| 3019 | LAB268 | radish\|gb164\|FD937807 | 6565 | 616 | 98.1 | globlastp |
| 3020 | LAB268 | rye\|gb164\|BE587390 | 6566 | 616 | 98.1 | globlastp |
| 3021 | LAB268 | sugarcane\|gb157.3\|CA072969 | 6567 | 616 | 98.1 | globlastp |
| 3022 | LAB268 | sugarcane\|gb157.3\|CA111743 | 6568 | 616 | 98.1 | globlastp |
| 3023 | LAB268 | sugarcane\|gb157.3\|CA140464 | 6569 | 616 | 98.1 | globlastp |
| 3024 | LAB268 | walnuts\|gb166\|EL894813 | 6570 | 616 | 98.1 | globlastp |
| 3025 | LAB268 | zinnia\|gb171\|AU290856 | 6544 | 616 | 98.1 | globlastp |
| 3026 | LAB268 | pine\|10v1\|DR694482 | 6571 | 616 | 98.1 | globlastp |
| 3027 | LAB268 | artemisia\|10v1\|SRR019254S0090211 | 6572 | 616 | 98.06 | glotblastn |
| 3028 | LAB268 | sugarcane\|gb157.3\|CA116605 | 6573 | 616 | 98.06 | glotblastn |
| 3029 | LAB268 | wheat\|gb164\|BJ315666 | 6574 | 616 | 98.06 | glotblastn |
| 3030 | LAB268 | wheat\|gb164\|CA623503 | 6575 | 616 | 98.06 | glotblastn |
| 3031 | LAB268 | wheat\|gb164\|CA630334 | 6576 | 616 | 98.06 | glotblastn |
| 3032 | LAB268 | artemisia\|10v1\|SRR019254S0022227 | — | 616 | 98.06 | glotblastn |
| 3033 | LAB268 | artemisia\|10v1\|SRR019254S0216912 | — | 616 | 98.06 | glotblastn |
| 3034 | LAB268 | dandelion\|gb161\|DY840608 | — | 616 | 98.06 | glotblastn |
| 3035 | LAB268 | tea\|gb171\|FE861322 | — | 616 | 98.06 | glotblastn |
| 3036 | LAB268 | radish\|gb164\|EW726563 | 6577 | 616 | 97.2 | globlastp |
| 3037 | LAB268 | avocado\|10v1\|CO995142 | 6578 | 616 | 97.1 | globlastp |
| 3038 | LAB268 | orobanche\|10v1\|SRR023495S0084187 | 6578 | 616 | 97.1 | globlastp |
| 3039 | LAB268 | apple\|gb171\|CN494677 | 6579 | 616 | 97.1 | globlastp |
| 3040 | LAB268 | maize\|gb170\|LLFL427387 | 6580 | 616 | 97.1 | globlastp |
| 3041 | LAB268 | pine\|10v1\|CF388178 | 6581 | 616 | 97.1 | globlastp |
| 3041 | LAB268 | pine\|gb157.2\|CF388178 | 6963 | 616 | 84.7 | globlastp |
| 3042 | LAB268 | pine\|gb157.2\|DR694482 | 6582 | 616 | 97.1 | globlastp |
| 3043 | LAB268 | rose\|gb157.2\|EC586553 | 6583 | 616 | 97.1 | globlastp |
| 3044 | LAB268 | soybean\|gb168\|CA898703 | 6584 | 616 | 97.1 | globlastp |
| 3045 | LAB268 | sugarcane\|gb157.3\|CA213810 | 6585 | 616 | 97.1 | globlastp |
| 3046 | LAB268 | tobacco\|gb162\|AJ633035 | 6586 | 616 | 97.1 | globlastp |
| 3047 | LAB268 | volvox\|gb162\|BU645998 | 6587 | 616 | 97.1 | globlastp |
| 3048 | LAB268 | volvox\|gb162\|CBGZ25401FWD | 6587 | 616 | 97.1 | globlastp |
| 3049 | LAB268 | volvox\|gb162\|MDLJGIVOLCA1102100 | 6587 | 616 | 97.1 | globlastp |
| 3050 | LAB268 | volvox\|gb162\|MDLJGIVOLCA1102370 | 6587 | 616 | 97.1 | globlastp |
| 3051 | LAB268 | volvox\|gb162\|MDLJGIVOLCA155291 | 6587 | 616 | 97.1 | globlastp |
| 3052 | LAB268 | volvox\|gb162\|MDLJGIVOLCA155542 | 6587 | 616 | 97.1 | globlastp |
| 3053 | LAB268 | volvox\|gb162\|MDLJGIVOLCA156769 | 6587 | 616 | 97.1 | globlastp |
| 3054 | LAB268 | volvox\|gb162\|MDLJGIVOLCA163165 | 6587 | 616 | 97.1 | globlastp |
| 3055 | LAB268 | volvox\|gb162\|MDLJGIVOLCA188140 | 6587 | 616 | 97.1 | globlastp |
| 3056 | LAB268 | zinnia\|gb171\|DV017431 | 6588 | 616 | 97.1 | globlastp |
| 3057 | LAB268 | artemisia\|10v1\|SRR019546S0127820 | 6589 | 616 | 97.09 | glotblastn |
| 3058 | LAB268 | artemisia\|10v1\|SRR019547S0487952 | 6590 | 616 | 97.09 | glotblastn |
| 3059 | LAB268 | artemisia\|10v1\|SRR019550S0086000 | 6591 | 616 | 97.09 | glotblastn |
| 3060 | LAB268 | gerbera\|09v1\|AJ755846 | 6592 | 616 | 97.09 | glotblastn |
| 3061 | LAB268 | amborella\|gb166\|FD427255 | 6593 | 616 | 97.09 | glotblastn |
| 3062 | LAB268 | cotton\|gb164\|W484397 | 6594 | 616 | 97.09 | glotblastn |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3063 | LAB268 | ipomoea\|gb157.2\|DV034788 | 6595 | 616 | 97.09 | glotblastn |
| 3064 | LAB268 | rose\|gb157.2\|EC587467 | 6596 | 616 | 97.09 | glotblastn |
| 3065 | LAB268 | volvox\|gb162\|MDLJGIVOLCA1103472 | 6597 | 616 | 97.09 | glotblastn |
| 3066 | LAB268 | volvox\|gb162\|MDLJGIVOLCA1108939 | 6598 | 616 | 97.09 | glotblastn |
| 3067 | LAB268 | basilicum\|gb157.3\|DY336248 | — | 616 | 97.09 | glotblastn |
| 3068 | LAB268 | lettuce\|gb157.2\|DW049814 | 6599 | 616 | 96.3 | globlastp |
| 3069 | LAB268 | sunflower\|gb162\|CF088050 | 6600 | 616 | 96.3 | globlastp |
| 3070 | LAB268 | nasturtium\|10v1\|SRR032563S0097524 | 6601 | 616 | 96.2 | globlastp |
| 3071 | LAB268 | basilicum\|gb157.3\|DY323944 | 6602 | 616 | 96.2 | globlastp |
| 3072 | LAB268 | monkeyflower\|10v1\|DV206995 | 6603 | 616 | 96.12 | glotblastn |
| 3073 | LAB268 | oat\|10v1\|GO585940 | 6604 | 616 | 96.12 | glotblastn |
| 3074 | LAB268 | oat\|10v1\|GO586224 | 6605 | 616 | 96.12 | glotblastn |
| 3075 | LAB268 | oat\|10v1\|GO586484 | 6606 | 616 | 96.12 | glotblastn |
| 3076 | LAB268 | oat\|10v1\|GO586800 | 6607 | 616 | 96.12 | glotblastn |
| 3077 | LAB268 | oat\|10v1\|CN814783 | 6608 | 616 | 96.12 | glotblastn |
| 3078 | LAB268 | sugarcane\|gb157.3\|CA082940 | 6609 | 616 | 96.12 | glotblastn |
| 3079 | LAB268 | wheat\|gb164\|CA617786 | 6610 | 616 | 96.12 | glotblastn |
| 3080 | LAB268 | wheat\|gb164\|CA618960 | 6611 | 616 | 96.12 | glotblastn |
| 3081 | LAB268 | sunflower\|gb162\|DY959162 | — | 616 | 96.12 | glotblastn |
| 3082 | LAB268 | artemisia\|10v1\|SRR019254S0002617 | 6612 | 616 | 96.1 | globlastp |
| 3083 | LAB268 | fescue\|gb161\|DT686102 | 6613 | 616 | 96.1 | globlastp |
| 3084 | LAB268 | fescue\|gb161\|DT690378 | 6614 | 616 | 96.1 | globlastp |
| 3085 | LAB268 | senecio\|gb170\|DY663617 | 6614 | 616 | 96.1 | globlastp |
| 3086 | LAB268 | spurge\|gb161\|DV116777 | 6615 | 616 | 96.1 | globlastp |
| 3087 | LAB268 | sugarcane\|gb157.3\|CA226811 | 6616 | 616 | 96.1 | globlastp |
| 3088 | LAB268 | tobacco\|gb162\|AM838335 | 6617 | 616 | 96.1 | globlastp |
| 3089 | LAB268 | canola\|gb161\|CX193674 | 6618 | 616 | 95.4 | globlastp |
| 3090 | LAB268 | rye\|gb164\|BE636849 | 6619 | 616 | 95.4 | globlastp |
| 3091 | LAB268 | triphysaria\|gb164\|EX999279 | 6620 | 616 | 95.4 | globlastp |
| 3092 | LAB268 | wheat\|gb164\|BE591511 | 6621 | 616 | 95.4 | globlastp |
| 3093 | LAB268 | canola\|gb161\|EE502343 | 6622 | 616 | 95.3 | globlastp |
| 3094 | LAB268 | chickpea\|09v2\|GR398035 | 6623 | 616 | 95.15 | glotblastn |
| 3095 | LAB268 | oat\|10v1\|CN821564 | 6624 | 616 | 95.15 | glotblastn |
| 3096 | LAB268 | oat\|10v1\|GO586658 | 6625 | 616 | 95.15 | glotblastn |
| 3097 | LAB268 | oat\|10v1\|GR332308 | 6626 | 616 | 95.15 | glotblastn |
| 3098 | LAB268 | oat\|10v1\|GR365369 | 6627 | 616 | 95.15 | glotblastn |
| 3099 | LAB268 | eucalyptus\|gb166\|CD668166 | 6628 | 616 | 95.15 | glotblastn |
| 3100 | LAB268 | onion\|gb162\|BI095512 | 6629 | 616 | 95.15 | glotblastn |
| 3101 | LAB268 | pine\|gb157.2\|AW697623 | 6630 | 616 | 95.15 | glotblastn |
| 3102 | LAB268 | rye\|gb164\|BE705751 | 6631 | 616 | 95.15 | glotblastn |
| 3103 | LAB268 | sugarcane\|gb157.3\|CA215987 | 6632 | 616 | 95.15 | glotblastn |
| 3104 | LAB268 | tea\|gb171\|CV014626 | 6633 | 616 | 95.15 | glotblastn |
| 3105 | LAB268 | triphysaria\|gb164\|EY019376 | 6634 | 616 | 95.15 | glotblastn |
| 3106 | LAB268 | wheat\|gb164\|CA620392 | 6635 | 616 | 95.15 | glotblastn |
| 3107 | LAB268 | wheat\|gb164\|CK202277 | 6636 | 616 | 95.15 | glotblastn |
| 3108 | LAB268 | artemisia\|10v1\|SRR019254S0011984 | 6637 | 616 | 95.1 | globlastp |
| 3109 | LAB268 | artemisia\|10v1\|SRR019254S0031076 | 6638 | 616 | 95.1 | globlastp |
| 3110 | LAB268 | artemisia\|10v1\|SRR019552S0240607 | 6637 | 616 | 95.1 | globlastp |
| 3111 | LAB268 | oat\|10v1\|GR359321 | 6639 | 616 | 95.1 | globlastp |
| 3112 | LAB268 | liriodendron\|gb166\|FD495606 | 6640 | 616 | 95.1 | globlastp |
| 3113 | LAB268 | maize\|gb170\|LLBE512363 | 6641 | 616 | 95.1 | globlastp |
| 3114 | LAB268 | medicago\|09v1\|LLAJ500188 | 6642 | 616 | 95.1 | globlastp |
| 3115 | LAB268 | medicago\|gb157.2\|AJ500188 | 6642 | 616 | 95.1 | globlastp |
| 3116 | LAB268 | oat\|gb164\|CN821564 | 6643 | 616 | 95.1 | globlastp |
| 3117 | LAB268 | rose\|gb157.2\|EC589151 | 6644 | 616 | 95.1 | globlastp |
| 3118 | LAB268 | wheat\|gb164\|CA601913 | 6645 | 616 | 95.1 | globlastp |
| 3119 | LAB268 | tobacco\|gb162\|CN949751 | 6646 | 616 | 94.4 | globlastp |
| 3120 | LAB268 | wheat\|gb164\|CA652102 | 6647 | 616 | 94.4 | globlastp |
| 3121 | LAB268 | poplar\|gb170\|CA823688 | 6648 | 616 | 94.3 | globlastp |
| 3122 | LAB268 | wheat\|gb164\|BG606703 | 6649 | 616 | 94.3 | globlastp |
| 3123 | LAB268 | wheat\|gb164\|CA711773 | 6650 | 616 | 94.23 | glotblastn |
| 3124 | LAB268 | artemisia\|10v1\|SRR019254S0542206 | 6651 | 616 | 94.2 | globlastp |
| 3125 | LAB268 | rhizophora\|10v1\|SRR005793S0076222 | 6652 | 616 | 94.2 | globlastp |
| 3126 | LAB268 | barley\|gb157SOLEXA\|BF625158 | 6653 | 616 | 94.2 | globlastp |
| 3127 | LAB268 | barley\|gb157SOLEXA\|BG417494 | 6654 | 616 | 94.2 | globlastp |
| 3128 | LAB268 | barley\|gb157SOLEXA\|BI959450 | 6655 | 616 | 94.2 | globlastp |
| 3129 | LAB268 | centaurea\|gb166\|EH741518 | 6656 | 616 | 94.2 | globlastp |
| 3130 | LAB268 | maize\|gb170\|LLBE509909 | 6657 | 616 | 94.2 | globlastp |
| 3131 | LAB268 | maize\|gb170\|LLDN221334 | 6658 | 616 | 94.2 | globlastp |
| 3132 | LAB268 | maize\|gb170\|LLFL303881 | 6659 | 616 | 94.2 | globlastp |
| 3133 | LAB268 | sugarcane\|gb157.3\|CA129712 | 6660 | 616 | 94.2 | globlastp |
| 3134 | LAB268 | triphysaria\|gb164\|EY011518 | 6661 | 616 | 94.2 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3135 | LAB268 | triphysaria\|gb164\|EY133021 | 6662 | 616 | 94.2 | globlastp |
| 3136 | LAB268 | oat\|10v1\|CN819743 | 6663 | 616 | 94.17 | glotblastn |
| 3137 | LAB268 | oat\|10v1\|GO586171 | 6664 | 616 | 94.17 | glotblastn |
| 3138 | LAB268 | lettuce\|10v1\|DW046141 | 6665 | 616 | 94.17 | glotblastn |
| 3139 | LAB268 | lettuce\|gb157.2\|DW046141 | 6665 | 616 | 94.17 | glotblastn |
| 3140 | LAB268 | lettuce\|gb157.2\|DW160543 | 6666 | 616 | 94.17 | glotblastn |
| 3141 | LAB268 | lovegrass\|gb167\|EH194643 | 6667 | 616 | 94.17 | glotblastn |
| 3142 | LAB268 | sunflower\|gb162\|DY958196 | 6668 | 616 | 94.17 | glotblastn |
| 3143 | LAB268 | ginseng\|10v1\|GR871574 | 6669 | 616 | 93.6 | globlastp |
| 3144 | LAB268 | medicago\|gb157.2\|AL366664 | 6670 | 616 | 93.6 | globlastp |
| 3145 | LAB268 | sunflower\|gb162\|CD851214 | 6671 | 616 | 93.6 | globlastp |
| 3146 | LAB268 | wheat\|gb164\|CJ880722 | 6672 | 616 | 93.6 | globlastp |
| 3147 | LAB268 | bean\|gb167\|FE709035 | 6674 | 616 | 93.3 | globlastp |
| 3148 | LAB268 | pine\|gb157.2\|CN852349 | 6674 | 616 | 93.3 | globlastp |
| 3149 | LAB268 | artemisia\|10v1\|SRR019254S0003873 | 6675 | 616 | 93.2 | globlastp |
| 3150 | LAB268 | artemisia\|10v1\|SRR019254S0123773 | 6676 | 616 | 93.2 | globlastp |
| 3151 | LAB268 | artemisia\|10v1\|SRR019254S0145628 | 6677 | 616 | 93.2 | glotblastn |
| 3152 | LAB268 | barley\|10v1\|AJ434335 | 6678 | 616 | 93.2 | glotblastn |
| 3153 | LAB268 | oat\|10v1\|GR358555 | 6679 | 616 | 93.2 | globlastp |
| 3154 | LAB268 | orobanche\|10v1\|SRR023189S0034388 | 6676 | 616 | 93.2 | globlastp |
| 3155 | LAB268 | barley\|gb157SOLEXA\|BF258395 | 6680 | 616 | 93.2 | globlastp |
| 3156 | LAB268 | cacao\|gb167\|CU472310 | 6681 | 616 | 93.2 | globlastp |
| 3157 | LAB268 | cowpea\|gb166\|FF394656 | 6682 | 616 | 93.2 | glotblastn |
| 3158 | LAB268 | iceplant\|gb164\|BE035501 | 6683 | 616 | 93.2 | glotblastn |
| 3159 | LAB268 | maize\|gb170\|LLAW179408 | 6684 | 616 | 93.2 | glotblastn |
| 3160 | LAB268 | maize\|gb170\|LLCD997639 | 6685 | 616 | 93.2 | globlastp |
| 3161 | LAB268 | maize\|gb170\|LLFL027196 | 6686 | 616 | 93.2 | globlastp |
| 3162 | LAB268 | maize\|gb170\|LLFL303809 | 6687 | 616 | 93.2 | glotblastn |
| 3163 | LAB268 | maize\|gb170\|LLFL319760 | 6688 | 616 | 93.2 | globlastp |
| 3164 | LAB268 | onion\|gb162\|ES449597 | 6675 | 616 | 93.2 | globlastp |
| 3165 | LAB268 | peanut\|gb171\|GO335559 | 6689 | 616 | 93.2 | globlastp |
| 3166 | LAB268 | soybean\|gb168\|SB2GWP105728 | 6690 | 616 | 93.2 | globlastp |
| 3167 | LAB268 | sugarcane\|gb157.3\|CA256731 | 6691 | 616 | 93.2 | glotblastn |
| 3168 | LAB268 | triphysaria\|gb164\|EX994401 | 6676 | 616 | 93.2 | globlastp |
| 3169 | LAB268 | wheat\|gb164\|CA608777 | 6692 | 616 | 93.2 | glotblastn |
| 3170 | LAB268 | wheat\|gb164\|CJ833410 | 6693 | 616 | 93.2 | globlastp |
| 3171 | LAB268 | zinnia\|gb171\|DV017189 | 6676 | 616 | 93.2 | globlastp |
| 3172 | LAB268 | zinnia\|gb171\|DV017366 | 6676 | 616 | 93.2 | globlastp |
| 3173 | LAB268 | zinnia\|gb171\|DV017419 | 6676 | 616 | 93.2 | globlastp |
| 3174 | LAB268 | senecio\|gb170\|DY661591 | — | 616 | 93.2 | glotblastn |
| 3175 | LAB268 | radish\|gb164\|EV528352 | 6694 | 616 | 92.8 | globlastp |
| 3176 | LAB268 | wheat\|gb164\|BJ211841 | 6695 | 616 | 92.8 | globlastp |
| 3177 | LAB268 | wheat\|gb164\|CA729136 | 6696 | 616 | 92.8 | globlastp |
| 3178 | LAB268 | spurge\|gb161\|BI946403 | 6697 | 616 | 92.6 | globlastp |
| 3179 | LAB268 | maize\|gb170\|LLBM268739 | 6698 | 616 | 92.3 | globlastp |
| 3180 | LAB268 | ipomoea\|gb157.2\|EE881854 | 6699 | 616 | 92.23 | glotblastn |
| 3180 | LAB268 | ipomoea_batatas\|10v1\|EE881854 | 6702 | 616 | 92.2 | globlastp |
| 3181 | LAB268 | maize\|gb170\|LLEG077297 | 6700 | 616 | 92.23 | glotblastn |
| 3182 | LAB268 | melon\|gb165\|DV632781 | 6701 | 616 | 92.23 | glotblastn |
| 3183 | LAB268 | salvia\|10v1\|SRR014553S0015933 | 6703 | 616 | 92.2 | globlastp |
| 3184 | LAB268 | tragopogon\|10v1\|SRR020205S0178366 | 6703 | 616 | 92.2 | globlastp |
| 3185 | LAB268 | b_rapa\|gb162\|EX133290 | 6704 | 616 | 92.2 | globlastp |
| 3186 | LAB268 | barley\|gb157SOLEXA\|BM370668 | 6705 | 616 | 92.2 | globlastp |
| 3187 | LAB268 | cacao\|gb167\|CU469633 | 6706 | 616 | 92.2 | globlastp |
| 3188 | LAB268 | sugarcane\|gb157.3\|CA241052 | 6707 | 616 | 92.2 | globlastp |
| 3189 | LAB268 | cotton\|gb164\|BF270999 | 6708 | 616 | 92 | globlastp |
| 3190 | LAB268 | dandelion\|gb161\|DY836577 | 6709 | 616 | 92 | globlastp |
| 3191 | LAB268 | radish\|gb164\|EV529345 | 6710 | 616 | 92 | globlastp |
| 3192 | LAB268 | tomato\|gb164\|BG130199 | 6711 | 616 | 91.9 | globlastp |
| 3193 | LAB268 | wheat\|gb164\|CA711406 | 6712 | 616 | 91.9 | globlastp |
| 3194 | LAB268 | artemisia\|10v1\|EY056079 | 6713 | 616 | 91.3 | globlastp |
| 3195 | LAB268 | canola\|10v1\|GT085139 | 6714 | 616 | 91.3 | globlastp |
| 3196 | LAB268 | heritiera\|10v1\|SRR005795S0031594 | 6715 | 616 | 91.3 | globlastp |
| 3197 | LAB268 | oat\|10v1\|GR361209 | 6716 | 616 | 91.3 | globlastp |
| 3198 | LAB268 | oat\|10v1\|GR361398 | 6716 | 616 | 91.3 | globlastp |
| 3199 | LAB268 | barley\|gb157SOLEXA\|CD056360 | 6716 | 616 | 91.3 | globlastp |
| 3200 | LAB268 | bruguiera\|gb166\|BP939745 | 6713 | 616 | 91.3 | globlastp |
| 3201 | LAB268 | fern\|gb171\|DK959947 | 6717 | 616 | 91.3 | globlastp |
| 3202 | LAB268 | maize\|gb170\|LLCF021239 | 6718 | 616 | 91.3 | globlastp |
| 3203 | LAB268 | maize\|gb170\|LLFL026667 | 6719 | 616 | 91.3 | globlastp |
| 3204 | LAB268 | maize\|gb170\|LLFL367469 | 6720 | 616 | 91.3 | globlastp |
| 3205 | LAB268 | spruce\|gb162\|CO210449 | 6721 | 616 | 91.3 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3206 | LAB268 | spruce\|gb162\|CO478069 | 6716 | 616 | 91.3 | globlastp |
| 3207 | LAB268 | spruce\|gb162\|ES256096 | 6722 | 616 | 91.3 | globlastp |
| 3208 | LAB268 | spruce\|gb162\|EX306950 | 6716 | 616 | 91.3 | globlastp |
| 3209 | LAB268 | spruce\|gb162\|EX309778 | 6723 | 616 | 91.3 | globlastp |
| 3210 | LAB268 | sugarcane\|gb157.3\|CA245664 | 6724 | 616 | 91.3 | globlastp |
| 3211 | LAB268 | sugarcane\|gb157.3\|CA281611 | 6716 | 616 | 91.3 | globlastp |
| 3212 | LAB268 | tamarix\|gb166\|EG969617 | 6723 | 616 | 91.3 | globlastp |
| 3213 | LAB268 | wheat\|gb164\|CA686942 | 6716 | 616 | 91.3 | globlastp |
| 3214 | LAB268 | barley\|10v1\|BE437542 | 6725 | 616 | 91.26 | glotblastn |
| 3215 | LAB268 | tea\|10v1\|CV013790 | 6726 | 616 | 91.26 | glotblastn |
| 3216 | LAB268 | barley\|gb157SOLEXA\|BG415721 | 6727 | 616 | 91.26 | glotblastn |
| 3217 | LAB268 | dandelion\|gb161\|DY836671 | 6728 | 616 | 91.26 | glotblastn |
| 3218 | LAB268 | peanut\|gb171\|EH043386 | 6729 | 616 | 91.26 | glotblastn |
| 3219 | LAB268 | spruce\|gb162\|ES249576 | 6730 | 616 | 91.26 | glotblastn |
| 3220 | LAB268 | sunflower\|gb162\|CF082956 | 6731 | 616 | 91.26 | glotblastn |
| 3221 | LAB268 | volvox\|gb162\|AW676472 | 6732 | 616 | 91.26 | glotblastn |
| 3222 | LAB268 | wheat\|gb164\|CA706348 | 6733 | 616 | 91.26 | glotblastn |
| 3223 | LAB268 | wheat\|gb164\|CJ639897 | 6734 | 616 | 91.26 | glotblastn |
| 3224 | LAB268 | wheat\|gb164\|DR044938 | 6735 | 616 | 91.26 | glotblastn |
| 3225 | LAB268 | b_juncea\|gb164\|EVGN00680114742616 | 6736 | 616 | 91.2 | globlastp |
| 3226 | LAB268 | beet\|gb162\|BI543915 | 6737 | 616 | 91.2 | globlastp |
| 3227 | LAB268 | cassava\|gb164\|BM260241 | 6738 | 616 | 91.2 | globlastp |
| 3228 | LAB268 | melon\|gb165\|DV632791 | 6739 | 616 | 91.2 | globlastp |
| 3229 | LAB268 | strawberry\|gb164\|EX663851 | 6740 | 616 | 91.2 | globlastp |
| 3230 | LAB268 | sunflower\|gb162\|CD849382 | 6741 | 616 | 91.2 | globlastp |
| 3231 | LAB268 | sunflower\|gb162\|CD849751 | 6742 | 616 | 91.2 | globlastp |
| 3232 | LAB268 | sunflower\|gb162\|CD850210 | 6743 | 616 | 91.2 | globlastp |
| 3233 | LAB268 | beet\|gb162\|BQ588711 | 6744 | 616 | 91.1 | globlastp |
| 3234 | LAB268 | spruce\|gb162\|EX415867 | 6745 | 616 | 91.1 | globlastp |
| 3235 | LAB268 | potato\|gb157.2\|BQ518377 | 6746 | 616 | 91 | globlastp |
| 3236 | LAB268 | volvox\|gb162\|MDLJGIVOLCA178755 | 6747 | 616 | 90.9 | globlastp |
| 3237 | LAB268 | oat\|10v1\|GR364347 | 6748 | 616 | 90.7 | globlastp |
| 3238 | LAB268 | b_rapa\|gb162\|EX115114 | 6749 | 616 | 90.4 | globlastp |
| 3239 | LAB268 | dandelion\|gb161\|DY837249 | 6750 | 616 | 90.4 | globlastp |
| 3240 | LAB268 | oil_palm\|gb166\|EL681099 | 6751 | 616 | 90.4 | globlastp |
| 3241 | LAB268 | wheat\|gb164\|AL820678 | 6752 | 616 | 90.4 | globlastp |
| 3242 | LAB268 | wheat\|gb164\|CA611188 | 6753 | 616 | 90.4 | globlastp |
| 3243 | LAB268 | wheat\|gb164\|BU672653 | 6754 | 616 | 90.38 | glotblastn |
| 3244 | LAB268 | artemisia\|10v1\|SRR019254S0032901 | 6755 | 616 | 90.3 | globlastp |
| 3245 | LAB268 | canola\|10v1\|CD812509 | 6756 | 616 | 90.3 | globlastp |
| 3246 | LAB268 | eschscholzia\|10v1\|CD480997 | 6756 | 616 | 90.3 | globlastp |
| 3247 | LAB268 | barley\|gb157SOLEXA\|BI948748 | 6757 | 616 | 90.3 | globlastp |
| 3248 | LAB268 | cacao\|gb167\|CU614547 | 6758 | 616 | 90.3 | globlastp |
| 3249 | LAB268 | melon\|gb165\|AM721598 | 6759 | 616 | 90.3 | globlastp |
| 3250 | LAB268 | papaya\|gb165\|EX272338 | 6760 | 616 | 90.3 | globlastp |
| 3251 | LAB268 | potato\|gb157.2\|CV492347 | 6761 | 616 | 90.3 | globlastp |
| 3252 | LAB268 | spruce\|gb162\|ES253259 | 6762 | 616 | 90.3 | globlastp |
| 3253 | LAB268 | sunflower\|gb162\|CF086418 | 6763 | 616 | 90.3 | globlastp |
| 3254 | LAB268 | artemisia\|10v1\|SRR019254S0030053 | — | 616 | 90.29 | glotblastn |
| 3255 | LAB268 | ipomoea_batatas\|10v1\|DV036726 | — | 616 | 90.29 | glotblastn |
| 3256 | LAB268 | ipomoea\|gb157.2\|DV036726 | — | 616 | 90.29 | glotblastn |
| 3257 | LAB268 | sunflower\|gb162\|CF077698 | 6764 | 616 | 90.1 | globlastp |
| 3258 | LAB268 | artemisia\|10v1\|SRR019550S0172069 | 6765 | 616 | 89.6 | globlastp |
| 3259 | LAB268 | arabidopsis\|gb165\|AT2G28740 | 6766 | 616 | 89.6 | globlastp |
| 3260 | LAB268 | cowpea\|gb166\|FC459371 | 6767 | 616 | 89.6 | globlastp |
| 3261 | LAB268 | fescue\|gb161\|DT687184 | 6768 | 616 | 89.6 | globlastp |
| 3262 | LAB268 | lettuce\|gb157.2\|DW045072 | 6769 | 616 | 89.6 | globlastp |
| 3263 | LAB268 | lettuce\|gb157.2\|DW119855 | 6770 | 616 | 89.6 | globlastp |
| 3264 | LAB268 | lettuce\|gb157.2\|DW140646 | 6771 | 616 | 89.6 | globlastp |
| 3265 | LAB268 | medicago\|gb157.2\|AL378431 | 6772 | 616 | 89.6 | globlastp |
| 3266 | LAB268 | wheat\|gb164\|BE422710 | 6773 | 616 | 89.6 | globlastp |
| 3267 | LAB268 | triphysaria\|gb164\|BE574792 | 6774 | 616 | 89.52 | glotblastn |
| 3268 | LAB268 | potato\|gb157.2\|BQ512707 | 6775 | 616 | 89.5 | globlastp |
| 3269 | LAB268 | pseudoroegneria\|gb167\|FF366170 | 6776 | 616 | 89.5 | globlastp |
| 3270 | LAB268 | wheat\|gb164\|BQ838511 | 6777 | 616 | 89.5 | globlastp |
| 3271 | LAB268 | eucalyptus\|gb166\|CT981403 | 6778 | 616 | 89.4 | globlastp |
| 3272 | LAB268 | barley\|10v1\|BG299823 | 6779 | 616 | 89.32 | glotblastn |
| 3273 | LAB268 | solanum_phureja\|09v1\|SPHBF054460 | 6780 | 616 | 89.32 | glotblastn |
| 3274 | LAB268 | wheat\|gb164\|CA607090 | 6781 | 616 | 89.32 | glotblastn |
| 3275 | LAB268 | barley\|gb157SOLEXA\|BI949366 | 6782 | 616 | 89.32 | glotblastn |
| 3276 | LAB268 | barley\|10v1\|BM370668 | 6783 | 616 | 89.32 | glotblastn |
| 3277 | LAB268 | lettuce\|gb157.2\|DW122372 | 6784 | 616 | 89.32 | glotblastn |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3278 | LAB268 | maize\|gb170\|LLFL027108 | 6785 | 616 | 89.32 | glotblastn |
| 3279 | LAB268 | strawberry\|gb164\|CO817468 | 6786 | 616 | 89.32 | glotblastn |
| 3280 | LAB268 | triphysaria\|gb164\|EY015990 | 6787 | 616 | 89.32 | glotblastn |
| 3281 | LAB268 | wheat\|gb164\|CA598647 | 6788 | 616 | 89.32 | glotblastn |
| 3282 | LAB268 | artemisia\|10v1\|SRR019254S0032449 | 6789 | 616 | 89.3 | globlastp |
| 3283 | LAB268 | barley\|10v1\|BE455800 | 6790 | 616 | 89.3 | globlastp |
| 3284 | LAB268 | barley\|10v1\|CV054877 | 6790 | 616 | 89.3 | globlastp |
| 3285 | LAB268 | apple\|gb171\|EB138544 | 6791 | 616 | 89.3 | globlastp |
| 3286 | LAB268 | bean\|gb167\|FG229977 | 6792 | 616 | 89.3 | globlastp |
| 3287 | LAB268 | fescue\|gb161\|DT685923 | 6793 | 616 | 89.3 | globlastp |
| 3288 | LAB268 | oat\|10v1\|GO586215 | 6794 | 616 | 89.2 | globlastp |
| 3289 | LAB268 | medicago\|09v1\|LLEL563523 | 6795 | 616 | 89.1 | globlastp |
| 3290 | LAB268 | lettuce\|10v1\|DW053970 | 6796 | 616 | 88.89 | glotblastn |
| 3291 | LAB268 | b_juncea\|gb164\|EVGN00255111393429 | 6797 | 616 | 88.8 | globlastp |
| 3292 | LAB268 | cotton\|gb164\|ES825038 | 6798 | 616 | 88.8 | globlastp |
| 3293 | LAB268 | fescue\|gb161\|DT686778 | 6799 | 616 | 88.8 | globlastp |
| 3294 | LAB268 | lettuce\|gb157.2\|DW074962 | 6800 | 616 | 88.8 | globlastp |
| 3295 | LAB268 | medicago\|gb157.2\|AL366317 | 6801 | 616 | 88.8 | globlastp |
| 3296 | LAB268 | rye\|gb164\|BE493864 | 6802 | 616 | 88.8 | globlastp |
| 3297 | LAB268 | rye\|gb164\|BE637133 | 6803 | 616 | 88.8 | globlastp |
| 3298 | LAB268 | sunflower\|gb162\|CD849947 | 6804 | 616 | 88.8 | globlastp |
| 3299 | LAB268 | triphysaria\|gb164\|BM357495 | 6805 | 616 | 88.8 | globlastp |
| 3300 | LAB268 | radish\|gb164\|EY934820 | 6806 | 616 | 88.7 | globlastp |
| 3301 | LAB268 | spruce\|gb162\|DR543346 | 6807 | 616 | 88.7 | globlastp |
| 3302 | LAB268 | tomato\|gb164\|BG125424 | 6808 | 616 | 88.7 | globlastp |
| 3303 | LAB268 | artemisia\|10v1\|SRR019254S0000755 | 6809 | 616 | 88.6 | globlastp |
| 3304 | LAB268 | sunflower\|gb162\|EE652838 | 6810 | 616 | 88.5 | globlastp |
| 3305 | LAB268 | wheat\|gb164\|CA702608 | 6811 | 616 | 88.5 | globlastp |
| 3306 | LAB268 | barley\|gb157SOLEXA\|BF624980 | 6812 | 616 | 88.35 | glotblastn |
| 3307 | LAB268 | barley\|gb157SOLEXA\|BM375641 | 6813 | 616 | 88.35 | glotblastn |
| 3308 | LAB268 | barley\|gb157SOLEXA\|CV062231 | 6814 | 616 | 88.35 | glotblastn |
| 3309 | LAB268 | cacao\|gb167\|CU472080 | 6815 | 616 | 88.35 | glotblastn |
| 3310 | LAB268 | maize\|gb170\|LLFL121319 | 6816 | 616 | 88.35 | glotblastn |
| 3311 | LAB268 | maize\|gb170\|LLFL290833 | 6817 | 616 | 88.35 | glotblastn |
| 3312 | LAB268 | sugarcane\|gb157.3\|CA124638 | 6818 | 616 | 88.35 | glotblastn |
| 3313 | LAB268 | sugarcane\|gb157.3\|CA129028 | 6819 | 616 | 88.35 | glotblastn |
| 3314 | LAB268 | sugarcane\|10v1\|CA286333 | 6820 | 616 | 88.35 | glotblastn |
| 3315 | LAB268 | sugarcane\|gb157.3\|CA286333 | 6820 | 616 | 88.35 | glotblastn |
| 3316 | LAB268 | wheat\|gb164\|BJ309601 | 6821 | 616 | 88.35 | glotblastn |
| 3317 | LAB268 | wheat\|gb164\|CA607921 | 6822 | 616 | 88.35 | glotblastn |
| 3318 | LAB268 | wheat\|gb164\|CK170457 | 6823 | 616 | 88.35 | glotblastn |
| 3319 | LAB268 | barley\|10v1\|BI948748 | 6824 | 616 | 88.3 | globlastp |
| 3320 | LAB268 | barley\|10v1\|CD056360 | 6825 | 616 | 88.3 | globlastp |
| 3321 | LAB268 | cassava\|gb164\|DB925963 | 6826 | 616 | 88.3 | globlastp |
| 3322 | LAB268 | cenchrus\|gb166\|EB661022 | 6827 | 616 | 88.3 | globlastp |
| 3323 | LAB268 | eucalyptus\|gb166\|CD668068 | 6828 | 616 | 88.3 | globlastp |
| 3324 | LAB268 | prunus\|gb167\|CB819033 | 6829 | 616 | 88.3 | globlastp |
| 3325 | LAB268 | avocado\|gb164\|CK754489 | 6830 | 616 | 88 | globlastp |
| 3326 | LAB268 | b_rapa\|gb162\|L33581 | 6831 | 616 | 88 | globlastp |
| 3327 | LAB268 | cowpea\|gb166\|FF387598 | 6832 | 616 | 88 | globlastp |
| 3328 | LAB268 | fescue\|gb161\|DT686507 | 6833 | 616 | 88 | globlastp |
| 3329 | LAB268 | fescue\|gb161\|DT686700 | 6834 | 616 | 88 | globlastp |
| 3330 | LAB268 | ginger\|gb164\|DY350509 | 6835 | 616 | 88 | globlastp |
| 3331 | LAB268 | lettuce\|gb157.2\|DW105457 | 6836 | 616 | 88 | globlastp |
| 3332 | LAB268 | medicago\|gb157.2\|AL380016 | 6837 | 616 | 88 | globlastp |
| 3333 | LAB268 | radish\|gb164\|EW714623 | 6838 | 616 | 88 | globlastp |
| 3334 | LAB268 | sunflower\|gb162\|CD849277 | 6839 | 616 | 88 | globlastp |
| 3335 | LAB268 | sunflower\|gb162\|CD851055 | 6840 | 616 | 88 | globlastp |
| 3336 | LAB268 | wheat\|gb164\|BE416157 | 6841 | 616 | 88 | globlastp |
| 3337 | LAB268 | wheat\|gb164\|BE417363 | 6842 | 616 | 88 | globlastp |
| 3338 | LAB268 | wheat\|gb164\|BE499108 | 6843 | 616 | 88 | globlastp |
| 3339 | LAB268 | wheat\|gb164\|BG608114 | 6844 | 616 | 88 | globlastp |
| 3340 | LAB268 | wheat\|gb164\|CJ646588 | 6845 | 616 | 88 | globlastp |
| 3341 | LAB268 | wheat\|gb164\|CA635795 | 6846 | 616 | 87.5 | glotblastn |
| 3342 | LAB268 | artemisia\|10v1\|EY032843 | 6847 | 616 | 87.4 | globlastp |
| 3343 | LAB268 | artemisia\|10v1\|SRR019254S0041967 | 6847 | 616 | 87.4 | globlastp |
| 3344 | LAB268 | kiwi\|gb166\|FG431516 | 6848 | 616 | 87.4 | globlastp |
| 3345 | LAB268 | nuphar\|gb166\|CD474059 | 6849 | 616 | 87.4 | globlastp |
| 3346 | LAB268 | pine\|gb157.2\|DT638657 | 6850 | 616 | 87.4 | globlastp |
| 3347 | LAB268 | sesame\|gb157.2\|BU667917 | 6851 | 616 | 87.4 | globlastp |
| 3348 | LAB268 | sugarcane\|10v1\|CA106117 | 6852 | 616 | 87.4 | globlastp |
| 3349 | LAB268 | sugarcane\|gb157.3\|CA085023 | 6852 | 616 | 87.4 | globlastp |

TABLE 54-continued

Homologues of the identified genes/polypeptides for increasing abiotic stress
tolerance, water use efficiency, yield, growth rate, vigor, oil content, biomass, growth
rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3350 | LAB268 | sugarcane\|gb157.3\|CA115738 | 6853 | 616 | 87.4 | globlastp |
| 3351 | LAB268 | sugarcane\|10v1\|CA129028 | 6854 | 616 | 87.4 | globlastp |
| 3352 | LAB268 | sunflower\|gb162\|BQ974944 | 6855 | 616 | 87.4 | globlastp |
| 3353 | LAB268 | wheat\|gb164\|CJ578594 | 6856 | 616 | 87.4 | globlastp |
| 3354 | LAB268 | barley\|10v1\|BE412620 | 6857 | 616 | 87.38 | glotblastn |
| 3355 | LAB268 | b_juncea\|gb164\|EVGN00529211853307 | 6858 | 616 | 87.3 | globlastp |
| 3356 | LAB268 | fescue\|gb161\|DT688459 | 6859 | 616 | 87.3 | globlastp |
| 3357 | LAB268 | lotus\|gb157.2\|CN825630 | 6860 | 616 | 87.3 | globlastp |
| 3358 | LAB268 | radish\|gb164\|EV527978 | 6861 | 616 | 87.3 | globlastp |
| 3359 | LAB268 | rose\|gb157.2\|EC588926 | 6862 | 616 | 87.3 | globlastp |
| 3360 | LAB268 | rye\|gb164\|BE586695 | 6863 | 616 | 87.3 | globlastp |
| 3361 | LAB268 | sunflower\|gb162\|CD848230 | 6864 | 616 | 87.3 | globlastp |
| 3362 | LAB268 | wheat\|gb164\|BE415928 | 6865 | 616 | 87.3 | globlastp |
| 3363 | LAB268 | wheat\|gb164\|BE438441 | 6866 | 616 | 87.3 | globlastp |
| 3364 | LAB268 | wheat\|gb164\|BE493582 | 6867 | 616 | 87.3 | globlastp |
| 3365 | LAB268 | wheat\|gb164\|BE518452 | 6868 | 616 | 87.3 | globlastp |
| 3366 | LAB268 | wheat\|gb164\|BF292946 | 6869 | 616 | 87.3 | globlastp |
| 3367 | LAB268 | wheat\|gb164\|BJ223844 | 6870 | 616 | 87.3 | globlastp |
| 3368 | LAB268 | avocado\|gb164\|CK750317 | 6871 | 616 | 87.2 | globlastp |
| 3369 | LAB268 | lettuce\|gb157.2\|DW052423 | 6872 | 616 | 87.2 | globlastp |
| 3370 | LAB268 | strawberry\|gb164\|CO817177 | 6873 | 616 | 87 | globlastp |
| 3371 | LAB268 | onion\|gb162\|BQ579926 | 6874 | 616 | 86.79 | glotblastn |
| 3372 | LAB268 | wheat\|gb164\|CK168652 | 6875 | 616 | 86.7 | globlastp |
| 3373 | LAB268 | avocado\|gb164\|CO995142 | 6876 | 616 | 86.6 | globlastp |
| 3374 | LAB268 | b_rapa\|gb162\|CX267515 | 6877 | 616 | 86.6 | globlastp |
| 3375 | LAB268 | grape\|gb160\|BQ794122 | 6878 | 616 | 86.6 | globlastp |
| 3376 | LAB268 | lettuce\|gb157.2\|DW047728 | 6879 | 616 | 86.6 | globlastp |
| 3377 | LAB268 | lettuce\|gb157.2\|DW059381 | 6880 | 616 | 86.6 | globlastp |
| 3378 | LAB268 | lotus\|gb157.2\|BW597052 | 6881 | 616 | 86.6 | globlastp |
| 3379 | LAB268 | rye\|gb164\|BE495019 | 6882 | 616 | 86.6 | globlastp |
| 3380 | LAB268 | spurge\|gb161\|DV113688 | 6883 | 616 | 86.6 | globlastp |
| 3381 | LAB268 | sunflower\|gb162\|EE651618 | 6884 | 616 | 86.6 | globlastp |
| 3382 | LAB268 | triphysaria\|gb164\|EY005632 | 6885 | 616 | 86.6 | globlastp |
| 3383 | LAB268 | wheat\|gb164\|AL826630 | 6886 | 616 | 86.6 | globlastp |
| 3384 | LAB268 | wheat\|gb164\|BE405172 | 6887 | 616 | 86.6 | globlastp |
| 3385 | LAB268 | wheat\|gb164\|BE417224 | 6888 | 616 | 86.6 | globlastp |
| 3386 | LAB268 | wheat\|gb164\|CA618316 | 6889 | 616 | 86.6 | globlastp |
| 3387 | LAB268 | cenchrus\|gb166\|EB672104 | 6890 | 616 | 86.41 | glotblastn |
| 3388 | LAB268 | maize\|gb170\|LLFL430119 | 6891 | 616 | 86.41 | glotblastn |
| 3389 | LAB268 | sugarcane\|gb157.3\|CA241139 | 6892 | 616 | 86.41 | glotblastn |
| 3390 | LAB268 | wheat\|gb164\|CJ634647 | 6893 | 616 | 86.41 | glotblastn |
| 3391 | LAB268 | canola\|10v1\|EE455340 | 6894 | 616 | 86.4 | globlastp |
| 3392 | LAB268 | gerbera\|09v1\|AJ753672 | 6894 | 616 | 86.4 | globlastp |
| 3393 | LAB268 | barley\|gb157SOLEXA\|BF258586 | 6895 | 616 | 86.4 | globlastp |
| 3394 | LAB268 | barley\|gb157SOLEXA\|BY850447 | 6896 | 616 | 86.4 | globlastp |
| 3395 | LAB268 | cotton\|gb164\|BF275139 | 6897 | 616 | 86.4 | globlastp |
| 3396 | LAB268 | fescue\|gb161\|DT690081 | 6894 | 616 | 86.4 | globlastp |
| 3397 | LAB268 | potato\|gb157.2\|BM109083 | 6898 | 616 | 86.4 | globlastp |
| 3398 | LAB268 | spruce\|gb162\|EX375049 | 6899 | 616 | 86.4 | globlastp |
| 3399 | LAB268 | tomato\|gb164\|BG126455 | 6900 | 616 | 86.4 | globlastp |
| 3400 | LAB268 | artemisia\|gb164\|EY034318 | 6901 | 616 | 85.8 | globlastp |
| 3401 | LAB268 | artemisia\|gb164\|EY048377 | 6902 | 616 | 85.8 | globlastp |
| 3402 | LAB268 | bean\|gb167\|CA898706 | 6903 | 616 | 85.8 | globlastp |
| 3403 | LAB268 | canola\|gb161\|CD812235 | 6904 | 616 | 85.8 | globlastp |
| 3404 | LAB268 | cowpea\|gb166\|FC456793 | 6905 | 616 | 85.8 | globlastp |
| 3405 | LAB268 | fescue\|gb161\|DT689099 | 6906 | 616 | 85.8 | globlastp |
| 3406 | LAB268 | fescue\|gb161\|DT689969 | 6907 | 616 | 85.8 | globlastp |
| 3407 | LAB268 | grape\|gb160\|CB970763 | 6908 | 616 | 85.8 | globlastp |
| 3408 | LAB268 | lettuce\|gb157.2\|DW054334 | 6909 | 616 | 85.8 | globlastp |
| 3409 | LAB268 | lettuce\|gb157.2\|DW075486 | 6910 | 616 | 85.8 | globlastp |
| 3410 | LAB268 | lettuce\|gb157.2\|DW105307 | 6911 | 616 | 85.8 | globlastp |
| 3411 | LAB268 | lettuce\|gb157.2\|DW108025 | 6912 | 616 | 85.8 | globlastp |
| 3412 | LAB268 | rose\|gb157.2\|EC587851 | 6913 | 616 | 85.8 | globlastp |
| 3413 | LAB268 | sunflower\|gb162\|CD848228 | 6914 | 616 | 85.8 | globlastp |
| 3414 | LAB268 | sunflower\|gb162\|CD850844 | 6915 | 616 | 85.8 | globlastp |
| 3415 | LAB268 | sunflower\|gb162\|CD850923 | 6916 | 616 | 85.8 | globlastp |
| 3416 | LAB268 | wheat\|gb164\|BE399592 | 6917 | 616 | 85.8 | globlastp |
| 3417 | LAB268 | wheat\|gb164\|BE405116 | 6918 | 616 | 85.8 | globlastp |
| 3418 | LAB268 | wheat\|gb164\|BE518109 | 6919 | 616 | 85.8 | globlastp |
| 3419 | LAB268 | wheat\|gb164\|BJ311599 | 6920 | 616 | 85.8 | globlastp |
| 3420 | LAB268 | wheat\|gb164\|CA651602 | 6921 | 616 | 85.8 | globlastp |
| 3421 | LAB268 | wheat\|gb164\|CA718879 | 6922 | 616 | 85.8 | globlastp |

TABLE 54-continued

Homologues of the identified genes/polypeptides for increasing abiotic stress
tolerance, water use efficiency, yield, growth rate, vigor, oil content, biomass, growth
rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3422 | LAB268 | wheat\|gb164\|CD453642 | 6923 | 616 | 85.8 | globlastp |
| 3423 | LAB268 | rye\|gb164\|BE494409 | 6924 | 616 | 85.7 | globlastp |
| 3424 | LAB268 | triphysaria\|gb164\|EX999992 | 6925 | 616 | 85.7 | globlastp |
| 3425 | LAB268 | wheat\|gb164\|CA622006 | 6926 | 616 | 85.7 | globlastp |
| 3426 | LAB268 | oil_palm\|gb166\|CN600292 | 6927 | 616 | 85.6 | globlastp |
| 3427 | LAB268 | barley\|10v1\|CV062231 | 6928 | 616 | 85.44 | glotblastn |
| 3428 | LAB268 | wheat\|gb164\|CA624635 | 6929 | 616 | 85.44 | glotblastn |
| 3429 | LAB268 | triphysaria\|gb164\|EX988310 | — | 616 | 85.44 | glotblastn |
| 3430 | LAB268 | artemisia\|10v1\|SRR019254S0057308 | 6930 | 616 | 85.4 | globlastp |
| 3431 | LAB268 | pea\|09v1\|EX570524 | 6931 | 616 | 85.4 | globlastp |
| 3432 | LAB268 | pea\|09v1\|EX570579 | 6932 | 616 | 85.4 | globlastp |
| 3433 | LAB268 | pine\|10v1\|BX250390 | 6933 | 616 | 85.4 | globlastp |
| 3434 | LAB268 | barley\|10v1\|BF625158 | 6934 | 616 | 85.4 | globlastp |
| 3435 | LAB268 | poplar\|10v1\|CV225507 | 6935 | 616 | 85.4 | globlastp |
| 3436 | LAB268 | spruce\|gb162\|CO224810 | 6933 | 616 | 85.4 | globlastp |
| 3437 | LAB268 | oat\|10v1\|GO586850 | 6936 | 616 | 85.2 | globlastp |
| 3438 | LAB268 | oat\|10v1\|GO587649 | 6937 | 616 | 85.2 | globlastp |
| 3439 | LAB268 | oat\|10v1\|GR328829 | 6938 | 616 | 85.2 | globlastp |
| 3440 | LAB268 | b_oleracea\|gb161\|ES944086 | 6939 | 616 | 85.1 | globlastp |
| 3441 | LAB268 | b_rapa\|gb162\|CA991789 | 6940 | 616 | 85.1 | globlastp |
| 3442 | LAB268 | b_rapa\|gb162\|CX265826 | 6940 | 616 | 85.1 | globlastp |
| 3443 | LAB268 | cotton\|gb164\|AI728766 | 6941 | 616 | 85.1 | globlastp |
| 3444 | LAB268 | cotton\|gb164\|BG443736 | 6942 | 616 | 85.1 | globlastp |
| 3445 | LAB268 | dandelion\|gb161\|DY836046 | 6943 | 616 | 85.1 | globlastp |
| 3446 | LAB268 | dandelion\|gb161\|DY837761 | 6944 | 616 | 85.1 | globlastp |
| 3447 | LAB268 | ginger\|gb164\|DY358309 | 6945 | 616 | 85.1 | globlastp |
| 3448 | LAB268 | lettuce\|gb157.2\|DW072522 | 6946 | 616 | 85.1 | globlastp |
| 3449 | LAB268 | lettuce\|gb157.2\|DW105156 | 6947 | 616 | 85.1 | globlastp |
| 3450 | LAB268 | lettuce\|gb157.2\|DW106760 | 6948 | 616 | 85.1 | globlastp |
| 3451 | LAB268 | lettuce\|gb157.2\|DW170641 | 6949 | 616 | 85.1 | globlastp |
| 3452 | LAB268 | oil_palm\|gb166\|EL681602 | 6950 | 616 | 85.1 | globlastp |
| 3453 | LAB268 | radish\|gb164\|EX904649 | 6951 | 616 | 85.1 | globlastp |
| 3454 | LAB268 | radish\|gb164\|FD936397 | 6952 | 616 | 85.1 | globlastp |
| 3455 | LAB268 | wheat\|gb164\|BE417597 | 6953 | 616 | 85.1 | globlastp |
| 3456 | LAB268 | wheat\|gb164\|BE417802 | 6954 | 616 | 85.1 | globlastp |
| 3457 | LAB268 | wheat\|gb164\|BE422967 | 6955 | 616 | 85.1 | globlastp |
| 3458 | LAB268 | wheat\|gb164\|BF483140 | 6956 | 616 | 85.1 | globlastp |
| 3459 | LAB268 | wheat\|gb164\|CA598185 | 6957 | 616 | 85.1 | globlastp |
| 3460 | LAB268 | wheat\|gb164\|CA707571 | 6958 | 616 | 85.1 | globlastp |
| 3461 | LAB268 | nicotiana_benthamiana\|gb162\|CN743932 | 6959 | 616 | 85 | globlastp |
| 3462 | LAB268 | spruce\|gb162\|CO233199 | 6960 | 616 | 85 | globlastp |
| 3463 | LAB268 | tomato\|gb164\|BG123365 | 6961 | 616 | 85 | globlastp |
| 3464 | LAB268 | kiwi\|gb166\|FG502449 | 6962 | 616 | 84.9 | globlastp |
| 3465 | LAB268 | sunflower\|gb162\|EE658389 | 6964 | 616 | 84.7 | globlastp |
| 3466 | LAB268 | maize\|gb170\|LLAI855380 | 6965 | 616 | 84.68 | glotblastn |
| 3467 | LAB268 | oat\|gb164\|CN814783 | 6966 | 616 | 84.6 | globlastp |
| 3468 | LAB268 | spruce\|gb162\|CK434637 | 6967 | 616 | 84.6 | globlastp |
| 3469 | LAB268 | gerbera\|09v1\|AJ753690 | 6968 | 616 | 84.5 | globlastp |
| 3470 | LAB268 | oat\|10v1\|GO586105 | 6969 | 616 | 84.5 | globlastp |
| 3471 | LAB268 | tragopogon\|10v1\|SRR020205S0080113 | 6970 | 616 | 84.5 | globlastp |
| 3472 | LAB268 | b_juncea\|gb164\|EVGN01238609041063 | 6971 | 616 | 84.5 | globlastp |
| 3473 | LAB268 | canola\|gb161\|EE568160 | 6972 | 616 | 84.5 | globlastp |
| 3474 | LAB268 | cotton\|gb164\|CD486193 | 6973 | 616 | 84.5 | globlastp |
| 3475 | LAB268 | cycas\|gb166\|EX921626 | 6974 | 616 | 84.5 | globlastp |
| 3476 | LAB268 | spruce\|gb162\|DR572882 | 6975 | 616 | 84.5 | globlastp |
| 3477 | LAB268 | wheat\|gb164\|CV065522 | 6976 | 616 | 84.5 | globlastp |
| 3478 | LAB268 | ipomoea_nil\|10v1\|BJ573681 | 6977 | 616 | 84.47 | glotblastn |
| 3479 | LAB268 | sugarcane\|10v1\|CA243313 | 6978 | 616 | 84.47 | glotblastn |
| 3480 | LAB268 | barley\|gb157SOLEXA\|BF623064 | 6979 | 616 | 84.47 | glotblastn |
| 3481 | LAB268 | maize\|gb170\|LLFL225872 | 6980 | 616 | 84.47 | glotblastn |
| 3482 | LAB268 | maize\|gb170\|LLFL375355 | 6981 | 616 | 84.47 | glotblastn |
| 3483 | LAB268 | maize\|gb170\|LLFL398411 | 6982 | 616 | 84.47 | glotblastn |
| 3484 | LAB268 | sunflower\|gb162\|CD853795 | 6983 | 616 | 84.47 | glotblastn |
| 3485 | LAB268 | sunflower\|gb162Y929104 | 6984 | 616 | 84.47 | glotblastn |
| 3486 | LAB268 | wheat\|gb164\|CA627121 | 6985 | 616 | 84.47 | glotblastn |
| 3487 | LAB268 | cotton\|gb164\|DT458957 | 6986 | 616 | 84.4 | globlastp |
| 3488 | LAB268 | cryptomeria\|gb166\|BY890130 | 6987 | 616 | 84.4 | globlastp |
| 3489 | LAB268 | fescue\|gb161\|DT685912 | 6988 | 616 | 84.4 | globlastp |
| 3490 | LAB268 | fescue\|gb161\|DT685921 | 6989 | 616 | 84.4 | globlastp |
| 3491 | LAB268 | fescue\|gb161\|DT689498 | 6990 | 616 | 84.4 | globlastp |
| 3492 | LAB268 | lettuce\|gb157.2\|DW044538 | 6991 | 616 | 84.4 | globlastp |
| 3493 | LAB268 | lettuce\|gb157.2\|DW045694 | 6992 | 616 | 84.4 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3494 | LAB268 | lettuce\|gb157.2\|DW112493 | 6993 | 616 | 84.4 | globlastp |
| 3495 | LAB268 | lettuce\|gb157.2\|DW152364 | 6994 | 616 | 84.4 | globlastp |
| 3496 | LAB268 | lotus\|gb157.2\|CB828182 | 6995 | 616 | 84.4 | globlastp |
| 3497 | LAB268 | oil_palm\|gb166\|EL681389 | 6996 | 616 | 84.4 | globlastp |
| 3498 | LAB268 | rye\|gb164\|BE495825 | 6997 | 616 | 84.4 | globlastp |
| 3499 | LAB268 | triphysaria\|gb164\|CB815232 | 6998 | 616 | 84.4 | globlastp |
| 3500 | LAB268 | wheat\|gb164\|BE399101 | 6999 | 616 | 84.4 | globlastp |
| 3501 | LAB268 | wheat\|gb164\|BE400757 | 7000 | 616 | 84.4 | globlastp |
| 3502 | LAB268 | wheat\|gb164\|BE401940 | 7001 | 616 | 84.4 | globlastp |
| 3503 | LAB268 | wheat\|gb164\|BE415991 | 7002 | 616 | 84.4 | globlastp |
| 3504 | LAB268 | wheat\|gb164\|BE416205 | 7003 | 616 | 84.4 | globlastp |
| 3505 | LAB268 | wheat\|gb164\|BE427056 | 7004 | 616 | 84.4 | globlastp |
| 3506 | LAB268 | wheat\|gb164\|BE443644 | 7005 | 616 | 84.4 | globlastp |
| 3507 | LAB268 | wheat\|gb164\|BE498264 | 7006 | 616 | 84.4 | globlastp |
| 3508 | LAB268 | wheat\|gb164\|BE606944 | 7007 | 616 | 84.4 | globlastp |
| 3509 | LAB268 | wheat\|gb164\|BQ752653 | 7008 | 616 | 84.4 | globlastp |
| 3510 | LAB268 | wheat\|gb164\|CA622310 | 7009 | 616 | 84.4 | globlastp |
| 3511 | LAB268 | wheat\|gb164\|CA701185 | 7010 | 616 | 84.4 | globlastp |
| 3512 | LAB268 | b_oleracea\|gb161\|EE531495 | 7011 | 616 | 84.3 | globlastp |
| 3513 | LAB268 | nicotiana_benthamiana\|gb162\|ES885671 | 7012 | 616 | 84.3 | globlastp |
| 3514 | LAB268 | spruce\|gb162\|DV974261 | 7013 | 616 | 84.3 | globlastp |
| 3515 | LAB268 | spruce\|gb162\|EX317959 | 7014 | 616 | 84.3 | globlastp |
| 3516 | LAB268 | spruce\|gb162\|EX384965 | 7015 | 616 | 84.3 | globlastp |
| 3517 | LAB268 | maize\|gb170\|LLFL417329 | 7016 | 616 | 84.1 | globlastp |
| 3518 | LAB268 | monkeyflower\|10v1\|DV209491 | 7017 | 616 | 83.9 | globlastp |
| 3519 | LAB268 | safflower\|gb162\|EL398759 | 7018 | 616 | 83.8 | globlastp |
| 3520 | LAB268 | b_juncea\|gb164\|EVGN00020808423390 | 7019 | 616 | 83.7 | globlastp |
| 3521 | LAB268 | b_juncea\|gb164\|EVGN00450511902650 | 7020 | 616 | 83.7 | globlastp |
| 3522 | LAB268 | b_rapa\|gb162\|CV432749 | 7021 | 616 | 83.7 | globlastp |
| 3523 | LAB268 | b_rapa\|gb162\|CX272811 | 7022 | 616 | 83.7 | globlastp |
| 3524 | LAB268 | cotton\|gb164\|BE053285 | 7023 | 616 | 83.7 | globlastp |
| 3525 | LAB268 | cotton\|gb164\|BE053467 | 7024 | 616 | 83.7 | globlastp |
| 3526 | LAB268 | cotton\|gb164\|DT458659 | 7025 | 616 | 83.7 | globlastp |
| 3527 | LAB268 | cowpea\|gb166\|FC457316 | 7026 | 616 | 83.7 | globlastp |
| 3528 | LAB268 | fescue\|gb161\|DT707337 | 7027 | 616 | 83.7 | globlastp |
| 3529 | LAB268 | ginger\|gb164\|DY358075 | 7028 | 616 | 83.7 | globlastp |
| 3530 | LAB268 | ipomoea\|gb157.2\|CJ744369 | 7029 | 616 | 83.7 | globlastp |
| 3531 | LAB268 | lettuce\|gb157.2\|DW148044 | 7031 | 616 | 83.7 | globlastp |
| 3532 | LAB268 | radish\|gb164\|EV539475 | 7032 | 616 | 83.7 | globlastp |
| 3533 | LAB268 | radish\|gb164\|EX904372 | 7033 | 616 | 83.7 | globlastp |
| 3534 | LAB268 | sunflower\|gb162\|CD848280 | 7034 | 616 | 83.7 | globlastp |
| 3535 | LAB268 | sunflower\|gb162\|CD849983 | 7035 | 616 | 83.7 | globlastp |
| 3536 | LAB268 | wheat\|gb164\|BE422475 | 7036 | 616 | 83.7 | globlastp |
| 3537 | LAB268 | wheat\|gb164\|BE423456 | 7037 | 616 | 83.7 | globlastp |
| 3538 | LAB268 | wheat\|gb164\|BE423794 | 7038 | 616 | 83.7 | globlastp |
| 3539 | LAB268 | wheat\|gb164\|BE444787 | 7039 | 616 | 83.7 | globlastp |
| 3540 | LAB268 | wheat\|gb164\|BQ240605 | 7040 | 616 | 83.7 | globlastp |
| 3541 | LAB268 | wheat\|gb164\|BQ484067 | 7041 | 616 | 83.7 | globlastp |
| 3542 | LAB268 | wheat\|gb164\|CA633516 | 7042 | 616 | 83.7 | globlastp |
| 3543 | LAB268 | wheat\|gb164\|CA726043 | 7043 | 616 | 83.7 | globlastp |
| 3544 | LAB268 | wheat\|gb164\|DR737070 | 7044 | 616 | 83.7 | globlastp |
| 3545 | LAB268 | melon\|gb165\|AM719080 | 7045 | 616 | 83.6 | globlastp |
| 3546 | LAB268 | radish\|gb164\|EV547372 | 7046 | 616 | 83.6 | globlastp |
| 3547 | LAB268 | radish\|gb164\|EV567871 | 7047 | 616 | 83.6 | globlastp |
| 3548 | LAB268 | pea\|09v1\|EX568838 | 7048 | 616 | 83.5 | globlastp |
| 3549 | LAB268 | pea\|09v1\|EX570248 | 7048 | 616 | 83.5 | globlastp |
| 3550 | LAB268 | pea\|09v1\|EX570251 | 7048 | 616 | 83.5 | globlastp |
| 3551 | LAB268 | pea\|09v1\|EX571338 | 7049 | 616 | 83.5 | glotblastn |
| 3552 | LAB268 | sugarcane\|10v1\|CA077203 | 7050 | 616 | 83.5 | glotblastn |
| 3553 | LAB268 | artemisia\|gb164\|EY039119 | 7051 | 616 | 83.5 | globlastp |
| 3554 | LAB268 | artemisia\|gb164\|EY063572 | 7052 | 616 | 83.5 | glotblastn |
| 3555 | LAB268 | barley\|gb157SOLEXA\|BQ754387 | 7053 | 616 | 83.5 | glotblastn |
| 3556 | LAB268 | canola\|gb161\|EE545425 | 7054 | 616 | 83.5 | glotblastn |
| 3557 | LAB268 | maize\|gb170\|LLFL026684 | 7055 | 616 | 83.5 | globlastp |
| 3558 | LAB268 | spruce\|gb162\|EX403699 | 7056 | 616 | 83.5 | globlastp |
| 3559 | LAB268 | spruce\|gb162\|EX423558 | 7057 | 616 | 83.5 | globlastp |
| 3560 | LAB268 | sunflower\|gb162\|CF077380 | 7058 | 616 | 83.5 | globlastp |
| 3561 | LAB268 | citrus\|gb166\|EY743876 | — | 616 | 83.5 | glotblastn |
| 3562 | LAB268 | canola\|gb161\|CD812364 | 7059 | 616 | 83.1 | globlastp |
| 3563 | LAB268 | cotton\|gb164\|DT456196 | 7060 | 616 | 83.1 | globlastp |
| 3564 | LAB268 | cryptomeria\|gb166\|BY884124 | 7061 | 616 | 83.1 | globlastp |
| 3565 | LAB268 | fescue\|gb161\|DT685782 | 7062 | 616 | 83.1 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3566 | LAB268 | fescue\|gb161\|DT686722 | 7063 | 616 | 83.1 | globlastp |
| 3567 | LAB268 | ginger\|gb164\|DY347124 | 7064 | 616 | 83.1 | globlastp |
| 3568 | LAB268 | ipomoea\|gb157.2\|CB330659 | 7065 | 616 | 83.1 | globlastp |
| 3569 | LAB268 | lettuce\|gb157.2\|DW104257 | 7066 | 616 | 83.1 | globlastp |
| 3570 | LAB268 | lettuce\|gb157.2\|DW112662 | 7067 | 616 | 83.1 | globlastp |
| 3571 | LAB268 | radish\|gb164\|EV569789 | 7068 | 616 | 83.1 | globlastp |
| 3572 | LAB268 | strawberry\|gb164\|CO817361 | 7069 | 616 | 83.1 | globlastp |
| 3573 | LAB268 | triphysaria\|gb164\|EY020033 | 7070 | 616 | 83.1 | globlastp |
| 3574 | LAB268 | wheat\|gb164\|BE416319 | 7071 | 616 | 83.1 | globlastp |
| 3575 | LAB268 | wheat\|gb164\|BE416450 | 7072 | 616 | 83.1 | globlastp |
| 3576 | LAB268 | wheat\|gb164\|BE499046 | 7073 | 616 | 83.1 | globlastp |
| 3577 | LAB268 | wheat\|gb164\|BF200454 | 7074 | 616 | 83.1 | globlastp |
| 3578 | LAB268 | wheat\|gb164\|BF484135 | 7075 | 616 | 83.1 | globlastp |
| 3579 | LAB268 | wheat\|gb164\|BU101226 | 7076 | 616 | 83.1 | globlastp |
| 3580 | LAB268 | wheat\|gb164\|CA597413 | 7077 | 616 | 83.1 | globlastp |
| 3581 | LAB268 | wheat\|gb164\|CA610380 | 7078 | 616 | 83.1 | globlastp |
| 3582 | LAB268 | wheat\|gb164\|CA616899 | 7079 | 616 | 83.1 | globlastp |
| 3583 | LAB268 | wheat\|gb164\|CA639849 | 7080 | 616 | 83.1 | globlastp |
| 3584 | LAB268 | cotton\|gb164\|CD486080 | 7081 | 616 | 83 | globlastp |
| 3585 | LAB268 | sunflower\|gb162\|CD848926 | 7082 | 616 | 83 | globlastp |
| 3586 | LAB268 | lettuce\|gb157.2\|DW120600 | 7083 | 616 | 82.9 | globlastp |
| 3587 | LAB268 | radish\|gb164\|FD966520 | 7084 | 616 | 82.9 | globlastp |
| 3588 | LAB268 | spikemoss\|gb165\|FE448582 | 7085 | 616 | 82.9 | globlastp |
| 3589 | LAB268 | spruce\|gb162\|EX400483 | 7086 | 616 | 82.8 | globlastp |
| 3590 | LAB268 | triphysaria\|gb164\|EX998942 | 7087 | 616 | 82.8 | globlastp |
| 3591 | LAB268 | wheat\|gb164\|CA622100 | 7088 | 616 | 82.69 | glotblastn |
| 3592 | LAB268 | apple\|gb171\|CN578733 | 7089 | 616 | 82.52 | glotblastn |
| 3593 | LAB268 | cotton\|gb164\|ES837982 | 7090 | 616 | 82.52 | glotblastn |
| 3594 | LAB268 | maize\|gb170\|LLFL008979 | 7091 | 616 | 82.52 | glotblastn |
| 3595 | LAB268 | sugarcane\|10v1\|CA234599XX2 | 7092 | 616 | 82.52 | glotblastn |
| 3596 | LAB268 | lolium\|10v1\|SRR029314S0011890 | 7093 | 616 | 82.5 | globlastp |
| 3597 | LAB268 | orobanche\|10v1\|SRR023495S0014175 | 7094 | 616 | 82.5 | globlastp |
| 3598 | LAB268 | triphysaria\|10v1\|SRR023500S0019032 | 7094 | 616 | 82.5 | globlastp |
| 3599 | LAB268 | b_rapa\|gb162\|CA991835 | 7095 | 616 | 82.5 | globlastp |
| 3600 | LAB268 | cichorium\|gb171\|EH703474 | 7096 | 616 | 82.5 | globlastp |
| 3601 | LAB268 | tea\|10v1\|GE652467 | 7097 | 616 | 82.5 | globlastp |
| 3602 | LAB268 | tea\|gb171\|GE652467 | 7097 | 616 | 82.5 | globlastp |
| 3603 | LAB268 | oat\|10v1\|GO586588 | 7098 | 616 | 82.4 | globlastp |
| 3604 | LAB268 | oat\|10v1\|GO586968 | 7099 | 616 | 82.4 | globlastp |
| 3605 | LAB268 | arabidopsis\|gb165\|AT5G59970 | 7100 | 616 | 82.4 | globlastp |
| 3606 | LAB268 | beet\|gb162\|BI096197 | 7101 | 616 | 82.4 | globlastp |
| 3607 | LAB268 | canola\|gb161\|CD817261 | 7102 | 616 | 82.4 | globlastp |
| 3608 | LAB268 | fescue\|gb161\|DT686588 | 7103 | 616 | 82.4 | globlastp |
| 3609 | LAB268 | fescue\|gb161\|DT687391 | 7104 | 616 | 82.4 | globlastp |
| 3610 | LAB268 | ipomoea\|gb157.2\|CJ738107 | 7105 | 616 | 82.4 | globlastp |
| 3611 | LAB268 | lettuce\|gb157.2\|DW075639 | 7106 | 616 | 82.4 | globlastp |
| 3612 | LAB268 | lettuce\|gb157.2\|DW147673 | 7107 | 616 | 82.4 | globlastp |
| 3613 | LAB268 | lotus\|gb157.2\|AW163944 | 7108 | 616 | 82.4 | globlastp |
| 3614 | LAB268 | radish\|gb164\|EV549130 | 7109 | 616 | 82.4 | globlastp |
| 3615 | LAB268 | radish\|gb164\|EX746739 | 7110 | 616 | 82.4 | globlastp |
| 3616 | LAB268 | rose\|gb157.2\|EC586164 | 7111 | 616 | 82.4 | globlastp |
| 3617 | LAB268 | rye\|gb164\|BE704504 | 7112 | 616 | 82.4 | globlastp |
| 3618 | LAB268 | strawberry\|gb164\|DY670022 | 7113 | 616 | 82.4 | globlastp |
| 3619 | LAB268 | wheat\|gb164\|BE399555 | 7114 | 616 | 82.4 | globlastp |
| 3620 | LAB268 | wheat\|gb164\|BE399932 | 7115 | 616 | 82.4 | globlastp |
| 3621 | LAB268 | wheat\|gb164\|BE415110 | 7116 | 616 | 82.4 | globlastp |
| 3622 | LAB268 | wheat\|gb164\|BE416325 | 7117 | 616 | 82.4 | globlastp |
| 3623 | LAB268 | wheat\|gb164\|BE423864 | 7118 | 616 | 82.4 | globlastp |
| 3624 | LAB268 | wheat\|gb164\|BE424898 | 7119 | 616 | 82.4 | globlastp |
| 3625 | LAB268 | wheat\|gb164\|BE425234 | 7120 | 616 | 82.4 | globlastp |
| 3626 | LAB268 | wheat\|gb164\|BG263850 | 7121 | 616 | 82.4 | globlastp |
| 3627 | LAB268 | wheat\|gb164\|BG275092 | 7122 | 616 | 82.4 | globlastp |
| 3628 | LAB268 | wheat\|gb164\|CD869572 | 7123 | 616 | 82.4 | globlastp |
| 3629 | LAB268 | cassava\|gb164\|BM260125 | 7124 | 616 | 82.3 | globlastp |
| 3630 | LAB268 | radish\|gb164\|FD538823 | 7125 | 616 | 82.3 | globlastp |
| 3631 | LAB268 | spruce\|gb162\|CO223362 | 7126 | 616 | 82.3 | globlastp |
| 3632 | LAB268 | spruce\|gb162\|DR570941 | 7127 | 616 | 82.3 | globlastp |
| 3633 | LAB268 | spruce\|gb162\|EX323253 | 7128 | 616 | 82.3 | globlastp |
| 3634 | LAB268 | triphysaria\|gb164\|EX991298 | 7129 | 616 | 82.3 | globlastp |
| 3635 | LAB268 | wheat\|gb164\|CK154925 | 7130 | 616 | 81.8 | globlastp |
| 3636 | LAB268 | barley\|gb157SOLEXA\|BG344395 | 7131 | 616 | 81.73 | glotblastn |
| 3637 | LAB268 | b_juncea\|gb164\|EVGN00141408432756 | 7132 | 616 | 81.7 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3638 | LAB268 | b_rapa\|gb162\|L33665 | 7133 | 616 | 81.7 | globlastp |
| 3639 | LAB268 | beet\|gb162\|EG551265 | 7134 | 616 | 81.7 | globlastp |
| 3640 | LAB268 | canola\|gb161\|CD812509 | 7135 | 616 | 81.7 | globlastp |
| 3641 | LAB268 | lettuce\|gb157.2\|DW054329 | 7136 | 616 | 81.7 | globlastp |
| 3642 | LAB268 | lettuce\|gb157.2\|DW158082 | 7137 | 616 | 81.7 | globlastp |
| 3643 | LAB268 | radish\|gb164\|EY903059 | 7138 | 616 | 81.7 | globlastp |
| 3644 | LAB268 | wheat\|gb164\|AL820085 | 7139 | 616 | 81.7 | globlastp |
| 3645 | LAB268 | wheat\|gb164\|BE398313 | 7140 | 616 | 81.7 | globlastp |
| 3646 | LAB268 | wheat\|gb164\|BE415832 | 7141 | 616 | 81.7 | globlastp |
| 3647 | LAB268 | wheat\|gb164\|BE415870 | 7142 | 616 | 81.7 | globlastp |
| 3648 | LAB268 | wheat\|gb164\|BE416751 | 7143 | 616 | 81.7 | globlastp |
| 3649 | LAB268 | wheat\|gb164\|BE417145 | 7144 | 616 | 81.7 | globlastp |
| 3650 | LAB268 | wheat\|gb164\|BE423800 | 7145 | 616 | 81.7 | globlastp |
| 3651 | LAB268 | wheat\|gb164\|BE425155 | 7146 | 616 | 81.7 | globlastp |
| 3652 | LAB268 | wheat\|gb164\|CA605518 | 7147 | 616 | 81.7 | globlastp |
| 3653 | LAB268 | maize\|gb170\|LLFL325425 | 7148 | 616 | 81.6 | globlastp |
| 3654 | LAB268 | oil_palm\|gb166\|EL683840 | 7149 | 616 | 81.6 | globlastp |
| 3655 | LAB268 | spruce\|gb162\|ES665243 | 7150 | 616 | 81.6 | globlastp |
| 3656 | LAB268 | barley\|gb157SOLEXA\|BM444527 | 7151 | 616 | 81.55 | glotblastn |
| 3657 | LAB268 | maize\|gb170\|LLCD447518 | 7152 | 616 | 81.55 | glotblastn |
| 3658 | LAB268 | sugarcane\|gb157.3\|CA107504 | 7153 | 616 | 81.55 | glotblastn |
| 3659 | LAB268 | sugarcane\|gb157.3\|CA108717 | 7154 | 616 | 81.55 | glotblastn |
| 3660 | LAB268 | jatropha\|09v1\|FM888435 | — | 616 | 81.55 | glotblastn |
| 3661 | LAB268 | triphysaria\|gb164\|EY012083 | — | 616 | 81.55 | glotblastn |
| 3662 | LAB268 | fescue\|gb161\|DT687241 | 7155 | 616 | 81.5 | globlastp |
| 3663 | LAB268 | radish\|gb164\|FD580482 | 7156 | 616 | 81.5 | globlastp |
| 3664 | LAB268 | citrus\|gb166\|EY825373 | 7157 | 616 | 81.1 | globlastp |
| 3665 | LAB268 | fescue\|gb161\|DT687220 | 7158 | 616 | 81.1 | globlastp |
| 3666 | LAB268 | fescue\|gb161\|DT688818 | 7159 | 616 | 81.1 | globlastp |
| 3667 | LAB268 | ipomoea\|gb157.2\|CB330950 | 7160 | 616 | 81.1 | globlastp |
| 3668 | LAB268 | lettuce\|gb157.2\|DW049144 | 7161 | 616 | 81.1 | globlastp |
| 3669 | LAB268 | rose\|gb157.2\|EC587324 | 7162 | 616 | 81.1 | globlastp |
| 3670 | LAB268 | wheat\|gb164\|BE399369 | 7163 | 616 | 81.1 | globlastp |
| 3671 | LAB268 | wheat\|gb164\|BE416516 | 7164 | 616 | 81.1 | globlastp |
| 3672 | LAB268 | wheat\|gb164\|BF474715 | 7165 | 616 | 81.1 | globlastp |
| 3673 | LAB268 | wheat\|gb164\|BM135522 | 7166 | 616 | 81.1 | globlastp |
| 3674 | LAB268 | wheat\|gb164\|BQ608801 | 7167 | 616 | 81.1 | globlastp |
| 3675 | LAB268 | wheat\|gb164\|CA593029 | 7168 | 616 | 81.1 | globlastp |
| 3676 | LAB268 | wheat\|gb164\|CA609335 | 7169 | 616 | 81.1 | globlastp |
| 3677 | LAB268 | pine\|gb157.2\|DR056167 | 7170 | 616 | 81 | globlastp |
| 3678 | LAB268 | rye\|gb164\|BE493942 | 7171 | 616 | 81 | globlastp |
| 3679 | LAB268 | soybean\|gb168\|BM139774 | 7172 | 616 | 81 | globlastp |
| 3680 | LAB268 | wheat\|gb164\|CA692550 | 7173 | 616 | 81 | globlastp |
| 3681 | LAB268 | wheat\|gb164\|CA708235 | 7174 | 616 | 81 | globlastp |
| 3682 | LAB268 | fescue\|gb161\|DT675092 | 7175 | 616 | 80.8 | globlastp |
| 3683 | LAB268 | potato\|gb157.2\|CV475517 | 7176 | 616 | 80.8 | globlastp |
| 3684 | LAB268 | spruce\|gb162\|DR481843 | 7177 | 616 | 80.8 | globlastp |
| 3685 | LAB268 | sugarcane\|gb157.3\|CA198373 | 7178 | 616 | 80.8 | globlastp |
| 3686 | LAB268 | pea\|09v1\|FG532461 | 7179 | 616 | 80.6 | globlastp |
| 3687 | LAB268 | barley\|gb157SOLEXA\|BF627774 | 7180 | 616 | 80.6 | globlastp |
| 3688 | LAB268 | rose\|gb157.2\|EC587236 | 7181 | 616 | 80.6 | globlastp |
| 3689 | LAB268 | wheat\|gb164\|CJ509634 | 7182 | 616 | 80.6 | globlastp |
| 3690 | LAB268 | sesame\|10v1\|BU667852 | 7183 | 616 | 80.58 | glotblastn |
| 3690 | LAB268 | sesame\|gb157.2\|BU667852 | 7184 | 616 | 80.58 | glotblastn |
| 3691 | LAB268 | wheat\|gb164\|DR737618 | 7185 | 616 | 80.58 | glotblastn |
| 3692 | LAB268 | artemisia\|10v1\|SRR019551S0085700 | | 616 | 80.58 | glotblastn |
| 3693 | LAB268 | b_rapa\|gb162\|EE523641 | 7186 | 616 | 80.5 | globlastp |
| 3694 | LAB268 | cotton\|gb164\|BF269451 | 7187 | 616 | 80.5 | globlastp |
| 3695 | LAB268 | fescue\|gb161\|DT687024 | 7188 | 616 | 80.5 | globlastp |
| 3696 | LAB268 | fescue\|gb161\|DT687419 | 7189 | 616 | 80.5 | globlastp |
| 3697 | LAB268 | fescue\|gb161\|DT702542 | 7190 | 616 | 80.5 | globlastp |
| 3698 | LAB268 | iceplant\|gb164\|BE033998 | 7191 | 616 | 80.5 | globlastp |
| 3699 | LAB268 | wheat\|gb164\|BE404764 | 7192 | 616 | 80.5 | globlastp |
| 3700 | LAB268 | wheat\|gb164\|CA484177 | 7193 | 616 | 80.5 | globlastp |
| 3701 | LAB268 | beet\|gb162\|BE590319 | 7194 | 616 | 80 | globlastp |
| 3702 | LAB269 | sugarcane\|gb157.3\|CA073377 | 7195 | 617 | 96.2 | globlastp |
| 3703 | LAB269 | sugarcane\|gb157.3\|CA073918 | 7196 | 617 | 96.2 | globlastp |
| 3704 | LAB269 | sugarcane\|gb157.3\|CA116132 | 7195 | 617 | 96.2 | globlastp |
| 3705 | LAB269 | sorghum\|09v1\|SB01G000950 | 7197 | 617 | 95 | globlastp |
| 3706 | LAB269 | sorghum\|gb161.crp\|BF585848 | 7197 | 617 | 95 | globlastp |
| 3707 | LAB269 | sugarcane\|gb157.3\|CA073796 | 7197 | 617 | 95 | globlastp |
| 3708 | LAB269 | sugarcane\|gb157.3\|CA079491 | 7197 | 617 | 95 | globlastp |

TABLE 54-continued

Homologues of the identified genes/polypeptides for increasing abiotic stress
tolerance, water use efficiency, yield, growth rate, vigor, oil content, biomass, growth
rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3709 | LAB269 | sugarcane\|gb157.3\|CA090885 | 7197 | 617 | 95 | globlastp |
| 3710 | LAB269 | sugarcane\|gb157.3\|CA242409 | 7198 | 617 | 93.1 | globlastp |
| 3711 | LAB269 | cenchrus\|gb166\|EB669873 | 7199 | 617 | 92.5 | globlastp |
| 3712 | LAB269 | sugarcane\|gb157.3\|BU102855 | 7200 | 617 | 92.5 | globlastp |
| 3713 | LAB269 | sugarcane\|gb157.3\|CA085423 | 7200 | 617 | 92.5 | globlastp |
| 3714 | LAB269 | sugarcane\|gb157.3\|CA114248 | 7200 | 617 | 92.5 | globlastp |
| 3715 | LAB269 | sugarcane\|10v1\|CA073377 | 7201 | 617 | 92.45 | glotblastn |
| 3716 | LAB269 | sugarcane\|gb157.3\|CA071501 | 7202 | 617 | 91.9 | globlastp |
| 3717 | LAB269 | sugarcane\|10v1\|CA073796 | 7203 | 617 | 91.82 | glotblastn |
| 3718 | LAB269 | sugarcane\|10v1\|CA088321 | 7204 | 617 | 91.82 | glotblastn |
| 3719 | LAB269 | cotton\|gb164\|DT556619 | 7205 | 617 | 91.2 | globlastp |
| 3720 | LAB269 | maize\|gb170\|AA661456 | 7206 | 617 | 91.2 | globlastp |
| 3721 | LAB269 | maize\|gb170\|AI395882 | 7205 | 617 | 91.2 | globlastp |
| 3722 | LAB269 | sorghum\|09v1\|SB02G030950 | 7207 | 617 | 91.2 | globlastp |
| 3723 | LAB269 | sorghum\|gb161.crp\|AI657275 | 7207 | 617 | 91.2 | globlastp |
| 3724 | LAB269 | sugarcane\|gb157.3\|CA079328 | 7208 | 617 | 91.19 | glotblastn |
| 3725 | LAB269 | sorghum\|09v1\|SB01G039250 | 7209 | 617 | 90.6 | globlastp |
| 3726 | LAB269 | sorghum\|gb161.crp\|AI396033 | 7209 | 617 | 90.6 | globlastp |
| 3727 | LAB269 | sugarcane\|gb157.3\|CA066505 | 7210 | 617 | 90.6 | globlastp |
| 3728 | LAB269 | sugarcane\|gb157.3\|CA071525 | 7211 | 617 | 90.6 | globlastp |
| 3729 | LAB269 | maize\|gb170\|LLFL026072 | 7212 | 617 | 90 | glotblastn |
| 3730 | LAB269 | sugarcane\|gb157.3\|CA073176 | 7213 | 617 | 90 | globlastp |
| 3731 | LAB269 | sugarcane\|10v1\|CA071525 | 7214 | 617 | 89.94 | glotblastn |
| 3732 | LAB269 | sugarcane\|gb157.3\|CA114685 | 7215 | 617 | 89.94 | glotblastn |
| 3733 | LAB269 | rice\|gb170\|OS01G31800 | 7216 | 617 | 89.4 | globlastp |
| 3734 | LAB269 | rice\|gb170\|OS03G17100 | 7216 | 617 | 89.4 | globlastp |
| 3735 | LAB269 | switchgrass\|gb167\|FE601150 | 7217 | 617 | 89.4 | globlastp |
| 3736 | LAB269 | switchgrass\|gb167\|FL727559 | 7218 | 617 | 89.4 | globlastp |
| 3737 | LAB269 | maize\|gb170\|LLEG052954 | 7219 | 617 | 89.38 | glotblastn |
| 3738 | LAB269 | sugarcane\|10v1\|BU102855 | 7220 | 617 | 89.31 | glotblastn |
| 3739 | LAB269 | sugarcane\|10v1\|CA071501 | 7221 | 617 | 89.31 | glotblastn |
| 3740 | LAB269 | sugarcane\|gb157.3\|CA077796 | 7222 | 617 | 89.31 | glotblastn |
| 3741 | LAB269 | sorghum\|09v1\|SB01G039240 | 7223 | 617 | 88.8 | globlastp |
| 3742 | LAB269 | sorghum\|gb161.crp\|AI444702 | 7223 | 617 | 88.8 | globlastp |
| 3743 | LAB269 | switchgrass\|gb167\|FE614567 | 7224 | 617 | 88.8 | globlastp |
| 3744 | LAB269 | sugarcane\|gb157.3\|CA116578 | 7225 | 617 | 88.75 | glotblastn |
| 3745 | LAB269 | sugarcane\|10v1\|CA072812 | 7226 | 617 | 88.68 | glotblastn |
| 3746 | LAB269 | maize\|gb170\|LLCF059749 | 7227 | 617 | 88.68 | glotblastn |
| 3747 | LAB269 | cenchrus\|gb166\|EB652626 | 7228 | 617 | 88.1 | globlastp |
| 3748 | LAB269 | maize\|gb170\|AI395995 | 7229 | 617 | 88.1 | globlastp |
| 3749 | LAB269 | maize\|gb170\|LLDR828188 | 7230 | 617 | 88.1 | globlastp |
| 3750 | LAB269 | maize\|gb170\|ZMU08225 | 7230 | 617 | 88.1 | globlastp |
| 3751 | LAB269 | switchgrass\|gb167\|FE599840 | 7231 | 617 | 88.1 | globlastp |
| 3752 | LAB269 | sugarcane\|gb157.3\|CA123898 | 7232 | 617 | 88.05 | glotblastn |
| 3753 | LAB269 | sugarcane\|gb157.3\|CA239448 | 7233 | 617 | 88.05 | glotblastn |
| 3754 | LAB269 | millet\|09v1\|CD724737 | 7234 | 617 | 87.5 | glotblastn |
| 3755 | LAB269 | maize\|gb170\|AI396033 | 7235 | 617 | 87.5 | globlastp |
| 3756 | LAB269 | switchgrass\|gb167\|DN151599 | 7236 | 617 | 87.5 | globlastp |
| 3757 | LAB269 | oat\|10v1\|GO586241 | 7237 | 617 | 87.4 | globlastp |
| 3758 | LAB269 | sugarcane\|gb157.3\|CA087750 | 7238 | 617 | 87 | globlastp |
| 3759 | LAB269 | sugarcane\|gb157.3\|CA118440 | 7239 | 617 | 87 | globlastp |
| 3760 | LAB269 | gerbera\|09v1\|AJ752939 | 7240 | 617 | 86.8 | globlastp |
| 3761 | LAB269 | oat\|10v1\|CN814889 | 7241 | 617 | 86.8 | globlastp |
| 3762 | LAB269 | sugarcane\|gb157.3\|CA123779 | 7242 | 617 | 86.79 | glotblastn |
| 3763 | LAB269 | sugarcane\|gb157.3\|CA101458 | 7243 | 617 | 86.7 | globlastp |
| 3764 | LAB269 | beet\|gb162\|BQ588291 | 7244 | 617 | 86.2 | globlastp |
| 3765 | LAB269 | fescue\|gb161\|DT689657 | 7245 | 617 | 86.2 | globlastp |
| 3766 | LAB269 | sugarcane\|gb157.3\|CA124793 | 7246 | 617 | 86.2 | globlastp |
| 3767 | LAB269 | brachypodium\|09v1\|DV488718 | 7247 | 617 | 85.7 | globlastp |
| 3768 | LAB269 | brachypodium\|gb169\|BE401791 | 7247 | 617 | 85.7 | globlastp |
| 3769 | LAB269 | brachypodium\|gb169\|BI960263 | 7248 | 617 | 85.6 | globlastp |
| 3770 | LAB269 | sugarcane\|gb157.3\|CA129121 | 7249 | 617 | 85.53 | glotblastn |
| 3771 | LAB269 | switchgrass\|gb167\|DN140680 | 7250 | 617 | 85.5 | globlastp |
| 3772 | LAB269 | switchgrass\|gb167\|DN141778 | 7250 | 617 | 85.5 | globlastp |
| 3773 | LAB269 | switchgrass\|gb167\|FE633841 | 7250 | 617 | 85.5 | globlastp |
| 3774 | LAB269 | switchgrass\|gb167\|FL736645 | 7250 | 617 | 85.5 | globlastp |
| 3775 | LAB269 | sorghum\|09v1\|SB09G001520 | 7251 | 617 | 85.2 | globlastp |
| 3776 | LAB269 | sorghum\|gb161.crp\|AW287442 | 7251 | 617 | 85.2 | globlastp |
| 3777 | LAB269 | sugarcane\|gb157.3\|CA080385 | 7252 | 617 | 85.1 | globlastp |
| 3778 | LAB269 | sugarcane\|gb157.3\|CA100971 | 7253 | 617 | 85.1 | globlastp |
| 3779 | LAB269 | sugarcane\|gb157.3\|CA103471 | 7253 | 617 | 85.1 | globlastp |
| 3780 | LAB269 | maize\|gb170\|T18401 | 7254 | 617 | 85 | globlastp |

TABLE 54-continued

Homologues of the identified genes/polypeptides for increasing abiotic stress
tolerance, water use efficiency, yield, growth rate, vigor, oil content, biomass, growth
rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3781 | LAB269 | oat\|10v1\|GR358067 | 7255 | 617 | 84.9 | globlastp |
| 3782 | LAB269 | barley\|10v1\|BQ460682 | 7256 | 617 | 84.9 | globlastp |
| 3783 | LAB269 | barley\|gb157SOLEXA\|BQ460682 | 7256 | 617 | 84.9 | globlastp |
| 3784 | LAB269 | cassava\|09v1\|BM259730 | 7257 | 617 | 84.9 | globlastp |
| 3785 | LAB269 | cassava\|gb164\|BM259730 | 7257 | 617 | 84.9 | globlastp |
| 3786 | LAB269 | liriodendron\|gb166\|DT579867 | 7258 | 617 | 84.9 | globlastp |
| 3787 | LAB269 | maize\|gb170\|LLFK966020 | 7259 | 617 | 84.9 | globlastp |
| 3788 | LAB269 | prunus\|gb167\|DY646167 | 7260 | 617 | 84.9 | globlastp |
| 3789 | LAB269 | lotus\|09v1\|BG661990 | 7261 | 617 | 84.4 | globlastp |
| 3790 | LAB269 | lotus\|gb157.2\|BG661990 | 7261 | 617 | 84.4 | globlastp |
| 3791 | LAB269 | oil_palm\|gb166\|EL681634 | 7262 | 617 | 84.4 | globlastp |
| 3792 | LAB269 | gerbera\|09v1\|AJ753301 | 7263 | 617 | 84.3 | globlastp |
| 3793 | LAB269 | citrus\|gb166\|BQ624783 | 7264 | 617 | 84.3 | globlastp |
| 3794 | LAB269 | cowpea\|gb166\|FC456663 | 7265 | 617 | 84.3 | globlastp |
| 3795 | LAB269 | cowpea\|gb166\|FC456998 | 7266 | 617 | 84.3 | globlastp |
| 3796 | LAB269 | medicago\|09v1\|BF643805 | 7267 | 617 | 84.3 | globlastp |
| 3797 | LAB269 | soybean\|gb168\|CA898616 | 7268 | 617 | 84.3 | globlastp |
| 3798 | LAB269 | artemisia\|10v1\|EY031915 | 7269 | 617 | 84.28 | glotblastn |
| 3799 | LAB269 | artemisia\|10v1\|EY075725 | 7269 | 617 | 84.28 | glotblastn |
| 3800 | LAB269 | artemisia\|10v1\|GW328612 | 7269 | 617 | 84.28 | glotblastn |
| 3801 | LAB269 | artemisia\|10v1\|GW329305 | 7269 | 617 | 84.28 | glotblastn |
| 3802 | LAB269 | artemisia\|10v1\|SRR019254S0011741 | 7269 | 617 | 84.28 | glotblastn |
| 3803 | LAB269 | artemisia\|10v1\|SRR019254S0001774 | 7269 | 617 | 84.28 | glotblastn |
| 3804 | LAB269 | artemisia\|gb164\|EY031915 | 7269 | 617 | 84.28 | glotblastn |
| 3805 | LAB269 | artemisia\|10v1\|SRR019254S0002410 | 7269 | 617 | 84.28 | glotblastn |
| 3806 | LAB269 | artemisia\|gb164\|EY055445 | 7269 | 617 | 84.28 | glotblastn |
| 3807 | LAB269 | lotus\|09v1\|BI418493 | 7270 | 617 | 84 | globlastp |
| 3808 | LAB269 | lotus\|gb157.2\|BI418493 | 7270 | 617 | 84 | globlastp |
| 3809 | LAB269 | maize\|gb170\|BM259143 | 7271 | 617 | 84 | globlastp |
| 3810 | LAB269 | sugarcane\|gb157.3\|CA071927 | 7272 | 617 | 84 | globlastp |
| 3811 | LAB269 | sugarcane\|gb157.3\|CA118816 | 7272 | 617 | 84 | globlastp |
| 3812 | LAB269 | spurge\|gb161\|AF242311 | 7273 | 617 | 83.95 | glotblastn |
| 3813 | LAB269 | castorbean\|gb160\|EE259198 | 7274 | 617 | 83.8 | globlastp |
| 3814 | LAB269 | castorbean\|09v1\|EE259198 | 7274 | 617 | 83.8 | globlastp |
| 3815 | LAB269 | cynara\|gb167\|GE588632 | 7275 | 617 | 83.8 | globlastp |
| 3816 | LAB269 | maize\|gb170\|LLAI666147 | 7276 | 617 | 83.8 | globlastp |
| 3817 | LAB269 | onion\|gb162\|BI095529 | 7277 | 617 | 83.75 | glotblastn |
| 3818 | LAB269 | sugarcane\|gb157.3\|CA113890 | 7278 | 617 | 83.7 | globlastp |
| 3819 | LAB269 | cichorium\|gb171\|EH704900 | 7279 | 617 | 83.65 | glotblastn |
| 3820 | LAB269 | gerbera\|09v1\|AJ756141 | 7280 | 617 | 83.6 | globlastp |
| 3821 | LAB269 | apple\|gb171\|CN579547 | 7281 | 617 | 83.6 | globlastp |
| 3822 | LAB269 | apple\|gb171\|CN861500 | 7282 | 617 | 83.6 | globlastp |
| 3823 | LAB269 | beet\|gb162\|BI543765 | 7283 | 617 | 83.6 | globlastp |
| 3824 | LAB269 | cassava\|09v1\|BM259833 | 7284 | 617 | 83.6 | globlastp |
| 3825 | LAB269 | cassava\|gb164\|BM259833 | 7284 | 617 | 83.6 | globlastp |
| 3826 | LAB269 | chestnut\|gb170\|SRR006295S0009247 | 7285 | 617 | 83.6 | globlastp |
| 3827 | LAB269 | cotton\|gb164\|BE052224 | 7286 | 617 | 83.6 | globlastp |
| 3828 | LAB269 | cotton\|gb164\|BE055384 | 7286 | 617 | 83.6 | globlastp |
| 3829 | LAB269 | cotton\|gb164\|CO110571 | 7287 | 617 | 83.6 | globlastp |
| 3830 | LAB269 | cotton\|gb164\|DT048656 | 7286 | 617 | 83.6 | globlastp |
| 3831 | LAB269 | oak\|gb170\|N950260 | 7285 | 617 | 83.6 | globlastp |
| 3832 | LAB269 | poppy\|gb166\|FG607964 | 7288 | 617 | 83.6 | globlastp |
| 3833 | LAB269 | soybean\|gb168\|BE660063 | 7289 | 617 | 83.6 | globlastp |
| 3834 | LAB269 | soybean\|gb168\|BI273631 | 7290 | 617 | 83.6 | globlastp |
| 3835 | LAB269 | spurge\|gb161\|AW874994 | 7291 | 617 | 83.6 | globlastp |
| 3836 | LAB269 | wheat\|gb164\|BQ802458 | 7292 | 617 | 83.6 | globlastp |
| 3837 | LAB269 | strawberry\|gb164\|DY674860 | 7293 | 617 | 83.3 | globlastp |
| 3838 | LAB269 | cenchrus\|gb166\|EB656997 | 7294 | 617 | 83.2 | globlastp |
| 3839 | LAB269 | maize\|gb170\|LLEB406213 | 7295 | 617 | 83.12 | glotblastn |
| 3840 | LAB269 | artemisia\|10v1\|SRR019254S0013055 | 7296 | 617 | 83.1 | globlastp |
| 3841 | LAB269 | tea\|10v1\|CV013635 | 7297 | 617 | 83.1 | globlastp |
| 3842 | LAB269 | castorbean\|gb160\|MDL29154M000210 | 7298 | 617 | 83.1 | globlastp |
| 3843 | LAB269 | castorbean\|09v1\|EV520334 | 7298 | 617 | 83.1 | globlastp |
| 3844 | LAB269 | ginger\|gb164\|DY353641 | 7299 | 617 | 83.1 | globlastp |
| 3845 | LAB269 | medicago\|gb157.2\|BF643805 | 7300 | 617 | 83.1 | globlastp |
| 3846 | LAB269 | sugarcane\|gb157.3\|CA120528 | 7301 | 617 | 83.1 | globlastp |
| 3847 | LAB269 | tea\|gb171\|CV013635 | 7297 | 617 | 83.1 | globlastp |
| 3848 | LAB269 | bean\|gb167\|CA898614 | 7302 | 617 | 83.02 | glotblastn |
| 3849 | LAB269 | iceplant\|gb164\|BE130702 | 7303 | 617 | 83.02 | glotblastn |
| 3850 | LAB269 | wheat\|gb164\|AL826759 | 7304 | 617 | 83.02 | glotblastn |
| 3851 | LAB269 | flax\|09v1\|EU830866 | 7305 | 617 | 83 | globlastp |
| 3852 | LAB269 | orobanche\|10v1\|SRR023189S0002180 | 7306 | 617 | 83 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3853 | LAB269 | cowpea\|gb166\|FF397354 | 7307 | 617 | 83 | globlastp |
| 3854 | LAB269 | liquorice\|gb171\|FS254761 | 7308 | 617 | 83 | globlastp |
| 3855 | LAB269 | lotus\|09v1\|LLAW719911 | 7309 | 617 | 83 | globlastp |
| 3856 | LAB269 | lotus\|gb157.2\|AW719911 | 7309 | 617 | 83 | globlastp |
| 3857 | LAB269 | pseudoroegneria\|gb167\|FF340751 | 7310 | 617 | 83 | globlastp |
| 3858 | LAB269 | soybean\|gb168\|AL377356 | 7311 | 617 | 83 | globlastp |
| 3859 | LAB269 | soybean\|gb168\|AW348342 | 7312 | 617 | 83 | globlastp |
| 3860 | LAB269 | rice\|gb170\|OS05G02300 | 7313 | 617 | 82.7 | globlastp |
| 3861 | LAB269 | sugarcane\|10v1\|CA080385 | 7314 | 617 | 82.61 | glotblastn |
| 3862 | LAB269 | eschscholzia\|10v1\|CD480726 | 7315 | 617 | 82.6 | globlastp |
| 3863 | LAB269 | centaurea\|gb166\|EL932239 | 7316 | 617 | 82.6 | globlastp |
| 3864 | LAB269 | lettuce\|10v1\|CV700185 | 7317 | 617 | 82.6 | globlastp |
| 3865 | LAB269 | lettuce\|gb157.2\|CV700185 | 7317 | 617 | 82.6 | globlastp |
| 3866 | LAB269 | lettuce\|10v1\|DW043988 | 7317 | 617 | 82.6 | globlastp |
| 3867 | LAB269 | lettuce\|gb157.2\|DW043988 | 7317 | 617 | 82.6 | globlastp |
| 3868 | LAB269 | lettuce\|10v1\|DW145083 | 7317 | 617 | 82.6 | globlastp |
| 3869 | LAB269 | lettuce\|gb157.2\|DW145083 | 7317 | 617 | 82.6 | globlastp |
| 3870 | LAB269 | coffea\|10v1\|DV673276 | 7318 | 617 | 82.5 | globlastp |
| 3871 | LAB269 | eggplant\|10v1\|FS017038 | 7319 | 617 | 82.5 | globlastp |
| 3872 | LAB269 | ginseng\|10v1\|DV554362 | 7320 | 617 | 82.5 | globlastp |
| 3873 | LAB269 | avocado\|10v1\|CV004562 | 7321 | 617 | 82.5 | globlastp |
| 3874 | LAB269 | avocado\|gb164\|CV004562 | 7321 | 617 | 82.5 | globlastp |
| 3875 | LAB269 | brachypodium\|gb169\|BE398477 | 7322 | 617 | 82.5 | globlastp |
| 3876 | LAB269 | brachypodium\|09v1\|DV475962 | 7323 | 617 | 82.5 | globlastp |
| 3877 | LAB269 | brachypodium\|gb169\|BE400244 | 7323 | 617 | 82.5 | globlastp |
| 3878 | LAB269 | cotton\|gb164\|BF275621 | 7324 | 617 | 82.5 | globlastp |
| 3879 | LAB269 | cotton\|gb164\|DR461180 | 7324 | 617 | 82.5 | globlastp |
| 3880 | LAB269 | kiwi\|gb166\|FG404103 | 7325 | 617 | 82.5 | globlastp |
| 3881 | LAB269 | kiwi\|gb166\|FG410690 | 7326 | 617 | 82.5 | globlastp |
| 3882 | LAB269 | medicago\|09v1\|BE239402 | 7327 | 617 | 82.5 | globlastp |
| 3883 | LAB269 | medicago\|gb157.2\|BE239402 | 7327 | 617 | 82.5 | globlastp |
| 3884 | LAB269 | sunflower\|gb162\|CD850054 | 7328 | 617 | 82.5 | globlastp |
| 3885 | LAB269 | tea\|10v1\|FE861646 | 7329 | 617 | 82.5 | globlastp |
| 3886 | LAB269 | tea\|gb171\|FE861646 | 7329 | 617 | 82.5 | globlastp |
| 3887 | LAB269 | artemisia\|10v1\|GW329229 | 7330 | 617 | 82.4 | globlastp |
| 3888 | LAB269 | jatropha\|09v1\|GT228525 | 7331 | 617 | 82.4 | globlastp |
| 3889 | LAB269 | orobanche\|10v1\|SRR023189S0007626 | 7332 | 617 | 82.4 | globlastp |
| 3890 | LAB269 | grape\|gb160\|CF209226 | 7333 | 617 | 82.4 | globlastp |
| 3891 | LAB269 | antirrhinum\|gb166\|AJ568652 | 7334 | 617 | 82.4 | globlastp |
| 3892 | LAB269 | barley\|gb157SOLEXA\|BQ470520 | 7335 | 617 | 82.4 | globlastp |
| 3893 | LAB269 | bruguiera\|gb166\|BP941111 | 7336 | 617 | 82.4 | globlastp |
| 3894 | LAB269 | cassava\|09v1\|FF534531 | 7337 | 617 | 82.4 | globlastp |
| 3895 | LAB269 | clover\|gb162\|BB902942 | 7338 | 617 | 82.4 | globlastp |
| 3896 | LAB269 | papaya\|gb165\|EX255877 | 7339 | 617 | 82.4 | globlastp |
| 3897 | LAB269 | peanut\|gb171\|CD038080 | 7340 | 617 | 82.4 | globlastp |
| 3898 | LAB269 | peanut\|gb171\|CX018047 | 7341 | 617 | 82.4 | globlastp |
| 3899 | LAB269 | peanut\|gb171\|EE124672 | 7342 | 617 | 82.4 | globlastp |
| 3900 | LAB269 | poplar\|10v1\|AI162505 | 7343 | 617 | 82.4 | globlastp |
| 3901 | LAB269 | poplar\|gb170\|AI162505 | 7343 | 617 | 82.4 | globlastp |
| 3902 | LAB269 | tea\|10v1\|CV014555 | 7344 | 617 | 82.4 | globlastp |
| 3903 | LAB269 | tea\|gb171\|CV014555 | 7344 | 617 | 82.4 | globlastp |
| 3904 | LAB269 | tragopogon\|10v1\|SRR020205S0003365 | 7345 | 617 | 82.39 | glotblastn |
| 3905 | LAB269 | cacao\|gb167\|EH057782 | 7346 | 617 | 82.39 | glotblastn |
| 3906 | LAB269 | canola\|10v1\|EG020378 | 7347 | 617 | 82.39 | glotblastn |
| 3907 | LAB269 | canola\|gb161\|EG020378 | 7348 | 617 | 82.39 | glotblastn |
| 3908 | LAB269 | rye\|gb164\|BE704593 | 7349 | 617 | 82.39 | glotblastn |
| 3909 | LAB269 | artemisia\|10v1\|SRR019254S0011939 | — | 617 | 82.39 | glotblastn |
| 3910 | LAB269 | cichorium\|gb171\|EH698455 | — | 617 | 82.39 | glotblastn |
| 3911 | LAB269 | cucumber\|09v1\|CK085829 | 7350 | 617 | 82.1 | globlastp |
| 3912 | LAB269 | barley\|10v1\|BF621287 | 7351 | 617 | 82.1 | globlastp |
| 3913 | LAB269 | barley\|gb157SOLEXA\|AL508027 | 7351 | 617 | 82.1 | globlastp |
| 3914 | LAB269 | melon\|gb165\|DV633078 | 7350 | 617 | 82.1 | globlastp |
| 3915 | LAB269 | sugarcane\|gb157.3\|CA246050 | 7352 | 617 | 82.1 | glotblastn |
| 3916 | LAB269 | wheat\|gb164\|BE415790 | 7353 | 617 | 82.1 | globlastp |
| 3917 | LAB269 | lettuce\|10v1\|DW074552 | 7354 | 617 | 82 | globlastp |
| 3918 | LAB269 | brachypodium\|09v1\|SRR031795S0043037 | 7355 | 617 | 82 | globlastp |
| 3919 | LAB269 | lettuce\|gb157.2\|DW074552 | 7354 | 617 | 82 | globlastp |
| 3920 | LAB269 | onion\|gb162\|CF445361 | 7356 | 617 | 82 | globlastp |
| 3921 | LAB269 | sunflower\|gb162\|CF077703 | 7357 | 617 | 82 | globlastp |
| 3922 | LAB269 | sugarcane\|10v1\|BQ529676 | 7358 | 617 | 81.99 | glotblastn |
| 3923 | LAB269 | sugarcane\|gb157.3\|BQ529676 | 7358 | 617 | 81.99 | glotblastn |
| 3924 | LAB269 | eggplant\|10v1\|AB018242 | 7359 | 617 | 81.9 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3925 | LAB269 | cynara\|gb167\|GE588059 | 7360 | 617 | 81.9 | globlastp |
| 3926 | LAB269 | dandelion\|gb161\|DY816120 | 7361 | 617 | 81.9 | globlastp |
| 3927 | LAB269 | ginger\|gb164\|DY366805 | 7362 | 617 | 81.9 | globlastp |
| 3928 | LAB269 | maize\|gb170\|LLDV025110 | 7363 | 617 | 81.9 | globlastp |
| 3929 | LAB269 | sunflower\|gb162\|CD848740 | 7361 | 617 | 81.9 | globlastp |
| 3930 | LAB269 | sunflower\|gb162\|CD850823 | 7361 | 617 | 81.9 | globlastp |
| 3931 | LAB269 | sunflower\|gb162\|EL460335 | 7361 | 617 | 81.9 | globlastp |
| 3932 | LAB269 | lettuce\|10v1\|DW076202 | 7364 | 617 | 81.88 | glotblastn |
| 3933 | LAB269 | nasturtium\|10v1\|SRR032558S0003969 | 7365 | 617 | 81.8 | globlastp |
| 3934 | LAB269 | grape\|gb160\|CB340156 | 7366 | 617 | 81.8 | globlastp |
| 3935 | LAB269 | barley\|10v1\|BQ470520 | 7367 | 617 | 81.8 | globlastp |
| 3936 | LAB269 | medicago\|09v1\|AL384067 | 7368 | 617 | 81.8 | globlastp |
| 3937 | LAB269 | medicago\|gb157.2\|AL384067 | 7368 | 617 | 81.8 | globlastp |
| 3938 | LAB269 | nuphar\|gb166\|CD473263 | 7369 | 617 | 81.8 | globlastp |
| 3939 | LAB269 | nuphar\|gb166\|CD474301 | 7370 | 617 | 81.8 | globlastp |
| 3940 | LAB269 | nuphar\|gb166\|CD475325 | 7371 | 617 | 81.8 | globlastp |
| 3941 | LAB269 | oil_palm\|gb166\|CN600853 | 7372 | 617 | 81.8 | globlastp |
| 3942 | LAB269 | oil_palm\|gb166\|EL682266 | 7373 | 617 | 81.8 | globlastp |
| 3943 | LAB269 | pseudoroegneria\|gb167\|FF342758 | 7374 | 617 | 81.8 | globlastp |
| 3944 | LAB269 | sesame\|10v1\|BU667747 | 7375 | 617 | 81.8 | globlastp |
| 3945 | LAB269 | sesame\|gb157.2\|BU667747 | 7375 | 617 | 81.8 | globlastp |
| 3946 | LAB269 | tamarix\|gb166\|CF199999 | 7376 | 617 | 81.8 | globlastp |
| 3947 | LAB269 | walnuts\|gb166\|EL893578 | 7377 | 617 | 81.8 | globlastp |
| 3948 | LAB269 | wheat\|gb164\|BF475107 | 7378 | 617 | 81.8 | globlastp |
| 3949 | LAB269 | wheat\|gb164\|BM137700 | 7379 | 617 | 81.8 | globlastp |
| 3950 | LAB269 | pea\|09v1\|PEAH2A | 7380 | 617 | 81.76 | glotblastn |
| 3951 | LAB269 | bean\|gb167\|CA898623 | 7381 | 617 | 81.76 | glotblastn |
| 3952 | LAB269 | lettuce\|gb157.2\|DW046318 | 7382 | 617 | 81.76 | glotblastn |
| 3953 | LAB269 | lettuce\|gb157.2\|DW104400 | 7383 | 617 | 81.76 | glotblastn |
| 3954 | LAB269 | lettuce\|gb157.2\|DW105504 | 7382 | 617 | 81.76 | glotblastn |
| 3955 | LAB269 | lettuce\|gb157.2\|DW148380 | 7383 | 617 | 81.76 | glotblastn |
| 3956 | LAB269 | lettuce\|gb157.2\|DW153827 | 7384 | 617 | 81.76 | glotblastn |
| 3957 | LAB269 | maize\|gb170\|LLBE345313 | 7385 | 617 | 81.76 | glotblastn |
| 3958 | LAB269 | senecio\|gb170\|DY658597 | 7386 | 617 | 81.76 | glotblastn |
| 3959 | LAB269 | lettuce\|10v1\|DW104400 | 7383 | 617 | 81.76 | glotblastn |
| 3960 | LAB269 | brachypodium\|09v1\|SRR031797S0022709 | 7387 | 617 | 81.7 | globlastp |
| 3961 | LAB269 | cotton\|gb164\|BE055408 | 7388 | 617 | 81.6 | globlastp |
| 3962 | LAB269 | lettuce\|gb157.2\|DW123638 | 7389 | 617 | 81.6 | globlastp |
| 3963 | LAB269 | avocado\|10v1\|CK753619 | 7390 | 617 | 81.5 | globlastp |
| 3964 | LAB269 | avocado\|gb164\|CK753619 | 7390 | 617 | 81.5 | globlastp |
| 3965 | LAB269 | barley\|10v1\|AJ473557 | 7391 | 617 | 81.5 | globlastp |
| 3966 | LAB269 | barley\|gb157SOLEXA\|AJ473557 | 7391 | 617 | 81.5 | globlastp |
| 3967 | LAB269 | cichorium\|gb171\|EH682187 | 7392 | 617 | 81.5 | globlastp |
| 3968 | LAB269 | sugarcane\|10v1\|CA071927 | 7314 | 617 | 81.48 | glotblastn |
| 3969 | LAB269 | dandelion\|gb161\|DY834183 | 7393 | 617 | 81.4 | globlastp |
| 3970 | LAB269 | maize\|gb170\|LLFK947559 | 7394 | 617 | 81.25 | glotblastn |
| 3971 | LAB269 | ginseng\|10v1\|DV555645 | 7395 | 617 | 81.2 | globlastp |
| 3972 | LAB269 | orobanche\|10v1\|SRR023189S0008983 | 7396 | 617 | 81.2 | globlastp |
| 3973 | LAB269 | tragopogon\|10v1\|SRR020205S0018059 | 7397 | 617 | 81.2 | globlastp |
| 3974 | LAB269 | catharanthus\|gb166\|EG558535 | 7398 | 617 | 81.2 | globlastp |
| 3975 | LAB269 | catharanthus\|gb166\|EG562453 | 7399 | 617 | 81.2 | globlastp |
| 3976 | LAB269 | catharanthus\|gb166\|FD416131 | 7400 | 617 | 81.2 | globlastp |
| 3977 | LAB269 | centaurea\|gb166\|EH753053 | 7401 | 617 | 81.2 | globlastp |
| 3978 | LAB269 | ginger\|gb164\|DY377650 | 7402 | 617 | 81.2 | globlastp |
| 3979 | LAB269 | kiwi\|gb166\|FG428941 | 7403 | 617 | 81.2 | globlastp |
| 3980 | LAB269 | safflower\|gb162\|EL377394 | 7404 | 617 | 81.2 | globlastp |
| 3981 | LAB269 | sunflower\|gb162\|CD849669 | 7405 | 617 | 81.2 | globlastp |
| 3982 | LAB269 | artemisia\|10v1\|SRR019254S0001113 | 7406 | 617 | 81.13 | glotblastn |
| 3983 | LAB269 | jatropha\|09v1\|GT229311 | 7407 | 617 | 81.13 | glotblastn |
| 3984 | LAB269 | nasturtium\|10v1\|SRR032558S0000657 | 7408 | 617 | 81.13 | glotblastn |
| 3985 | LAB269 | nasturtium\|10v1\|SRR032558S0008269 | 7409 | 617 | 81.13 | glotblastn |
| 3986 | LAB269 | orobanche\|10v1\|SRR023189S0017978 | 7410 | 617 | 81.13 | glotblastn |
| 3987 | LAB269 | pea\|09v1\|EX568943 | 7411 | 617 | 81.13 | glotblastn |
| 3988 | LAB269 | dandelion\|gb161\|DY840384 | 7412 | 617 | 81.13 | glotblastn |
| 3989 | LAB269 | lettuce\|10v1\|DW048053 | 7413 | 617 | 81.13 | glotblastn |
| 3990 | LAB269 | lettuce\|gb157.2\|DW048053 | 7413 | 617 | 81.13 | glotblastn |
| 3991 | LAB269 | lettuce\|gb157.2\|DW106082 | 7414 | 617 | 81.13 | glotblastn |
| 3992 | LAB269 | lettuce\|gb157.2\|DW146506 | 7414 | 617 | 81.13 | glotblastn |
| 3993 | LAB269 | nicotiana_benthamiana\|gb162\|CN655396 | 7415 | 617 | 81.13 | glotblastn |
| 3994 | LAB269 | rye\|gb164\|BE586810 | 7416 | 617 | 81.13 | glotblastn |
| 3995 | LAB269 | spurge\|gb161\|DV157416 | 7417 | 617 | 81.13 | glotblastn |
| 3996 | LAB269 | sunflower\|gb162\|CD848219 | 7418 | 617 | 81.13 | glotblastn |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 3997 | LAB269 | barley|10v1|BE55608 | 7419 | 617 | 81.1 | globlastp |
| 3998 | LAB269 | chickpea|09v2|GR401929 | 7420 | 617 | 81.1 | globlastp |
| 3999 | LAB269 | cucumber|09v1|CK085962 | 7421 | 617 | 81.1 | globlastp |
| 4000 | LAB269 | medicago|09v1|AL377356 | 7422 | 617 | 81.1 | globlastp |
| 4001 | LAB269 | medicago|09v1|BF519200 | 7423 | 617 | 81.1 | globlastp |
| 4002 | LAB269 | orobanche|10v1|SRR023189S0010876 | 7424 | 617 | 81.1 | globlastp |
| 4003 | LAB269 | orobanche|10v1|SRR023189S0028654 | 7425 | 617 | 81.1 | globlastp |
| 4004 | LAB269 | pea|09v1|EX569036 | 7426 | 617 | 81.1 | globlastp |
| 4005 | LAB269 | barley|gb157SOLEXA|AL506299 | 7419 | 617 | 81.1 | globlastp |
| 4006 | LAB269 | basilicum|10v1|DY323812 | 7427 | 617 | 81.1 | globlastp |
| 4007 | LAB269 | basilicum|gb157.3|DY323812 | 7427 | 617 | 81.1 | globlastp |
| 4008 | LAB269 | bean|gb167|CA898617 | 7428 | 617 | 81.1 | globlastp |
| 4009 | LAB269 | cacao|gb167|EH057760 | 7429 | 617 | 81.1 | globlastp |
| 4010 | LAB269 | cassava|gb164|DB935361 | 7430 | 617 | 81.1 | globlastp |
| 4011 | LAB269 | cichorium|gb171|DT212229 | 7431 | 617 | 81.1 | globlastp |
| 4012 | LAB269 | clover|gb162|BB937077 | 7432 | 617 | 81.1 | globlastp |
| 4013 | LAB269 | kiwi|gb166|FG403789 | 7433 | 617 | 81.1 | globlastp |
| 4014 | LAB269 | medicago|gb157.2|AW574007 | 7434 | 617 | 81.1 | globlastp |
| 4015 | LAB269 | oak|gb170|CR627534 | 7435 | 617 | 81.1 | globlastp |
| 4016 | LAB269 | peanut|gb171|CX128201 | 7436 | 617 | 81.1 | globlastp |
| 4017 | LAB269 | tobacco|gb162|BQ843038 | 7437 | 617 | 81.1 | globlastp |
| 4018 | LAB269 | triphysaria|10v1|BM356994 | 7438 | 617 | 81.1 | globlastp |
| 4019 | LAB269 | triphysaria|10v1|DR173737 | 7439 | 617 | 81.1 | globlastp |
| 4020 | LAB269 | triphysaria|gb164|EY137032 | 7439 | 617 | 81.1 | globlastp |
| 4021 | LAB269 | wheat|gb164|BE498725 | 7440 | 617 | 81.1 | globlastp |
| 4022 | LAB269 | wheat|gb164|CK202244 | 7441 | 617 | 81.1 | globlastp |
| 4023 | LAB269 | heritiera|10v1|SRR005795S0031964 | 7442 | 617 | 81 | globlastp |
| 4024 | LAB269 | barley|gb157SOLEXA|AL511284 | 7443 | 617 | 81 | globlastp |
| 4025 | LAB269 | lettuce|gb157.2|DW046029 | 7444 | 617 | 81 | globlastp |
| 4026 | LAB269 | barley|10v1|AW983233 | 7443 | 617 | 81 | globlastp |
| 4027 | LAB269 | barley|gb157.3SOLEXA|AL506114 | 7445 | 617 | 80.98 | glotblastn |
| 4028 | LAB269 | sugarcane|gb157.3|CA200286 | 7446 | 617 | 80.98 | glotblastn |
| 4029 | LAB269 | cleome_gynandra|10v1|SRR015532S0022202 | 7447 | 617 | 80.75 | glotblastn |
| 4030 | LAB269 | artemisia|10v1|EY082330 | 7448 | 617 | 80.7 | globlastp |
| 4031 | LAB269 | artemisia|10v1|EY084850 | 7448 | 617 | 80.7 | globlastp |
| 4032 | LAB269 | artemisia|10v1|SRR019254S0007700 | 7448 | 617 | 80.7 | globlastp |
| 4033 | LAB269 | artemisia|10v1|SRR019254S0012643 | 7448 | 617 | 80.7 | globlastp |
| 4034 | LAB269 | ipomoea_nil|10v1|BJ554819 | 7449 | 617 | 80.7 | globlastp |
| 4035 | LAB269 | artemisia|10v1|EY039776 | 7448 | 617 | 80.7 | globlastp |
| 4036 | LAB269 | artemisia|gb164|EY082330 | 7448 | 617 | 80.7 | globlastp |
| 4037 | LAB269 | artemisia|gb164|EY084850 | 7448 | 617 | 80.7 | globlastp |
| 4038 | LAB269 | ipomoea|gb157.2|BJ554819 | 7449 | 617 | 80.7 | globlastp |
| 4039 | LAB269 | sunflower|gb162|CD855395 | 7450 | 617 | 80.7 | globlastp |
| 4040 | LAB269 | orobanche|10v1|SRR023189S0001029 | 7451 | 617 | 80.62 | glotblastn |
| 4041 | LAB269 | lettuce|gb157.2|DW076202 | 7452 | 617 | 80.62 | glotblastn |
| 4042 | LAB269 | sorghum|09v1|SB09G022690 | 7453 | 617 | 80.61 | glotblastn |
| 4043 | LAB269 | sorghum|gb161.crp|AW681166 | 7453 | 617 | 80.61 | glotblastn |
| 4044 | LAB269 | cleome_spinosa|10v1|GR932674 | 7454 | 617 | 80.6 | globlastp |
| 4045 | LAB269 | eggplant|10v1|FS000322 | 7455 | 617 | 80.6 | globlastp |
| 4046 | LAB269 | ginseng|10v1|DV553422 | 7456 | 617 | 80.6 | globlastp |
| 4047 | LAB269 | apple|gb171|CN494745 | 7457 | 617 | 80.6 | globlastp |
| 4048 | LAB269 | apple|gb171|CN880302 | 7458 | 617 | 80.6 | globlastp |
| 4049 | LAB269 | centaurea|gb166|EL930888 | 7459 | 617 | 80.6 | globlastp |
| 4050 | LAB269 | centaurea|gb166|EL934894 | 7460 | 617 | 80.6 | globlastp |
| 4051 | LAB269 | rose|10v1|BI978192 | 7461 | 617 | 80.6 | globlastp |
| 4052 | LAB269 | rose|gb157.2|BI978192 | 7461 | 617 | 80.6 | globlastp |
| 4053 | LAB269 | strawberry|gb164|EX664843 | 7462 | 617 | 80.6 | globlastp |
| 4054 | LAB269 | sugarcane|gb157.3|CA112320 | 7463 | 617 | 80.6 | globlastp |
| 4055 | LAB269 | sugarcane|gb157.3|CA193165 | 7464 | 617 | 80.6 | globlastp |
| 4056 | LAB269 | tobacco|gb162|BP192536 | 7465 | 617 | 80.6 | globlastp |
| 4057 | LAB269 | artemisia|10v1|SRR019254S0007762 | 7466 | 617 | 80.5 | glotblastn |
| 4058 | LAB269 | medicago|09v1|AL376385 | 7467 | 617 | 80.5 | globlastp |
| 4059 | LAB269 | monkeyflower|10v1|DV206744 | 7468 | 617 | 80.5 | globlastp |
| 4060 | LAB269 | oat|10v1|GO586644 | 7469 | 617 | 80.5 | glotblastn |
| 4061 | LAB269 | orobanche|10v1|SRR023189S0000458 | 7470 | 617 | 80.5 | glotblastn |
| 4062 | LAB269 | orobanche|10v1|SRR023189S0014080 | 7471 | 617 | 80.5 | globlastp |
| 4063 | LAB269 | pea|09v1|EX571168 | 7472 | 617 | 80.5 | globlastp |
| 4064 | LAB269 | pea|09v1|EX571270 | 7473 | 617 | 80.5 | globlastp |
| 4065 | LAB269 | triphysaria|10v1|DR176290 | 7474 | 617 | 80.5 | globlastp |
| 4066 | LAB269 | antirrhinum|gb166|AJ558758 | 7475 | 617 | 80.5 | glotblastn |
| 4067 | LAB269 | antirrhinum|gb166|AJ568035 | 7476 | 617 | 80.5 | glotblastn |
| 4068 | LAB269 | barley|gb157SOLEXA|BF625527 | 7477 | 617 | 80.5 | glotblastn |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4069 | LAB269 | chestnut\|gb170\|SRR006295S0011437 | 7478 | 617 | 80.5 | globlastp |
| 4070 | LAB269 | fescue\|gb161\|DT678950 | 7479 | 617 | 80.5 | glotblastn |
| 4071 | LAB269 | fescue\|gb161\|DT685753 | 7480 | 617 | 80.5 | glotblastn |
| 4072 | LAB269 | kiwi\|gb166\|FG403861 | 7481 | 617 | 80.5 | globlastp |
| 4073 | LAB269 | lettuce\|gb157.2\|DW050465 | 7482 | 617 | 80.5 | glotblastn |
| 4074 | LAB269 | lettuce\|10v1\|DW074637 | 7483 | 617 | 80.5 | globlastp |
| 4075 | LAB269 | lettuce\|gb157.2\|DW074637 | 7484 | 617 | 80.5 | glotblastn |
| 4076 | LAB269 | lettuce\|gb157.2\|DW148769 | 7485 | 617 | 80.5 | glotblastn |
| 4077 | LAB269 | liriodendron\|gb166\|CK748317 | 7486 | 617 | 80.5 | globlastp |
| 4078 | LAB269 | maize\|gb170\|LLDQ245995 | 7487 | 617 | 80.5 | glotblastn |
| 4079 | LAB269 | medicago\|gb157.2\|AL376384 | 7488 | 617 | 80.5 | globlastp |
| 4080 | LAB269 | nicotiana_benthamiana\|gb162\|CN741779 | 7489 | 617 | 80.5 | globlastp |
| 4081 | LAB269 | petunia\|gb171\|CV300217 | 7490 | 617 | 80.5 | globlastp |
| 4082 | LAB269 | poppy\|gb166\|FE967078 | 7491 | 617 | 80.5 | glotblastn |
| 4083 | LAB269 | senecio\|gb170\|DY658035 | 7492 | 617 | 80.5 | globlastp |
| 4084 | LAB269 | sugarcane\|gb157.3\|CA124689 | 7493 | 617 | 80.5 | globlastp |
| 4085 | LAB269 | sugarcane\|gb157.3\|CA214343 | 7494 | 617 | 80.5 | glotblastn |
| 4086 | LAB269 | sunflower\|gb162\|CD852070 | 7495 | 617 | 80.5 | globlastp |
| 4087 | LAB269 | tobacco\|gb162\|DV158750 | 7496 | 617 | 80.5 | glotblastn |
| 4088 | LAB269 | triphysaria\|gb164\|BM356994 | 7497 | 617 | 80.5 | globlastp |
| 4089 | LAB269 | triphysaria\|gb164\|EY129294 | 7498 | 617 | 80.5 | globlastp |
| 4090 | LAB269 | triphysaria\|gb164\|EY136702 | 7499 | 617 | 80.5 | glotblastn |
| 4091 | LAB269 | barley\|gb157SOLEXA\|AL501872 | 7500 | 617 | 80.4 | globlastp |
| 4092 | LAB269 | lettuce\|gb157.2\|DW080680 | 7501 | 617 | 80.4 | globlastp |
| 4093 | LAB269 | maize\|gb170\|AI939777 | 7502 | 617 | 80.25 | glotblastn |
| 4094 | LAB269 | triphysaria\|gb164\|BE574777 | 7503 | 617 | 80.25 | glotblastn |
| 4095 | LAB269 | triphysaria\|gb164\|EX999662 | 7504 | 617 | 80.25 | glotblastn |
| 4096 | LAB269 | artemisia\|10v1\|EY082130 | 7505 | 617 | 80.1 | globlastp |
| 4097 | LAB269 | artemisia\|10v1\|GW328287 | 7506 | 617 | 80.1 | globlastp |
| 4098 | LAB269 | artemisia\|10v1\|GW328462 | 7507 | 617 | 80.1 | globlastp |
| 4099 | LAB269 | artemisia\|10v1\|SRR019254S0000360 | 7508 | 617 | 80.1 | globlastp |
| 4100 | LAB269 | artemisia\|10v1\|SRR019254S0003074 | 7508 | 617 | 80.1 | globlastp |
| 4101 | LAB269 | artemisia\|10v1\|SRR019254S0042995 | 7508 | 617 | 80.1 | globlastp |
| 4102 | LAB269 | artemisia\|10v1\|SRR019254S0094458 | 7506 | 617 | 80.1 | globlastp |
| 4103 | LAB269 | artemisia\|10v1\|SRR019254S0000494 | 7508 | 617 | 80.1 | globlastp |
| 4104 | LAB269 | artemisia\|gb164\|EY082130 | 7505 | 617 | 80.1 | globlastp |
| 4105 | LAB269 | rice\|gb170\|OS05G38640 | 7509 | 617 | 80.1 | globlastp |
| 4106 | LAB269 | gerbera\|09v1\|AJ754996 | 7510 | 617 | 80 | globlastp |
| 4107 | LAB269 | tea\|10v1\|CV013767 | 7511 | 617 | 80 | globlastp |
| 4108 | LAB269 | cynara\|gb167\|GE592728 | 7512 | 617 | 80 | globlastp |
| 4109 | LAB269 | radish\|gb164\|EW726668 | 7513 | 617 | 80 | glotblastn |
| 4110 | LAB269 | safflower\|gb162\|EL403937 | 7514 | 617 | 80 | globlastp |
| 4111 | LAB269 | sunflower\|gb162\|CD851052 | 7515 | 617 | 80 | globlastp |
| 4112 | LAB269 | tea\|gb171\|CV013640 | 7511 | 617 | 80 | globlastp |
| 4113 | LAB269 | tobacco\|gb162\|BP192693 | 7516 | 617 | 80 | globlastp |
| 4114 | LAB269 | tobacco\|gb162\|CV018747 | 7517 | 617 | 80 | globlastp |
| 4115 | LAB270 | maize\|gb170\|AI615043 | 7518 | 618 | 98.1 | globlastp |
| 4116 | LAB270 | maize\|gb170\|AI586603 | 7519 | 618 | 97.2 | globlastp |
| 4117 | LAB270 | rice\|gb170\|OS02G55410 | 7520 | 618 | 96.8 | globlastp |
| 4118 | LAB270 | brachypodium\|09v1\|GT797969 | 7521 | 618 | 93.5 | globlastp |
| 4119 | LAB270 | wheat\|gb164\|BE400172 | 7522 | 618 | 93.3 | globlastp |
| 4120 | LAB270 | brachypodium\|gb169\|BE400172 | 7523 | 618 | 93.1 | globlastp |
| 4121 | LAB270 | barley\|10v1\|AV914416 | 7524 | 618 | 92.9 | globlastp |
| 4122 | LAB270 | barley\|gb157SOLEXA\|AL507066 | 7525 | 618 | 83.7 | globlastp |
| 4123 | LAB271 | switchgrass\|gb167\|FE611169 | 7526 | 619 | 92.15 | glotblastn |
| 4124 | LAB271 | switchgrass\|gb167\|FE600805 | 7527 | 619 | 91.1 | globlastp |
| 4125 | LAB271 | pseudoroegneria\|gb167\|FF345930 | 7528 | 619 | 80.7 | globlastp |
| 4126 | LAB271 | leymus\|gb166\|EG378703 | 7529 | 619 | 80.6 | globlastp |
| 4127 | LAB272 | maize\|gb170\|AW067349 | 7530 | 620 | 94.9 | globlastp |
| 4128 | LAB272 | rice\|gb170\|OS05G39310 | 7531 | 620 | 92.6 | globlastp |
| 4129 | LAB272 | medicago\|09v1\|AW256724 | 7532 | 620 | 81 | globlastp |
| 4130 | LAB272 | medicago\|gb157.2\|AW256724 | 7532 | 620 | 81 | globlastp |
| 4131 | LAB272 | monkeyflower\|10v1\|CV517019 | 7533 | 620 | 80.6 | globlastp |
| 4132 | LAB272 | soybean\|gb168\|AW126006 | 7534 | 620 | 80.4 | globlastp |
| 4133 | LAB272 | cassava\|09v1\|CK643325 | 7535 | 620 | 80.3 | globlastp |
| 4134 | LAB272 | apple\|gb171\|CK900562 | 7536 | 620 | 80.3 | globlastp |
| 4135 | LAB272 | kiwi\|gb166\|FG403505 | 7537 | 620 | 80.1 | globlastp |
| 4136 | LAB272 | soybean\|gb168\|AW256724 | 7538 | 620 | 80.1 | globlastp |
| 4137 | LAB272 | tobacco\|gb162\|DW002823 | 7539 | 620 | 80.1 | globlastp |
| 4138 | LAB272 | nasturtium\|10v1\|SRR032558S0007563 | 7540 | 620 | 80 | globlastp |
| 4139 | LAB274 | sugarcane\|gb157.3\|CA066127 | 7541 | 621 | 94.7 | globlastp |
| 4140 | LAB274 | switchgrass\|gb167\|FE605626 | 7542 | 621 | 84.7 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4141 | LAB274 | brachypodium\|09v1\|DV477522 | 7543 | 621 | 82.91 | glotblastn |
| 4142 | LAB274 | maize\|gb170\|CF013850 | 7544 | 621 | 82.6 | globlastp |
| 4143 | LAB274 | leymus\|gb166\|EG388830 | 7545 | 621 | 82.2 | globlastp |
| 4144 | LAB274 | pseudoroegneria\|gb167\|FF340314 | 7546 | 621 | 81.2 | globlastp |
| 4145 | LAB274 | wheat\|gb164\|BE429931 | 7547 | 621 | 80.1 | globlastp |
| 4146 | LAB275 | sugarcane\|10v1\|BQ535805 | 7548 | 622 | 95.7 | globlastp |
| 4147 | LAB275 | sugarcane\|gb157.3\|BQ535805 | 7549 | 622 | 95.3 | globlastp |
| 4148 | LAB275 | maize\|gb170\|AI586596 | 7550 | 622 | 93.1 | globlastp |
| 4149 | LAB275 | maize\|gb170\|AW129871 | 7551 | 622 | 90.9 | globlastp |
| 4150 | LAB275 | switchgrass\|gb167\|FE607687 | 7552 | 622 | 89.9 | globlastp |
| 4151 | LAB276 | sorghum\|09v1\|SB02G003590 | 7553 | 623 | 81.03 | glotblastn |
| 4152 | LAB276 | sorghum\|gb161.crp1\|BE366228 | 7553 | 623 | 81.03 | glotblastn |
| 4153 | LAB277 | sugarcane\|10v1\|CA074813 | 7554 | 624 | 80.51 | globlastp |
| 4154 | LAB278 | maize\|gb170\|AW054293 | 7555 | 625 | 91.3 | globlastp |
| 4155 | LAB278 | switchgrass\|gb167\|FE626292 | 7556 | 625 | 84.75 | glotblastn |
| 4156 | LAB278 | rice\|gb170\|OS10G32810 | 7557 | 625 | 82.3 | globlastp |
| 4157 | LAB279 | sugarcane\|10v1\|CA120192 | 7558 | 626 | 93.2 | globlastp |
| 4158 | LAB279 | sugarcane\|gb157.3\|CA120192 | 7559 | 626 | 92.6 | globlastp |
| 4159 | LAB279 | maize\|gb170\|AW355902 | 7560 | 626 | 84.57 | glotblastn |
| 4160 | LAB279 | maize\|gb170\|LLCO441794 | 7561 | 626 | 82.32 | glotblastn |
| 4161 | LAB279 | switchgrass\|gb167\|FE649969 | 7562 | 626 | 82.3 | globlastp |
| 4162 | LAB280 | maize\|gb170\|AW066651 | 7563 | 627 | 81.7 | globlastp |
| 4163 | LAB280 | maize\|gb170\|AW289072 | 7564 | 627 | 81.5 | globlastp |
| 4164 | LAB280 | switchgrass\|gb167\|FE607054 | 7565 | 627 | 80.8 | globlastp |
| 4165 | LAB281 | sugarcane\|gb157.3\|BQ535213 | 7566 | 628 | 98.1 | globlastp |
| 4166 | LAB281 | switchgrass\|gb167\|N141686 | 7567 | 628 | 93.4 | globlastp |
| 4167 | LAB281 | switchgrass\|gb167\|N141006 | 7568 | 628 | 92.2 | globlastp |
| 4168 | LAB281 | maize\|gb170\|AW499357 | 7569 | 628 | 91.8 | globlastp |
| 4169 | LAB281 | rice\|gb170\|OS03G60080 | 7570 | 628 | 83.9 | globlastp |
| 4170 | LAB281 | maize\|gb170\|AI668448 | 7571 | 628 | 81.3 | globlastp |
| 4171 | LAB283 | sugarcane\|gb157.3\|CA075098 | 7572 | 630 | 99.5 | globlastp |
| 4172 | LAB283 | sugarcane\|10v1\|BQ533910 | 7572 | 630 | 99.5 | globlastp |
| 4173 | LAB283 | sugarcane\|gb157.3\|BQ533910 | 7573 | 630 | 98.4 | globlastp |
| 4174 | LAB283 | switchgrass\|gb167\|FE653888 | 7574 | 630 | 98.4 | globlastp |
| 4175 | LAB283 | switchgrass\|gb167\|FL789395 | 7575 | 630 | 98.4 | globlastp |
| 4176 | LAB283 | rice\|gb170\|OS03G22180 | 7576 | 630 | 96.3 | globlastp |
| 4177 | LAB283 | brachypodium\|09v1\|DV476934 | 7577 | 630 | 95.7 | globlastp |
| 4178 | LAB283 | brachypodium\|gb169\|BE424014 | 7577 | 630 | 95.7 | globlastp |
| 4179 | LAB283 | sorghum\|09v1\|SB02G042750 | 7578 | 630 | 95.7 | globlastp |
| 4180 | LAB283 | sorghum\|gb161.crp\|BI096623 | 7578 | 630 | 95.7 | globlastp |
| 4181 | LAB283 | maize\|gb170\|AI396532 | 7579 | 630 | 95.2 | globlastp |
| 4182 | LAB283 | sugarcane\|gb157.3\|CA084838 | 7580 | 630 | 95.2 | globlastp |
| 4183 | LAB283 | brachypodium\|09v1\|GT790399 | 7581 | 630 | 94.7 | globlastp |
| 4184 | LAB283 | maize\|gb170\|LLEB160472 | 7582 | 630 | 94.7 | globlastp |
| 4185 | LAB283 | sorghum\|gb161.crp\|AI491551 | 7583 | 630 | 94.7 | globlastp |
| 4186 | LAB283 | switchgrass\|gb167\|FL770723 | 7584 | 630 | 94.7 | globlastp |
| 4187 | LAB283 | wheat\|gb164\|CA594043 | 7585 | 630 | 94.7 | globlastp |
| 4188 | LAB283 | maize\|gb170\|AA030700 | 7586 | 630 | 94.1 | globlastp |
| 4189 | LAB283 | maize\|gb170\|AI629674 | 7586 | 630 | 94.1 | globlastp |
| 4190 | LAB283 | pseudoroegneria\|gb167\|FF340152 | 7587 | 630 | 94.1 | globlastp |
| 4191 | LAB283 | sorghum\|09v1\|SB09G004290 | 7588 | 630 | 94.1 | globlastp |
| 4192 | LAB283 | sugarcane\|gb157.3\|BQ530487 | 7588 | 630 | 94.1 | globlastp |
| 4193 | LAB283 | wheat\|gb164\|BE424014 | 7589 | 630 | 94.1 | globlastp |
| 4194 | LAB283 | sugarcane\|10v1\|BQ530487 | 7588 | 630 | 94.1 | globlastp |
| 4195 | LAB283 | rye\|gb164\|BE494252 | 7590 | 630 | 93.6 | globlastp |
| 4196 | LAB283 | wheat\|gb164\|BE422875 | 7591 | 630 | 93.6 | globlastp |
| 4197 | LAB283 | rice\|gb170\|OS05G06310 | 7592 | 630 | 93.1 | globlastp |
| 4198 | LAB283 | sugarcane\|gb157.3\|CA080289 | 7593 | 630 | 93.1 | globlastp |
| 4199 | LAB283 | sugarcane\|gb157.3\|CA094181 | 7594 | 630 | 93.1 | globlastp |
| 4200 | LAB283 | wheat\|gb164\|BG606257 | 7595 | 630 | 93.05 | glotblastn |
| 4201 | LAB283 | oat\|10v1\|CN817059 | 7596 | 630 | 93 | globlastp |
| 4202 | LAB283 | wheat\|gb164\|BE398853 | 7597 | 630 | 93 | globlastp |
| 4203 | LAB283 | wheat\|gb164\|BE443573 | 7597 | 630 | 93 | globlastp |
| 4204 | LAB283 | lovegrass\|gb167\|EH188796 | 7598 | 630 | 92.51 | glotblastn |
| 4205 | LAB283 | barley\|10v1\|BF253836 | 7599 | 630 | 92.5 | globlastp |
| 4206 | LAB283 | barley\|gb157SOLEXA\|BF253836 | 7599 | 630 | 92.5 | globlastp |
| 4207 | LAB283 | millet\|09v1\|EVO454PM013564 | 7600 | 630 | 92 | globlastp |
| 4208 | LAB283 | switchgrass\|gb167\|DN140847 | 7601 | 630 | 92 | globlastp |
| 4209 | LAB283 | cenchrus\|gb166\|EB652891 | 7602 | 630 | 91.5 | globlastp |
| 4210 | LAB283 | lovegrass\|gb167\|DN480250 | 7603 | 630 | 91.5 | globlastp |
| 4211 | LAB283 | switchgrass\|gb167\|FE612726 | 7604 | 630 | 91.5 | globlastp |
| 4212 | LAB283 | wheat\|gb164\|CA502712 | 7605 | 630 | 90.4 | globlastp |

TABLE 54-continued

Homologues of the identified genes/polypeptides for increasing abiotic stress
tolerance, water use efficiency, yield, growth rate, vigor, oil content, biomass, growth
rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4213 | LAB283 | brachypodium\|09v1\|DV477815 | 7606 | 630 | 89.9 | globlastp |
| 4214 | LAB283 | catharanthus\|gb166\|EG561166 | 7607 | 630 | 89.8 | globlastp |
| 4215 | LAB283 | ginger\|gb164\|DY346160 | 7608 | 630 | 89.8 | globlastp |
| 4216 | LAB283 | pineapple\|10v1\|DT336417 | 7609 | 630 | 89.8 | globlastp |
| 4217 | LAB283 | sugarcane\|10v1\|CA115516 | 7610 | 630 | 89.8 | globlastp |
| 4218 | LAB283 | rice\|gb170\|OS07G47780 | 7611 | 630 | 89.7 | globlastp |
| 4219 | LAB283 | maize\|gb170\|LLDQ246011 | 7612 | 630 | 89.4 | globlastp |
| 4220 | LAB283 | wheat\|gb164\|BE352581 | 7612 | 630 | 89.4 | globlastp |
| 4221 | LAB283 | wheat\|gb164\|BE404049 | 7612 | 630 | 89.4 | globlastp |
| 4222 | LAB283 | oil_palm\|gb166\|CN600822 | 7613 | 630 | 89.3 | glotblastn |
| 4223 | LAB283 | banana\|gb167\|ES433979 | 7614 | 630 | 88.8 | globlastp |
| 4224 | LAB283 | barley\|10v1\|BG299572 | 7615 | 630 | 88.8 | globlastp |
| 4225 | LAB283 | barley\|gb157SOLEXA\|AL505846 | 7615 | 630 | 88.8 | globlastp |
| 4226 | LAB283 | fescue\|gb161\|DT685631 | 7616 | 630 | 88.8 | globlastp |
| 4227 | LAB283 | oil_palm\|gb166\|EL686178 | 7617 | 630 | 88.8 | globlastp |
| 4228 | LAB283 | pseudoroegneria\|gb167\|FF343982 | 7618 | 630 | 88.8 | globlastp |
| 4229 | LAB283 | wheat\|gb164\|BE423765 | 7619 | 630 | 88.8 | globlastp |
| 4230 | LAB283 | lolium\|10v1\|ES699035 | 7620 | 630 | 88.3 | globlastp |
| 4231 | LAB283 | oat\|10v1\|GO582808 | 7621 | 630 | 88.3 | globlastp |
| 4232 | LAB283 | leymus\|gb166\|EG374681 | 7622 | 630 | 88.3 | globlastp |
| 4233 | LAB283 | banana\|gb167\|FF561221 | 7623 | 630 | 88.2 | globlastp |
| 4234 | LAB283 | cassava\|09v1\|CK644077 | 7624 | 630 | 88.2 | globlastp |
| 4235 | LAB283 | cassava\|gb164\|CK644077 | 7624 | 630 | 88.2 | globlastp |
| 4236 | LAB283 | citrus\|gb166\|BQ623150 | 7625 | 630 | 88.2 | globlastp |
| 4237 | LAB283 | cotton\|gb164\|DT557850 | 7626 | 630 | 88.2 | globlastp |
| 4238 | LAB283 | sugarcane\|gb157.3\|CA080288 | 7627 | 630 | 88.2 | globlastp |
| 4239 | LAB283 | cleome_gynandra\|10v1\|SRR015532S0020282 | 7628 | 630 | 87.7 | globlastp |
| 4240 | LAB283 | cleome_spinosa\|10v1\|GR931300 | 7629 | 630 | 87.7 | globlastp |
| 4241 | LAB283 | cleome_spinosa\|10v1\|GR931891 | 7630 | 630 | 87.7 | globlastp |
| 4242 | LAB283 | flax\|09v1\|EU830561 | 7631 | 630 | 87.7 | globlastp |
| 4243 | LAB283 | jatropha\|09v1\|GT229173 | 7632 | 630 | 87.7 | globlastp |
| 4244 | LAB283 | amborella\|gb166\|CD483554 | 7633 | 630 | 87.7 | globlastp |
| 4245 | LAB283 | banana\|gb167\|FF560367 | 7634 | 630 | 87.7 | globlastp |
| 4246 | LAB283 | cacao\|gb167\|CA795583 | 7635 | 630 | 87.7 | globlastp |
| 4247 | LAB283 | castorbean\|09v1\|EE255447 | 7636 | 630 | 87.7 | globlastp |
| 4248 | LAB283 | castorbean\|gb160\|EE255447 | 7636 | 630 | 87.7 | globlastp |
| 4249 | LAB283 | cotton\|gb164\|DT046974 | 7637 | 630 | 87.7 | globlastp |
| 4250 | LAB283 | cotton\|gb164\|DW232816 | 7638 | 630 | 87.7 | globlastp |
| 4251 | LAB283 | cowpea\|gb166\|FC459109 | 7639 | 630 | 87.7 | globlastp |
| 4252 | LAB283 | ginger\|gb164\|DY368354 | 7640 | 630 | 87.7 | globlastp |
| 4253 | LAB283 | grape\|gb160\|BQ796886 | 7641 | 630 | 87.7 | globlastp |
| 4254 | LAB283 | onion\|gb162\|CF451866 | 7642 | 630 | 87.7 | globlastp |
| 4255 | LAB283 | papaya\|gb165\|EX262198 | 7643 | 630 | 87.7 | globlastp |
| 4256 | LAB283 | cleome_gynandra\|10v1\|SRR015532S0010711 | 7644 | 630 | 87.2 | globlastp |
| 4257 | LAB283 | cleome_spinosa\|10v1\|SRR015531S0011099 | 7645 | 630 | 87.2 | globlastp |
| 4258 | LAB283 | cucumber\|09v1\|DV631905 | 7646 | 630 | 87.2 | globlastp |
| 4259 | LAB283 | banana\|gb167\|FL658404 | 7647 | 630 | 87.2 | globlastp |
| 4260 | LAB283 | cassava\|09v1\|DV442672 | 7648 | 630 | 87.2 | globlastp |
| 4261 | LAB283 | cassava\|gb164\|DV442672 | 7648 | 630 | 87.2 | globlastp |
| 4262 | LAB283 | coffea\|10v1\|DV678801 | 7649 | 630 | 87.2 | globlastp |
| 4263 | LAB283 | coffea\|gb157.2\|DV678801 | 7649 | 630 | 87.2 | globlastp |
| 4264 | LAB283 | cotton\|gb164\|AI730706 | 7650 | 630 | 87.2 | globlastp |
| 4265 | LAB283 | cotton\|gb164\|AI731751 | 7651 | 630 | 87.2 | globlastp |
| 4266 | LAB283 | cotton\|gb164\|BE052367 | 7652 | 630 | 87.2 | globlastp |
| 4267 | LAB283 | cotton\|gb164\|BF279005 | 7650 | 630 | 87.2 | globlastp |
| 4268 | LAB283 | papaya\|gb165\|EX275159 | 7653 | 630 | 87.2 | globlastp |
| 4269 | LAB283 | jatropha\|09v1\|FM892996 | 7654 | 630 | 87.17 | glotblastn |
| 4270 | LAB283 | chickpea\|09v2\|AJ004961 | 7655 | 630 | 86.6 | globlastp |
| 4271 | LAB283 | cleome_gynandra\|10v1\|SRR015532S0008000 | 7656 | 630 | 86.6 | globlastp |
| 4272 | LAB283 | cleome_spinosa\|10v1\|SRR015531S0003355 | 7657 | 630 | 86.6 | globlastp |
| 4273 | LAB283 | avocado\|10v1\|CO998684 | 7658 | 630 | 86.6 | globlastp |
| 4274 | LAB283 | avocado\|gb164\|CO998684 | 7658 | 630 | 86.6 | globlastp |
| 4275 | LAB283 | cassava\|09v1\|CK648694 | 7659 | 630 | 86.6 | globlastp |
| 4276 | LAB283 | cassava\|gb164\|CK648694 | 7660 | 630 | 86.6 | globlastp |
| 4277 | LAB283 | grape\|gb160\|BQ800472 | 7661 | 630 | 86.6 | globlastp |
| 4278 | LAB283 | liquorice\|gb171\|FS244095 | 7662 | 630 | 86.6 | globlastp |
| 4279 | LAB283 | melon\|gb165\|DV631905 | 7663 | 630 | 86.6 | globlastp |
| 4280 | LAB283 | onion\|gb162\|CF436696 | 7664 | 630 | 86.6 | globlastp |
| 4281 | LAB283 | peanut\|gb171\|CD038311 | 7665 | 630 | 86.6 | globlastp |
| 4282 | LAB283 | peanut\|gb171\|CD038838 | 7666 | 630 | 86.6 | globlastp |
| 4283 | LAB283 | pineapple\|gb157.2\|DT336417 | 7667 | 630 | 86.6 | globlastp |
| 4284 | LAB283 | poplar\|10v1\|AI162670 | 7668 | 630 | 86.6 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4285 | LAB283 | arabidopsis_lyrata\|09v1\|BQ834416 | 7669 | 630 | 86.1 | globlastp |
| 4286 | LAB283 | cleome_gynandra\|10v1\|SRR015532S0012271 | 7670 | 630 | 86.1 | glotblastn |
| 4287 | LAB283 | cucumber\|09v1\|DN910478 | 7671 | 630 | 86.1 | globlastp |
| 4288 | LAB283 | nasturtium\|10v1\|GH163808 | 7672 | 630 | 86.1 | globlastp |
| 4289 | LAB283 | apple\|gb171\|CN494008 | 7673 | 630 | 86.1 | globlastp |
| 4290 | LAB283 | apple\|gb171\|CN864078 | 7674 | 630 | 86.1 | globlastp |
| 4291 | LAB283 | banana\|gb167\|ES437537 | 7675 | 630 | 86.1 | globlastp |
| 4292 | LAB283 | bean\|gb167\|CA897668 | 7676 | 630 | 86.1 | globlastp |
| 4293 | LAB283 | bean\|gb167\|CA897674 | 7677 | 630 | 86.1 | globlastp |
| 4294 | LAB283 | castorbean\|09v1\|CF981310 | 7678 | 630 | 86.1 | globlastp |
| 4295 | LAB283 | castorbean\|gb160\|CF981310 | 7679 | 630 | 86.1 | glotblastn |
| 4296 | LAB283 | cotton\|gb164\|AI730100 | 7680 | 630 | 86.1 | globlastp |
| 4297 | LAB283 | cowpea\|gb166\|FF383705 | 7681 | 630 | 86.1 | globlastp |
| 4298 | LAB283 | cowpea\|gb166\|FF384965 | 7682 | 630 | 86.1 | globlastp |
| 4299 | LAB283 | ginger\|gb164\|DY349506 | 7683 | 630 | 86.1 | globlastp |
| 4300 | LAB283 | grape\|gb160\|BM437118 | 7684 | 630 | 86.1 | globlastp |
| 4301 | LAB283 | liquorice\|gb171\|FS244478 | 7685 | 630 | 86.1 | globlastp |
| 4302 | LAB283 | melon\|gb165\|AM718598 | 7686 | 630 | 86.1 | globlastp |
| 4303 | LAB283 | poplar\|gb170\|AI162670 | 7687 | 630 | 86.1 | globlastp |
| 4304 | LAB283 | poplar\|10v1\|AI162871 | 7688 | 630 | 86.1 | globlastp |
| 4305 | LAB283 | poplar\|gb170\|AI162871 | 7688 | 630 | 86.1 | globlastp |
| 4306 | LAB283 | poplar\|10v1\|AI163306 | 7689 | 630 | 86.1 | globlastp |
| 4307 | LAB283 | poplar\|gb170\|AI163306 | 7689 | 630 | 86.1 | globlastp |
| 4308 | LAB283 | poppy\|gb166\|FE968414 | 7690 | 630 | 86.1 | globlastp |
| 4309 | LAB283 | prunus\|gb167\|AJ827102 | 7691 | 630 | 86.1 | globlastp |
| 4310 | LAB283 | prunus\|gb167\|CB822575 | 7692 | 630 | 86.1 | globlastp |
| 4311 | LAB283 | soybean\|gb168\|AW288068 | 7693 | 630 | 86.1 | globlastp |
| 4312 | LAB283 | walnuts\|gb166\|EL894571 | 7694 | 630 | 86.1 | globlastp |
| 4313 | LAB283 | wheat\|gb164\|BQ838809 | 7695 | 630 | 86.1 | globlastp |
| 4314 | LAB283 | ipomoea_nil\|10v1\|BJ556879 | 7696 | 630 | 85.6 | globlastp |
| 4314 | LAB283 | ipomoea\|gb157.2\|BJ556879 | 7696 | 630 | 85.6 | globlastp |
| 4315 | LAB283 | orobanche\|10v1\|SRR023189S0004601 | 7697 | 630 | 85.6 | globlastp |
| 4316 | LAB283 | apple\|gb171\|CN898032 | 7698 | 630 | 85.6 | globlastp |
| 4317 | LAB283 | citrus\|gb166\|CB293637 | 7699 | 630 | 85.6 | globlastp |
| 4318 | LAB283 | eucalyptus\|gb166\|CT982220 | 7700 | 630 | 85.6 | globlastp |
| 4319 | LAB283 | peanut\|gb171\|EG030272 | 7701 | 630 | 85.6 | globlastp |
| 4320 | LAB283 | soybean\|gb168\|AW256698 | 7702 | 630 | 85.6 | globlastp |
| 4321 | LAB283 | sunflower\|gb162\|BU672022 | 7703 | 630 | 85.6 | globlastp |
| 4322 | LAB283 | triphysaria\|10v1\|BM356765 | 7704 | 630 | 85.1 | globlastp |
| 4323 | LAB283 | triphysaria\|10v1\|BM356862 | 7704 | 630 | 85.1 | globlastp |
| 4324 | LAB283 | triphysaria\|10v1\|EX990668 | 7704 | 630 | 85.1 | globlastp |
| 4325 | LAB283 | ipomoea\|gb157.2\|BJ553202 | 7705 | 630 | 85.03 | glotblastn |
| 4326 | LAB283 | eschscholzia\|10v1\|CD478146 | 7706 | 630 | 85 | globlastp |
| 4327 | LAB283 | ipomoea_batatas\|10v1\|CB330344 | 7707 | 630 | 85 | globlastp |
| 4328 | LAB283 | ipomoea_nil\|10v1\|BJ553202 | 7708 | 630 | 85 | globlastp |
| 4329 | LAB283 | ipomoea_nil\|10v1\|CJ737673 | 7709 | 630 | 85 | globlastp |
| 4330 | LAB283 | nasturtium\|10v1\|SRR032558S0018850 | 7710 | 630 | 85 | globlastp |
| 4331 | LAB283 | solanum_phureja\|09v1\|SPHBG127682 | 7711 | 630 | 85 | globlastp |
| 4332 | LAB283 | arabidopsis\|gb165\|AT5G27850 | 7712 | 630 | 85 | globlastp |
| 4333 | LAB283 | b_oleracea\|gb161\|DY025769 | 7713 | 630 | 85 | globlastp |
| 4334 | LAB283 | b_rapa\|gb162\|DY010000 | 7713 | 630 | 85 | globlastp |
| 4335 | LAB283 | canola\|10v1\|CN730540 | 7713 | 630 | 85 | globlastp |
| 4336 | LAB283 | canola\|gb161\|CN730540 | 7713 | 630 | 85 | globlastp |
| 4337 | LAB283 | centaurea\|gb166\|EH737450 | 7714 | 630 | 85 | globlastp |
| 4338 | LAB283 | cryptomeria\|gb166\|BW993132 | 7715 | 630 | 85 | globlastp |
| 4339 | LAB283 | cynara\|gb167\|GE586442 | 7716 | 630 | 85 | globlastp |
| 4340 | LAB283 | ipomoea\|gb157.2\|CB330344 | 7707 | 630 | 85 | globlastp |
| 4341 | LAB283 | liriodendron\|gb166\|CK766210 | 7717 | 630 | 85 | globlastp |
| 4342 | LAB283 | petunia\|gb171\|DY396235 | 7718 | 630 | 85 | globlastp |
| 4343 | LAB283 | poplar\|10v1\|AI161894 | 7719 | 630 | 85 | globlastp |
| 4344 | LAB283 | poplar\|gb170\|AI161894 | 7719 | 630 | 85 | globlastp |
| 4345 | LAB283 | radish\|gb164\|EV537215 | 7713 | 630 | 85 | globlastp |
| 4346 | LAB283 | radish\|gb164\|EV546651 | 7713 | 630 | 85 | globlastp |
| 4347 | LAB283 | radish\|gb164\|EV566253 | 7720 | 630 | 85 | globlastp |
| 4348 | LAB283 | radish\|gb164\|EW718156 | 7720 | 630 | 85 | globlastp |
| 4349 | LAB283 | safflower\|gb162\|EL395026 | 7714 | 630 | 85 | globlastp |
| 4350 | LAB283 | soybean\|gb168\|AL376539 | 7721 | 630 | 85 | globlastp |
| 4351 | LAB283 | soybean\|gb168\|AW684723 | 7722 | 630 | 85 | globlastp |
| 4352 | LAB283 | tobacco\|gb162\|BQ842820 | 7723 | 630 | 85 | globlastp |
| 4353 | LAB283 | tobacco\|gb162\|DV158247 | 7724 | 630 | 85 | globlastp |
| 4354 | LAB283 | triphysaria\|gb164\|BM356862 | 7725 | 630 | 84.6 | globlastp |
| 4355 | LAB283 | gerbera\|09v1\|AJ750626 | 7726 | 630 | 84.5 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4356 | LAB283 | lotus|09v1|BW595275 | 7727 | 630 | 84.5 | globlastp |
| 4357 | LAB283 | pea|09v1|EX568904 | 7728 | 630 | 84.5 | globlastp |
| 4358 | LAB283 | apple|gb171|CN875969 | 7729 | 630 | 84.5 | globlastp |
| 4359 | LAB283 | arabidopsis|gb165|AT3G05590 | 7730 | 630 | 84.5 | globlastp |
| 4360 | LAB283 | b_juncea|gb164|EVGN01032312490823 | 7731 | 630 | 84.5 | globlastp |
| 4361 | LAB283 | b_oleracea|gb161|DY028050 | 7732 | 630 | 84.5 | globlastp |
| 4362 | LAB283 | b_rapa|gb162|CX267092 | 7733 | 630 | 84.5 | globlastp |
| 4363 | LAB283 | bean|gb167|CA897690 | 7734 | 630 | 84.5 | globlastp |
| 4364 | LAB283 | canola|10v1|CD818850 | 7732 | 630 | 84.5 | globlastp |
| 4365 | LAB283 | canola|gb161|CD818850 | 7732 | 630 | 84.5 | globlastp |
| 4366 | LAB283 | chestnut|gb170|SRR006295S0003138 | 7735 | 630 | 84.5 | globlastp |
| 4367 | LAB283 | cotton|gb164|BE053784 | 7736 | 630 | 84.5 | globlastp |
| 4368 | LAB283 | fern|gb171|DK952766 | 7737 | 630 | 84.5 | globlastp |
| 4369 | LAB283 | kiwi|gb166|FG397867 | 7738 | 630 | 84.5 | globlastp |
| 4370 | LAB283 | lotus|09v1|LLCN825309 | 7739 | 630 | 84.5 | globlastp |
| 4371 | LAB283 | lotus|gb157.2|CN825309 | 7739 | 630 | 84.5 | globlastp |
| 4372 | LAB283 | oak|gb170|DN951034 | 7735 | 630 | 84.5 | globlastp |
| 4373 | LAB283 | pine|gb157.2|AL750084 | 7740 | 630 | 84.5 | globlastp |
| 4374 | LAB283 | radish|gb164|EX903877 | 7741 | 630 | 84.5 | globlastp |
| 4375 | LAB283 | senecio|gb170|DY658757 | 7742 | 630 | 84.5 | globlastp |
| 4376 | LAB283 | soybean|gb168|BI969217 | 7743 | 630 | 84.5 | globlastp |
| 4377 | LAB283 | soybean|gb168|BI969863 | 7744 | 630 | 84.5 | globlastp |
| 4378 | LAB283 | spruce|gb162|CO234240 | 7745 | 630 | 84.5 | globlastp |
| 4379 | LAB283 | spurge|gb161|BE095307 | 7746 | 630 | 84.5 | globlastp |
| 4380 | LAB283 | sunflower|gb162|CD845836 | 7747 | 630 | 84.5 | globlastp |
| 4381 | LAB283 | sunflower|gb162|CD848533 | 7748 | 630 | 84.5 | globlastp |
| 4382 | LAB283 | thellungiella|gb167|BQ079245 | 7749 | 630 | 84.5 | globlastp |
| 4383 | LAB283 | tobacco|gb162|CV020739 | 7750 | 630 | 84.5 | globlastp |
| 4384 | LAB283 | eschscholzia|10v1|CD477064 | 7751 | 630 | 84.49 | glotblastn |
| 4385 | LAB283 | canola|gb161|CX278684 | 7752 | 630 | 84.49 | glotblastn |
| 4386 | LAB283 | coffea|10v1|DV666712 | 7753 | 630 | 84 | globlastp |
| 4387 | LAB283 | eggplant|10v1|FS007197 | 7754 | 630 | 84 | globlastp |
| 4388 | LAB283 | ipomoea_batatas|10v1|CB330862 | 7755 | 630 | 84 | globlastp |
| 4389 | LAB283 | physcomitrella|10v1|BJ158142 | 7756 | 630 | 84 | globlastp |
| 4390 | LAB283 | physcomitrella|10v1|BJ185019 | 7757 | 630 | 84 | globlastp |
| 4391 | LAB283 | bruguiera|gb166|BP938752 | 7758 | 630 | 84 | globlastp |
| 4392 | LAB283 | cichorium|gb171|EH701900 | 7759 | 630 | 84 | globlastp |
| 4393 | LAB283 | clover|gb162|BB918213 | 7760 | 630 | 84 | globlastp |
| 4394 | LAB283 | dandelion|gb161|DQ160027 | 7761 | 630 | 84 | globlastp |
| 4395 | LAB283 | lettuce|gb157.2|DW045621 | 7762 | 630 | 84 | globlastp |
| 4396 | LAB283 | lettuce|10v1|DW075909 | 7763 | 630 | 84 | globlastp |
| 4397 | LAB283 | lettuce|gb157.2|DW075909 | 7763 | 630 | 84 | globlastp |
| 4398 | LAB283 | lettuce|gb157.2|DW107696 | 7762 | 630 | 84 | globlastp |
| 4399 | LAB283 | lotus|09v1|LLAW720439 | 7764 | 630 | 84 | globlastp |
| 4400 | LAB283 | pine|gb157.2|AW290194 | 7765 | 630 | 84 | globlastp |
| 4401 | LAB283 | potato|gb157.2|AW906174 | 7766 | 630 | 84 | globlastp |
| 4402 | LAB283 | radish|gb164|EV536533 | 7767 | 630 | 84 | globlastp |
| 4403 | LAB283 | radish|gb164|EV536583 | 7768 | 630 | 84 | globlastp |
| 4404 | LAB283 | radish|gb164|EV550169 | 7769 | 630 | 84 | globlastp |
| 4405 | LAB283 | radish|gb164|EV568547 | 7770 | 630 | 84 | globlastp |
| 4406 | LAB283 | radish|gb164|EW716009 | 7767 | 630 | 84 | globlastp |
| 4407 | LAB283 | radish|gb164|EW728074 | 7767 | 630 | 84 | globlastp |
| 4408 | LAB283 | radish|gb164|T25181 | 7767 | 630 | 84 | globlastp |
| 4409 | LAB283 | radish|gb164|T25182 | 7767 | 630 | 84 | globlastp |
| 4410 | LAB283 | safflower|gb162|EL408656 | 7771 | 630 | 84 | globlastp |
| 4411 | LAB283 | tea|10v1|CV013664 | 7772 | 630 | 84 | globlastp |
| 4412 | LAB283 | tea|gb171|CV013664 | 7772 | 630 | 84 | globlastp |
| 4413 | LAB283 | tobacco|gb162|CV016133 | 7773 | 630 | 84 | globlastp |
| 4414 | LAB283 | tobacco|gb162|CV019619 | 7774 | 630 | 84 | globlastp |
| 4415 | LAB283 | tomato|09v1|BG127682 | 7775 | 630 | 84 | globlastp |
| 4416 | LAB283 | tomato|gb164|BG127682 | 7775 | 630 | 84 | globlastp |
| 4417 | LAB283 | triphysaria|gb164|BM356765 | 7776 | 630 | 84 | globlastp |
| 4418 | LAB283 | lettuce|10v1|DW045621 | 7762 | 630 | 84 | globlastp |
| 4419 | LAB283 | pine|10v1|AW010654 | 7765 | 630 | 84 | globlastp |
| 4420 | LAB283 | physcomitrella|gb157|BJ158142 | 7777 | 630 | 83.96 | glotblastn |
| 4421 | LAB283 | triphysaria|10v1|EY014546 | 7778 | 630 | 83.5 | globlastp |
| 4422 | LAB283 | beet|gb162|BF011058 | 7779 | 630 | 83.42 | glotblastn |
| 4423 | LAB283 | dandelion|gb161|DY806963 | 7780 | 630 | 83.42 | glotblastn |
| 4424 | LAB283 | physcomitrella|gb157|AW126838 | 7781 | 630 | 83.42 | glotblastn |
| 4425 | LAB283 | physcomitrella|gb157|BG362299 | 7782 | 630 | 83.42 | glotblastn |
| 4426 | LAB283 | arabidopsis_lyrata|09v1|JGIAL022452 | 7783 | 630 | 83.4 | globlastp |
| 4427 | LAB283 | canola|10v1|CD812625 | 7784 | 630 | 83.4 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4428 | LAB283 | canola\|10v1\|CD840995 | 7785 | 630 | 83.4 | globlastp |
| 4429 | LAB283 | ipomoea_batatas\|10v1\|EE882526 | 7786 | 630 | 83.4 | globlastp |
| 4430 | LAB283 | orobanche\|10v1\|SRR023189S0022111 | 7787 | 630 | 83.4 | globlastp |
| 4431 | LAB283 | physcomitrella\|10v1\|AW126838 | 7788 | 630 | 83.4 | globlastp |
| 4432 | LAB283 | physcomitrella\|10v1\|BG362299 | 7789 | 630 | 83.4 | globlastp |
| 4433 | LAB283 | pigeonpea\|gb171\|GR466455 | 7790 | 630 | 83.4 | globlastp |
| 4434 | LAB283 | tragopogon\|10v1\|SRR020205S0015140 | 7791 | 630 | 83.4 | globlastp |
| 4435 | LAB283 | tragopogon\|10v1\|SRR020205S0106933 | 7792 | 630 | 83.4 | globlastp |
| 4436 | LAB283 | b_juncea\|gb164\|EVGN00081204610071 | 7793 | 630 | 83.4 | globlastp |
| 4437 | LAB283 | b_oleracea\|gb161\|DY025951 | 7794 | 630 | 83.4 | globlastp |
| 4438 | LAB283 | b_oleracea\|gb161\|DY027454 | 7784 | 630 | 83.4 | globlastp |
| 4439 | LAB283 | b_rapa\|gb162\|CV432333 | 7784 | 630 | 83.4 | globlastp |
| 4440 | LAB283 | b_rapa\|gb162\|CV433788 | 7784 | 630 | 83.4 | globlastp |
| 4441 | LAB283 | b_rapa\|gb162\|L33551 | 7795 | 630 | 83.4 | globlastp |
| 4442 | LAB283 | b_rapa\|gb162\|L33568 | 7795 | 630 | 83.4 | globlastp |
| 4443 | LAB283 | canola\|gb161\|CD812625 | 7784 | 630 | 83.4 | globlastp |
| 4444 | LAB283 | canola\|10v1\|CD814590 | 7795 | 630 | 83.4 | globlastp |
| 4445 | LAB283 | canola\|gb161\|CD814590 | 7795 | 630 | 83.4 | globlastp |
| 4446 | LAB283 | canola\|10v1\|CD820367 | 7795 | 630 | 83.4 | globlastp |
| 4447 | LAB283 | canola\|gb161\|CD820367 | 7795 | 630 | 83.4 | globlastp |
| 4448 | LAB283 | canola\|gb161\|CX188482 | 7784 | 630 | 83.4 | globlastp |
| 4449 | LAB283 | canola\|10v1\|T18367 | 7794 | 630 | 83.4 | globlastp |
| 4450 | LAB283 | canola\|gb161\|T18367 | 7794 | 630 | 83.4 | globlastp |
| 4451 | LAB283 | centaurea\|gb166\|EH738805 | 7796 | 630 | 83.4 | globlastp |
| 4452 | LAB283 | centaurea\|gb166\|EH739466 | 7797 | 630 | 83.4 | globlastp |
| 4453 | LAB283 | cichorium\|gb171\|DT213052 | 7798 | 630 | 83.4 | globlastp |
| 4454 | LAB283 | cynara\|gb167\|GE588262 | 7799 | 630 | 83.4 | globlastp |
| 4455 | LAB283 | fern\|gb171\|DK949008 | 7800 | 630 | 83.4 | globlastp |
| 4456 | LAB283 | ipomoea\|gb157.2\|CJ737673 | 7801 | 630 | 83.4 | globlastp |
| 4457 | LAB283 | lettuce\|gb157.2\|DW076892 | 7802 | 630 | 83.4 | globlastp |
| 4458 | LAB283 | lettuce\|gb157.2\|DW145375 | 7803 | 630 | 83.4 | globlastp |
| 4459 | LAB283 | lettuce\|gb157.2\|DW148040 | 7804 | 630 | 83.4 | globlastp |
| 4460 | LAB283 | nicotiana_benthamiana\|gb162\|CN745163 | 7805 | 630 | 83.4 | globlastp |
| 4461 | LAB283 | oak\|gb170\|DN949820 | 7806 | 630 | 83.4 | globlastp |
| 4462 | LAB283 | pepper\|gb171\|BM064100 | 7807 | 630 | 83.4 | globlastp |
| 4463 | LAB283 | pepper\|gb171\|BM068255 | 7808 | 630 | 83.4 | globlastp |
| 4464 | LAB283 | petunia\|gb171\|CV295039 | 7809 | 630 | 83.4 | globlastp |
| 4465 | LAB283 | petunia\|gb171\|CV299987 | 7810 | 630 | 83.4 | globlastp |
| 4466 | LAB283 | radish\|gb164\|EV535201 | 7811 | 630 | 83.4 | globlastp |
| 4467 | LAB283 | radish\|gb164\|EV551301 | 7812 | 630 | 83.4 | globlastp |
| 4468 | LAB283 | radish\|gb164\|EY904311 | 7813 | 630 | 83.4 | globlastp |
| 4469 | LAB283 | safflower\|gb162\|EL374888 | 7814 | 630 | 83.4 | globlastp |
| 4470 | LAB283 | thellungiella\|gb167\|BY803938 | 7815 | 630 | 83.4 | globlastp |
| 4471 | LAB283 | canola\|10v1\|CX188482 | 7784 | 630 | 83.4 | globlastp |
| 4472 | LAB283 | ginseng\|10v1\|CN848661 | 7816 | 630 | 82.9 | globlastp |
| 4473 | LAB283 | physcomitrella\|10v1\|AW126801 | 7817 | 630 | 82.9 | globlastp |
| 4474 | LAB283 | b_oleracea\|gb161\|DY026489 | 7818 | 630 | 82.9 | globlastp |
| 4475 | LAB283 | canola\|10v1\|CD812987 | 7818 | 630 | 82.9 | globlastp |
| 4476 | LAB283 | canola\|gb161\|CD812987 | 7818 | 630 | 82.9 | globlastp |
| 4477 | LAB283 | chestnut\|gb170\|SRR006295S0000969 | 7819 | 630 | 82.9 | globlastp |
| 4478 | LAB283 | dandelion\|gb161\|DY806552 | 7820 | 630 | 82.9 | globlastp |
| 4479 | LAB283 | iceplant\|gb164\|BE033787 | 7821 | 630 | 82.9 | globlastp |
| 4480 | LAB283 | kiwi\|gb166\|FG397111 | 7822 | 630 | 82.9 | globlastp |
| 4481 | LAB283 | lettuce\|gb157.2\|DW046061 | 7823 | 630 | 82.9 | globlastp |
| 4482 | LAB283 | lettuce\|gb157.2\|DW079832 | 7824 | 630 | 82.9 | globlastp |
| 4483 | LAB283 | lettuce\|gb157.2\|DW106263 | 7824 | 630 | 82.9 | globlastp |
| 4484 | LAB283 | lettuce\|gb157.2\|DW108449 | 7823 | 630 | 82.9 | globlastp |
| 4485 | LAB283 | liriodendron\|gb166\|DT580181 | 7825 | 630 | 82.9 | globlastp |
| 4486 | LAB283 | spikemoss\|gb165\|DN839616 | 7826 | 630 | 82.9 | globlastp |
| 4487 | LAB283 | spikemoss\|gb165\|FE445919 | 7827 | 630 | 82.9 | globlastp |
| 4488 | LAB283 | spruce\|gb162\|CO215472 | 7828 | 630 | 82.9 | globlastp |
| 4489 | LAB283 | sunflower\|gb162\|EL465100 | 7829 | 630 | 82.9 | globlastp |
| 4490 | LAB283 | zamia\|gb166\|DY031019 | 7830 | 630 | 82.9 | globlastp |
| 4491 | LAB283 | lettuce\|10v1\|DW046061 | 7823 | 630 | 82.9 | globlastp |
| 4492 | LAB283 | lettuce\|10v1\|DW065820 | 7824 | 630 | 82.9 | globlastp |
| 4493 | LAB283 | b_rapa\|gb162\|BG544074 | 7831 | 630 | 82.89 | glotblastn |
| 4494 | LAB283 | beet\|gb162\|BQ592402 | 7832 | 630 | 82.89 | glotblastn |
| 4495 | LAB283 | kiwi\|gb166\|FG418360 | 7833 | 630 | 82.89 | glotblastn |
| 4496 | LAB283 | physcomitrella\|gb157\|AW126801 | 7834 | 630 | 82.89 | glotblastn |
| 4497 | LAB283 | eggplant\|10v1\|FS000992 | 7835 | 630 | 82.4 | globlastp |
| 4498 | LAB283 | salvia\|10v1\|CV164239 | 7836 | 630 | 82.4 | globlastp |
| 4499 | LAB283 | salvia\|10v1\|SRR014553S0002907 | 7837 | 630 | 82.4 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4500 | LAB283 | tragopogon\|10v1\|SRR020205S0018138 | 7838 | 630 | 82.4 | globlastp |
| 4501 | LAB283 | artemisia\|10v1\|EY032066 | 7839 | 630 | 82.4 | globlastp |
| 4502 | LAB283 | artemisia\|gb164\|EY032066 | 7839 | 630 | 82.4 | globlastp |
| 4503 | LAB283 | artemisia\|10v1\|EY056461 | 7840 | 630 | 82.4 | globlastp |
| 4504 | LAB283 | artemisia\|gb164\|EY056461 | 7840 | 630 | 82.4 | globlastp |
| 4505 | LAB283 | basilicum\|10v1\|DY321729 | 7841 | 630 | 82.4 | globlastp |
| 4506 | LAB283 | cichorium\|gb171\|EH683001 | 7842 | 630 | 82.4 | globlastp |
| 4507 | LAB283 | cycas\|gb166\|CB088957 | 7843 | 630 | 82.4 | globlastp |
| 4508 | LAB283 | medicago\|09v1\|AW684723 | 7844 | 630 | 82.4 | globlastp |
| 4509 | LAB283 | medicago\|gb157.2\|AW684723 | 7844 | 630 | 82.4 | globlastp |
| 4510 | LAB283 | nicotiana_benthamiana\|gb162\|CN742004 | 7845 | 630 | 82.4 | globlastp |
| 4511 | LAB283 | poppy\|gb166\|FE964997 | 7846 | 630 | 82.4 | globlastp |
| 4512 | LAB283 | radish\|gb164\|EW713569 | 7847 | 630 | 82.4 | globlastp |
| 4513 | LAB283 | spruce\|gb162\|CO231722 | 7848 | 630 | 82.4 | globlastp |
| 4514 | LAB283 | b_juncea\|gb164\|EVGN00901614231757 | 7849 | 630 | 82.35 | glotblastn |
| 4515 | LAB283 | cynara\|gb167\|GE588021 | 7850 | 630 | 82.35 | glotblastn |
| 4516 | LAB283 | iceplant\|gb164\|BE033487 | 7851 | 630 | 82.35 | glotblastn |
| 4517 | LAB283 | medicago\|09v1\|LLAW256698 | 7852 | 630 | 81.9 | globlastp |
| 4518 | LAB283 | medicago\|gb157.2\|AW256698 | 7852 | 630 | 81.9 | globlastp |
| 4519 | LAB283 | monkeyflower\|10v1\|DV207165 | 7853 | 630 | 81.8 | globlastp |
| 4520 | LAB283 | monkeyflower\|10v1\|DV208950 | 7854 | 630 | 81.8 | globlastp |
| 4521 | LAB283 | salvia\|10v1\|FE536981 | 7855 | 630 | 81.8 | globlastp |
| 4522 | LAB283 | solanum_phureja\|09v1\|SPHBG127027 | 7856 | 630 | 81.8 | globlastp |
| 4523 | LAB283 | antirrhinum\|gb166\|AJ558493 | 7857 | 630 | 81.8 | globlastp |
| 4524 | LAB283 | antirrhinum\|gb166\|AJ7881\|3 | 7858 | 630 | 81.8 | globlastp |
| 4525 | LAB283 | clover\|gb162\|BB923394 | 7859 | 630 | 81.8 | globlastp |
| 4526 | LAB283 | lettuce\|gb157.2\|DW065820 | 7860 | 630 | 81.8 | globlastp |
| 4527 | LAB283 | potato\|gb157.2\|BG350906 | 7856 | 630 | 81.8 | globlastp |
| 4528 | LAB283 | potato\|gb157.2\|BG592372 | 7856 | 630 | 81.8 | globlastp |
| 4529 | LAB283 | potato\|10v1\|BG350906 | 7856 | 630 | 81.8 | globlastp |
| 4530 | LAB283 | artemisia\|gb164\|EY033512 | 7861 | 630 | 81.3 | globlastp |
| 4531 | LAB283 | basilicum\|gb157.3\|DY321729 | 7862 | 630 | 81.3 | globlastp |
| 4532 | LAB283 | liquorice\|gb171\|FS266383 | 7863 | 630 | 81.3 | globlastp |
| 4533 | LAB283 | marchantia\|gb166\|C96610 | 7864 | 630 | 81.3 | globlastp |
| 4534 | LAB283 | medicago\|09v1\|BE249407 | 7865 | 630 | 81.3 | globlastp |
| 4535 | LAB283 | medicago\|gb157.2\|BE249407 | 7865 | 630 | 81.3 | globlastp |
| 4536 | LAB283 | potato\|gb157.2\|BG589732 | 7866 | 630 | 81.3 | globlastp |
| 4537 | LAB283 | tomato\|09v1\|BG127027 | 7866 | 630 | 81.3 | globlastp |
| 4538 | LAB283 | tomato\|gb164\|BG127027 | 7866 | 630 | 81.3 | globlastp |
| 4539 | LAB283 | artemisia\|10v1\|EY033512 | 7867 | 630 | 81.28 | glotblastn |
| 4540 | LAB283 | triphysaria\|gb164\|BM356434 | 7868 | 630 | 80.9 | globlastp |
| 4541 | LAB283 | triphysaria\|gb164\|EY126952 | 7869 | 630 | 80.9 | globlastp |
| 4542 | LAB283 | triphysaria\|10v1\|EY133632 | 7870 | 630 | 80.9 | globlastp |
| 4543 | LAB283 | triphysaria\|gb164\|EY133632 | 7870 | 630 | 80.9 | globlastp |
| 4544 | LAB283 | ginseng\|10v1\|CN848265 | 7871 | 630 | 80.7 | globlastp |
| 4545 | LAB283 | petunia\|gb171\|DC244521 | 7872 | 630 | 80.5 | globlastp |
| 4546 | LAB283 | triphysaria\|10v1\|EY126952 | 7873 | 630 | 80.3 | globlastp |
| 4547 | LAB283 | triphysaria\|10v1\|BM356434 | 7874 | 630 | 80.3 | globlastp |
| 4548 | LAB284 | maize\|gb170\|AW091217 | 7875 | 631 | 89.7 | globlastp |
| 4549 | LAB286 | maize\|gb170\|AI001359 | 7876 | 632 | 86.6 | globlastp |
| 4550 | LAB286 | sorghum\|gb161.crp\|CF481271 | 7877 | 632 | 84.11 | glotblastn |
| 4551 | LAB286 | sorghum\|09v1\|CF481271 | 7878 | 632 | 83.4 | globlastp |
| 4552 | LAB289 | sugarcane\|gb157.3\|BQ537261 | 7879 | 633 | 99.7 | globlastp |
| 4553 | LAB289 | sugarcane\|gb157.3\|CA072303 | 7880 | 633 | 99.7 | globlastp |
| 4554 | LAB289 | sugarcane\|10v1\|BQ537261 | 7879 | 633 | 99.7 | globlastp |
| 4555 | LAB289 | maize\|gb170\|AI491553 | 7881 | 633 | 97.4 | globlastp |
| 4556 | LAB289 | maize\|gb170\|BQ294294 | 7882 | 633 | 96.8 | globlastp |
| 4557 | LAB289 | switchgrass\|gb167\|FE605676 | 7883 | 633 | 95.9 | globlastp |
| 4558 | LAB289 | rice\|gb170\|OS07G39280 | 7884 | 633 | 94.5 | globlastp |
| 4559 | LAB289 | wheat\|gb164\|BE470949 | 7885 | 633 | 90 | globlastp |
| 4560 | LAB289 | leymus\|gb166\|EG384787 | 7886 | 633 | 89.9 | globlastp |
| 4561 | LAB289 | barley\|10v1\|BE412637 | 7887 | 633 | 89.7 | globlastp |
| 4562 | LAB289 | barley\|gb157SOLEXA\|BE412637 | 7887 | 633 | 89.7 | globlastp |
| 4563 | LAB289 | brachypodium\|gb169\|BE412637 | 7888 | 633 | 89.7 | globlastp |
| 4564 | LAB289 | brachypodium\|09v1\|DV472699 | 7889 | 633 | 89.4 | glotblastn |
| 4565 | LAB290 | sorghum\|09v1\|SB05G023240 | 7890 | 634 | 97.4 | globlastp |
| 4565 | LAB290_H0 | sorghum\|09v1\|SB05G023240 | 7890 | 688 | 84.9 | globlastp |
| 4566 | LAB290 | sorghum\|gb161.crp\|BE363468 | 7890 | 634 | 97.4 | globlastp |
| 4566 | LAB290_H0 | sorghum\|gb161.crp\|BE363468 | 7890 | 688 | 84.9 | globlastp |
| 4567 | LAB290 | sugarcane\|gb157.3\|CA084515 | 7891 | 634 | 82.8 | globlastp |
| 4567 | LAB290_H0 | sugarcane\|gb157.3\|CA084515 | 7891 | 688 | 84.24 | glotblastn |
| 4568 | LAB290 | switchgrass\|gb167\|DN143335 | 7892 | 634 | 82.1 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4569 | LAB292 | sugarcane\|10v1\|CA065722 | 7893 | 635 | 87.8 | globlastp |
| 4570 | LAB292 | sugarcane\|gb157.3\|CA065722 | 7894 | 635 | 87.5 | globlastp |
| 4571 | LAB292 | maize\|gb170\|CB617317 | 7895 | 635 | 83.44 | glotblastn |
| 4572 | LAB292 | maize\|gb170\|AI901624 | 7896 | 635 | 82.8 | globlastp |
| 4573 | LAB293 | maize\|gb170\|CD946962 | 7897 | 636 | 88.3 | globlastp |
| 4574 | LAB296 | switchgrass\|gb167\|FL698667 | 7898 | 639 | 93.55 | glotblastn |
| 4575 | LAB296 | sugarcane\|10v1\|CA102880 | 7899 | 639 | 92.1 | globlastp |
| 4576 | LAB296 | sugarcane\|gb157.3\|CA102880 | 7900 | 639 | 89.2 | globlastp |
| 4577 | LAB296 | rice\|gb170\|OS04G46880 | 7901 | 639 | 86.1 | globlastp |
| 4578 | LAB296 | brachypodium\|09v1\|SRR031795S0000152 | 7902 | 639 | 85 | globlastp |
| 4579 | LAB296 | brachypodium\|gb169\|BG262952 | 7902 | 639 | 85 | globlastp |
| 4580 | LAB296 | maize\|gb170\|LLEU957736 | 7903 | 639 | 85 | globlastp |
| 4581 | LAB296 | maize\|gb170\|BM259168 | 7904 | 639 | 84.3 | globlastp |
| 4582 | LAB297 | sorghum\|gb161.crp\|BI098059 | 7905 | 640 | 82.4 | globlastp |
| 4583 | LAB297 | sorghum\|09v1\|SB05G000860 | 7906 | 640 | 81.9 | globlastp |
| 4584 | LAB302 | maize\|gb170\|AA979768 | 7907 | 644 | 81.3 | glotblastn |
| 4585 | LAB302 | maize\|gb170\|LLBE051112 | 7908 | 644 | 81.3 | globlastp |
| 4586 | LAB304 | maize\|gb170\|DR813947 | 7909 | 646 | 92.27 | glotblastn |
| 4587 | LAB304 | switchgrass\|gb167\|FL902445 | 7910 | 646 | 87.63 | glotblastn |
| 4588 | LAB304 | rice\|gb170\|OS03G03550 | 7911 | 646 | 84.1 | glotblastn |
| 4589 | LAB304 | maize\|gb170\|CRPZM2N005678 | 7912 | 646 | 83.76 | glotblastn |
| 4590 | LAB307 | soybean\|gb168\|AW697150 | 7913 | 648 | 91.4 | globlastp |
| 4591 | LAB307 | lotus\|09v1\|BW594599 | 7914 | 648 | 84.9 | globlastp |
| 4592 | LAB307 | chickpea\|09v2\|GFXFJ477886X1 | 7915 | 648 | 84.7 | globlastp |
| 4593 | LAB307 | bean\|gb167\|CV541797 | 7916 | 648 | 84.7 | globlastp |
| 4594 | LAB307 | medicago\|09v1\|BE325764 | 7917 | 648 | 83.7 | globlastp |
| 4595 | LAB307 | medicago\|gb157.2\|BE325764 | 7917 | 648 | 83.7 | globlastp |
| 4596 | LAB307 | peanut\|gb171\|EC365261 | 7918 | 648 | 82.6 | globlastp |
| 4597 | LAB308 | soybean\|gb168\|BG449301 | 7919 | 649 | 96.3 | globlastp |
| 4598 | LAB308 | cowpea\|gb166\|AY257179 | 7920 | 649 | 87.9 | globlastp |
| 4599 | LAB308 | medicago\|09v1\|AW257191 | 7921 | 649 | 83.4 | globlastp |
| 4600 | LAB309 | soybean\|gb168\|EV263579 | 7922 | 650 | 92.5 | globlastp |
| 4601 | LAB311 | lettuce\|gb157.2\|DW132299 | 7923 | 652 | 83.5 | globlastp |
| 4602 | LAB311 | lettuce\|10v1\|DW052365 | 7924 | 652 | 83.5 | globlastp |
| 4603 | LAB311 | lettuce\|gb157.2\|DW087492 | 7925 | 652 | 83 | globlastp |
| 4604 | LAB311 | lettuce\|gb157.2\|DW048584 | 7926 | 652 | 82.2 | globlastp |
| 4605 | LAB311 | cichorium\|gb171\|EH676540 | 7927 | 652 | 80.2 | globlastp |
| 4606 | LAB311 | lettuce\|gb157.2\|DW117160 | 7928 | 652 | 80 | globlastp |
| 4607 | LAB312 | potato\|gb157.2\|BG096129 | 7929 | 653 | 98.1 | globlastp |
| 4608 | LAB312 | solanum_phureja\|09v1\|SPHAF079231 | 7930 | 653 | 97.8 | globlastp |
| 4609 | LAB312 | potato\|gb157.2\|BQ117749 | 7931 | 653 | 97.8 | globlastp |
| 4610 | LAB312 | eggplant\|10v1\|FS008591 | 7932 | 653 | 94 | globlastp |
| 4611 | LAB312 | pepper\|gb171\|BM066919 | 7933 | 653 | 93.4 | globlastp |
| 4612 | LAB312 | tobacco\|gb162\|AF113545 | 7934 | 653 | 90.5 | globlastp |
| 4613 | LAB312 | potato\|10v1\|BG096129 | 7935 | 653 | 88.6 | globlastp |
| 4614 | LAB312 | poplar\|gb170\|AI162953 | 7936 | 653 | 80.7 | globlastp |
| 4615 | LAB312 | poplar\|10v1\|AI163602 | 7937 | 653 | 80.1 | globlastp |
| 4616 | LAB312 | poplar\|10v1\|AI162953 | 7938 | 653 | 80.1 | globlastp |
| 4617 | LAB314 | solanum_phureja\|09v1\|SPHBG627257 | 7939 | 654 | 95.7 | globlastp |
| 4618 | LAB314 | potato\|10v1\|BE921587 | 7940 | 654 | 95.1 | globlastp |
| 4619 | LAB314 | potato\|gb157.2\|BE921587 | 7941 | 654 | 92.3 | globlastp |
| 4620 | LAB314 | tobacco\|gb162\|DW001183 | 7942 | 654 | 83.89 | globlastp |
| 4621 | LAB315 | potato\|10v1\|CV503760 | 7943 | 655 | 93.5 | globlastp |
| 4622 | LAB315 | potato\|gb157.2\|CV503760 | 7943 | 655 | 93.5 | globlastp |
| 4623 | LAB315 | solanum_phureja\|09v1\|SPHAI487529 | 7944 | 655 | 93 | globlastp |
| 4624 | LAB317 | potato\|gb157.2\|BG595203 | 7945 | 657 | 98.1 | globlastp |
| 4625 | LAB317 | potato\|10v1\|BG595203 | 7946 | 657 | 97.8 | globlastp |
| 4626 | LAB317 | eggplant\|10v1\|FS033756 | 7947 | 657 | 90.8 | globlastp |
| 4627 | LAB317 | solanum_phureja\|09v1\|SPHAI773737 | 7948 | 657 | 89.7 | globlastp |
| 4628 | LAB317 | pepper\|gb171\|CA513828 | 7949 | 657 | 83.6 | globlastp |
| 4629 | LAB317 | nicotiana_benthamiana\|gb162\|CK284916 | 7950 | 657 | 82.6 | globlastp |
| 4630 | LAB319 | solanum_phureja\|09v1\|SPHAW032666 | 7951 | 659 | 94.1 | globlastp |
| 4631 | LAB319 | potato\|10v1\|BG350293 | 7951 | 659 | 94.1 | globlastp |
| 4632 | LAB319 | potato\|gb157.2\|BG350293 | 7951 | 659 | 94.1 | globlastp |
| 4633 | LAB319 | tobacco\|gb162\|DW005109 | 7952 | 659 | 82.8 | globlastp |
| 4634 | LAB319 | petunia\|gb171\|AM489763 | 7953 | 659 | 80.2 | globlastp |
| 4635 | LAB320 | solanum_phureja\|09v1\|SPHAW979674 | 7954 | 660 | 92.9 | globlastp |
| 4636 | LAB324 | solanum_phureja\|09v1\|SPHBG628155 | 7955 | 662 | 99.2 | globlastp |
| 4637 | LAB324 | eggplant\|10v1\|FS000167 | 7956 | 662 | 97.5 | globlastp |
| 4638 | LAB324 | tobacco\|gb162\|EB424763 | 7957 | 662 | 97.5 | globlastp |
| 4639 | LAB324 | pepper\|gb171\|CA517713 | 7958 | 662 | 97.1 | globlastp |
| 4640 | LAB324 | petunia\|gb171\|PETTRNSFB | 7959 | 662 | 96.7 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4641 | LAB324 | coffea\|10v1\|DV664667 | 7960 | 662 | 94.2 | globlastp |
| 4642 | LAB324 | coffea\|gb157.2\|DV664667 | 7960 | 662 | 94.2 | globlastp |
| 4643 | LAB324 | ipomoea_nil\|10v1\|BJ555139 | 7961 | 662 | 90.9 | globlastp |
| 4643 | LAB324 | ipomoea\|gb157.2\|BJ555139 | 7961 | 662 | 90.9 | globlastp |
| 4644 | LAB324 | grape\|gb160\|AF373603 | 7962 | 662 | 90.1 | globlastp |
| 4645 | LAB324 | kiwi\|gb166\|FG414728 | 7963 | 662 | 87.8 | globlastp |
| 4646 | LAB324 | antirrhinum\|gb166\|AY306142 | 7964 | 662 | 87.7 | globlastp |
| 4647 | LAB324 | castorbean\|09v1\|EE259386 | 7965 | 662 | 87.6 | globlastp |
| 4648 | LAB324 | prunus\|gb167\|BU039561 | 7966 | 662 | 87.6 | globlastp |
| 4649 | LAB324 | cucumber\|09v1\|CD726807 | 7967 | 662 | 87.2 | globlastp |
| 4650 | LAB324 | papaya\|gb165\|EX248886 | 7968 | 662 | 87.2 | globlastp |
| 4651 | LAB324 | cacao\|gb167\|CU475790 | 7969 | 662 | 87 | globlastp |
| 4652 | LAB324 | antirrhinum\|gb166\|AY306140 | 7970 | 662 | 86.8 | globlastp |
| 4653 | LAB324 | antirrhinum\|gb166\|AY306141 | 7971 | 662 | 86.5 | globlastp |
| 4654 | LAB324 | strawberry\|gb164\|CO381239 | 7972 | 662 | 86.4 | globlastp |
| 4655 | LAB324 | triphysaria\|10v1\|SRR023501S0006880 | 7973 | 662 | 86.3 | globlastp |
| 4656 | LAB324 | cassava\|09v1\|JGICASSAVA45541M1 | 7974 | 662 | 86 | globlastp |
| 4657 | LAB324 | cotton\|gb164\|BE055122 | 7975 | 662 | 85.6 | globlastp |
| 4658 | LAB324 | apple\|gb171\|CN445627 | 7976 | 662 | 85.5 | globlastp |
| 4659 | LAB324 | nasturtium\|10v1\|SRR032558S0070643 | 7977 | 662 | 84.8 | globlastp |
| 4660 | LAB324 | melon\|gb165\|AM736201 | 7978 | 662 | 84.7 | globlastp |
| 4661 | LAB324 | cotton\|gb164\|AI725419 | 7979 | 662 | 84.6 | globlastp |
| 4662 | LAB324 | cotton\|gb164\|BF273794 | 7979 | 662 | 84.6 | globlastp |
| 4663 | LAB324 | citrus\|gb166\|CB290298 | 7980 | 662 | 84.4 | globlastp |
| 4664 | LAB324 | lotus\|09v1\|AY770397 | 7981 | 662 | 84.4 | globlastp |
| 4665 | LAB324 | lotus\|gb157.2\|AY770397 | 7981 | 662 | 84.4 | globlastp |
| 4666 | LAB324 | nasturtium\|10v1\|SRR032558S0103587 | 7982 | 662 | 83.6 | globlastp |
| 4667 | LAB324 | cichorium\|gb171\|EH686695 | 7983 | 662 | 83.3 | globlastp |
| 4668 | LAB324 | medicago\|09v1\|CRPMT000849 | 7984 | 662 | 83.1 | globlastp |
| 4669 | LAB324 | poplar\|10v1\|BU877006 | 7985 | 662 | 83.1 | globlastp |
| 4670 | LAB324 | monkeyflower\|10v1\|DV209383 | 7986 | 662 | 82.7 | globlastp |
| 4671 | LAB324 | lettuce\|10v1\|DY978967 | 7987 | 662 | 82.4 | globlastp |
| 4672 | LAB324 | dandelion\|gb161\|DY812927 | 7988 | 662 | 82 | globlastp |
| 4673 | LAB324 | poplar\|10v1\|BU876142 | 7989 | 662 | 81.9 | globlastp |
| 4674 | LAB324 | poplar\|gb170\|BU876142 | 7989 | 662 | 81.9 | globlastp |
| 4675 | LAB324 | soybean\|gb168\|BE822733 | 7990 | 662 | 81.8 | globlastp |
| 4676 | LAB324 | soybean\|gb168\|BI970422 | 7991 | 662 | 81.4 | globlastp |
| 4677 | LAB324 | walnuts\|gb166\|CB303585 | 7992 | 662 | 81.3 | globlastp |
| 4678 | LAB324 | peanut\|gb171\|AY517932 | 7993 | 662 | 80.7 | globlastp |
| 4679 | LAB324 | sunflower\|gb162\|DY928057 | 7994 | 662 | 80 | glotblastn |
| 4680 | LAB325 | potato\|gb157.2\|BQ514801 | 7995 | 663 | 94.5 | glotblastn |
| 4681 | LAB325 | solanum_phureja\|09v1\|SPHBG630481 | 7996 | 663 | 94.2 | globlastp |
| 4682 | LAB325 | potato\|10v1\|BQ514801 | 7997 | 663 | 94.2 | globlastp |
| 4683 | LAB325 | potato\|gb157.2\|BM108612 | 7998 | 663 | 88.4 | globlastp |
| 4684 | LAB325 | pepper\|gb171\|BM060738 | 7999 | 663 | 82.4 | globlastp |
| 4685 | LAB326 | potato\|10v1\|BE922713 | 8000 | 664 | 82 | globlastp |
| 4686 | LAB327 | solanum_phureja\|09v1\|SPHBI934696 | 8001 | 665 | 99.5 | globlastp |
| 4687 | LAB327 | tobacco\|gb162\|GFXX79005X1 | 8002 | 665 | 97.8 | globlastp |
| 4688 | LAB327 | cucumber\|09v1\|AA660065 | 8003 | 665 | 95.2 | globlastp |
| 4689 | LAB327 | citrus\|gb166\|CB293061 | 8004 | 665 | 95.2 | globlastp |
| 4690 | LAB327 | cassava\|09v1\|CK642375 | 8005 | 665 | 94.4 | globlastp |
| 4691 | LAB327 | cassava\|gb164\|CK642375 | 8005 | 665 | 94.4 | globlastp |
| 4692 | LAB327 | liriodendron\|gb166\|DT580890 | 8006 | 665 | 94.4 | globlastp |
| 4693 | LAB327 | poplar\|10v1\|AI163141 | 8007 | 665 | 94.4 | globlastp |
| 4694 | LAB327 | poplar\|gb170\|AI163141 | 8007 | 665 | 94.4 | globlastp |
| 4695 | LAB327 | spurge\|gb161\|BI975260 | 8008 | 665 | 94.4 | globlastp |
| 4696 | LAB327 | cucumber\|09v1\|DV632499 | 8009 | 665 | 94.2 | globlastp |
| 4697 | LAB327 | castorbean\|09v1\|EE255332 | 8010 | 665 | 94.2 | globlastp |
| 4698 | LAB327 | castorbean\|gb160\|EE255332 | 8010 | 665 | 94.2 | globlastp |
| 4699 | LAB327 | grape\|gb160\|BQ793182 | 8011 | 665 | 94.2 | globlastp |
| 4700 | LAB327 | strawberry\|gb164\|CO381092 | 8012 | 665 | 94.2 | globlastp |
| 4701 | LAB327 | cotton\|gb164\|AI726446 | 8013 | 665 | 93.9 | globlastp |
| 4702 | LAB327 | cotton\|gb164\|AI730198 | 8014 | 665 | 93.9 | globlastp |
| 4703 | LAB327 | grape\|gb160\|CB917904 | 8015 | 665 | 93.9 | globlastp |
| 4704 | LAB327 | liriodendron\|gb166\|CO998849 | 8016 | 665 | 93.9 | globlastp |
| 4705 | LAB327 | walnuts\|gb166\|CV195060 | 8017 | 665 | 93.9 | globlastp |
| 4706 | LAB327 | cleome_spinosa\|10v1\|GR932329 | 8018 | 665 | 93.7 | globlastp |
| 4707 | LAB327 | eschscholzia\|10v1\|CD476730 | 8019 | 665 | 93.7 | globlastp |
| 4708 | LAB327 | nasturtium\|10v1\|GH163469 | 8020 | 665 | 93.7 | globlastp |
| 4709 | LAB327 | nasturtium\|10v1\|SRR032558S0000854 | 8021 | 665 | 93.7 | globlastp |
| 4710 | LAB327 | nasturtium\|10v1\|SRR032558S0006059 | 8022 | 665 | 93.7 | globlastp |
| 4711 | LAB327 | citrus\|gb166\|CF417897 | 8023 | 665 | 93.7 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4712 | LAB327 | oil_palm\|gb166\|CN600175 | 8024 | 665 | 93.7 | globlastp |
| 4713 | LAB327 | sunflower\|gb162\|CD851809 | 8025 | 665 | 93.7 | globlastp |
| 4714 | LAB327 | monkeyflower\|10v1\|DV208648 | 8026 | 665 | 93.5 | globlastp |
| 4715 | LAB327 | solanum_phureja\|09v1\|SPHBG134543 | 8027 | 665 | 93.5 | globlastp |
| 4716 | LAB327 | apple\|gb171\|AY347787 | 8028 | 665 | 93.5 | globlastp |
| 4717 | LAB327 | apple\|gb171\|CN581798 | 8029 | 665 | 93.5 | globlastp |
| 4718 | LAB327 | aquilegia\|10v1\|DR937723 | 8030 | 665 | 93.5 | globlastp |
| 4719 | LAB327 | aquilegia\|gb157.3\|DR937723 | 8030 | 665 | 93.5 | globlastp |
| 4720 | LAB327 | avocado\|10v1\|CV003076 | 8031 | 665 | 93.5 | globlastp |
| 4721 | LAB327 | avocado\|gb164\|CV003076 | 8031 | 665 | 93.5 | globlastp |
| 4722 | LAB327 | cacao\|gb167\|CU473741 | 8032 | 665 | 93.5 | globlastp |
| 4723 | LAB327 | cotton\|gb164\|AI727813 | 8033 | 665 | 93.5 | globlastp |
| 4724 | LAB327 | nicotiana_benthamiana\|gb162\|CN743455 | 8034 | 665 | 93.5 | globlastp |
| 4725 | LAB327 | poplar\|10v1\|BI120621 | 8035 | 665 | 93.5 | globlastp |
| 4726 | LAB327 | poplar\|gb170\|BI120621 | 8035 | 665 | 93.5 | globlastp |
| 4727 | LAB327 | potato\|gb157.2\|BF460248 | 8027 | 665 | 93.5 | globlastp |
| 4728 | LAB327 | tobacco\|gb162\|AJ632823 | 8036 | 665 | 93.5 | globlastp |
| 4729 | LAB327 | tobacco\|gb162\|X79138 | 8037 | 665 | 93.5 | globlastp |
| 4730 | LAB327 | tomato\|09v1\|BG127387 | 8038 | 665 | 93.5 | globlastp |
| 4731 | LAB327 | tomato\|gb164\|AI637390 | 8038 | 665 | 93.5 | globlastp |
| 4732 | LAB327 | tomato\|09v1\|BG134543 | 8027 | 665 | 93.5 | globlastp |
| 4733 | LAB327 | tomato\|gb164\|BG134543 | 8027 | 665 | 93.5 | globlastp |
| 4734 | LAB327 | solanum_phureja\|09v1\|SPHEG016197 | 8039 | 665 | 93.2 | globlastp |
| 4735 | LAB327 | apple\|gb171\|CN494642 | 8040 | 665 | 93.2 | globlastp |
| 4736 | LAB327 | cichorium\|gb171\|DT212028 | 8041 | 665 | 93.2 | globlastp |
| 4737 | LAB327 | clover\|gb162\|BB939080 | 8042 | 665 | 93.2 | globlastp |
| 4738 | LAB327 | grape\|gb160\|BM437878 | 8043 | 665 | 93.2 | globlastp |
| 4739 | LAB327 | lettuce\|gb157.2\|DW070872 | 8044 | 665 | 93.2 | globlastp |
| 4740 | LAB327 | oak\|gb170\|CU640723 | 8045 | 665 | 93.2 | globlastp |
| 4741 | LAB327 | oil_palm\|gb166\|ES323934 | 8046 | 665 | 93.2 | globlastp |
| 4742 | LAB327 | peanut\|gb171\|CD037791 | 8047 | 665 | 93.2 | globlastp |
| 4743 | LAB327 | potato\|gb157.2\|BF052374 | 8048 | 665 | 93.2 | globlastp |
| 4744 | LAB327 | potato\|gb157.2\|BG350562 | 8048 | 665 | 93.2 | globlastp |
| 4745 | LAB327 | prunus\|gb167\|BU046232 | 8049 | 665 | 93.2 | globlastp |
| 4746 | LAB327 | soybean\|gb168\|AJ388958 | 8050 | 665 | 93.2 | globlastp |
| 4747 | LAB327 | soybean\|gb168\|AW690650 | 8051 | 665 | 93.2 | globlastp |
| 4748 | LAB327 | soybean\|gb168\|AW697016 | 8051 | 665 | 93.2 | globlastp |
| 4749 | LAB327 | tobacco\|gb162\|CV019594 | 8052 | 665 | 93.2 | globlastp |
| 4750 | LAB327 | solanum_phureja\|09v1\|SPHAI637390 | 8053 | 665 | 93 | globlastp |
| 4751 | LAB327 | apple\|gb171\|CN495362 | 8054 | 665 | 93 | globlastp |
| 4752 | LAB327 | artemisia\|10v1\|EY045818 | 8055 | 665 | 93 | globlastp |
| 4753 | LAB327 | cassava\|09v1\|FF380298 | 8056 | 665 | 93 | globlastp |
| 4754 | LAB327 | chestnut\|gb170\|SRR006295S0000341 | 8057 | 665 | 93 | globlastp |
| 4755 | LAB327 | chestnut\|gb170\|SRR006295S0005786 | 8058 | 665 | 93 | globlastp |
| 4756 | LAB327 | cotton\|gb164\|BE054566 | 8059 | 665 | 93 | globlastp |
| 4757 | LAB327 | lettuce\|10v1\|DW089577 | 8060 | 665 | 93 | globlastp |
| 4758 | LAB327 | lotus\|09v1\|LLBG662143 | 8061 | 665 | 93 | globlastp |
| 4759 | LAB327 | medicago\|09v1\|AA660688 | 8062 | 665 | 93 | globlastp |
| 4760 | LAB327 | medicago\|gb157.2\|AA660688 | 8062 | 665 | 93 | globlastp |
| 4761 | LAB327 | melon\|gb165\|DV632499 | 8063 | 665 | 93 | globlastp |
| 4762 | LAB327 | oak\|gb170\|DB996889 | 8064 | 665 | 93 | globlastp |
| 4763 | LAB327 | papaya\|gb165\|AM903981 | 8065 | 665 | 93 | globlastp |
| 4764 | LAB327 | pepper\|gb171\|CA515957 | 8066 | 665 | 93 | globlastp |
| 4765 | LAB327 | poplar\|gb170\|BU871877 | 8067 | 665 | 93 | globlastp |
| 4766 | LAB327 | prunus\|gb167\|BU039863 | 8068 | 665 | 93 | globlastp |
| 4767 | LAB327 | soybean\|gb168\|AL370120 | 8069 | 665 | 93 | globlastp |
| 4768 | LAB327 | sunflower\|gb162\|BU672037 | 8070 | 665 | 93 | globlastp |
| 4769 | LAB327 | sunflower\|gb162\|CD849909 | 8071 | 665 | 93 | globlastp |
| 4770 | LAB327 | tobacco\|gb162\|CV016269 | 8072 | 665 | 93 | globlastp |
| 4771 | LAB327 | poplar\|10v1\|AI163175 | 8073 | 665 | 93 | globlastp |
| 4772 | LAB327 | coffea\|10v1\|DV665562 | 8074 | 665 | 92.8 | globlastp |
| 4773 | LAB327 | coffea\|gb157.2\|DV665562 | 8074 | 665 | 92.8 | globlastp |
| 4774 | LAB327 | cleome_gynandra\|10v1\|SRR015532S0001004 | 8075 | 665 | 92.7 | globlastp |
| 4775 | LAB327 | cacao\|gb167\|EH057828 | 8076 | 665 | 92.7 | globlastp |
| 4776 | LAB327 | castorbean\|09v1\|EE258638 | 8077 | 665 | 92.7 | globlastp |
| 4777 | LAB327 | castorbean\|gb160\|EE258638 | 8077 | 665 | 92.7 | globlastp |
| 4778 | LAB327 | cichorium\|gb171\|DT211464 | 8078 | 665 | 92.7 | globlastp |
| 4779 | LAB327 | cowpea\|gb166\|FC457491 | 8079 | 665 | 92.7 | globlastp |
| 4780 | LAB327 | kiwi\|gb166\|FG403474 | 8080 | 665 | 92.7 | globlastp |
| 4781 | LAB327 | medicago\|09v1\|BE239304 | 8081 | 665 | 92.7 | globlastp |
| 4782 | LAB327 | medicago\|gb157.2\|BE239304 | 8081 | 665 | 92.7 | globlastp |
| 4783 | LAB327 | petunia\|gb171\|CV293104 | 8082 | 665 | 92.7 | globlastp |

TABLE 54-continued

Homologues of the identified genes/polypeptides for increasing abiotic stress
tolerance, water use efficiency, yield, growth rate, vigor, oil content, biomass, growth
rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4784 | LAB327 | poplar\|10v1\|BU871877 | 8083 | 665 | 92.7 | globlastp |
| 4785 | LAB327 | soybean\|gb168\|AA660688 | 8084 | 665 | 92.7 | globlastp |
| 4786 | LAB327 | soybean\|gb168\|AL379116 | 8085 | 665 | 92.7 | globlastp |
| 4787 | LAB327 | soybean\|gb168\|BI420953 | 8086 | 665 | 92.7 | globlastp |
| 4788 | LAB327 | strawberry\|gb164\|CO380304 | 8087 | 665 | 92.7 | globlastp |
| 4789 | LAB327 | cassava\|09v1\|JGICASSAVA37390VALIDM1 | 8088 | 665 | 92.5 | globlastp |
| 4790 | LAB327 | pea\|09v1\|CD859558 | 8089 | 665 | 92.5 | globlastp |
| 4791 | LAB327 | artemisia\|gb164\|EY045818 | 8090 | 665 | 92.5 | globlastp |
| 4792 | LAB327 | artemisia\|10v1\|EY084194 | 8091 | 665 | 92.5 | globlastp |
| 4793 | LAB327 | artemisia\|gb164\|EY084194 | 8091 | 665 | 92.5 | globlastp |
| 4794 | LAB327 | bean\|gb167\|CA898099 | 8092 | 665 | 92.5 | globlastp |
| 4795 | LAB327 | ginger\|gb164\|DY344990 | 8093 | 665 | 92.5 | globlastp |
| 4796 | LAB327 | prunus\|gb167\|BU039728 | 8094 | 665 | 92.5 | globlastp |
| 4797 | LAB327 | soybean\|gb168\|AW586495 | 8095 | 665 | 92.5 | globlastp |
| 4798 | LAB327 | soybean\|gb168\|CD415289 | 8096 | 665 | 92.5 | globlastp |
| 4799 | LAB327 | tomato\|09v1\|BG135965 | 8097 | 665 | 92.5 | globlastp |
| 4800 | LAB327 | tomato\|gb164\|BG135965 | 8097 | 665 | 92.5 | globlastp |
| 4801 | LAB327 | jatropha\|09v1\|GO247020 | 8098 | 665 | 92.3 | globlastp |
| 4802 | LAB327 | cowpea\|gb166\|FF382852 | 8099 | 665 | 92.3 | globlastp |
| 4803 | LAB327 | cowpea\|gb166\|FF394250 | 8100 | 665 | 92.3 | globlastp |
| 4804 | LAB327 | lotus\|09v1\|BI420953 | 8101 | 665 | 92.3 | globlastp |
| 4805 | LAB327 | lotus\|gb157.2\|BI420953 | 8101 | 665 | 92.3 | globlastp |
| 4806 | LAB327 | oak\|gb170\|CU656288 | 8102 | 665 | 92.3 | globlastp |
| 4807 | LAB327 | potato\|10v1\|BE924067 | 8103 | 665 | 92.3 | globlastp |
| 4808 | LAB327 | tobacco\|gb162\|X79137 | 8104 | 665 | 92.3 | globlastp |
| 4809 | LAB327 | canola\|10v1\|CD836425 | 8105 | 665 | 92.3 | globlastp |
| 4810 | LAB327 | arabidopsis_lyrata\|09v1\|JGIAL004953 | 8106 | 665 | 92 | globlastp |
| 4811 | LAB327 | arabidopsis_lyrata\|09v1\|JGIAL009850 | 8107 | 665 | 92 | globlastp |
| 4812 | LAB327 | monkeyflower\|10v1\|DV206993 | 8108 | 665 | 92 | globlastp |
| 4813 | LAB327 | oat\|10v1\|GO586168 | 8109 | 665 | 92 | globlastp |
| 4814 | LAB327 | arabidopsis\|gb165\|AT3G13920 | 8110 | 665 | 92 | globlastp |
| 4815 | LAB327 | canola\|gb161\|CD823763 | 8111 | 665 | 92 | globlastp |
| 4816 | LAB327 | cenchrus\|gb166\|EB653990 | 8112 | 665 | 92 | globlastp |
| 4817 | LAB327 | chestnut\|gb170\|SRR006295S0005347 | 8113 | 665 | 92 | globlastp |
| 4818 | LAB327 | kiwi\|gb166\|FG403265 | 8114 | 665 | 92 | globlastp |
| 4819 | LAB327 | maize\|gb170\|ZMU73459 | 8115 | 665 | 92 | globlastp |
| 4820 | LAB327 | medicago\|09v1\|AW256944 | 8116 | 665 | 92 | globlastp |
| 4821 | LAB327 | medicago\|gb157.2\|AW256944 | 8116 | 665 | 92 | globlastp |
| 4822 | LAB327 | pepper\|gb171\|BM065705 | 8117 | 665 | 92 | globlastp |
| 4823 | LAB327 | sorghum\|09v1\|SB10G028940 | 8118 | 665 | 92 | globlastp |
| 4824 | LAB327 | sorghum\|gb161.crp\|ZMU73459 | 8118 | 665 | 92 | globlastp |
| 4825 | LAB327 | sugarcane\|gb157.3\|AA525682 | 8119 | 665 | 92 | globlastp |
| 4826 | LAB327 | switchgrass\|gb167\|FE602797 | 8120 | 665 | 92 | globlastp |
| 4827 | LAB327 | oat\|10v1\|GO581813 | 8121 | 665 | 91.8 | globlastp |
| 4828 | LAB327 | b_oleracea\|gb161\|AM386369 | 8122 | 665 | 91.8 | globlastp |
| 4829 | LAB327 | b_oleracea\|gb161\|AM387779 | 8123 | 665 | 91.8 | globlastp |
| 4830 | LAB327 | b_rapa\|gb162\|BQ790684 | 8123 | 665 | 91.8 | globlastp |
| 4831 | LAB327 | barley\|10v1\|BE427740 | 8124 | 665 | 91.8 | globlastp |
| 4832 | LAB327 | barley\|gb157SOLEXA\|BE427740 | 8124 | 665 | 91.8 | globlastp |
| 4833 | LAB327 | bean\|gb167\|CA898100 | 8125 | 665 | 91.8 | globlastp |
| 4834 | LAB327 | brachypodium\|09v1\|DV470402 | 8126 | 665 | 91.8 | globlastp |
| 4835 | LAB327 | brachypodium\|gb1691Z21510 | 8126 | 665 | 91.8 | globlastp |
| 4836 | LAB327 | canola\|gb161\|CD813607 | 8123 | 665 | 91.8 | globlastp |
| 4837 | LAB327 | canola\|gb161\|CD822634 | 8127 | 665 | 91.8 | globlastp |
| 4838 | LAB327 | canola\|gb161\|CD836953 | 8123 | 665 | 91.8 | globlastp |
| 4839 | LAB327 | cowpea\|gb166\|FF382264 | 8128 | 665 | 91.8 | globlastp |
| 4840 | LAB327 | kiwi\|gb166\|FG397118 | 8129 | 665 | 91.8 | globlastp |
| 4841 | LAB327 | lotus\|09v1\|BP036168 | 8130 | 665 | 91.8 | globlastp |
| 4842 | LAB327 | maize\|gb170\|AF007580 | 8131 | 665 | 91.8 | globlastp |
| 4843 | LAB327 | soybean\|gb168\|CA783189 | 8132 | 665 | 91.8 | globlastp |
| 4844 | LAB327 | sugarcane\|gb157.3\|CA071075 | 8133 | 665 | 91.8 | globlastp |
| 4845 | LAB327 | switchgrass\|gb167\|FE602798 | 8134 | 665 | 91.8 | globlastp |
| 4846 | LAB327 | triphysaria\|10v1\|BE574917 | 8135 | 665 | 91.8 | globlastp |
| 4847 | LAB327 | wheat\|gb164\|BE398943 | 8136 | 665 | 91.8 | globlastp |
| 4848 | LAB327 | wheat\|gb164\|BE400861 | 8137 | 665 | 91.8 | globlastp |
| 4849 | LAB327 | wheat\|gb164\|BE402776 | 8136 | 665 | 91.8 | globlastp |
| 4850 | LAB327 | wheat\|gb164\|Z21510 | 8124 | 665 | 91.8 | globlastp |
| 4851 | LAB327 | sugarcane\|10v1\|CA071075 | 8133 | 665 | 91.8 | globlastp |
| 4852 | LAB327 | orobanche\|10v1\|SRR023189S0018945 | 8138 | 665 | 91.5 | globlastp |
| 4853 | LAB327 | arabidopsis\|gb165\|AT1G54270 | 8139 | 665 | 91.5 | globlastp |
| 4854 | LAB327 | barley\|gb157SOLEXA\|BE411837 | 8140 | 665 | 91.5 | globlastp |
| 4855 | LAB327 | canola\|gb161\|DY030421 | 8141 | 665 | 91.5 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4856 | LAB327 | canola\|gb161\|EG020438 | 8141 | 665 | 91.5 | globlastp |
| 4857 | LAB327 | cotton\|gb164\|AI728255 | 8142 | 665 | 91.5 | globlastp |
| 4858 | LAB327 | millet\|09v1\|DQ013263 | 8143 | 665 | 91.5 | globlastp |
| 4859 | LAB327 | rice\|gb170\|OS02G05330 | 8144 | 665 | 91.5 | globlastp |
| 4860 | LAB327 | sorghum\|09v1\|SB04G003390 | 8145 | 665 | 91.5 | globlastp |
| 4861 | LAB327 | sorghum\|gb161.crp\|ZMU17979 | 8145 | 665 | 91.5 | globlastp |
| 4862 | LAB327 | barley\|10v1\|BE411837 | 8140 | 665 | 91.5 | globlastp |
| 4863 | LAB327 | canola\|10v1\|EE456605 | 8146 | 665 | 91.5 | globlastp |
| 4864 | LAB327 | artemisia\|gb164\|EY063986 | 8147 | 665 | 91.3 | globlastp |
| 4865 | LAB327 | canola\|10v1\|CD822634 | 8148 | 665 | 91.3 | globlastp |
| 4866 | LAB327 | canola\|10v1\|DY002101 | 8148 | 665 | 91.3 | globlastp |
| 4867 | LAB327 | leymus\|gb166\|CD808554 | 8149 | 665 | 91.3 | globlastp |
| 4868 | LAB327 | rice\|gb170\|OS06G48750 | 8150 | 665 | 91.3 | globlastp |
| 4869 | LAB327 | millet\|gb161\|DQ013263 | 8151 | 665 | 91.1 | globlastp |
| 4870 | LAB327 | lettuce\|gb157.2\|DW047925 | 8152 | 665 | 91.04 | glotblastn |
| 4871 | LAB327 | cowpea\|gb166\|FC458343 | 8153 | 665 | 91 | globlastp |
| 4872 | LAB327 | maize\|gb170\|LLZMU17979 | 8154 | 665 | 91 | globlastp |
| 4873 | LAB327 | b_oleracea\|gb161\|GFXAF180356X1 | 8155 | 665 | 90.8 | globlastp |
| 4874 | LAB327 | bean\|gb167\|CA905627 | 8156 | 665 | 90.8 | globlastp |
| 4875 | LAB327 | canola\|10v1\|CD837669 | 8157 | 665 | 90.8 | globlastp |
| 4876 | LAB327 | canola\|gb161\|CD837669 | 8157 | 665 | 90.8 | globlastp |
| 4877 | LAB327 | cenchrus\|gb166\|BM084681 | 8158 | 665 | 90.8 | globlastp |
| 4878 | LAB327 | nuphar\|gb166\|CD474917 | 8159 | 665 | 90.8 | globlastp |
| 4879 | LAB327 | triphysaria\|10v1\|BE574926 | 8160 | 665 | 90.8 | globlastp |
| 4880 | LAB327 | triphysaria\|gb164\|BE574926 | 8161 | 665 | 90.6 | globlastp |
| 4881 | LAB327 | monkeyflower\|10v1\|DV210546 | 8162 | 665 | 90.3 | globlastp |
| 4882 | LAB327 | cycas\|gb166\|CB088419 | 8163 | 665 | 90.3 | globlastp |
| 4883 | LAB327 | poplar\|gb170\|BU814784 | 8164 | 665 | 90.1 | globlastp |
| 4884 | LAB327 | millet\|09v1\|EVO454PM015209 | 8165 | 665 | 89.6 | globlastp |
| 4885 | LAB327 | pea\|09v1\|AY167671 | 8166 | 665 | 89.6 | globlastp |
| 4886 | LAB327 | potato\|10v1\|BF460248 | 8167 | 665 | 89.6 | globlastp |
| 4887 | LAB327 | potato\|10v1\|BG350562 | 8168 | 665 | 89.6 | globlastp |
| 4888 | LAB327 | safflower\|gb162\|EL375669 | 8169 | 665 | 89.59 | glotblastn |
| 4889 | LAB327 | canola\|10v1\|CD813607 | 8170 | 665 | 89.5 | globlastp |
| 4890 | LAB327 | canola\|10v1\|CD836953 | 8171 | 665 | 89.3 | globlastp |
| 4891 | LAB327 | aquilegia\|10v1\|DR917189 | 8172 | 665 | 89.3 | globlastp |
| 4892 | LAB327 | aquilegia\|gb157.31DR917189 | 8172 | 665 | 89.3 | globlastp |
| 4893 | LAB327 | iceplant\|gb164\|BE036146 | 8173 | 665 | 89.3 | globlastp |
| 4894 | LAB327 | triphysaria\|10v1\|EY006504 | 8174 | 665 | 89.1 | globlastp |
| 4895 | LAB327 | lettuce\|gb157.2\|DW104332 | 8175 | 665 | 88.9 | globlastp |
| 4896 | LAB327 | physcomitrella\|10v1\|AW145733 | 8176 | 665 | 88.6 | globlastp |
| 4897 | LAB327 | cacao\|gb167\|CU512667 | 8177 | 665 | 88.6 | globlastp |
| 4898 | LAB327 | marchantia\|gb166\|C96517 | 8178 | 665 | 88.6 | globlastp |
| 4899 | LAB327 | physcomitrella\|gb157\|AW145733 | 8176 | 665 | 88.6 | globlastp |
| 4900 | LAB327 | pine\|10v1\|AA556416 | 8179 | 665 | 88.6 | globlastp |
| 4901 | LAB327 | pine\|gb157.2\|AA556416 | 8179 | 665 | 88.6 | globlastp |
| 4902 | LAB327 | spruce\|gb162\|CO218039 | 8180 | 665 | 88.6 | globlastp |
| 4903 | LAB327 | canola\|10v1\|DY030421 | 8181 | 665 | 88.5 | globlastp |
| 4904 | LAB327 | arabidopsis_lyrata\|09v1\|JGIAL007533 | 8182 | 665 | 88.4 | globlastp |
| 4905 | LAB327 | arabidopsis\|gb165\|AT1G72730 | 8183 | 665 | 88.4 | globlastp |
| 4906 | LAB327 | canola\|10v1\|EG020438 | 8184 | 665 | 88.1 | globlastp |
| 4907 | LAB327 | lolium\|10v1\|AU250857 | 8185 | 665 | 87.9 | globlastp |
| 4908 | LAB327 | physcomitrella\|10v1\|AW477079 | 8186 | 665 | 87.9 | globlastp |
| 4909 | LAB327 | physcomitrella\|10v1\|BG409334 | 8187 | 665 | 87.9 | globlastp |
| 4910 | LAB327 | physcomitrella\|gb157\|AW477079 | 8186 | 665 | 87.9 | globlastp |
| 4911 | LAB327 | physcomitrella\|gb157\|BG409334 | 8187 | 665 | 87.9 | globlastp |
| 4912 | LAB327 | centaurea\|gb166\|EH763543 | 8188 | 665 | 87.7 | globlastp |
| 4913 | LAB327 | physcomitrella\|10v1\|AJ225463 | 8189 | 665 | 87.7 | globlastp |
| 4914 | LAB327 | lovegrass\|gb167\|DN483216 | 8190 | 665 | 87.7 | globlastp |
| 4915 | LAB327 | physcomitrella\|gb157\|AW561235 | 8189 | 665 | 87.7 | globlastp |
| 4916 | LAB327 | tomato\|09v1\|CRPSP014772 | 8191 | 665 | 87.4 | globlastp |
| 4917 | LAB327 | castorbean\|09v1\|XM002524260 | 8192 | 665 | 87.4 | globlastp |
| 4918 | LAB327 | castorbean\|gb160\|MDL29863M001062 | 8192 | 665 | 87.4 | globlastp |
| 4919 | LAB327 | canola\|gb161\|CD826344 | 8193 | 665 | 87.2 | globlastp |
| 4920 | LAB327 | b_rapa\|gb162\|EX037330 | 8194 | 665 | 87 | globlastp |
| 4921 | LAB327 | spikemoss\|gb165\|FE431394 | 8195 | 665 | 86.7 | globlastp |
| 4922 | LAB327 | spikemoss\|gb165\|FE439012 | 8195 | 665 | 86.7 | globlastp |
| 4923 | LAB327 | cotton\|gb164\|AI055309 | 8196 | 665 | 86.4 | globlastp |
| 4924 | LAB327 | catharanthus\|gb166\|EG558000 | 8197 | 665 | 86.2 | globlastp |
| 4925 | LAB327 | canola\|10v1\|CD826344 | 8198 | 665 | 85.3 | globlastp |
| 4926 | LAB327 | artemisia\|10v1\|EY063986 | 8199 | 665 | 85.2 | globlastp |
| 4927 | LAB327 | spikemoss\|gb165\|FE428260 | 8200 | 665 | 85.2 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 4928 | LAB327 | bean\|gb167\|CA905225 | 8201 | 665 | 85 | globlastp |
| 4929 | LAB327 | b_rapa\|gb162\|CV650421 | 8202 | 665 | 84.8 | globlastp |
| 4930 | LAB327 | orobanche\|10v1\|SRR023189S0021240 | 8203 | 665 | 84.5 | glotblastn |
| 4931 | LAB327 | pine\|10v1\|AI812354 | 8204 | 665 | 84.5 | globlastp |
| 4932 | LAB327 | pine\|gb157.2\|AI812354 | 8204 | 665 | 84.5 | globlastp |
| 4933 | LAB327 | pine\|10v1\|AW011098 | 8205 | 665 | 84.5 | globlastp |
| 4934 | LAB327 | pine\|gb157.2\|AW011098 | 8205 | 665 | 84.5 | globlastp |
| 4935 | LAB327 | radish\|gb164\|EV540574 | 8206 | 665 | 84.5 | globlastp |
| 4936 | LAB327 | iceplant\|gb164\|BE034440 | 8207 | 665 | 84.3 | globlastp |
| 4937 | LAB327 | spruce\|gb162\|CO242602 | 8208 | 665 | 84.3 | globlastp |
| 4938 | LAB327 | mesostigma\|gb166\|DN254955 | 8209 | 665 | 84 | globlastp |
| 4939 | LAB327 | peanut\|gb171\|CD038335 | 8210 | 665 | 84 | globlastp |
| 4940 | LAB327 | spruce\|gb162\|CK444474 | 8211 | 665 | 84 | globlastp |
| 4941 | LAB327 | spruce\|gb162\|CO216603 | 8212 | 665 | 83.8 | globlastp |
| 4942 | LAB327 | chlamydomonas\|gb162\|AI670453 | 8213 | 665 | 83.5 | globlastp |
| 4943 | LAB327 | pine\|10v1\|AA557094 | 8214 | 665 | 83.5 | globlastp |
| 4944 | LAB327 | pine\|gb157.2\|AA557094 | 8214 | 665 | 83.5 | globlastp |
| 4945 | LAB327 | volvox\|gb162\|AI670453 | 8215 | 665 | 82.5 | globlastp |
| 4946 | LAB327 | dandelion\|gb161\|DY820664 | 8216 | 665 | 82.08 | glotblastn |
| 4947 | LAB327 | b_rapa\|gb162\|CX267240 | 8217 | 665 | 81.2 | globlastp |
| 4948 | LAB327 | switchgrass\|gb167\|FE601743 | 8218 | 665 | 81.1 | globlastp |
| 4949 | LAB327 | ostreococcus\|gb162\|XM001418935 | 8219 | 665 | 80.6 | globlastp |
| 4950 | LAB327 | pseudoroegneria\|gb167\|FF346170 | 8220 | 665 | 80.6 | globlastp |
| 4951 | LAB327 | sugarcane\|10v1\|AA525682 | 8221 | 665 | 80.1 | globlastp |
| 4952 | LAB329 | solanum_phureja\|09v1\|SPHAA076679 | 8222 | 666 | 81 | globlastp |
| 4953 | LAB329 | potato\|gb157.2\|BG600407 | 8222 | 666 | 81 | globlastp |
| 4954 | LAB335 | pseudoroegneria\|gb167\|FF348025 | 8223 | 667 | 98.18 | glotblastn |
| 4955 | LAB335 | wheat\|gb164\|BE430022 | 8224 | 667 | 97.4 | globlastp |
| 4956 | LAB335 | barley\|gb157SOLEXA\|AL502372 | 8225 | 667 | 97.1 | globlastp |
| 4957 | LAB335 | barley\|10v1\|BE420777XX1 | 8225 | 667 | 97.1 | globlastp |
| 4958 | LAB335 | brachypodium\|09v1\|DV477130 | 8226 | 667 | 86.2 | globlastp |
| 4959 | LAB335 | rice\|gb170\|OS06G33710 | 8227 | 667 | 84.2 | globlastp |
| 4960 | LAB335 | switchgrass\|gb167\|FE658978 | 8228 | 667 | 82.5 | globlastp |
| 4961 | LAB335 | brachypodium\|gb169\|BE430022 | 8229 | 667 | 82.3 | globlastp |
| 4962 | LAB335 | switchgrass\|gb167\|FE632114 | 8230 | 667 | 82 | globlastp |
| 4963 | LAB335 | switchgrass\|gb167\|DN143077 | 8231 | 667 | 81.9 | globlastp |
| 4964 | LAB335 | sorghum\|09v1\|SB10G020570 | 8232 | 667 | 81.7 | globlastp |
| 4965 | LAB335 | sorghum\|gb161.crp\|AI977976 | 8232 | 667 | 81.7 | globlastp |
| 4966 | LAB335 | maize\|gb170\|AI649774 | 8233 | 667 | 81.2 | globlastp |
| 4967 | LAB335 | sorghum\|09v1\|SB04G009230 | 8234 | 667 | 80.8 | globlastp |
| 4968 | LAB335 | sorghum\|gb161.crp\|AI987556 | 8234 | 667 | 80.8 | globlastp |
| 4969 | LAB335 | sorghum\|09v1\|SB04G001510 | 8235 | 667 | 80.46 | glotblastn |
| 4970 | LAB335 | sorghum\|gb161.crp\|BE918485 | 8235 | 667 | 80.46 | glotblastn |
| 4971 | LAB336 | wheat\|gbl64\|CK211137 | 8236 | 668 | 98.67 | glotblastn |
| 4972 | LAB336 | barley\|10v1\|BE213707 | 8237 | 668 | 89.3 | globlastp |
| 4973 | LAB336 | barley\|gb157SOLEXA\|BE213707 | 8237 | 668 | 89.3 | globlastp |
| 4974 | LAB336 | barley\|10v1\|BE193842 | 8238 | 668 | 86.7 | globlastp |
| 4975 | LAB336 | barley\|gb157SOLEXA\|BE193842 | 8238 | 668 | 86.7 | globlastp |
| 4976 | LAB337 | wheat\|gb164\|BE605188 | 8239 | 669 | 98.5 | globlastp |
| 4977 | LAB337 | wheat\|gb164\|CA711145 | 8240 | 669 | 97.1 | globlastp |
| 4978 | LAB337 | barley\|10v1\|BI947303 | 8241 | 669 | 95.6 | globlastp |
| 4979 | LAB337 | barley\|gb157SOLEXA\|BI947303 | 8241 | 669 | 95.6 | globlastp |
| 4980 | LAB337 | pseudoroegneria\|gb167\|FF341367 | 8242 | 669 | 92.8 | globlastp |
| 4981 | LAB339 | wheat\|gb164\|BM138484 | 8243 | 670 | 97.9 | globlastp |
| 4982 | LAB339 | pseudoroegneria\|gb167\|FF344192 | 8244 | 670 | 95.4 | globlastp |
| 4983 | LAB339 | barley\|10v1\|AV835301 | 8245 | 670 | 95.2 | globlastp |
| 4984 | LAB339 | barley\|gb157SOLEXA\|AL501112 | 8245 | 670 | 95.2 | globlastp |
| 4985 | LAB339 | oat\|10v1\|GR350608 | 8246 | 670 | 89.8 | globlastp |
| 4986 | LAB340 | brachypodium\|09v1\|GT766551 | 8247 | 671 | 82.91 | glotblastn |
| 4987 | LAB342 | lolium\|10v1\|ES699371 | 8248 | 672 | 86 | globlastp |
| 4988 | LAB342 | barley\|10v1\|AW982420 | 8249 | 672 | 82 | globlastp |
| 4989 | LAB342 | barley\|gb157SOLEXA\|AW982420 | 8250 | 672 | 80.86 | glotblastn |
| 4990 | LAB343 | b_rapa\|gb162\|DY013496 | 8251 | 673 | 95.6 | globlastp |
| 4991 | LAB343 | canola\|gb161\|CD831099 | 8252 | 673 | 94.4 | globlastp |
| 4992 | LAB343 | radish\|gb164\|EV526960 | 8253 | 673 | 86.7 | globlastp |
| 4993 | LAB343 | radish\|gb164\|EV546393 | 8254 | 673 | 85.7 | globlastp |
| 4994 | LAB343 | canola\|gb161\|DY023342 | 8255 | 673 | 85.5 | globlastp |
| 4995 | LAB343 | canola\|10v1\|EG019883 | 8256 | 673 | 85.1 | globlastp |
| 4996 | LAB343 | canola\|10v1\|EE483904 | 8257 | 673 | 85.1 | globlastp |
| 4997 | LAB343 | canola\|gb161\|EE483904 | 8257 | 673 | 85.1 | globlastp |
| 4998 | LAB343 | radish\|gb164\|EV529074 | 8258 | 673 | 84.5 | globlastp |
| 4999 | LAB343 | canola\|10v1\|DY023342 | 8259 | 673 | 84.34 | glotblastn |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 5000 | LAB343 | arabidopsis\|gb165\|AT3G07880 | 8260 | 673 | 84 | globlastp |
| 5001 | LAB343 | radish\|gb164\|EX770997 | 8261 | 673 | 83.3 | globlastp |
| 5002 | LAB343 | arabidopsis_lyrata\|09v1\|JGIAL009219 | 8262 | 673 | 83.1 | globlastp |
| 5003 | LAB343 | radish\|gb164\|EW713645 | 8263 | 673 | 80.7 | globlastp |
| 5004 | LAB344 | sugarcane\|10v1\|CA081767 | 8264 | 674 | 84.4 | globlastp |
| 5005 | LAB344 | sugarcane\|gb157.3\|CA075762 | 8265 | 674 | 83.41 | glotblastn |
| 5006 | LAB344 | sorghum\|gb161.crp\|BE917776 | 8266 | 674 | 81.4 | globlastp |
| 5007 | LAB344 | sorghum\|09v1\|SB06G029650 | 8266 | 674 | 81.4 | globlastp |
| 5008 | LAB344 | sugarcane\|gb157.3\|CA075840 | 8267 | 674 | 80.95 | glotblastn |
| 5009 | LAB349 | soybean\|gb168\|BE824094 | 8268 | 679 | 89.3 | globlastp |
| 5010 | LAB352 | barley\|gb157SOLEXA\|BF628371 | 8269 | 681 | 98.1 | globlastp |
| 5011 | LAB352 | barley\|10v1\|BF628371 | 8269 | 681 | 98.1 | globlastp |
| 5012 | LAB352 | leymus\|gb166\|EG375949 | 8270 | 681 | 97.5 | globlastp |
| 5013 | LAB352 | brachypodium\|09v1\|DV478509 | 8271 | 681 | 80.7 | globlastp |
| 5014 | LAB353 | barley\|10v1\|BM816694 | 8272 | 682 | 85.9 | globlastp |
| 5015 | LAB353 | barley\|gb157SOLEXA\|BM816694 | 8272 | 682 | 85.9 | globlastp |
| 5016 | LAB355 | barley\|10v1\|AV908964 | 8273 | 683 | 91.6 | globlastp |
| 5017 | LAB355 | barley\|gb157SOLEXA\|AV908964 | 8273 | 683 | 91.6 | globlastp |
| 5018 | LAB355 | wheat\|gb164\|BE499690 | 8274 | 683 | 84.7 | globlastp |
| 5019 | LAB355 | rice\|gb170\|OS08G38780 | 8275 | 683 | 83.7 | globlastp |
| 5020 | LAB355 | brachypodium\|gb169\|BE494994 | 8276 | 683 | 82.3 | globlastp |
| 5021 | LAB355 | brachypodium\|09v1\|GFXAM072969X2 | 8276 | 683 | 82.3 | globlastp |
| 5022 | LAB355 | sorghum\|09v1\|SB02G027870 | 8277 | 683 | 82.2 | globlastp |
| 5023 | LAB355 | sorghum\|gb161.crp\|BF507008 | 8277 | 683 | 82.2 | globlastp |
| 5024 | LAB355 | barley\|gb157SOLEXA\|BM100516 | 8278 | 683 | 81.8 | globlastp |
| 5025 | LAB355 | maize\|gb170\|AI783410 | 8279 | 683 | 81.7 | globlastp |
| 5026 | LAB355 | sorghum\|09v1\|SB07G028600 | 8280 | 683 | 81.6 | globlastp |
| 5027 | LAB355 | maize\|gb170\|AI372324 | 8281 | 683 | 81.6 | globlastp |
| 5028 | LAB355 | sorghum\|gb161.crp\|AI372324 | 8280 | 683 | 81.6 | globlastp |
| 5029 | LAB367 | b_oleracea\|gb161\|DY025911 | 8282 | 684 | 97.2 | globlastp |
| 5030 | LAB367 | thellungiella\|gb167\|BY818625 | 8283 | 684 | 95.8 | globlastp |
| 5031 | LAB367 | arabidopsis_lyrata\|09v1\|JGIAL015133 | 8284 | 684 | 93.71 | glotblastn |
| 5032 | LAB367 | arabidopsis\|gb165\|AT2G38880 | 8284 | 684 | 93.71 | glotblastn |
| 5033 | LAB367 | radish\|gb164\|EV527174 | 8285 | 684 | 89.5 | globlastp |
| 5034 | LAB367 | cleome_gynandra\|10v1\|SRR015532S0028391 | 8286 | 684 | 84.6 | globlastp |
| 5035 | LAB381 | poplar\|gb170\|BI129814 | 8287 | 685 | 94.86 | glotblastn |
| 5036 | LAB381 | cassava\|gb164\|CK645876 | 8288 | 685 | 90.8 | globlastp |
| 5037 | LAB381 | castorbean\|gb160\|EG665628 | 8289 | 685 | 90.8 | glotblastn |
| 5038 | LAB381 | castorbean\|09v1\|EG665628 | 8290 | 685 | 90.8 | globlastp |
| 5039 | LAB381 | citrus\|gb166\|CB290512 | 8291 | 685 | 85.7 | globlastp |
| 5040 | LAB381 | nasturtium\|10v1\|SRR032558S0015243 | 8292 | 685 | 85.1 | globlastp |
| 5041 | LAB381 | cotton\|gb164\|AI728916 | 8293 | 685 | 81.1 | globlastp |
| 5042 | LAB383 | soybean\|gb168\|BE821922 | 8294 | 686 | 95.9 | globlastp |
| 5043 | LAB383 | medicago\|09v1\|AL387357 | 8295 | 686 | 85.1 | globlastp |
| 5044 | LAB55 | rye\|gb164\|BF145456 | 8296 | 690 | 93.48 | glotblastn |
| 5045 | LAB55 | millet\|09v1\|EVO454PM000227 | 8297 | 690 | 86.96 | glotblastn |
| 5046 | LAB55 | wheat\|gb164\|CA484197 | 8298 | 690 | 84.8 | globlastp |
| 5047 | LAB55 | fescue\|gb161\|DT713184 | 8299 | 690 | 83.7 | glotblastn |
| 5048 | LAB55 | wheat\|gb164\|CK208158 | 8300 | 690 | 83.7 | glotblastn |
| 5049 | LAB72 | papaya\|gb165\|EX239264 | 8301 | 694 | 82.35 | glotblastn |
| 5050 | LAB72 | citrus\|gb166\|CK740017 | 8302 | 694 | 80.95 | glotblastn |
| 5051 | LAB72 | castorbean\|09v1\|XM002510905 | 8303 | 694 | 80.88 | glotblastn |
| 5052 | LAB72 | castorbean\|gb160\|MDL30147M014220 | 8303 | 694 | 80.88 | glotblastn |
| 5053 | LAB72 | cassava\|gb164\|V447303 | 8304 | 694 | 80.51 | glotblastn |
| 5054 | LAB120 | pepper\|gb171\|CA522804 | 8305 | 700 | 86.3 | globlastp |
| 5055 | LAB120 | solanum_phureja\|09v1\|SPHAK320985 | 8306 | 700 | 81.23 | glotblastn |
| 5056 | LAB120 | nasturtium\|10v1\|SRR032558S0243931 | 8307 | 700 | 80 | glotblastn |
| 5057 | LAB221 | sorghum\|09v1\|SB02G038960 | 8308 | 711 | 86.7 | globlastp |
| 5058 | LAB221 | sorghum\|gb161.crp\|SBGWP022909 | 8308 | 711 | 86.7 | globlastp |
| 5059 | LAB221 | maize\|gb170\|AW231650 | 8309 | 711 | 85.1 | globlastp |
| 5060 | LAB293 | maize\|gb170\|AI629471 | 8310 | 715 | 89.2 | globlastp |
| 5061 | LAB293 | rice\|gb170\|OS08G33740 | 8311 | 715 | 86.7 | glotblastn |
| 5062 | LAB293 | brachypodium\|09v1\|GT829942 | 8312 | 715 | 85.22 | glotblastn |
| 5063 | LAB293 | brachypodium\|gb169\|BF257470 | 8313 | 715 | 84.1 | globlastp |
| 5064 | LAB293 | switchgrass\|gb167\|FE656679 | 8314 | 715 | 83.5 | globlastp |
| 5065 | LAB293 | wheat\|gb164\|CA627636 | 8315 | 715 | 82.5 | globlastp |
| 5066 | LAB300 | sorghum\|09v1\|SB05G002450 | 8316 | 719 | 95.7 | glotblastn |
| 5067 | LAB300 | sorghum\|gb161.crp\|BF421813 | 8316 | 719 | 95.7 | glotblastn |
| 5068 | LAB300 | maize\|gb170\|AW120452 | 8317 | 719 | 92.47 | glotblastn |
| 5069 | LAB300 | sugarcane\|10v1\|BU103524 | 8318 | 719 | 92.47 | glotblastn |
| 5070 | LAB300 | sugarcane\|gb157.3\|BU103524 | 8319 | 719 | 92.47 | glotblastn |
| 5071 | LAB300 | maize\|gb170\|BQ035158 | 8320 | 719 | 90.32 | glotblastn |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 5072 | LAB300 | switchgrass\|gb167\|FE618131 | 8321 | 719 | 87.1 | glotblastn |
| 5073 | LAB300 | millet\|09v1\|EVO454PM051167 | 8322 | 719 | 86.02 | glotblastn |
| 5074 | LAB300 | rice\|gb170\|OS12G04290 | 8323 | 719 | 86.02 | glotblastn |
| 5075 | LAB300 | switchgrass\|gb167\|DN141039 | 8324 | 719 | 86.02 | glotblastn |
| 5076 | LAB300 | rice\|gb170\|OS11G04520 | 8325 | 719 | 84.95 | glotblastn |
| 5077 | LAB300 | oat\|10v1\|GR349530 | 8326 | 719 | 82.8 | glotblastn |
| 5078 | LAB300 | brachypodium\|09v1\|GT778679 | 8327 | 719 | 80.65 | glotblastn |
| 5079 | LAB300 | brachypodium\|gb169\|BE496864 | 8328 | 719 | 80.65 | glotblastn |
| 5080 | LAB300 | wheat\|gb164\|BE416393 | 8329 | 719 | 80.65 | glotblastn |
| 5081 | LAB311 | cichorium\|gb171\|DT211930 | 8330 | 721 | 83.71 | glotblastn |
| 5082 | LAB311 | dandelion\|gb161\|DY828396 | 8331 | 721 | 81.47 | glotblastn |
| 5083 | LAB316 | petunia\|gb171\|CV292888 | 8332 | 723 | 87.61 | glotblastn |
| 5084 | LAB316 | triphysaria\|10v1\|DR175232 | 8333 | 723 | 83 | glotblastn |
| 5085 | LAB316 | grape\|gb160\|CF213593 | 8334 | 723 | 82.66 | glotblastn |
| 5086 | LAB316 | cotton\|gb164\|AI726514 | 8335 | 723 | 82.08 | glotblastn |
| 5087 | LAB316 | coffea\|10v1\|DV665545 | 8336 | 723 | 81.84 | glotblastn |
| 5088 | LAB316 | bean\|gb167\|CA910091 | 8337 | 723 | 81.79 | glotblastn |
| 5089 | LAB316 | castorbean\|09v1\|XM002530954 | 8338 | 723 | 81.79 | glotblastn |
| 5090 | LAB316 | castorbean\|gb160\|MDL29847M000246 | 8338 | 723 | 81.79 | glotblastn |
| 5091 | LAB316 | soybean\|gb168\|BI969411 | 8339 | 723 | 81.5 | glotblastn |
| 5092 | LAB316 | soybean\|gb168\|CA910091 | 8340 | 723 | 81.5 | glotblastn |
| 5093 | LAB316 | tragopogon\|10v1\|SRR020205S0000615 | 8341 | 723 | 81.21 | glotblastn |
| 5094 | LAB316 | chestnut\|gb170\|SRR006295S0002034 | 8342 | 723 | 81.21 | glotblastn |
| 5095 | LAB316 | citrus\|gb166\|CF507005 | 8343 | 723 | 81.21 | glotblastn |
| 5096 | LAB316 | cucumber\|09v1\|DN910234 | 8344 | 723 | 80.98 | glotblastn |
| 5097 | LAB316 | coffea\|gb157.2\|DV665545 | 8345 | 723 | 80.98 | glotblastn |
| 5098 | LAB316 | lotus\|09v1\|BP037753 | 8346 | 723 | 80.92 | glotblastn |
| 5099 | LAB316 | cichorium\|gb171\|EH673760 | 8347 | 723 | 80.92 | glotblastn |
| 5100 | LAB316 | sunflower\|gb162\|DY925338 | 8348 | 723 | 80.92 | glotblastn |
| 5101 | LAB316 | sunflower\|gb162\|DY932981 | 8349 | 723 | 80.92 | glotblastn |
| 5102 | LAB316 | artemisia\|10v1\|EY089946 | 8350 | 723 | 80.64 | glotblastn |
| 5103 | LAB316 | artemisia\|gb164\|EY089946 | 8351 | 723 | 80.35 | glotblastn |
| 5104 | LAB323 | potato\|gb157.2\|AW907080 | 8352 | 725 | 89.24 | glotblastn |
| 5105 | LAB326 | pepper\|gb171\|CA514118 | 8353 | 726 | 92.28 | glotblastn |
| 5106 | LAB326 | solanum_phureja\|09v1\|SPHAI776997 | 8354 | 726 | 91.95 | glotblastn |
| 5107 | LAB326 | potato\|10v1\|BG886798 | 8355 | 726 | 90.9 | globlastp |
| 5108 | LAB326 | petunia\|gb171\|CV298273 | 8356 | 726 | 89.04 | glotblastn |
| 5109 | LAB326 | artemisia\|gb164\|EY085224 | 8357 | 726 | 81.46 | glotblastn |
| 5110 | LAB326 | artemisia\|10v1\|SRR019254S0002302 | 8358 | 726 | 80.74 | glotblastn |
| 5111 | LAB326 | lettuce\|10v1\|DW065639 | 8359 | 726 | 80.5 | globlastp |
| 5112 | LAB327 | poppy\|gb166\|FG606884 | 8360 | 727 | 99.01 | glotblastn |
| 5113 | LAB327 | canola\|10v1\|CD823763 | 8361 | 727 | 98.02 | glotblastn |
| 5114 | LAB327 | eggplant\|10v1\|FS002516 | 8362 | 727 | 98.02 | glotblastn |
| 5115 | LAB327 | eggplant\|10v1\|FS018078 | 8363 | 727 | 98.02 | glotblastn |
| 5116 | LAB327 | sorghum\|09v1\|SLXL50010512D1 | 8364 | 727 | 98.02 | glotblastn |
| 5117 | LAB327 | tomato\|09v1\|AI484526 | 8365 | 727 | 98.02 | glotblastn |
| 5118 | LAB327 | tomato\|09v1\|BQ118912 | 8366 | 727 | 98.02 | glotblastn |
| 5119 | LAB327 | b_juncea\|gb164\|EVGN01382831710219 | 8367 | 727 | 98.02 | glotblastn |
| 5120 | LAB327 | b_oleracea\|gb161\|AM386836 | 8368 | 727 | 98.02 | glotblastn |
| 5121 | LAB327 | canola\|gb161\|DY002101 | 8369 | 727 | 98.02 | glotblastn |
| 5122 | LAB327 | canola\|gb161\|EE413610 | 8370 | 727 | 98.02 | glotblastn |
| 5123 | LAB327 | canola\|gb161\|EE440622 | 8371 | 727 | 98.02 | glotblastn |
| 5124 | LAB327 | canola\|gb161\|EE456605 | 8372 | 727 | 98.02 | glotblastn |
| 5125 | LAB327 | canola\|gb161\|EE460641 | 8373 | 727 | 98.02 | glotblastn |
| 5126 | LAB327 | cassava\|09v1\|CK644469 | 8374 | 727 | 98.02 | glotblastn |
| 5127 | LAB327 | cassava\|gb164\|CK644469 | 8375 | 727 | 98.02 | glotblastn |
| 5128 | LAB327 | cotton\|gb164\|BF271275 | 8376 | 727 | 98.02 | glotblastn |
| 5129 | LAB327 | petunia\|gb171\|CV299604 | 8377 | 727 | 98.02 | glotblastn |
| 5130 | LAB327 | potato\|gb157.2\|CK270482 | 8378 | 727 | 98.02 | glotblastn |
| 5131 | LAB327 | radish\|gb164\|EV527546 | 8379 | 727 | 98.02 | glotblastn |
| 5132 | LAB327 | radish\|gb164\|EX888568 | 8380 | 727 | 98.02 | glotblastn |
| 5133 | LAB327 | walnuts\|gb166\|CV195688 | 8381 | 727 | 98.02 | glotblastn |
| 5134 | LAB327 | b_rapa\|gb162\|AB012653 | 8382 | 727 | 98 | globlastp |
| 5135 | LAB327 | nicotiana_benthamiana\|gb162\|CN743193 | 8383 | 727 | 98 | globlastp |
| 5136 | LAB327 | cleome_spinosa\|10v1\|SRR015531S0000653 | 8384 | 727 | 97.03 | glotblastn |
| 5137 | LAB327 | cucumber\|09v1\|DN909393 | 8385 | 727 | 97.03 | glotblastn |
| 5138 | LAB327 | eggplant\|10v1\|FS018763 | 8386 | 727 | 97.03 | glotblastn |
| 5139 | LAB327 | eschscholzia\|10v1\|SRR014116S0005541 | 8387 | 727 | 97.03 | glotblastn |
| 5140 | LAB327 | ipomoea_nil\|10v1\|BJ567233 | 8388 | 727 | 97.03 | glotblastn |
| 5140 | LAB327 | ipomoea\|gb157.2\|BJ567233 | 8388 | 727 | 97.03 | glotblastn |
| 5141 | LAB327 | rhizophora\|10v1\|SRR005792S0001643 | 8389 | 727 | 97.03 | glotblastn |
| 5142 | LAB327 | rhizophora\|10v1\|SRR005793S0006109 | 8390 | 727 | 97.03 | glotblastn |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 5143 | LAB327 | solanum_phureja|09v1|SPHBQ118912 | 8391 | 727 | 97.03 | glotblastn |
| 5144 | LAB327 | solanum_phureja|09v1|SPHCV492300 | 8392 | 727 | 97.03 | glotblastn |
| 5145 | LAB327 | tomato|09v1|CV492300 | 8393 | 727 | 97.03 | glotblastn |
| 5146 | LAB327 | b_juncea|gb164|EVGN00146809031110 | 8394 | 727 | 97.03 | glotblastn |
| 5147 | LAB327 | banana|gb167|FF562462 | 8395 | 727 | 97.03 | glotblastn |
| 5148 | LAB327 | barley|gb157SOLEXA|BEJ449692 | 8396 | 727 | 97.03 | glotblastn |
| 5149 | LAB327 | eucalyptus|gb166|CU396200 | 8397 | 727 | 97.03 | glotblastn |
| 5150 | LAB327 | ginger|gb164|DY353207 | 8398 | 727 | 97.03 | glotblastn |
| 5151 | LAB327 | leymus|gb166|CD808996 | 8399 | 727 | 97.03 | glotblastn |
| 5152 | LAB327 | maize|gb170|CD441688 | 8400 | 727 | 97.03 | glotblastn |
| 5153 | LAB327 | oil_palm|gb166|AY040227 | 8401 | 727 | 97.03 | glotblastn |
| 5154 | LAB327 | pineapple|10v1|DT337548 | 8402 | 727 | 97.03 | glotblastn |
| 5155 | LAB327 | poplar|gb170|AI163175 | 8403 | 727 | 97.03 | glotblastn |
| 5156 | LAB327 | potato|gb157.2|CK267835 | 8404 | 727 | 97.03 | glotblastn |
| 5157 | LAB327 | pseudoroegneria|gb167|FF343365 | 8405 | 727 | 97.03 | glotblastn |
| 5158 | LAB327 | radish|gb164|EV536307 | 8406 | 727 | 97.03 | glotblastn |
| 5159 | LAB327 | sorghum|gb161.crp|SBGWP053010 | 8407 | 727 | 97.03 | glotblastn |
| 5160 | LAB327 | tobacco|gb162|DW001412 | 8408 | 727 | 97.03 | glotblastn |
| 5161 | LAB327 | wheat|gb164|BE412017 | 8409 | 727 | 97.03 | glotblastn |
| 5162 | LAB327 | wheat|gb164|BF293084 | 8410 | 727 | 97.03 | glotblastn |
| 5163 | LAB327 | wheat|gb164|CD491106 | 8411 | 727 | 97.03 | glotblastn |
| 5164 | LAB327 | banana|gb167|FL665731 | 8412 | 727 | 97 | globlastp |
| 5165 | LAB327 | arabidopsis_lyrata|09v1|CRPALE014458 | 8413 | 727 | 96.04 | glotblastn |
| 5166 | LAB327 | chickpea|09v2|GR399685 | 8414 | 727 | 96.04 | glotblastn |
| 5167 | LAB327 | cleome_spinosa|10v1|SRR015531S0018590 | 8415 | 727 | 96.04 | glotblastn |
| 5168 | LAB327 | cleome_spinosa|10v1|SRR015531S0034249 | 8416 | 727 | 96.04 | glotblastn |
| 5169 | LAB327 | ipomoea_nil|10v1|BJ566333 | 8417 | 727 | 96.04 | glotblastn |
| 5169 | LAB327 | ipomoea|gb157.2|BJ566333 | 8417 | 727 | 96.04 | glotblastn |
| 5170 | LAB327 | lettuce|10v1|DW070872 | 8418 | 727 | 96.04 | glotblastn |
| 5171 | LAB327 | millet|09v1|EVO454PM002075 | 8419 | 727 | 96.04 | glotblastn |
| 5172 | LAB327 | pigeonpea|gb171|GR471472 | 8420 | 727 | 96.04 | glotblastn |
| 5173 | LAB327 | pigeonpea|gb171|GR473022 | 8421 | 727 | 96.04 | glotblastn |
| 5174 | LAB327 | salvia|10v1|CV162812 | 8422 | 727 | 96.04 | glotblastn |
| 5175 | LAB327 | salvia|10v1|CV163214 | 8423 | 727 | 96.04 | glotblastn |
| 5176 | LAB327 | solanum_phureja|09v1|SPHCRPSP044068 | 8424 | 727 | 96.04 | glotblastn |
| 5177 | LAB327 | banana|gb167|FL664451 | 8425 | 727 | 96.04 | glotblastn |
| 5178 | LAB327 | basilicum|10v1|DY325098 | 8426 | 727 | 96.04 | glotblastn |
| 5179 | LAB327 | basilicum|gb157.3|DY325098 | 8426 | 727 | 96.04 | glotblastn |
| 5180 | LAB327 | centaurea|gb166|EL931474 | 8427 | 727 | 96.04 | glotblastn |
| 5181 | LAB327 | cichorium|gb171|EH685996 | 8428 | 727 | 96.04 | glotblastn |
| 5182 | LAB327 | melon|gb165|AM713503 | 8429 | 727 | 96.04 | glotblastn |
| 5183 | LAB327 | peanut|gb171|EG030107 | 8430 | 727 | 96.04 | glotblastn |
| 5184 | LAB327 | sugarcane|gb157.3|CA073323 | 8431 | 727 | 96.04 | glotblastn |
| 5185 | LAB327 | switchgrass|gb167|FE605806 | 8432 | 727 | 96.04 | glotblastn |
| 5186 | LAB327 | zamia|gb166|CB095911 | 8433 | 727 | 96.04 | glotblastn |
| 5187 | LAB327 | eschscholzia|10v1|SRR014116S0006563 | 8434 | 727 | 96 | globlastp |
| 5188 | LAB327 | basilicum|gb157.3|DY326229 | 8435 | 727 | 96 | globlastp |
| 5188 | LAB327 | basilicum|10v1|DY326229 | 8486 | 727 | 91.5 | globlastp |
| 5189 | LAB327 | brachypodium|09v1|CRPBD012820 | 8436 | 727 | 95.05 | glotblastn |
| 5190 | LAB327 | chickpea|09v2|GR394209 | 8437 | 727 | 95.05 | glotblastn |
| 5191 | LAB327 | gerbera|09v1|AJ753152 | 8438 | 727 | 95.05 | glotblastn |
| 5192 | LAB327 | lotus|09v1|BG662143 | 8439 | 727 | 95.05 | glotblastn |
| 5193 | LAB327 | nasturtium|10v1|SRR032558S0020815 | 8440 | 727 | 95.05 | glotblastn |
| 5194 | LAB327 | oat|10v1|GR349416 | 8441 | 727 | 95.05 | glotblastn |
| 5195 | LAB327 | orobanche|10v1|SRR023189S0012423 | 8442 | 727 | 95.05 | glotblastn |
| 5196 | LAB327 | pea|09v1|FG529035 | 8443 | 727 | 95.05 | glotblastn |
| 5197 | LAB327 | physcomitrella|10v1|PHPCRP010667 | 8444 | 727 | 95.05 | glotblastn |
| 5198 | LAB327 | pigeonpea|gb171|GR466365 | 8445 | 727 | 95.05 | glotblastn |
| 5199 | LAB327 | bean|gb167|CA898102 | 8446 | 727 | 95.05 | glotblastn |
| 5200 | LAB327 | clover|gb162|BB907933 | 8447 | 727 | 95.05 | glotblastn |
| 5201 | LAB327 | cynara|gb167|GE599288 | 8448 | 727 | 95.05 | glotblastn |
| 5202 | LAB327 | onion|gb162|CF439850 | 8449 | 727 | 95.05 | glotblastn |
| 5203 | LAB327 | pineapple|10v1|DT335927 | 8450 | 727 | 95.05 | glotblastn |
| 5204 | LAB327 | pineapple|gb157.2|DT335927 | 8451 | 727 | 95.05 | glotblastn |
| 5205 | LAB327 | sunflower|gb162|BQ914361 | 8452 | 727 | 95.05 | glotblastn |
| 5206 | LAB327 | basilicum|10v1|DY341441 | 8453 | 727 | 94.06 | glotblastn |
| 5207 | LAB327 | eggplant|10v1|FS002029 | 8454 | 727 | 94.06 | glotblastn |
| 5208 | LAB327 | ipomoea_batatas|10v1|C0500259 | 8455 | 727 | 94.06 | glotblastn |
| 5209 | LAB327 | medicago|09v1|AL370119 | 8456 | 727 | 94.06 | glotblastn |
| 5210 | LAB327 | physcomitrella|10v1|PHPCRP016239 | 8457 | 727 | 94.06 | glotblastn |
| 5211 | LAB327 | tragopogon|10v1|SRR020205S0006730 | 8458 | 727 | 94.06 | glotblastn |
| 5212 | LAB327 | amborella|gb166|CO999518 | 8459 | 727 | 94.06 | glotblastn |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 5213 | LAB327 | basilicum\|gb157.3\|DY341441 | 8453 | 727 | 94.06 | glotblastn |
| 5214 | LAB327 | beet\|gb162\|BF011040 | 8460 | 727 | 94.06 | glotblastn |
| 5215 | LAB327 | canola\|10v1\|EV041917 | 8461 | 727 | 94.06 | glotblastn |
| 5216 | LAB327 | canola\|gb161\|EV041917 | 8462 | 727 | 94.06 | glotblastn |
| 5217 | LAB327 | cichorium\|gb171\|EH679514 | 8463 | 727 | 94.06 | glotblastn |
| 5218 | LAB327 | dandelion\|gb161\|DY832440 | 8464 | 727 | 94.06 | glotblastn |
| 5219 | LAB327 | petunia\|gb171\|CV297073 | 8465 | 727 | 94.06 | glotblastn |
| 5220 | LAB327 | sunflower\|gb162\|EL421491 | 8466 | 727 | 94.06 | glotblastn |
| 5221 | LAB327 | triphysaria\|gb164\|DR176592 | 8467 | 727 | 94.06 | glotblastn |
| 5222 | LAB327 | walnuts\|gb166\|CV195670 | 8468 | 727 | 94.06 | glotblastn |
| 5223 | LAB327 | tomato\|gb164\|BG735245 | 8469 | 727 | 93.1 | globlastp |
| 5224 | LAB327 | solanum_phureja\|09v1\|SPHCRPSP014772 | 8470 | 727 | 93.07 | glotblastn |
| 5225 | LAB327 | antirrhinum\|gb166\|AJ789472 | 8471 | 727 | 93.07 | glotblastn |
| 5226 | LAB327 | clover\|gb162\|BB909848 | 8472 | 727 | 93.07 | glotblastn |
| 5227 | LAB327 | cynara\|gb167\|GE598198 | 8473 | 727 | 93.07 | glotblastn |
| 5228 | LAB327 | fern\|gb171\|DK952436 | 8474 | 727 | 93.07 | glotblastn |
| 5229 | LAB327 | radish\|gb164\|EV545321 | 8475 | 727 | 93.07 | glotblastn |
| 5230 | LAB327 | radish\|gb164\|EW731903 | 8476 | 727 | 93.07 | glotblastn |
| 5231 | LAB327 | thellungiella\|gb167\|BY800754 | 8477 | 727 | 92.5 | glotblastn |
| 5232 | LAB327 | avocado\|10v1\|CO996828 | 8478 | 727 | 92.08 | glotblastn |
| 5233 | LAB327 | medicago\|09v1\|LLAL381370 | 8479 | 727 | 92.08 | glotblastn |
| 5234 | LAB327 | solanum_phureja\|09v1\|SPHCRPSP026105 | 8480 | 727 | 92.08 | glotblastn |
| 5235 | LAB327 | tomato\|09v1\|CRPSP026105 | 8480 | 727 | 92.08 | glotblastn |
| 5236 | LAB327 | brachypodium\|09v1\|DV469797 | 8481 | 727 | 92.08 | glotblastn |
| 5237 | LAB327 | brachypodium\|gb169\|BE400316 | 8481 | 727 | 92.08 | glotblastn |
| 5238 | LAB327 | lettuce\|10v1\|DW047925 | 8482 | 727 | 92.08 | glotblastn |
| 5239 | LAB327 | nuphar\|gb166\|CD474327 | 8483 | 727 | 92.08 | glotblastn |
| 5240 | LAB327 | triphysaria\|gb164\|EY006504 | 8484 | 727 | 92.08 | glotblastn |
| 5241 | LAB327 | zinnia\|gb171\|AU305761 | 8485 | 727 | 92.08 | glotblastn |
| 5242 | LAB327 | ginseng\|10v1\|GR871242 | 8487 | 727 | 91.1 | globlastp |
| 5243 | LAB327 | chickpea\|09v2\|GR915554 | 8488 | 727 | 91.09 | glotblastn |
| 5244 | LAB327 | gerbera\|09v1\|AJ754459 | 8489 | 727 | 91.09 | glotblastn |
| 5245 | LAB327 | b_oleracea\|gb161\|ES940987 | 8490 | 727 | 91.09 | glotblastn |
| 5246 | LAB327 | jatropha\|09v1\|FM891968 | 8491 | 727 | 90.1 | globlastp |
| 5247 | LAB327 | canola\|gb161\|CD836727 | 8492 | 727 | 90.1 | globlastp |
| 5248 | LAB327 | cassava\|gb164\|DB943271 | 8493 | 727 | 90.1 | globlastp |
| 5249 | LAB327 | mesostigma\|gb166\|EC727138 | 8494 | 727 | 90.1 | glotblastn |
| 5250 | LAB327 | antirrhinum\|gb166\|AJ559628 | 8495 | 727 | 89.7 | globlastp |
| 5251 | LAB327 | arabidopsis_lyrata\|09v1\|CRPALE015090 | 8496 | 727 | 89.11 | glotblastn |
| 5252 | LAB327 | soybean\|gb168\|SB2GWP031146 | 8497 | 727 | 88.12 | glotblastn |
| 5253 | LAB327 | rhizophora\|10v1\|SRR005793S0029492 | 8498 | 727 | 87.7 | globlastp |
| 5254 | LAB327 | cacao\|gb167\|CU583493 | 8499 | 727 | 87.13 | glotblastn |
| 5255 | LAB327 | senecio\|gb170\|SRR006594S0009563 | 8500 | 727 | 87.13 | glotblastn |
| 5256 | LAB327 | soybean\|gb168\|ES612478 | 8501 | 727 | 87.13 | glotblastn |
| 5257 | LAB327 | salvia\|10v1\|SRR014553S0018208 | 8502 | 727 | 86.8 | globlastp |
| 5258 | LAB327 | kiwi\|gb166\|FG403299 | 8503 | 727 | 86.6 | globlastp |
| 5259 | LAB327 | lettuce\|gb157.2\|DW044074 | 8504 | 727 | 86.4 | globlastp |
| 5260 | LAB327 | lettuce\|10v1\|DW044074 | 8504 | 727 | 86.4 | globlastp |
| 5261 | LAB327 | castorbean\|09v1\|CRPRC009201 | 8505 | 727 | 86.14 | glotblastn |
| 5262 | LAB327 | fern\|gb171\|DK945838 | 8506 | 727 | 86.14 | glotblastn |
| 5263 | LAB327 | cryptomeria\|gb166\|AU066365 | 8507 | 727 | 85.7 | globlastp |
| 5264 | LAB327 | lettuce\|10v1\|BQ847691 | 8508 | 727 | 85.5 | globlastp |
| 5265 | LAB327 | fescue\|gb161\|DT674428 | 8509 | 727 | 85.2 | globlastp |
| 5266 | LAB327 | fescue\|gb161\|DT704683 | 8509 | 727 | 85.2 | globlastp |
| 5267 | LAB327 | ginger\|gb164\|DY352710 | 8510 | 727 | 85.2 | globlastp |
| 5268 | LAB327 | ginger\|gb164\|DY367029 | 8511 | 727 | 85.1 | globlastp |
| 5269 | LAB327 | lettuce\|gb157.2\|BQ846927 | 8512 | 727 | 84.8 | globlastp |
| 5270 | LAB327 | chickpea\|09v2\|FL512356 | 8513 | 727 | 84.3 | globlastp |
| 5271 | LAB327 | beet\|gb162\|EG549666 | 8514 | 727 | 84.3 | globlastp |
| 5272 | LAB327 | castorbean\|09v1\|XM002516046 | 8515 | 727 | 84.16 | glotblastn |
| 5273 | LAB327 | castorbean\|gb160\|MDL29739M003574 | 8515 | 727 | 84.16 | glotblastn |
| 5274 | LAB327 | cryptomeria\|gb166\|BP175684 | 8516 | 727 | 83.5 | globlastp |
| 5275 | LAB327 | lotus\|gb157.2\|BP036168 | 8517 | 727 | 83.5 | globlastp |
| 5276 | LAB327 | triphysaria\|10v1\|EY154847 | 8518 | 727 | 83.17 | glotblastn |
| 5277 | LAB327 | triphysaria\|gb164\|EY154847 | 8519 | 727 | 83.17 | glotblastn |
| 5278 | LAB327 | wheat\|gb164\|BQ242360 | 8520 | 727 | 83.17 | glotblastn |
| 5279 | LAB327 | ipomoea_batatas\|10v1\|DV038154 | 8521 | 727 | 82.6 | globlastp |
| 5280 | LAB327 | ginger\|gb164\|DY357739 | 8522 | 727 | 82.6 | globlastp |
| 5281 | LAB327 | potato\|gb157.2\|EG016197 | 8523 | 727 | 82.6 | globlastp |
| 5281 | LAB327 | potato\|10v1\|EG016197 | 8527 | 727 | 81.9 | globlastp |
| 5282 | LAB327 | eucalyptus\|gb166\|CB967721 | 8524 | 727 | 82.2 | globlastp |
| 5283 | LAB327 | thellungiella\|gb167\|BY825969 | 8525 | 727 | 82.2 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 5284 | LAB327 | pea\|09v1\|FG534024 | 8526 | 727 | 82.1 | globlastp |
| 5285 | LAB327 | maize\|gb170\|LLCD985621 | 8528 | 727 | 81.19 | glotblastn |
| 5286 | LAB327 | oat\|10v1\|SRR020744S0068207 | 8529 | 727 | 80.6 | globlastp |
| 5287 | LAB327 | tragopogon\|10v1\|SRR020205S0002992 | 8530 | 727 | 80.2 | glotblastn |
| 5288 | LAB327 | b_juncea\|gb164\|EVGN15228424711949 | 8531 | 727 | 80.2 | globlastp |
| 5289 | LAB327 | sunflower\|gb162\|EL434559 | 8532 | 727 | 80.2 | glotblastn |
| 5290 | LAB327 | canola\|10v1\|CD836727 | 8533 | 727 | 80 | globlastp |
| 5291 | LAB327 | ipomoea\|gb157.2\|BJ569764 | 8534 | 727 | 80 | globlastp |
| 5292 | LAB348 | maize\|gb170\|EB407478 | 8535 | 728 | 90.7 | globlastp |
| 5293 | LAB348 | maize\|gb170\|DR814793 | 8536 | 728 | 87 | globlastp |
| 5294 | LAB381 | poplar\|10v1\|BI129814 | 8537 | 730 | 93.2 | globlastp |
| 5295 | LAB381 | cassava\|09v1\|CK645876 | 8538 | 730 | 91.3 | globlastp |
| 5296 | LAB381 | cucumber\|09v1\|EB715836 | 8539 | 730 | 81.1 | globlastp |
| 5297 | LAB65 | barley\|10v1\|BG368928 | 8540 | 735 | 81.73 | glotblastn |
| 5298 | LAB73 | cassava\|09v1\|CK649713 | 8541 | 736 | 81.7 | globlastp |
| 5299 | LAB73 | cacao\|gb167\|CU476966 | 8542 | 736 | 81.1 | globlastp |
| 5300 | LAB73 | cotton\|gb164\|AI725704 | 8543 | 736 | 80.5 | globlastp |
| 5301 | LAB73 | poplar\|10v1\|BU861781 | 8544 | 736 | 80.2 | globlastp |
| 5302 | LAB73 | poplar\|10v1\|CV230194 | 8545 | 736 | 80.18 | glotblastn |
| 5303 | LAB108 | maize\|gb170\|BM661010 | 8546 | 738 | 94.28 | glotblastn |
| 5304 | LAB108 | rice\|gb170\|OS12G12260 | 8547 | 738 | 84.7 | globlastp |
| 5305 | LAB108 | brachypodium\|09v1\|DV482604 | 8548 | 738 | 83.7 | globlastp |
| 5306 | LAB108 | brachypodium\|gb1691BF474193 | 8548 | 738 | 83.7 | globlastp |
| 5307 | LAB108 | barley\|10v1\|BG300035 | 8549 | 738 | 81.9 | globlastp |
| 5308 | LAB123 | tomato\|09v1\|BG889563 | 8550 | 739 | 94.1 | globlastp |
| 5309 | LAB125 | solanum_phureja\|09v1\|SPHBG124210 | 8551 | 741 | 88.8 | globlastp |
| 5310 | LAB126 | solanum_phureja\|09v1\|SPHBG126148 | 8552 | 742 | 96.5 | globlastp |
| 5311 | LAB138 | brachypodium\|gb169\|BE426494 | 8553 | 744 | 86.9 | globlastp |
| 5312 | LAB138 | brachypodium\|09v1SRR031795S0016784 | 8554 | 744 | 86.6 | globlastp |
| 5313 | LAB138 | rice\|gb170\|OS09G35680 | 8555 | 744 | 83.4 | globlastp |
| 5314 | LAB157 | maize\|gb170\|AW424421 | 8556 | 746 | 92.5 | globlastp |
| 5315 | LAB157 | rice\|gb170\|OS11G31570 | 8557 | 746 | 85.4 | globlastp |
| 5316 | LAB157 | brachypodium\|09v1\|SRR031797S0018936 | 8558 | 746 | 84.5 | globlastp |
| 5317 | LAB157 | wheat\|gb164\|CJ625105 | 8559 | 746 | 81.4 | globlastp |
| 5318 | LAB164 | switchgrass\|gb167\|FL925553 | 8560 | 748 | 92.9 | globlastp |
| 5319 | LAB164 | leymus\|gb166\|EG389112 | 8561 | 748 | 90.6 | globlastp |
| 5320 | LAB164 | rice\|gb170\|OS08G02070 | 8562 | 748 | 90.5 | globlastp |
| 5321 | LAB164 | maize\|gb170\|EG075778 | 8563 | 748 | 90.2 | globlastp |
| 5322 | LAB164 | maize\|gb170\|BM379409 | 8564 | 748 | 89 | globlastp |
| 5323 | LAB164 | wheat\|gb164\|BE445505 | 8565 | 748 | 88.8 | globlastp |
| 5324 | LAB164 | brachypodium\|09v1\|SRR031797S0001217 | 8566 | 748 | 84.5 | globlastp |
| 5325 | LAB190 | arabidopsis_lyrata\|09v1\|JGIAL027834 | 8567 | 753 | 89.3 | globlastp |
| 5326 | LAB206 | wheat\|gb164\|BE430173 | 8568 | 754 | 91.6 | globlastp |
| 5327 | LAB206 | wheat\|gb164\|BE591206 | 8568 | 754 | 91.6 | globlastp |
| 5328 | LAB206 | wheat\|gb164\|BE493558 | 8569 | 754 | 90.9 | globlastp |
| 5329 | LAB206 | wheat\|gb164\|BG313801 | 8570 | 754 | 90.9 | globlastp |
| 5330 | LAB206 | oat\|10v1\|GR360139 | 8571 | 754 | 87.7 | globlastp |
| 5331 | LAB207 | barley\|gb157SOLEXA\|AJ470859 | 8572 | 755 | 87.2 | globlastp |
| 5332 | LAB207 | barley\|gb157SOLEXA\|BI947011 | 8573 | 755 | 87.2 | globlastp |
| 5333 | LAB207 | barley\|10v1\|BI947011 | 8573 | 755 | 87.2 | globlastp |
| 5334 | LAB207 | wheat\|gb164\|BE399070 | 8574 | 755 | 83 | globlastp |
| 5335 | LAB207 | wheat\|gb164\|BG312816 | 8575 | 755 | 82.22 | glotblastn |
| 5336 | LAB207 | wheat\|gb164\|BE425222 | 8576 | 755 | 81.67 | glotblastn |
| 5337 | LAB207 | wheat\|gb164\|BE420315 | 8577 | 755 | 81.46 | glotblastn |
| 5338 | LAB207 | wheat\|gb164\|BE425435 | 8578 | 755 | 80.66 | glotblastn |
| 5339 | LAB207 | wheat\|gb164\|CD937530 | 8579 | 755 | 80.6 | globlastp |
| 5340 | LAB207 | wheat\|gb164\|BE426035 | 8580 | 755 | 80.3 | globlastp |
| 5341 | LAB207 | wheat\|gb164\|BE492138 | 8581 | 755 | 80.11 | glotblastn |
| 5342 | LAB210 | leymus\|gb166\|EG389322 | 8582 | 756 | 82.6 | glotblastn |
| 5343 | LAB210 | wheat\|gb164\|BE403306 | 8583 | 756 | 82.6 | globlastp |
| 5344 | LAB210 | wheat\|gb164\|BM134945 | 8584 | 756 | 82.4 | globlastp |
| 5345 | LAB210 | wheat\|gb164\|CA596301 | 8585 | 756 | 82.1 | globlastp |
| 5346 | LAB210 | wheat\|gb164\|BE499093 | 8586 | 756 | 82 | globlastp |
| 5347 | LAB210 | barley\|10v1\|BF621975 | 8587 | 756 | 80.5 | globlastp |
| 5348 | LAB210 | barley\|gb157SOLEXA\|BF621975 | 8587 | 756 | 80.5 | globlastp |
| 5349 | LAB210 | brachypodium\|gb169\|BE403306 | 8588 | 756 | 80.3 | globlastp |
| 5350 | LAB212 | rice\|gb170\|OS06G46900 | 8589 | 757 | 83.8 | globlastp |
| 5351 | LAB213 | wheat\|gb164\|BF473141 | 8590 | 758 | 93.4 | globlastp |
| 5352 | LAB213 | wheat\|gb164\|BF474599 | 8591 | 758 | 93.4 | globlastp |
| 5353 | LAB213 | wheat\|gb164\|BQ743375 | 8592 | 758 | 93.4 | globlastp |
| 5354 | LAB213 | leymus\|gb166\|EG374734 | 8593 | 758 | 92.1 | globlastp |
| 5355 | LAB213 | oat\|10v1\|GO594668 | 8594 | 758 | 82.6 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 5356 | LAB213 | wheat\|gb164\|BE426266 | 8595 | 758 | 82.4 | globlastp |
| 5357 | LAB213 | brachypodium\|09v1\|DV469105 | 8596 | 758 | 81 | globlastp |
| 5358 | LAB213 | brachypodium\|gb169\|BE426266 | 8596 | 758 | 81 | globlastp |
| 5359 | LAB222 | sorghum\|09v1\|SB04G034760 | 8597 | 761 | 83.6 | globlastp |
| 5360 | LAB271 | sugarcane\|10v1\|BU103128 | 8598 | 763 | 95.9 | globlastp |
| 5361 | LAB271 | sugarcane\|gb157.3\|BU103128 | 8598 | 763 | 95.9 | globlastp |
| 5362 | LAB271 | maize\|gb170\|AI649483 | 8599 | 763 | 94.6 | globlastp |
| 5363 | LAB271 | rice\|gb170\|OS01G66120 | 8600 | 763 | 84.2 | globlastp |
| 5364 | LAB271 | wheat\|gb164\|BE414854 | 8601 | 763 | 83 | globlastp |
| 5365 | LAB271 | wheat\|gb164\|BE414877 | 8602 | 763 | 82.7 | globlastp |
| 5366 | LAB271 | brachypodium\|09v1\|DV475081 | 8603 | 763 | 82.5 | globlastp |
| 5367 | LAB271 | brachypodium\|gb169\|BE414854 | 8603 | 763 | 82.5 | globlastp |
| 5368 | LAB271 | oat\|10v1\|GR323587 | 8604 | 763 | 81.8 | globlastp |
| 5369 | LAB271 | leymus\|gb166\|EG379378 | 8605 | 763 | 81.4 | globlastp |
| 5370 | LAB271 | barley\|10v1\|BF625713 | 8606 | 763 | 80.6 | globlastp |
| 5371 | LAB271 | barley\|gb157SOLEXA\|AL507776 | 8606 | 763 | 80.6 | globlastp |
| 5372 | LAB294 | maize\|gb170\|AW267317 | 8607 | 765 | 88.9 | globlastp |
| 5373 | LAB295 | maize\|gb170\|AI987279 | 8608 | 766 | 90.99 | glotblastn |
| 5374 | LAB297 | maize\|gb170\|AI939833 | 8609 | 768 | 82.9 | globlastp |
| 5375 | LAB298 | maize\|gb170\|BM267212 | 8610 | 769 | 91.2 | globlastp |
| 5376 | LAB299 | sugarcane\|10v1\|CA067401 | 8611 | 770 | 95.8 | globlastp |
| 5377 | LAB299 | sugarcane\|gb157.3\|CA067401 | 8612 | 770 | 95.8 | globlastp |
| 5378 | LAB306 | soybean\|gb168\|BU549205 | 8613 | 772 | 86.3 | globlastp |
| 5379 | LAB306 | cowpea\|gb166\|FF387950 | 8614 | 772 | 80.2 | globlastp |
| 5380 | LAB316 | solanum_phureja\|09v1\|SPHAI773156 | 8615 | 775 | 95.2 | globlastp |
| 5381 | LAB316 | tomato\|09v1\|BG125377 | 8616 | 775 | 86.6 | globlastp |
| 5382 | LAB316 | tomato\|gb164\|BG125377 | 8616 | 775 | 86.6 | globlastp |
| 5383 | LAB316 | tobacco\|gb162\|AJ718731 | 8617 | 775 | 86.1 | globlastp |
| 5384 | LAB316 | potato\|gb157.2\|BI405340 | 8618 | 775 | 85.9 | globlastp |
| 5385 | LAB316 | potato\|10v1\|BF459737 | 8619 | 775 | 85.7 | globlastp |
| 5386 | LAB316 | solanum_phureja\|09v1\|SPHBG125377 | 8620 | 775 | 85 | globlastp |
| 5387 | LAB316 | triphysaria\|gb164\|DR175232 | 8621 | 775 | 81.7 | globlastp |
| 5388 | LAB316 | triphysaria\|10v1\|DR171145 | 8622 | 775 | 81.5 | globlastp |
| 5389 | LAB316 | poplar\|10v1\|AI166150 | 8623 | 775 | 81.25 | globlastp |
| 5390 | LAB316 | poplar\|gb170\|AI166150 | 8623 | 775 | 81.25 | glotblastn |
| 5391 | LAB316 | cassava\|09v1\|CK649108 | 8624 | 775 | 80.9 | globlastp |
| 5392 | LAB316 | orobanche\|10v1\|SRR023189S0001256 | 8625 | 775 | 80.8 | globlastp |
| 5393 | LAB316 | grape\|gb160\|CB342294 | 8626 | 775 | 80.5 | globlastp |
| 5394 | LAB316 | lotus\|09v1\|GO026464 | 8627 | 775 | 80.3 | globlastp |
| 5395 | LAB316 | lettuce\|10v1\|DW047539 | 8628 | 775 | 80.1 | globlastp |
| 5396 | LAB316 | lettuce\|gb157.2\|DW047539 | 8628 | 775 | 80.1 | globlastp |
| 5397 | LAB318 | solanum_phureja\|09v1\|SPHAI899075 | 8629 | 777 | 95.1 | globlastp |
| 5398 | LAB318 | potato\|10v1\|BG596620 | 8630 | 777 | 94.9 | globlastp |
| 5399 | LAB326 | potato\|gb157.2\|BG350058 | 8631 | 778 | 97.5 | globlastp |
| 5400 | LAB326 | potato\|10v1\|BG350058 | 8631 | 778 | 97.5 | globlastp |
| 5401 | LAB326 | tomato\|09v1\|BG129901 | 8632 | 778 | 97.2 | globlastp |
| 5402 | LAB326 | potato\|gb157.2\|BE920131 | 8633 | 778 | 96.4 | globlastp |
| 5403 | LAB326 | solanum_phureja\|09v1\|SPHBG642701 | 8634 | 778 | 96.3 | globlastp |
| 5404 | LAB326 | potato\|10v1\|BG887005 | 8635 | 778 | 95.72 | glotblastn |
| 5405 | LAB326 | solanum_phureja\|09v1\|SPHBG123720 | 8636 | 778 | 95.71 | glotblastn |
| 5406 | LAB326 | potato\|gb157.2\|BF053757 | 8637 | 778 | 95.31 | glotblastn |
| 5407 | LAB326 | potato\|10v1\|BF153565 | 8638 | 778 | 94.7 | globlastp |
| 5408 | LAB326 | potato\|gb157.2\|BF153565 | 8638 | 778 | 94.7 | globlastp |
| 5409 | LAB326 | potato\|gb157.2\|BE922713 | 8639 | 778 | 94.64 | glotblastn |
| 5410 | LAB326 | solanum_phureja\|09v1\|SPHBG626585 | 8640 | 778 | 94.3 | globlastp |
| 5411 | LAB326 | pepper\|gb171\|AF081215 | 8641 | 778 | 93.6 | globlastp |
| 5412 | LAB326 | tobacco\|gb162\|GFXAB008200X1 | 8642 | 778 | 93.1 | globlastp |
| 5413 | LAB326 | solanum_phureja\|09v1\|SPHGFXX63103X1 | 8643 | 778 | 93.08 | glotblastn |
| 5414 | LAB326 | solanum_phureja\|09v1\|SPHAW031670 | 8644 | 778 | 93.07 | glotblastn |
| 5415 | LAB326 | tobacco\|gb162\|TOBPAL1 | 8645 | 778 | 90.2 | globlastp |
| 5416 | LAB326 | tobacco\|gb162\|X78269 | 8646 | 778 | 89.9 | globlastp |
| 5417 | LAB326 | potato\|10v1\|BG095888 | 8647 | 778 | 89.6 | globlastp |
| 5418 | LAB326 | potato\|gb157.2\|BG095888 | 8647 | 778 | 89.6 | globlastp |
| 5419 | LAB326 | solanum_phureja\|09v1\|SPHBG626799 | 8648 | 778 | 89.1 | globlastp |
| 5420 | LAB326 | solanum_phureja\|09v1\|SPHCV498380 | 8649 | 778 | 88.5 | globlastp |
| 5421 | LAB326 | ipomoea_nil\|10v1\|GFXAF325496X1 | 8650 | 778 | 88.4 | globlastp |
| 5422 | LAB326 | tomato\|09v1\|BG626799 | 8651 | 778 | 88.4 | globlastp |
| 5423 | LAB326 | ipomoea\|gb157.2\|IPBPALA | 8652 | 778 | 86.8 | globlastp |
| 5424 | LAB326 | catharanthus\|gb166\|AB042520 | 8653 | 778 | 86.5 | globlastp |
| 5425 | LAB326 | castorbean\|09v1\|EE260559 | 8654 | 778 | 85.2 | globlastp |
| 5426 | LAB326 | castorbean\|gb160\|EE260559 | 8654 | 778 | 85.2 | globlastp |
| 5427 | LAB326 | sunflower\|gb162\|CD846484 | 8655 | 778 | 85.2 | globlastp |

TABLE 54-continued

Homologues of the identified genes/polypeptides for increasing abiotic stress
tolerance, water use efficiency, yield, growth rate, vigor, oil content, biomass, growth
rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 5428 | LAB326 | ipomoea_batatas\|10v1\|IPBPAL | 8656 | 778 | 85 | globlastp |
| 5428 | LAB326 | ipomoea\|gb157.2\|IPBPAL | 8656 | 778 | 85 | globlastp |
| 5429 | LAB326 | ipomoea_batatas\|10v1\|IPBPALA | 8657 | 778 | 84.7 | globlastp |
| 5430 | LAB326 | cotton\|gb164\|BF276718 | 8658 | 778 | 84.7 | globlastp |
| 5431 | LAB326 | cynara\|gb167\|GFXAM418586X1 | 8659 | 778 | 84.7 | globlastp |
| 5432 | LAB326 | artemisia\|10v1\|EY085223 | 8660 | 778 | 84.6 | globlastp |
| 5433 | LAB326 | cassava\|09v1\|AF383150 | 8661 | 778 | 84.6 | globlastp |
| 5434 | LAB326 | cassava\|gb164\|AF383150 | 8662 | 778 | 84.5 | globlastp |
| 5435 | LAB326 | basilicum\|10v1\|DY321950 | 8663 | 778 | 84.3 | globlastp |
| 5436 | LAB326 | basilicum\|gb157.3\|DY322602 | 8663 | 778 | 84.3 | globlastp |
| 5437 | LAB326 | lettuce\|gb157.2\|CV700169 | 8664 | 778 | 84.21 | glotblastn |
| 5438 | LAB326 | artemisia\|10v1\|EY060660 | 8665 | 778 | 84.2 | globlastp |
| 5439 | LAB326 | basilicum\|10v1\|DY321580 | 8666 | 778 | 84.2 | globlastp |
| 5440 | LAB326 | lettuce\|10v1\|CV700169 | 8667 | 778 | 84.1 | globlastp |
| 5441 | LAB326 | jatropha\|09v1\|GFXDQ883805X1 | 8668 | 778 | 84 | globlastp |
| 5442 | LAB326 | poplar\|10v1\|AI166477 | 8669 | 778 | 83.9 | globlastp |
| 5443 | LAB326 | cotton\|gb164\|BE051903 | 8670 | 778 | 83.9 | globlastp |
| 5444 | LAB326 | beet\|gb162\|BI543368 | 8671 | 778 | 83.6 | globlastp |
| 5445 | LAB326 | citrus\|gb166\|CLU43338 | 8672 | 778 | 83.6 | globlastp |
| 5446 | LAB326 | salvia\|10v1\|CV165552 | 8673 | 778 | 83.6 | globlastp |
| 5447 | LAB326 | aquilegia\|10v1\|DR912258 | 8674 | 778 | 83.6 | globlastp |
| 5448 | LAB326 | monkeyflower\|10v1\|GO944801 | 8675 | 778 | 83.54 | glotblastn |
| 5449 | LAB326 | castorbean\|09v1\|EG660464 | 8676 | 778 | 83.5 | globlastp |
| 5450 | LAB326 | grape\|gb160\|BQ793161 | 8677 | 778 | 83.5 | globlastp |
| 5451 | LAB326 | grape\|gb160\|X75967 | 8678 | 778 | 83.5 | globlastp |
| 5452 | LAB326 | apple\|gb171\|X68126 | 8679 | 778 | 83.4 | globlastp |
| 5453 | LAB326 | poplar\|10v1\|POPPALGA | 8680 | 778 | 83.4 | globlastp |
| 5454 | LAB326 | citrus\|gb166\|CF832012 | 8681 | 778 | 83.3 | globlastp |
| 5455 | LAB326 | prunus\|gb167\|AF036948 | 8682 | 778 | 83.3 | globlastp |
| 5456 | LAB326 | cacao\|gb167\|CF974594 | 8683 | 778 | 83.2 | globlastp |
| 5457 | LAB326 | cynara\|gb167\|GFXAM418560X1 | 8684 | 778 | 83.2 | globlastp |
| 5458 | LAB326 | medicago\|09v1\|AI737513 | 8685 | 778 | 83.2 | globlastp |
| 5459 | LAB326 | grape\|gb160\|BQ796207 | 8686 | 778 | 83.1 | globlastp |
| 5460 | LAB326 | citrus\|gb166\|BE208887 | 8687 | 778 | 82.8 | globlastp |
| 5461 | LAB326 | cotton\|gb164\|BG443220 | 8688 | 778 | 82.8 | globlastp |
| 5462 | LAB326 | soybean\|gb168\|PHVPAL | 8689 | 778 | 82.8 | globlastp |
| 5463 | LAB326 | cassava\|09v1\|DB927918 | 8690 | 778 | 82.7 | globlastp |
| 5464 | LAB326 | nasturtium\|10v1\|GH164221 | 8691 | 778 | 82.7 | globlastp |
| 5465 | LAB326 | poplar\|10v1\|AI166713 | 8692 | 778 | 82.7 | globlastp |
| 5466 | LAB326 | tea\|10v1\|AY694188 | 8693 | 778 | 82.7 | globlastp |
| 5467 | LAB326 | cassava\|09v1\|AY036011 | 8694 | 778 | 82.6 | globlastp |
| 5468 | LAB326 | soybean\|gb168\|BG835821 | 8695 | 778 | 82.5 | globlastp |
| 5469 | LAB326 | monkeyflower\|10v1\|GO944409 | 8696 | 778 | 82.4 | globlastp |
| 5470 | LAB326 | clover\|gb162\|AB236800 | 8697 | 778 | 82.3 | globlastp |
| 5471 | LAB326 | cassava\|09v1\|JGICASSAVA14518M1 | 8698 | 778 | 82.2 | globlastp |
| 5472 | LAB326 | poplar\|10v1\|BI131326 | 8699 | 778 | 82.2 | globlastp |
| 5473 | LAB326 | lotus\|09v1\|AW720528 | 8700 | 778 | 82.1 | globlastp |
| 5474 | LAB326 | petunia\|gb171\|CV294118 | 8701 | 778 | 82 | globlastp |
| 5475 | LAB326 | lotus\|09v1\|CB826853 | 8702 | 778 | 81.9 | globlastp |
| 5476 | LAB326 | pea\|09v1\|CD858906 | 8703 | 778 | 81.7 | globlastp |
| 5477 | LAB326 | soybean\|gb168\|AA660545 | 8704 | 778 | 81.7 | globlastp |
| 5478 | LAB326 | soybean\|gb168\|S46988 | 8705 | 778 | 81.6 | globlastp |
| 5479 | LAB326 | canola\|10v1\|AA960723 | 8706 | 778 | 81.5 | globlastp |
| 5480 | LAB326 | nasturtium\|10v1\|SRR032558S0014671 | 8707 | 778 | 81.5 | globlastp |
| 5481 | LAB326 | bean\|gb167\|CA914521 | 8708 | 778 | 81.44 | glotblastn |
| 5482 | LAB326 | chestnut\|gb170\|SRR006295S0000016 | 8709 | 778 | 81.4 | globlastp |
| 5483 | LAB326 | triphysaria\|10v1\|EX991935 | 8710 | 778 | 81.28 | glotblastn |
| 5484 | LAB326 | coffea\|10v1\|AF218453 | 8711 | 778 | 81.2 | globlastp |
| 5485 | LAB326 | nasturtium\|10v1\|GH168296 | 8712 | 778 | 81.2 | globlastp |
| 5486 | LAB326 | tomato\|09v1\|BG132153 | 8713 | 778 | 81.1 | globlastp |
| 5487 | LAB326 | canola\|10v1\|CD828744 | 8714 | 778 | 81 | globlastp |
| 5488 | LAB326 | cucumber\|09v1\|AF529240 | 8715 | 778 | 81 | globlastp |
| 5489 | LAB326 | pea\|09v1\|GFXPEAPAL2X1 | 8716 | 778 | 81 | globlastp |
| 5490 | LAB326 | cucumber\|09v1\|AM715693 | 8717 | 778 | 80.9 | globlastp |
| 5491 | LAB326 | lotus\|09v1\|BP085550 | 8718 | 778 | 80.9 | globlastp |
| 5492 | LAB326 | oak\|gb170\|AY443341 | 8719 | 778 | 80.9 | globlastp |
| 5493 | LAB326 | solanum_phureja\|09v1\|SPHBG132153 | 8720 | 778 | 80.9 | globlastp |
| 5494 | LAB326 | soybean\|gb168\|BE352696 | 8721 | 778 | 80.9 | globlastp |
| 5495 | LAB326 | castorbean\|09v1\|XM002529368 | 8722 | 778 | 80.8 | globlastp |
| 5496 | LAB326 | clover\|gb162\|DQ073808 | 8723 | 778 | 80.8 | globlastp |
| 5497 | LAB326 | cucumber\|09v1\|AI563248 | 8724 | 778 | 80.8 | globlastp |
| 5498 | LAB326 | arabidopsis\|gb165\|AT2G37040 | 8725 | 778 | 80.6 | globlastp |

TABLE 54-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Polyn. SEQ ID NO: | Hom. to Gene Name | Cluster name | Polyp. SEQ ID NO: | Hom. to SEQ ID NO: | % Glob. identity | Algor. |
|---|---|---|---|---|---|---|
| 5499 | LAB326 | grape\|gb160\|CB975210 | 8726 | 778 | 80.6 | globlastp |
| 5500 | LAB326 | cucumber\|09v1\|AM715202 | 8727 | 778 | 80.58 | glotblastn |
| 5501 | LAB326 | arabidopsis_lyrata\|09v1\|JGIAL014871 | 8728 | 778 | 80.5 | globlastp |
| 5502 | LAB326 | citrus\|gb166\|CF417508 | 8729 | 778 | 80.5 | globlastp |
| 5503 | LAB326 | lotus\|09v1\|AB283035 | 8730 | 778 | 80.44 | glotblastn |
| 5504 | LAB326 | canola\|10v1\|GFXAY795077X1 | 8731 | 778 | 80.2 | globlastp |
| 5505 | LAB326 | canola\|10v1\|CD829602 | 8732 | 778 | 80.17 | glotblastn |
| 5506 | LAB326 | cotton\|gb164\|AA659954 | 8733 | 778 | 80.17 | glotblastn |
| 5507 | LAB326 | tea\|10v1\|FE942976 | 8734 | 778 | 80.17 | glotblastn |
| 5508 | LAB339 | brachypodium\|09v1\|DV469561 | 8735 | 779 | 81.3 | globlastp |
| 5509 | LAB383 | bean\|gb167\|FE898132 | 8736 | 782 | 86.21 | glotblastn |

Table 54: Provided are the homologous polypeptides (polypep.) and polynucleotides (polynucl.) of the genes for increasing abiotic stress tolerance, yield, growth rate, vigor, oil content, biomass, nitrogen use efficiency, water use efficiency and fertilizer use efficiency genes of a plant which are listed in Table 53 above. Homology was calculated as % of identity over the aligned sequences. The query sequences were polynucleotide and polypeptides depicted in Table 53 above, and the subject sequences are protein and polynucleotide sequences identified in the database based on greater than 80% global identity to the query nucleotide and/or polypeptide sequences.
Hom. = Homology; Glob. = Global; Algor. = Algorithm.

The output of the functional genomics approach described herein is a set of genes highly predicted to improve ABST, yield and/or other agronomic important traits such as growth rate, vigor, biomass, growth rate, oil content, nitrogen use efficiency, water use efficiency and fertilizer use efficiency of a plant by increasing their expression. Although each gene is predicted to have its own impact, modifying the mode of expression of more than one gene is expected to provide an additive or synergistic effect on the plant yield and/or other agronomic important yields performance. Altering the expression of each gene described here alone or set of genes together increases the overall yield and/or other agronomic important traits, hence expects to increase agricultural productivity.

Example 11

Gene Cloning and Generation of Binary Vectors for Plant Expression

To validate their role in improving ABST, yield, growth rate, biomass, vigor, oil content, WUE, NUE and/or FUE selected genes were over-expressed in plants, as follows.

Cloning Strategy

Selected genes from those presented in Examples 4 and 5 hereinabove are cloned into binary vectors for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) is performed on total RNA extracted from leaves, roots or other plant tissues, growing under normal conditions. Total RNA extraction, production of cDNA and PCR amplification is performed using standard protocols described elsewhere (Sambrook J., E. F. Fritsch, and T. Maniatis. 1989. Molecular Cloning. A Laboratory Manual, 2nd Ed. Cold Spring Harbor Laboratory Press, New York.) which are well known to those skilled in the art. PCR products are purified using PCR purification kit (Qiagen)

Usually, 2 sets of primers are prepared for the amplification of each gene, via nested PCR (if required). Both sets of primers are used for amplification on cDNA. In case no product is obtained, a nested PCR reaction is performed. Nested PCR is performed by amplification of the gene using external primers and then using the produced PCR product as a template for a second PCR reaction, where the internal set of primers are used. Alternatively, one or two of the internal primers are used for gene amplification, both in the first and the second PCR reactions (meaning only 2-3 primers were designed for a gene). To facilitate further cloning of the cDNAs, an 8-12 bp extension is added to the 5' of each internal primer. The primer extension includes an endonuclease restriction site. The restriction sites are selected using two parameters: (a) the restriction site does not exist in the cDNA sequence; and (b) the restriction sites in the forward and reverse primers are designed such that the digested cDNA is inserted in the sense direction into the binary vector utilized for transformation.

PCR products are digested with the restriction endonucleases (New England BioLabs Inc) according to the sites designed in the primers. Each digested PCR product is inserted into a high copy vector pBlue-script KS plasmid vector [pBlue-script KS plasmid vector, Hypertext Transfer Protocol://World Wide Web (dot) stratagene (dot) com/manuals/212205 (dot) pdf) or pUC19 (New England BioLabs Inc], or into plasmids originated from these vectors. In case of the high copy vector originated from pBlue-script KS plasmid vector (pGXN or pGXNa), the PCR product is inserted in the high copy plasmid upstream to the NOS terminator (SEQ ID NO:8737) originated from pBI101.3 binary vector (GenBank Accession No. U12640, nucleotides 4356 to 4693) and downstream to the 35S promoter. In other cases (pKSJ_6669a or pUC19_pr6669), the At6669 promoter (SEQ ID NO:8741) is already cloned into the pBlue-script KS or pUC19 respectively, so the gene is introduced downstream of the promoter.

Sequencing of the inserted genes is performed, using the ABI 377 sequencer (Applied Biosystems). In some cases, after confirming the sequences of the cloned genes, the cloned cDNA accompanied/or not with the NOS terminator is introduced into a modified pGI binary vector containing the At6669 promoter via digestion with appropriate restriction endonucleases (the cloned gene replaces the GUI gene). In other cases the cloned cDNA accompanied with the At6669 promoter is introduced into a pGI vector (that does not contain the At6669 promoter). In any case the insert is followed by single copy of the NOS terminator (SEQ ID NO:8737). The digested products and the linearized plasmid vector are ligated using T4 DNA ligase enzyme (Roche, Switzerland).

Several DNA sequences of the selected genes are synthesized by GeneArt [Hypertext Transfer Protocol://World Wide Web (dot) geneart (dot) com/]. Synthetic DNA is designed in silico. Suitable restriction enzymes sites are added to the cloned sequences at the 5' end and at the 3' end to enable later cloning into the desired binary vector.

The pPI plasmid vector is constructed by inserting a synthetic poly-(A) signal sequence, originating from pGL3 basic plasmid vector (Promega, GenBank Accession No. U47295; nucleotides 4658-4811) into the HindIII restriction site of the binary vector pBI101.3 (Clontech, GenBank Accession No. U12640). pGI (FIG. 1) is similar to pPI, but the original gene in the backbone is GUS-Intron and not GUS.

The modified pGI vector (pQFN or pQYN_6669) is a modified version of the pGI vector in which the cassette is inverted between the left and right borders so the gene and its corresponding promoter are close to the right border and the NPTII gene is close to the left border.

At6669, the *Arabidopsis thaliana* promoter sequence (SEQ ID NO:8741) is inserted in the modified pGI binary vector, upstream to the cloned genes, followed by DNA ligation and binary plasmid extraction from positive *E. coli* colonies, as described above. Colonies are analyzed by PCR using the primers covering the insert which are designed to span the introduced promoter and gene. Positive plasmids are identified, isolated and sequenced.

Selected genes cloned by the present inventors are provided in Table 55 below.

TABLE 55

Genes cloned in High copy number plasmids

| Gene Name | High copy plasmid | Organism | Primers used SEQ ID NOs: | Polynucleotide SEQ ID NO: | Polypeptide SEQ ID NO: |
|---|---|---|---|---|---|
| LAB190 | pKS (Pks_J) | *Arabidopsis thaliana* Kondara | 8903, 8904 | 360 | 753 |
| LAB191 | pGXN (pKG + Nos + 35S) | *Arabidopsis thaliana* Kondara | 8905, 8905, 8906, 8907 | 361 | 567 |
| LAB53 | pKS (Pks_J) | BARLEY *Hordeum vulgare* L. ND | 9148, 9149 | 275 | 474 |
| LAB54 | Topo B | BARLEY *Hordeum vulgare* L. Manit | 9150, 9151 | 276 | 732 |
| LAB55 | pKS (Pks_J) | BARLEY *Hordeum vulgare* L. Manit | 9152, 9153, 9154, 9155 | 277 | 733 |
| LAB56* | | | | 278 | 477 |
| LAB197 | Topo B | BARLEY *Hordeum vulgare* L. Manit | 8908, 8909 | 362 | 570 |
| LAB121 | pKS (Pks_J) | TOMATO *Lycopersicum* ND ND | 8770, 8771, 8772, 8773 | 312 | 516 |
| LAB124 | pKS (Pks_J) | TOMATO *Lycopersicum esculentum* M82 | 8778, 8778, 8779, 8780 | 315 | 740 |
| LAB131 | pKS (Pks_J) | TOMATO *Lycopersicum esculentum* M82 | 8798, 8799 | 322 | 526 |
| LAB58 | pKS (Pks_J) | BARLEY *Hordeum vulgare* L. Manit | 9156, 9157, 9158, 9159 | 279 | 478 |
| LAB206 | pGXN (pKG + Nos + 35S) | BARLEY *Hordeum vulgare* L. Manit | 8912, 8912, 8913, 8914 | 364 | 754 |
| LAB207 | pKS (Pks_J) | BARLEY *Hordeum vulgare* L. ND | 8915, 8916 | 365 | 755 |
| LAB64 | pGXN (pKG + Nos + 35S) | BARLEY *Hordeum vulgare* L. ND | 9160, 9161, 9162, 9163 | 220 | 734 |
| LAB210 | pKS (Pks_J) | BARLEY *Hordeum vulgare* L. Manit | 8917, 8918, 8919, 8920 | 366 | 756 |
| LAB211* | | | | 367 | 575 |
| LAB213 | pGXNa | BARLEY *Hordeum vulgare* L. Manit | 8925, 8926 | 369 | 758 |
| LAB65 | pKS (Pks_J) | BARLEY *Hordeum vulgare* L. Manit | 9164, 9165, 9166, 9167 | 280 | 735 |
| LAB170 | pGXN (pKG + Nos + 35S) | *Sorghum bicolor* ND | 8852, 8853, 8854, 8855 | 344 | 549 |
| LAB67 | Topo B | *Brachypodiums distachyon* ND | 9168, 9169 | 281 | 481 |
| LAB68 | pGXN (pKG + Nos + 35S) | *Brachypodiums distachyon* ND | 9170, 9171, 9172, 9173 | 282 | 482 |
| LAB69 | pGXN (pKG + Nos + 35S) | *Brachypodiums distachyon* ND | 9174, 9175, 9176, 9177 | 283 | 483 |
| LAB70 | pKS (Pks_J) | CANOLA *Brassica napus* ND | 9178, 9179 | 284 | 484 |
| LAB217 | Topo B | COTTON *Gossypium hirsutum* Akala | 8927, 8928 | 370 | 578 |
| LAB218 | pKS (Pks_J) | COTTON *Gossypium hirsutum* Akala | 8929, 8929, 8930, 8931 | 371 | 759 |
| LAB73 | pKS (Pks_J) | GRAPE *Vitis vinifera* ND (red glob (red) × salt krik) | 9180, 9181 | 285 | 736 |
| LAB74 | pKS (Pks_J) | MAIZE *Zea mays* L. B73 | 9182, 9183 | 286 | 488 |
| LAB220* | | | | 372 | 580 |
| LAB222 | pKS (Pks_J) | MAIZE *Zea mays* L. OH43 | 8935, 8936 | 374 | 761 |
| LAB204 | pKS (Pks_J) | BARLEY *Hordeum vulgare* L. ND | 8910, 8911 | 363 | 571 |
| LAB228* | | | | 376 | 585 |
| LAB229* | | | | 377 | 586 |
| LAB230 | pKS (Pks_J) | RICE *Oryza sativa* L. *Japonica* Nipponbare | 8939, 8940 | 378 | 587 |
| LAB231 | Topo B | RICE *Oryza sativa* L. *Japonica* Nipponbare | 8941, 8942 | 379 | 588 |
| LAB232 | pKS (Pks_J) | RICE *Oryza sativa* L. *Japonica* Nipponbare | 8943, 8944 | 380 | 589 |
| LAB234* | | | | 381 | 591 |
| LAB235* | | | | 382 | 592 |
| LAB236* | | | | 383 | 593 |
| LAB237* | | | | 384 | 594 |
| LAB247 | pGXN (pKG + Nos + 35S) | RICE *Oryza sativa* L. *Japonica* Nipponbare | 8957, 8958 | 390 | 600 |
| LAB221 | pKS (Pks_J) | MAIZE *Zea mays* L. B73 | 8932, 8932, 8933, 8934 | 373 | 760 |
| LAB249 | pKS (Pks_J) | RICE *Oryza sativa* L. *Japonica* LEMONT | 8959, 8960 | 391 | 601 |
| LAB147* | | | | 327 | 532 |
| LAB250 | Topo B | RICE *Oryza sativa* L. *Japonica* ND | 8961, 8962 | 392 | 602 |
| LAB225 | Topo B | RICE *Oryza sativa* L. *Japonica* LEMONT | 8937, 8938 | 375 | 584 |
| LAB252* | | | | 393 | 603 |
| LAB86 | pGXNa | RICE *Oryza sativa* L. *Japonica* ND | 9194, 9195, 9196, 9197 | 292 | 495 |
| LAB253* | | | | 394 | 604 |
| LAB254 | pKS (Pks_J) | RICE *Oryza sativa* L. *Japonica* Nipponbare | 8963, 8964 | 395 | 605 |
| LAB255 | Topo B | RICE *Oryza sativa* L. *Japonica* ND | 8965, 8966, 8967, 8968 | 396 | 762 |
| LAB258 | pKS (Pks_J) | RICE *Oryza sativa* L. *Japonica* ND | 8969, 8970 | 397 | 607 |

TABLE 55-continued

Genes cloned in High copy number plasmids

| Gene Name | High copy plasmid | Organism | Primers used SEQ ID NOs: | Polynucleotide SEQ ID NO: | Polypeptide SEQ ID NO: |
| --- | --- | --- | --- | --- | --- |
| LAB259 | pKS (Pks_J) | RICE Oryza sativa L. Japonica ND | 8971, 8972 | 398 | 608 |
| LAB260* | | | | 399 | 609 |
| LAB238 | pKS (Pks_J) | RICE Oryza sativa L. Japonica Nipponbare | 8945, 8946, 8947, 8948 | 385 | 595 |
| LAB262 | pGXNa | RICE Oryza sativa L. Japonica ND | 8975, 8976 | 401 | 611 |
| LAB263 | pGXNa | RICE Oryza sativa L. Japonica ND | 8977, 8978 | 402 | 612 |
| LAB264* | | | | 403 | 613 |
| LAB89 | Topo B | RICE Oryza sativa L. Japonica ND | 9200, 9201 | 294 | 737 |
| LAB145 | pKS (Pks_J) | RICE Oryza sativa L. Japonica Nipponbare | 8806, 8807, 8808, 8809 | 326 | 531 |
| LAB265 | pKS (Pks_J) | RICE Oryza sativa L. Japonica Nipponbare | 8979, 8980 | 404 | 614 |
| LAB240 | Topo B | RICE Oryza sativa L. Japonica Nipponbare | 8949, 8950 | 386 | 596 |
| LAB261 | Topo B | RICE Oryza sativa L. Japonica ND | 8973, 8974 | 400 | 610 |
| LAB269 | pGXN (pKG + Nos + 35S) | Sorghum bicolor ND | 8985, 8985, 8986, 8987 | 407 | 617 |
| LAB167 | pKS (Pks_J) | Sorghum bicolor ND | 8846, 8847 | 342 | 749 |
| LAB267 | Topo B | Sorghum bicolor ND | 8981, 8982 | 405 | 615 |
| LAB268 | pGXN (pKG + Nos + 35S) | Sorghum bicolor ND | 8983, 8984 | 406 | 616 |
| LAB270 | pKS (Pks_J) | Sorghum bicolor ND | 8988, 8989 | 408 | 618 |
| LAB271 | Topo B | Sorghum bicolor ND | 8990, 8991 | 409 | 763 |
| LAB169 | pKS (Pks_J) | Sorghum bicolor ND | 8848, 8849, 8850, 8851 | 343 | 548 |
| LAB272 | Topo B | Sorghum bicolor ND | 8992, 8993 | 410 | 620 |
| LAB171 | pKS (Pks_J) | Sorghum bicolor ND | 8856, 8857 | 345 | 550 |
| LAB97 | pGXN (pKG + Nos + 35S) | Sorghum bicolor ND | 9208, 9209, 9210, 9211 | 230 | 501 |
| LAB274 | Topo B | Sorghum bicolor ND | 8994, 8995 | 411 | 621 |
| LAB98* | | | | 298 | 502 |
| LAB275 | Topo B | Sorghum bicolor ND | 8996, 8997 | 412 | 622 |
| LAB172 | pKS (Pks_J) | Sorghum bicolor ND | 8858, 8859 | 346 | 551 |
| LAB276_H0* | | | | 470 | 687 |
| LAB277 | pGXN (pKG + Nos + 35S) | Sorghum bicolor ND | 8998, 8999 | 413 | 624 |
| LAB101 | pGXN (pKG + Nos + 35S) | Sorghum bicolor ND | 8743, 8744 | 299 | 503 |
| LAB278 | pGXN (pKG + Nos + 35S) | Sorghum bicolor ND | 9000, 9001, 9002, 9003 | 414 | 625 |
| LAB102* | | | | 300 | 504 |
| LAB279 | pGXN (pKG + Nos + 35S) | Sorghum bicolor ND | 9004, 9005 | 415 | 626 |
| LAB175 | pGXNa | Sorghum bicolor ND | 8860, 8861, 8862, 8863 | 347 | 553 |
| LAB152 | pKS (Pks_J) | Sorghum bicolor ND | 8810, 8811 | 328 | 533 |
| LAB153 | pKS (Pks_J) | Sorghum bicolor ND | 8812, 8813, 8814, 8815 | 329 | 534 |
| LAB154 | pKS (Pks_J) | Sorghum bicolor ND | 8816, 8817, 8818, 8819 | 330 | 535 |
| LAB280 | pGXN (pKG + Nos + 35S) | Sorghum bicolor ND | 9006, 9007, 9008, 9009 | 416 | 627 |
| LAB281 | pGXN (pKG + Nos + 35S) | Sorghum bicolor ND | 9010, 9011 | 417 | 628 |
| LAB282 | pKS (Pks_J) | Sorghum bicolor ND | 9012, 9013 | 418 | 629 |
| LAB106** | Topo B | Sorghum bicolor Monsanto S5 | 8745, 8746 | 301 | 505 |
| LAB283 | pGXN (pKG + Nos + 35S) | Sorghum bicolor ND | 9014, 9015 | 419 | 630 |
| LAB107 | Topo B | Sorghum bicolor ND | 8747, 8748 | 302 | 506 |
| LAB284 | pKS (Pks_J) | Sorghum bicolor ND | 9016, 9017 | 420 | 631 |
| LAB286 | pKS (Pks_J) | Sorghum bicolor ND | 9018, 9019, 9020, 9021 | 421 | 632 |
| LAB109 | pKS (Pks_J) | Sorghum bicolor ND | 8751, 8752 | 304 | 508 |
| LAB335 | Topo B | WHEAT Triticum aestivum L. ND | 9104, 9105 | 453 | 667 |
| LAB289 | pKS (Pks_J) | Sorghum bicolor ND | 9022, 9023, 9024, 9025 | 422 | 633 |
| LAB290_H0* | | | | 471 | 688 |
| LAB291** | TopoB | Sorghum bicolor ND | 9026, 9027 | 473 | |
| LAB292 | pGXN (pKG + Nos + 35S) | Sorghum bicolor ND | 9028, 9029 | 423 | 635 |
| LAB293 | Topo B | Sorghum bicolor ND | 9030, 9031 | 254 | 764 |
| LAB294 | Topo B | Sorghum bicolor ND | 9032, 9033 | 424 | 765 |
| LAB166 | Topo B | Sorghum bicolor ND | 8844, 8845 | 341 | 546 |
| LAB156 | pGXN (pKG + Nos + 35S) | Sorghum bicolor ND | 8820, 8821, 8822 | 331 | 745 |
| LAB295 | Topo B | Sorghum bicolor ND | 9034, 9035 | 425 | 766 |
| LAB157 | pKS (Pks_J) | Sorghum bicolor ND | 8823, 8824 | 332 | 746 |
| LAB158 | pKS (Pks_J) | Sorghum bicolor ND | 8825, 8826 | 333 | 747 |
| LAB296 | pGXN (pKG + Nos + 35S) | Sorghum bicolor ND | 9036, 9037 | 426 | 767 |
| LAB159 | pKS (Pks_J) | Sorghum bicolor ND | 8827, 8828, 8829, 8830 | 334 | 539 |
| LAB110 | pGXNa | Sorghum bicolor ND | 8753, 8754, 8755, 8756 | 305 | 509 |
| LAB160 | pKS (Pks_J) | Sorghum bicolor ND | 8831, 8832 | 335 | 540 |
| LAB297 | pGXN (pKG + Nos + 35S) | Sorghum bicolor ND | 9038, 9039 | 427 | 768 |
| LAB298 | pGXN (pKG + Nos + 35S) | Sorghum bicolor ND | 9040, 9041, 9042, 9043 | 428 | 769 |
| LAB161 | pKS (Pks_J) | Sorghum bicolor ND | 8833, 8834 | 336 | 541 |
| LAB299 | pKS (Pks_J) | Sorghum bicolor ND | 9044, 9045 | 429 | 770 |
| LAB176 | Topo B | Sorghum bicolor ND | 8864, 8865, 8866, 8867 | 348 | 554 |
| LAB300 | Topo B | Sorghum bicolor ND | 9046, 9047, 9048, 9049 | 430 | 771 |
| LAB336 | pKS (Pks_J) | WHEAT Triticum aestivum L. ND | 9106, 9106, 9107, 9108 | 454 | 668 |
| LAB302 | pKS (Pks_J) | Sorghum bicolor ND | 9050, 9051 | 431 | 644 |
| LAB303 | pGXN (pKG + Nos + 35S) | Sorghum bicolor ND | 9052, 9053 | 432 | 645 |
| LAB162 | pGXN (pKG + Nos + 35S) | Sorghum bicolor ND | 8835, 8836 | 337 | 542 |
| LAB163 | pKS (Pks_J) | Sorghum bicolor ND | 8837, 8838 | 338 | 543 |
| LAB164 | pKS (Pks_J) | Sorghum bicolor ND | 8839, 8840 | 339 | 748 |
| LAB177 | Topo B | Sorghum bicolor ND | 8868, 8869, 8870, 8871 | 349 | 555 |
| LAB165 | pGXN (pKG + Nos + 35S) | Sorghum bicolor ND | 8841, 8842, 8843 | 340 | 545 |

TABLE 55-continued

Genes cloned in High copy number plasmids

| Gene Name | High copy plasmid | Organism | Primers used SEQ ID NOs: | Polynucleotide SEQ ID NO: | Polypeptide SEQ ID NO: |
|---|---|---|---|---|---|
| LAB306** | pGXN (pKG + Nos + 35S) | SOYBEAN Glycine max 58-261 | 9054, 9055 | 433 | 772 |
| LAB307 | pKS (Pks_J) | SOYBEAN Glycine max 58-261 | 9056, 9057 | 434 | 648 |
| LAB308 | pKS (Pks_J) | SOYBEAN Glycine max 58-261 | 9058, 9059, 9060, 9061 | 435 | 649 |
| LAB309 | Topo B | SOYBEAN Glycine max 58-261 | 9062, 9063 | 436 | 650 |
| LAB310 | pGXN (pKG + Nos + 35S) | SOYBEAN Glycine max 58-261 | 9064, 9065 | 437 | 651 |
| LAB311 | pGXN (pKG + Nos + 35S) | SUNFLOWER Helianthus annuus ND | 9066, 9067 | 438 | 773 |
| LAB113 | pKS (Pks_J) | TOMATO Lycopersicum esculentum M82 | 8757, 8758, 8759, 8760 | 306 | 510 |
| LAB312 | pKS (Pks_J) | TOMATO Lycopersicum esculentum M82 | 9068, 9069 | 439 | 653 |
| LAB314 | pKS (Pks_J) | TOMATO Lycopersicum esculentum M82 | 9070, 9071 | 440 | 774 |
| LAB315 | Topo B | TOMATO Lycopersicum esculentum M82 | 9072, 9073 | 441 | 655 |
| LAB115 | pGXN (pKG + Nos + 35S) | TOMATO Lycopersicum esculentum M82 | 8761, 8762 | 307 | 511 |
| LAB178 | pKS (Pks_J) | TOMATO Lycopersicum esculentum M82 | 8872, 8872, 8873, 8874 | 350 | 556 |
| LAB116* |  |  |  | 308 | 512 |
| LAB117 | Topo B | TOMATO Lycopersicum esculentum M82 | 8763, 8764 | 309 | 513 |
| LAB119 | Topo B | TOMATO Lycopersicum esculentum M82 | 8765, 8766, 8767 | 310 | 514 |
| LAB316 | pKS (Pks_J) | TOMATO Lycopersicum esculentum M82 | 9074, 9074, 9075, 9076 | 442 | 775 |
| LAB317 | pGXN (pKG + Nos + 35S) | TOMATO Lycopersicum esculentum M82 | 9077, 9078 | 443 | 776 |
| LAB318 | pKS (Pks_J) | TOMATO Lycopersicum esculentum M82 | 9079, 9080, 9081, 9082 | 444 | 777 |
| LAB319 | pGXN (pKG + Nos + 35S) | TOMATO Lycopersicum esculentum M82 | 9083, 9084, 9085, 9086 | 445 | 659 |
| LAB120 | pGXNa | TOMATO Lycopersicum esculentum M82 | 8768, 8769 | 311 | 515 |
| LAB122 | pGXN (pKG + Nos + 35S) | TOMATO Lycopersicum esculentum M82 | 8774, 8775 | 313 | 517 |
| LAB123 | Topo B | TOMATO Lycopersicum ND ND | 8776, 8777 | 314 | 739 |
| LAB320 | pKS (Pks_J) | TOMATO Lycopersicum esculentum M82 | 9087, 9088, 9089, 9090 | 446 | 660 |
| LAB125 | pGXN (pKG + Nos + 35S) | TOMATO Lycopersicum esculentum M82 | 8781, 8782 | 316 | 741 |
| LAB126 | Topo B | TOMATO Lycopersicum esculentum M82 | 8783, 8784 | 317 | 742 |
| LAB127 | pKS (Pks_J) | TOMATO Lycopersicum esculentum M82 | 8785, 8786 | 318 | 522 |
| LAB128 | pGXN (pKG + Nos + 35S) | TOMATO Lycopersicum ND ND | 8787, 8788, 8789, 8790 | 319 | 523 |
| LAB129 | pKS (Pks_J) | TOMATO Lycopersicum esculentum M82 | 8791, 8791, 8792, 8793 | 320 | 524 |
| LAB323 | pGXN (pKG + Nos + 35S) | TOMATO Lycopersicum esculentum M82 | 9091, 9092, 9093, 9094 | 447 | 661 |
| LAB130 | Topo B | TOMATO Lycopersicum esculentum M82 | 8794, 8795, 8796, 8797 | 321 | 525 |
| LAB80 | pGXN (pKG + Nos + 35S) | RICE Oryza sativa L. Japonica Nipponbare | 9184, 9184, 9185, 9185 | 287 | 490 |
| LAB324 | pGXN (pKG + Nos + 35S) | TOMATO Lycopersicum esculentum M82 | 9095, 9096 | 448 | 662 |
| LAB133 | pKS (Pks_J) | TOMATO Lycopersicum esculentum M82 | 8800, 8801 | 323 | 527 |
| LAB325 | pKS (Pks_J) | TOMATO Lycopersicum esculentum M82 | 9097, 9098 | 449 | 663 |
| LAB326 | pGXN (pKG + Nos + 35S) | TOMATO Lycopersicum esculentum M82 | 9099, 9100 | 450 | 778 |
| LAB327 | pKS (Pks_J) | TOMATO Lycopersicum esculentum M82 | 9101, 9103 | 451 | 665 |
| LAB329* |  |  |  | 452 | 666 |
| LAB88 | pGXN (pKG + Nos + 35S) | RICE Oryza sativa L. Japonica Nipponbare | 9198, 9199 | 293 | 496 |
| LAB137 | pKS (Pks_J) | WHEAT Triticum aestivum L. EYAL | 8802, 8803 | 324 | 743 |
| LAB92 | pKS (Pks_J) | Sorghum bicolor ND | 9202, 9203 | 295 | 498 |
| LAB138 | Topo B | WHEAT Triticum aestivum L. EYAL | 8804, 8805 | 325 | 744 |
| LAB93 | pKS (Pks_J) | Sorghum bicolor ND | 9204, 9205 | 296 | 499 |
| LAB94 | pKS (Pks_J) | Sorghum bicolor ND | 9206, 9207 | 297 | 500 |
| LAB337 | pKS (Pks_J) | WHEAT Triticum aestivum L. ND | 9109, 9110, 9111, 9112 | 455 | 669 |
| LAB339 | pKS (Pks_J) | WHEAT Triticum aestivum L. ND | 9113, 9114 | 456 | 779 |
| LAB179 | pKS (Pks_J) | WHEAT Triticum aestivum L. ND | 8875, 8875, 8876, 8877 | 351 | 557 |
| LAB342* |  |  |  | 457 | 672 |
| LAB343 | pGXNa | CANOLA Brassica napus ND | 9115, 9116 | 458 | 673 |
| LAB344* |  |  |  | 459 | 674 |
| LAB345 | pGXN (pKG + Nos + 35S) | RICE Oryza sativa L. Japonica LEMONT | 9117, 9118 | 460 | 675 |
| LAB346 | pKS (Pks_J) | RICE Oryza sativa L. Japonica LEMONT | 9119, 9120 | 461 | 780 |
| LAB347_H0* |  |  |  | 472 | 689 |
| LAB348 | pKS (Pks_J) | Sorghum bicolor ND | 9121, 9122, 9123, 9124 | 205 | 678 |
| LAB349 | pKS (Pks_J) | SOYBEAN Glycine max 58-261 | 9125, 9125, 9126, 9127 | 462 | 679 |
| LAB351* |  |  |  | 463 | 680 |
| LAB352 | pKS (Pks_J) | WHEAT Triticum aestivum L. EYAL | 9128, 9129 | 464 | 781 |
| LAB353 | Topo B | WHEAT Triticum aestivum L. | 9130, 9131 | 465 | 682 |
| LAB355 | pGXN (pKG + Nos + 35S) | Brachypodiums distachyon ND | 9132, 9133, 9134, 9135 | 466 | 683 |
| LAB367 | Topo B | CANOLA Brassica napus ND | 9136, 9137, 9138, 9139 | 467 | 684 |
| LAB381 | pGXN (pKG + Nos + 35S) | POPLAR Populus ND ND | 9140, 9141, 9142, 9143 | 468 | 685 |
| LAB383 | pKS (Pks_J) | SOYBEAN Glycine max 58-261 | 9144, 9145, 9146, 9147 | 469 | 782 |
| LAB181 | pKS (Pks_J) | Arabidopsis thaliana Kondara | 8878, 8879, 8880, 8881 | 352 | 558 |
| LAB182 | pKS (Pks_J) | Arabidopsis thaliana Kondara | 8882, 8883, 8884, 8885 | 353 | 750 |
| LAB183 | pKS (Pks_J) | Arabidopsis thaliana Kondara | 8886, 8887, 8888, 8889 | 354 | 560 |
| LAB108 | Topo B | Sorghum bicolor ND | 8749, 8750 | 303 | 738 |
| LAB185 | Topo B | Arabidopsis thaliana Kondara | 8890, 8891 | 355 | 561 |
| LAB186 | pKS (Pks_J) | Arabidopsis thaliana Kondara | 8892, 8893 | 356 | 562 |
| LAB187 | pKS (Pks_J) | Arabidopsis thaliana Kondara | 8894, 8895, 8896, 8897 | 357 | 751 |
| LAB188 | pGXN (pKG + Nos + 35S) | Arabidopsis thaliana Kondara | 8898, 8899, 8900, 8900 | 358 | 564 |
| LAB189 | Topo B | Arabidopsis thaliana Kondara | 8901, 8902 | 359 | 752 |
| LAB81 | pKS (Pks_J) | RICE Oryza sativa L. Japonica Nipponbare | 9186, 9187 | 288 | 491 |
| LAB82 | Topo B | RICE Oryza sativa L. Japonica LEMONT | 9188, 9188, 9189, 9189 | 289 | 492 |
| LAB212 | pKS (Pks_J) | BARLEY Hordeum vulgare L. Manit | 8921, 8922, 8923, 8924 | 368 | 757 |
| LAB241* |  |  |  | 387 | 597 |

TABLE 55-continued

Genes cloned in High copy number plasmids

| Gene Name | High copy plasmid | Organism | Primers used SEQ ID NOs: | Polynucleotide SEQ ID NO: | Polypeptide SEQ ID NO: |
|---|---|---|---|---|---|
| LAB242 | pKS (Pks_J) | RICE *Oryza sativa* L. *Japonica* Nipponbare | 8951, 8952, 8953, 8954 | 388 | 598 |
| LAB83 | pGXNa | RICE *Oryza sativa* L. *Japonica* ND | 9190, 9191 | 290 | 493 |
| LAB243 | pKS (Pks_J) | RICE *Oryza sativa* L. *Japonica* Nipponbare | 8955, 8956 | 389 | 599 |
| LAB84 | Topo B | RICE *Oryza sativa* L. *Japonica* LEMONT | 9192, 9193 | 291 | 494 |

Table 55.
"Polyn."—Polynucleotide;
"Polyp."—polypeptide.
For cloning of each gene at least 2 primers were used: Forward (Fwd) or Reverse (Rev).
In some cases, 4 primers were used: External forward (EF), External reverse (ER), nested forward (NF) or nested reverse (NR).
The sequences of the primers used for cloning the genes are provided in the sequence listing.

Example 12

Transforming *Agrobacterium* Tumefaciens Cells with Binary Vectors Harboring the Polynucleotides of the Invention Each of the binary vectors described in Example 11 above are used to transform *Agrobacterium* cells. Two additional binary constructs, having only the At6669 or the 35S promoter or no additional promoter are used as negative controls.

The binary vectors are introduced to *Agrobacterium tumefaciens* GV301, or LB4404 competent cells (about $10^9$ cells/mL) by electroporation. The electroporation is performed using a MicroPulser electroporator (Biorad), 0.2 cm cuvettes (Biorad) and EC-2 electroporation program (Biorad). The treated cells are cultured in LB liquid medium at 28° C. for 3 hours, then plated over LB agar supplemented with gentamycin (50 mg/L; for *Agrobacterium* strains GV301) or streptomycin (300 mg/L; for *Agrobacterium* strain LB4404) and kanamycin (50 mg/L) at 28° C. for 48 hours. *Abrobacterium* colonies, which are developed on the selective media, are further analyzed by PCR using the primers designed to span the inserted sequence in the pPI plasmid. The resulting PCR products are isolated and sequenced to verify that the correct polynucleotide sequences of the invention are properly introduced to the *Agrobacterium* cells.

Example 13

Transformation of *Arabidopsis Thaliana* Plants with the Polynucleotides of the Invention

*Arabidopsis thaliana* Columbia plants ($T_0$ plants) are transformed using the Floral Dip procedure described by Clough and Bent, 1998 (Floral dip: a simplified method for *Agrobacterium*-mediated transformation of *Arabidopsis thaliana*. Plant J 16:735-43) and by Desfeux et al., 2000 (Female Reproductive Tissues Are the Primary Target of *Agrobacterium*-Mediated Transformation by the *Arabidopsis* Floral-Dip Method. Plant Physiol, July 2000, Vol. 123, pp. 895-904), with minor modifications. Briefly, $T_0$ Plants are sown in 250 ml pots filled with wet peat-based growth mix. The pots are covered with aluminum foil and a plastic dome, kept at 4° C. for 3-4 days, then uncovered and incubated in a growth chamber at 18-24° C. under 16/8 hour light/dark cycles. The T0 plants are ready for transformation six days before antithesis.

Single colonies of *Agrobacterium* carrying the binary constructs, are generated as described in Example 3 above. Colonies are cultured in LB medium supplemented with kanamycin (50 mg/L) and gentamycin (50 mg/L). The cultures are incubated at 28° C. for 48 hours under vigorous shaking and then centrifuged at 4000 rpm for 5 minutes. The pellets comprising the *Agrobacterium* cells are re-suspended in a transformation medium containing half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants is performed by inverting each plant into an *Agrobacterium* suspension, such that the above ground plant tissue is submerged for 3-5 seconds. Each inoculated $T_0$ plant is immediately placed in a plastic tray, then covered with clear plastic dome to maintain humidity and is kept in the dark at room temperature for 18 hours, to facilitate infection and transformation. Transformed (transgenic) plants are then uncovered and transferred to a greenhouse for recovery and maturation. The transgenic $T_0$ plants are grown in the greenhouse for 3-5 weeks until siliques are brown and dry. Seeds are harvested from plants and kept at room temperature until sowing.

For generating $T_1$ and $T_2$ transgenic plants harboring the genes, seeds collected from transgenic $T_0$ plants are surface-sterilized by soaking in 70% ethanol for 1 minute, followed by soaking in 5% sodium hydochloride and 0.05% triton for 5 minutes. The surface-sterilized seeds are thoroughly washed in sterile distilled water then placed on culture plates containing half-strength Murashige-Skoog (Duchefa); 2% sucrose; 0.8% plant agar; 50 mM kanamycin; and 200 mM carbenicylin (Duchefa). The culture plates are incubated at 4° C. for 48 hours then transferred to a growth room at 25° C. for an additional week of incubation. Vital $T_1$ *Arabidopsis* plants are transferred to a fresh culture plates for another week of incubation. Following incubation the $T_1$ plants are removed from culture plates and planted in growth mix contained in 250 ml pots. The transgenic plants are allowed to grow in a greenhouse to maturity. Seeds harvested from $T_1$ plants are cultured and grown to maturity as $T_2$ plants under the same conditions as used for culturing and growing the $T_1$ plants.

Example 14

Evaluating Transgenic *Arabidopsis* Plant Growth Under Abiotic Stress as Well as Under Favorable Conditions in Tissue Culture Assay Assay 1: plant growth under osmotic stress [poly (ethylene glycol) (PEG)] in tissue culture conditions—One of the consequences of drought is the induction of osmotic stress in the area surrounding the roots; therefore, in many scientific studies, PEG (e.g., 1.5% PEG) is used to simulate the osmotic stress conditions resembling the high osmolarity found during drought stress.

Surface sterilized seeds are sown in basal media [50% Murashige-Skoog medium (MS) supplemented with 0.8% plant agar as solidifying agent] in the presence of Kanamycin (for selecting only transgenic plants). After sowing, plates are transferred for 2-3 days for stratification at 4° C. and then grown at 25° C. under 12-hour light 12-hour dark daily cycles for 7 to 10 days. At this time point, seedlings randomly chosen are carefully transferred to plates containing 1.5% PEG: 0.5 MS media or Normal growth conditions (0.5 MS media). Each plate contained 5 seedlings of the same transgenic event, and 3-4 different plates (replicates) for each event. For each polynucleotide of the invention at least four independent transformation events are analyzed from each construct. Plants expressing the polynucleotides of the invention are compared to the average measurement of the control plants (empty vector or GUS reporter gene under the same promoter) used in the same experiment.

Digital imaging—A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) and located in a darkroom, is used for capturing images of plantlets sawn in agar plates.

The image capturing process is repeated every 3-4 days starting at day 1 till day 10 (see for example the images in FIGS. 3A-F).

An image analysis system was used, which consists of a personal desktop computer (Intel P4 3.0 GHz processor) and a public domain program—ImageJ 1.39 (Java based image processing program which was developed at the U.S. National Institutes of Health and freely available on the internet at Hypertext Transfer Protocol://rsbweb (dot) nih (dot) gov/). Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data was calculated, including leaf area, root coverage and root length.

The relative growth rate for the various seedling parameters was calculated according to the following formulas XVI, XVII and XVIII.

Relative growth rate of leaf area=Regression coefficient of leaf area along time course.     Formula XVI Relative growth rate of root coverage=Regression coefficient of root coverage along time course.     Formula XVII Relative growth rate of root length=Regression coefficient of root length along time course.     Formula XVIII At the end of the experiment, plantlets are removed from the media and weighed for the determination of plant fresh weight. Plantlets are then dried for 24 hours at 60° C., and weighed again to measure plant dry weight for later statistical analysis. Growth rate is determined by comparing the leaf area coverage, root coverage and root length, between each couple of sequential photographs, and results are used to resolve the effect of the gene introduced on plant vigor, under osmotic stress, as well as under optimal conditions. Similarly, the effect of the gene introduced on biomass accumulation, under osmotic stress as well as under optimal conditions, is determined by comparing the plants' fresh and dry weight to that of control plants (containing an empty vector or the GUS reporter gene under the same promoter). From every construct created, 3-5 independent transformation events are examined in replicates.

Statistical analyses—To identify genes conferring significantly improved tolerance to abiotic stresses or enlarged root architecture, the results obtained from the transgenic plants are compared to those obtained from control plants. To identify outperforming genes and constructs, results from the independent transformation events tested are analyzed separately. To evaluate the effect of a gene event over a control the data is analyzed by Student's t-test and the p value is calculated. Results are considered significant if $p \leq 0.1$. The JMP statistics software package was used (Version 5.2.1, SAS Institute Inc., Cary, N.C., USA).

Experimental Results:

The genes presented in Tables 56-59 showed a significant improvement in plant ABST since they produced larger plant biomass (plant fresh and dry weight and leaf area) in T2 generation (Tables 27-28) or T1 generation (Tables 29-30) when grown under osmotic stress conditions, compared to control plants. The genes were cloned under the regulation of a constitutive promoter (At6669; SEQ ID NO:8741). The evaluation of each gene was carried out by testing the performance of different number of events. Some of the genes were evaluated in more than one tissue culture assay. The results obtained in these second experiments were significantly positive as well.

TABLE 56

Genes showing improved plant performance under osmotic stress conditions (T2 generation)

| Gene Name | Plant Biomass Fresh Weight [gr.] | | | | Gene Name | Plant Biomass Dry Weight [gr.] | | | |
|---|---|---|---|---|---|---|---|---|---|
| | Event # | Ave. | p-val. | % Incr. | | Event # | Ave. | p-val. | % Incr. |
| LAB115 | 27281.2 | 0.146 | 0.283 | 47 | LAB115 | 27281.2 | 0.0082 | 0.218 | 66 |
| LAB115 | 27282.3 | 0.102 | 0.883 | 2 | LAB115 | 27282.3 | 0.0054 | 0.511 | 10 |
| LAB115 | 27284.3 | 0.112 | 0.137 | 12 | LAB115 | 27284.3 | 0.0061 | 0.138 | 23 |
| LAB115 | 27285.2 | 0.164 | 0.011 | 65 | LAB115 | 27285.2 | 0.0078 | 0.008 | 59 |
| LAB123 | 28282.3 | 0.114 | 0.267 | 14 | LAB123 | 28282.3 | 0.0061 | 0.049 | 24 |
| LAB123 | 28283.1 | — | | — | LAB123 | 28283.1 | 0.0051 | 0.853 | 3 |
| LAB123 | 28284.2 | — | | — | LAB123 | 28284.2 | 0.0059 | 0.124 | 21 |
| LAB123 | 28285.2 | 0.134 | 0.004 | 35 | LAB123 | 28285.2 | 0.0069 | 0.004 | 40 |
| LAB183 | 27452.2 | 0.120 | 0.419 | 20 | LAB183 | 27452.2 | 0.0071 | 0.231 | 45 |
| LAB183 | 27453.1 | — | | — | LAB183 | 27453.1 | 0.0053 | 0.497 | 7 |
| LAB189 | 28163.2 | 0.101 | 0.871 | 1 | LAB189 | 28163.2 | 0.0052 | 0.631 | 5 |
| LAB189 | 28165.2 | — | | — | LAB189 | 28165.2 | 0.0057 | 0.436 | 16 |

TABLE 56-continued

Genes showing improved plant performance under osmotic stress conditions (T2 generation)

| | Plant Biomass Fresh Weight [gr.] | | | | | Plant Biomass Dry Weight [gr.] | | | |
|---|---|---|---|---|---|---|---|---|---|
| Gene Name | Event # | Ave. | p-val. | % Incr. | Gene Name | Event # | Ave. | p-val. | % Incr. |
| LAB212 | 28041.1 | 0.110 | 0.619 | 11 | LAB212 | 28041.1 | 0.0062 | 0.453 | 26 |
| LAB212 | 28042.1 | 0.138 | 0.001 | 39 | LAB212 | 28042.1 | 0.0066 | 0.250 | 33 |
| LAB212 | 28043.2 | 0.130 | 0.441 | 30 | LAB212 | 28043.2 | 0.0061 | 0.500 | 24 |
| LAB212 | 28044.2 | — | — | — | LAB212 | 28044.2 | 0.0057 | 0.290 | 15 |
| LAB217 | 28033.2 | 0.128 | 0.405 | 28 | LAB217 | 28033.2 | 0.0089 | 0.164 | 82 |
| LAB217 | 28034.1 | 0.118 | 0.596 | 18 | LAB217 | 28034.1 | 0.0068 | 0.424 | 37 |
| LAB326 | 28053.2 | 0.148 | 0.240 | 49 | LAB326 | 28053.2 | 0.0079 | 0.141 | 61 |
| LAB326 | 28054.1 | — | — | — | LAB326 | 28054.1 | 0.0061 | 0.154 | 24 |
| LAB326 | 28056.2 | 0.111 | 0.381 | 12 | LAB326 | 28056.2 | 0.0054 | 0.645 | 10 |
| LAB326 | 28056.3 | 0.108 | 0.481 | 8 | LAB326 | 28056.3 | — | — | — |
| CONT | — | 0.100 | — | 0 | CONT | — | 0.0049 | — | 0 |
| LAB115 | 27281.3 | — | — | — | LAB115 | 27281.3 | 0.0058 | 0.789 | 7 |
| LAB115 | 27284.3 | 0.142 | 0.047 | 38 | LAB115 | 27284.3 | 0.0072 | 0.038 | 35 |
| LAB115 | 27285.1 | 0.161 | 0.199 | 56 | LAB115 | 27285.1 | 0.0094 | 0.221 | 76 |
| LAB123 | 28281.1 | 0.330 | 0.002 | 220 | LAB123 | 28281.1 | 0.0212 | 0.005 | 296 |
| LAB123 | 28282.3 | 0.145 | 0.169 | 40 | LAB123 | 28282.3 | 0.0071 | 0.004 | 33 |
| LAB123 | 28283.1 | 0.198 | 0.203 | 92 | LAB123 | 28283.1 | 0.0116 | 0.132 | 116 |
| LAB123 | 28284.1 | 0.197 | 0.000 | 91 | LAB123 | 28284.1 | 0.0122 | 0.000 | 128 |
| LAB123 | 28285.2 | 0.209 | 0.002 | 103 | LAB123 | 28285.2 | 0.0117 | 0.011 | 118 |
| LAB183 | 27453.4 | 0.165 | 0.021 | 60 | LAB183 | 27453.4 | 0.0095 | 0.061 | 78 |
| LAB189 | 28163.2 | 0.128 | 0.283 | 24 | LAB189 | 28163.2 | — | — | — |
| LAB189 | 28165.2 | 0.118 | 0.605 | 14 | LAB189 | 28165.2 | — | — | — |
| LAB189 | 28166.2 | 0.138 | 0.378 | 34 | LAB189 | 28166.2 | 0.0072 | 0.489 | 34 |
| LAB189 | 28166.5 | 0.121 | 0.577 | 17 | LAB189 | 28166.5 | 0.0064 | 0.559 | 20 |
| LAB206 | 30011.2 | 0.110 | 0.586 | 7 | LAB206 | 30011.2 | 0.0080 | 0.015 | 49 |
| LAB206 | 30012.4 | 0.153 | 0.013 | 48 | LAB206 | 30012.4 | 0.0075 | 0.002 | 40 |
| LAB206 | 30012.7 | 0.129 | 0.308 | 25 | LAB206 | 30012.7 | 0.0059 | 0.516 | 10 |
| LAB206 | 30012.8 | 0.109 | 0.717 | 6 | LAB206 | 30012.8 | 0.0066 | 0.153 | 23 |
| LAB212 | 28041.1 | — | — | — | LAB212 | 28041.1 | 0.0056 | 0.684 | 4 |
| LAB212 | 28042.1 | 0.105 | 0.904 | 2 | LAB212 | 28042.1 | — | — | — |
| LAB212 | 28045.1 | 0.129 | 0.073 | 25 | LAB212 | 28045.1 | 0.0067 | 0.117 | 26 |
| LAB217 | 28033.2 | 0.216 | 0.001 | 110 | LAB217 | 28033.2 | 0.0110 | 0.010 | 105 |
| LAB217 | 28034.1 | 0.164 | 0.225 | 59 | LAB217 | 28034.1 | 0.0089 | 0.092 | 65 |
| LAB217 | 28034.3 | 0.128 | 0.054 | 24 | LAB217 | 28034.3 | 0.0066 | 0.099 | 24 |
| LAB217 | 28035.1 | 0.199 | 0.169 | 93 | LAB217 | 28035.1 | 0.0107 | 0.174 | 100 |
| LAB217 | 28036.1 | 0.145 | 0.207 | 40 | LAB217 | 28036.1 | 0.0084 | 0.137 | 57 |
| LAB250 | 30251.2 | 0.135 | 0.198 | 31 | LAB250 | 30251.2 | 0.0076 | 0.199 | 41 |
| LAB250 | 30252.1 | 0.117 | 0.146 | 14 | LAB250 | 30252.1 | 0.0069 | 0.109 | 29 |
| LAB250 | 30254.3 | 0.116 | 0.543 | 12 | LAB250 | 30254.3 | 0.0056 | 0.768 | 5 |
| LAB314 | 29292.4 | 0.109 | 0.774 | 5 | LAB314 | 29292.4 | — | — | — |
| LAB314 | 29292.6 | 0.123 | 0.024 | 19 | LAB314 | 29292.6 | 0.0070 | 0.007 | 31 |
| LAB314 | 29294.1 | 0.117 | 0.471 | 14 | LAB314 | 29294.1 | 0.0059 | 0.471 | 10 |
| LAB326 | 28052.4 | 0.117 | 0.478 | 14 | LAB326 | 28052.4 | 0.0060 | 0.373 | 13 |
| LAB326 | 28056.3 | 0.122 | 0.125 | 19 | LAB326 | 28056.3 | 0.0061 | 0.234 | 14 |
| LAB351 | 30112.1 | 0.128 | 0.297 | 24 | LAB351 | 30112.1 | 0.0068 | 0.059 | 28 |
| LAB351 | 30115.1 | — | — | — | LAB351 | 30115.1 | 0.0063 | 0.228 | 17 |
| LAB351 | 30115.3 | 0.116 | 0.167 | 13 | LAB351 | 30115.3 | 0.0057 | 0.679 | 6 |
| LAB93 | 28271.3 | 0.146 | 0.159 | 42 | LAB93 | 28271.3 | 0.0079 | 0.208 | 47 |
| LAB93 | 28271.4 | 0.130 | 0.375 | 27 | LAB93 | 28271.4 | 0.0062 | 0.354 | 16 |
| LAB93 | 28272.3 | 0.211 | 0.017 | 104 | LAB93 | 28272.3 | 0.0131 | 0.020 | 144 |
| LAB93 | 28274.2 | 0.133 | 0.165 | 29 | LAB93 | 28274.2 | 0.0079 | 0.040 | 47 |
| LAB93 | 28274.3 | 0.121 | 0.335 | 18 | LAB93 | 28274.3 | 0.0064 | 0.374 | 20 |
| CONT | — | 0.103 | — | 0 | CONT | — | 0.0054 | — | 0 |
| LAB106 | 30031.4 | 0.096 | 0.702 | 3 | LAB106 | 30031.4 | 0.0061 | 0.062 | 29 |
| LAB106 | 30032.1 | 0.146 | 0.082 | 56 | LAB106 | 30032.1 | 0.0077 | 0.060 | 64 |
| LAB106 | 30032.2 | 0.141 | 0.072 | 51 | LAB106 | 30032.2 | 0.0089 | 0.012 | 89 |
| LAB206 | 30011.7 | 0.118 | 0.325 | 26 | LAB206 | 30011.7 | 0.0063 | 0.123 | 33 |
| LAB206 | 30012.4 | — | — | — | LAB206 | 30012.4 | 0.0055 | 0.410 | 17 |
| LAB206 | 30012.8 | 0.114 | 0.336 | 22 | LAB206 | 30012.8 | 0.0059 | 0.306 | 24 |
| LAB207 | 28842.1 | 0.099 | 0.729 | 6 | LAB207 | 28842.1 | 0.0053 | 0.466 | 13 |
| LAB207 | 28842.5 | 0.112 | 0.377 | 19 | LAB207 | 28842.5 | 0.0061 | 0.314 | 30 |
| LAB207 | 28843.3 | 0.114 | 0.372 | 22 | LAB207 | 28843.3 | 0.0076 | 0.009 | 61 |
| LAB207 | 28843.5 | 0.099 | 0.737 | 5 | LAB207 | 28843.5 | 0.0057 | 0.266 | 22 |
| LAB218 | 29432.2 | 0.111 | 0.057 | 19 | LAB218 | 29432.2 | 0.0062 | 0.119 | 31 |
| LAB218 | 29433.4 | — | — | — | LAB218 | 29433.4 | 0.0048 | 0.888 | 2 |
| LAB218 | 29434.3 | 0.108 | 0.651 | 15 | LAB218 | 29434.3 | 0.0066 | 0.416 | 40 |
| LAB250 | 30252.1 | 0.104 | 0.743 | 11 | LAB250 | 30252.1 | 0.0052 | 0.307 | 11 |
| LAB250 | 30253.1 | 0.134 | 0.228 | 43 | LAB250 | 30253.1 | 0.0080 | 0.133 | 69 |
| LAB250 | 30254.1 | — | — | — | LAB250 | 30254.1 | 0.0050 | 0.729 | 6 |
| LAB252 | 30291.4 | 0.120 | 0.199 | 29 | LAB252 | 30291.4 | 0.0067 | 0.119 | 43 |
| LAB252 | 30292.3 | 0.193 | 0.012 | 106 | LAB252 | 30292.3 | 0.0109 | 0.030 | 131 |
| LAB309 | 30052.2 | 0.117 | 0.264 | 24 | LAB309 | 30052.2 | 0.0065 | 0.211 | 39 |

TABLE 56-continued

Genes showing improved plant performance under osmotic stress conditions (T2 generation)

| | Plant Biomass Fresh Weight [gr.] | | | | | Plant Biomass Dry Weight [gr.] | | | |
|---|---|---|---|---|---|---|---|---|---|
| Gene Name | Event # | Ave. | p-val. | % Incr. | Gene Name | Event # | Ave. | p-val. | % Incr. |
| LAB309 | 30052.3 | 0.138 | 0.142 | 48 | LAB309 | 30052.3 | 0.0084 | 0.030 | 78 |
| LAB314 | 29292.4 | 0.118 | 0.099 | 26 | LAB314 | 29292.4 | 0.0077 | 0.002 | 64 |
| LAB314 | 29292.6 | 0.124 | 0.057 | 32 | LAB314 | 29292.6 | 0.0061 | 0.199 | 29 |
| LAB314 | 29294.1 | 0.151 | 0.015 | 61 | LAB314 | 29294.1 | 0.0081 | 0.002 | 73 |
| LAB314 | 29295.2 | 0.141 | 0.183 | 51 | LAB314 | 29295.2 | 0.0072 | 0.012 | 53 |
| LAB346 | 29442.2 | — | — | — | LAB346 | 29442.2 | 0.0052 | 0.289 | 11 |
| LAB346 | 29442.4 | 0.101 | 0.427 | 8 | LAB346 | 29442.4 | 0.0054 | 0.338 | 14 |
| LAB346 | 29443.2 | 0.111 | 0.561 | 18 | LAB346 | 29443.2 | 0.0060 | 0.371 | 27 |
| LAB346 | 29445.3 | 0.139 | 0.073 | 48 | LAB346 | 29445.3 | 0.0080 | 0.013 | 70 |
| LAB351 | 30111.2 | 0.118 | 0.182 | 26 | LAB351 | 30111.2 | 0.0073 | 0.006 | 55 |
| LAB351 | 30114.2 | 0.138 | 0.011 | 47 | LAB351 | 30114.2 | 0.0079 | 0.000 | 68 |
| LAB82 | 30181.3 | 0.095 | 0.964 | 1 | LAB 82 | 30181.3 | 0.0055 | 0.388 | 18 |
| LAB84 | 30161.4 | 0.159 | 0.013 | 69 | LAB 84 | 30161.4 | 0.0086 | 0.017 | 83 |
| LAB84 | 30162.2 | 0.104 | 0.672 | 11 | LAB 84 | 30162.2 | 0.0071 | 0.142 | 51 |
| LAB84 | 30162.4 | 0.172 | 0.061 | 84 | LAB 84 | 30162.4 | 0.0110 | 0.040 | 135 |
| LAB84 | 30163.4 | 0.150 | 0.059 | 60 | LAB 84 | 30163.4 | 0.0091 | 0.036 | 94 |
| LAB84 | 30164.2 | 0.166 | 0.093 | 77 | LAB 84 | 30164.2 | 0.0109 | 0.015 | 132 |
| CONT | — | 0.094 | — | 0 | CONT | — | 0.0047 | — | 0 |
| LAB110 | 30571.3 | 0.135 | 0.251 | 37 | LAB110 | 30571.3 | 0.0058 | 0.274 | 34 |
| LAB110 | 30572.1 | — | — | — | LAB110 | 30572.1 | 0.0045 | 0.870 | 4 |
| LAB110 | 30573.2 | 0.129 | 0.058 | 31 | LAB110 | 30573.2 | 0.0060 | 0.113 | 40 |
| LAB110 | 30574.2 | 0.140 | 0.115 | 42 | LAB110 | 30574.2 | 0.0069 | 0.005 | 61 |
| LAB117 | 27291.1 | 0.109 | 0.361 | 11 | LAB117 | 27291.1 | 0.0050 | 0.565 | 16 |
| LAB117 | 27291.5 | 0.150 | 0.092 | 53 | LAB117 | 27291.5 | 0.0063 | 0.292 | 47 |
| LAB117 | 27293.1 | 0.221 | 0.034 | 125 | LAB117 | 27293.1 | 0.0086 | 0.090 | 100 |
| LAB117 | 27296.1 | 0.135 | 0.109 | 37 | LAB117 | 27296.1 | 0.0067 | 0.262 | 55 |
| LAB124 | 30431.1 | 0.115 | 0.255 | 17 | LAB124 | 30431.1 | 0.0066 | 0.093 | 53 |
| LAB124 | 30434.1 | 0.148 | 0.174 | 51 | LAB124 | 30434.1 | 0.0059 | 0.510 | 36 |
| LAB124 | 30434.3 | 0.149 | 0.140 | 52 | LAB124 | 30434.3 | 0.0067 | 0.200 | 55 |
| LAB124 | 30435.2 | 0.154 | 0.027 | 57 | LAB124 | 30435.2 | 0.0059 | 0.045 | 37 |
| LAB125 | 30581.3 | 0.113 | 0.154 | 15 | LAB125 | 30581.3 | 0.0053 | 0.486 | 24 |
| LAB125 | 30583.1 | 0.110 | 0.469 | 12 | LAB125 | 30583.1 | 0.0047 | 0.789 | 8 |
| LAB125 | 30583.2 | 0.123 | 0.131 | 26 | LAB125 | 30583.2 | 0.0052 | 0.335 | 21 |
| LAB156 | 30401.4 | — | — | — | LAB156 | 30401.4 | 0.0056 | 0.440 | 31 |
| LAB156 | 30402.2 | 0.135 | 0.030 | 38 | LAB156 | 30402.2 | 0.0071 | 0.043 | 66 |
| LAB156 | 30405.3 | 0.112 | 0.285 | 14 | LAB156 | 30405.3 | 0.0047 | 0.468 | 9 |
| LAB228 | 30081.4 | 0.109 | 0.508 | 11 | LAB228 | 30081.4 | — | — | — |
| LAB228 | 30082.3 | — | — | — | LAB228 | 30082.3 | 0.0048 | 0.724 | 11 |
| LAB228 | 30084.3 | 0.129 | 0.105 | 31 | LAB228 | 30084.3 | 0.0052 | 0.458 | 20 |
| LAB275 | 30361.2 | 0.136 | 0.073 | 38 | LAB275 | 30361.2 | — | — | — |
| LAB275 | 30361.3 | 0.154 | 0.120 | 57 | LAB275 | 30361.3 | 0.0074 | 0.050 | 73 |
| LAB275 | 30366.4 | 0.110 | 0.642 | 12 | LAB275 | 30366.4 | 0.0052 | 0.304 | 20 |
| LAB276_H0 | 30331.1 | 0.161 | 0.037 | 64 | LAB276_H0 | 30331.1 | 0.0068 | 0.006 | 58 |
| LAB276_H0 | 30331.4 | — | — | — | LAB276_H0 | 30331.4 | 0.0045 | 0.823 | 4 |
| LAB276_H0 | 30333.3 | 0.116 | 0.381 | 18 | LAB276_H0 | 30333.3 | 0.0049 | 0.305 | 14 |
| LAB276_H0 | 30333.7 | 0.124 | 0.080 | 26 | LAB276_H0 | 30333.7 | 0.0051 | 0.474 | 19 |
| LAB277 | 30651.2 | 0.099 | 0.947 | 1 | LAB277 | 30651.2 | 0.0051 | 0.406 | 18 |
| LAB277 | 30652.3 | 0.117 | 0.222 | 19 | LAB277 | 30652.3 | 0.0052 | 0.226 | 21 |
| LAB277 | 30652.5 | 0.114 | 0.152 | 16 | LAB277 | 30652.5 | 0.0053 | 0.160 | 23 |
| LAB277 | 30653.1 | 0.134 | 0.044 | 36 | LAB277 | 30653.1 | 0.0077 | 0.014 | 79 |
| LAB278 | 30411.4 | 0.170 | 0.051 | 73 | LAB278 | 30411.4 | 0.0072 | 0.159 | 68 |
| LAB278 | 30412.1 | 0.109 | 0.649 | 11 | LAB278 | 30412.1 | — | — | — |
| LAB278 | 30413.3 | 0.110 | 0.417 | 12 | LAB278 | 30413.3 | 0.0046 | 0.816 | 7 |
| LAB278 | 30414.1 | — | — | — | LAB278 | 30414.1 | 0.0048 | 0.454 | 12 |
| LAB278 | 30414.2 | 0.143 | 0.210 | 46 | LAB278 | 30414.2 | 0.0069 | 0.010 | 60 |
| LAB281 | 30741.1 | 0.101 | 0.808 | 3 | LAB281 | 30741.1 | 0.0046 | 0.872 | 7 |
| LAB281 | 30742.1 | 0.102 | 0.761 | 4 | LAB281 | 30742.1 | 0.0043 | 0.996 | 0 |
| LAB281 | 30742.4 | 0.114 | 0.304 | 16 | LAB281 | 30742.4 | 0.0054 | 0.178 | 25 |
| LAB282 | 30751.3 | 0.125 | 0.264 | 27 | LAB282 | 30751.3 | 0.0054 | 0.558 | 26 |
| CONT | — | 0.098 | — | 0 | CONT | — | 0.0043 | — | 0 |
| LAB110 | 30571.3 | 0.116 | 0.620 | 12 | LAB110 | 30571.3 | 0.0058 | 0.431 | 16 |
| LAB110 | 30572.1 | 0.112 | 0.694 | 7 | LAB110 | 30572.1 | 0.0053 | 0.541 | 7 |
| LAB110 | 30572.2 | 0.195 | 0.023 | 87 | LAB110 | 30572.2 | 0.0105 | 0.000 | 112 |
| LAB110 | 30573.2 | 0.107 | 0.871 | 3 | LAB110 | 30573.2 | 0.0060 | 0.255 | 20 |
| LAB110 | 30574.2 | 0.157 | 0.070 | 51 | LAB110 | 30574.2 | 0.0080 | 0.036 | 61 |
| LAB117 | 27291.2 | 0.132 | 0.221 | 26 | LAB117 | 27291.2 | 0.0071 | 0.052 | 43 |
| LAB117 | 27293.1 | 0.194 | 0.019 | 87 | LAB117 | 27293.1 | 0.0118 | 0.015 | 136 |
| LAB117 | 27296.1 | 0.141 | 0.043 | 36 | LAB117 | 27296.1 | 0.0072 | 0.014 | 45 |
| LAB124 | 30432.3 | — | — | — | LAB124 | 30432.3 | 0.0053 | 0.511 | 7 |
| LAB124 | 30434.1 | 0.105 | 0.958 | 1 | LAB124 | 30434.1 | 0.0061 | 0.236 | 22 |
| LAB125 | 30581.3 | 0.136 | 0.288 | 31 | LAB125 | 30581.3 | 0.0062 | 0.564 | 24 |
| LAB125 | 30582.2 | — | — | — | LAB125 | 30582.2 | 0.0055 | 0.568 | 11 |

TABLE 56-continued

Genes showing improved plant performance under osmotic stress conditions (T2 generation)

| | Plant Biomass Fresh Weight [gr.] | | | | | Plant Biomass Dry Weight [gr.] | | | |
|---|---|---|---|---|---|---|---|---|---|
| Gene Name | Event # | Ave. | p-val. | % Incr. | Gene Name | Event # | Ave. | p-val. | % Incr. |
| LAB125 | 30584.2 | 0.175 | 0.053 | 68 | LAB125 | 30584.2 | 0.0095 | 0.042 | 91 |
| LAB156 | 30401.4 | 0.107 | 0.826 | 3 | LAB156 | 30401.4 | 0.0069 | 0.019 | 39 |
| LAB156 | 30403.4 | — | — | — | LAB156 | 30403.4 | 0.0054 | 0.392 | 9 |
| LAB156 | 30405.3 | 0.141 | 0.156 | 35 | LAB156 | 30405.3 | 0.0069 | 0.207 | 38 |
| LAB228 | 30082.3 | 0.169 | 0.034 | 62 | LAB228 | 30082.3 | 0.0090 | 0.010 | 81 |
| LAB228 | 30084.3 | 0.126 | 0.354 | 21 | LAB228 | 30084.3 | 0.0055 | 0.469 | 10 |
| LAB228 | 30084.4 | 0.121 | 0.309 | 17 | LAB228 | 30084.4 | — | — | — |
| LAB275 | 30361.2 | — | — | — | LAB275 | 30361.2 | 0.0053 | 0.664 | 7 |
| LAB275 | 30361.3 | 0.110 | 0.816 | 6 | LAB275 | 30361.3 | — | — | — |
| LAB275 | 30363.1 | 0.115 | 0.529 | 10 | LAB275 | 30363.1 | 0.0062 | 0.161 | 24 |
| LAB275 | 30363.4 | 0.105 | 0.956 | 1 | LAB275 | 30363.4 | 0.0053 | 0.591 | 7 |
| LAB275 | 30366.4 | — | — | — | LAB275 | 30366.4 | 0.0057 | 0.391 | 14 |
| LAB276_H0 | 30331.1 | 0.146 | 0.350 | 40 | LAB276_H0 | 30331.1 | 0.0076 | 0.303 | 53 |
| LAB276_H0 | 30331.4 | 0.199 | 0.000 | 91 | LAB276_H0 | 30331.4 | 0.0090 | 0.006 | 81 |
| LAB277 | 30652.3 | 0.107 | 0.890 | 3 | LAB277 | 30652.3 | 0.0057 | 0.313 | 15 |
| LAB277 | 30652.6 | 0.140 | 0.063 | 34 | LAB277 | 30652.6 | 0.0075 | 0.093 | 51 |
| LAB277 | 30653.1 | — | — | — | LAB277 | 30653.1 | 0.0053 | 0.591 | 6 |
| LAB278 | 30411.4 | 0.108 | 0.835 | 4 | LAB278 | 30411.4 | 0.0052 | 0.668 | 5 |
| LAB278 | 30413.3 | 0.139 | 0.350 | 33 | LAB278 | 30413.3 | 0.0081 | 0.087 | 64 |
| LAB278 | 30414.1 | 0.161 | 0.018 | 54 | LAB278 | 30414.1 | 0.0089 | 0.016 | 80 |
| LAB278 | 30414.2 | 0.115 | 0.699 | 11 | LAB278 | 30414.2 | — | — | — |
| LAB281 | 30742.4 | — | — | — | LAB281 | 30742.4 | 0.0054 | 0.674 | 8 |
| LAB282 | 30752.2 | 0.114 | 0.698 | 9 | LAB282 | 30752.2 | — | — | — |
| LAB282 | 30753.4 | 0.108 | 0.781 | 4 | LAB282 | 30753.4 | 0.0067 | 0.022 | 34 |
| CONT | — | 0.104 | — | 0 | CONT | — | 0.0050 | — | 0 |
| LAB106 | 30031.4 | 0.125 | 0.409 | 18 | LAB106 | 30031.4 | 0.0071 | 0.363 | 22 |
| LAB106 | 30032.1 | 0.113 | 0.759 | 6 | LAB106 | 30032.1 | 0.0072 | 0.133 | 24 |
| LAB106 | 30034.1 | 0.131 | 0.426 | 24 | LAB106 | 30034.1 | 0.0071 | 0.507 | 22 |
| LAB106 | 30035.2 | 0.120 | 0.546 | 13 | LAB106 | 30035.2 | 0.0073 | 0.332 | 25 |
| LAB127 | 30811.4 | — | — | — | LAB127 | 30811.4 | 0.0059 | 0.970 | 1 |
| LAB127 | 30814.2 | 0.116 | 0.708 | 9 | LAB127 | 30814.2 | — | — | — |
| LAB128 | 28074.1 | 0.121 | 0.510 | 14 | LAB128 | 28074.1 | 0.0061 | 0.808 | 5 |
| LAB128 | 28074.3 | 0.125 | 0.198 | 17 | LAB128 | 28074.3 | 0.0067 | 0.220 | 15 |
| LAB128 | 28075.2 | 0.142 | 0.032 | 33 | LAB128 | 28075.2 | 0.0080 | 0.018 | 37 |
| LAB207 | 28842.1 | — | — | — | LAB207 | 28842.1 | 0.0061 | 0.815 | 5 |
| LAB207 | 28842.5 | 0.108 | 0.937 | 1 | LAB207 | 28842.5 | 0.0067 | 0.474 | 14 |
| LAB207 | 28845.1 | 0.114 | 0.289 | 7 | LAB207 | 28845.1 | — | — | — |
| LAB218 | 29431.3 | 0.109 | 0.860 | 3 | LAB218 | 29431.3 | 0.0061 | 0.877 | 4 |
| LAB218 | 29432.2 | 0.110 | 0.813 | 4 | LAB218 | 29432.2 | 0.0063 | 0.766 | 8 |
| LAB218 | 29434.3 | 0.126 | 0.133 | 19 | LAB218 | 29434.3 | 0.0072 | 0.218 | 23 |
| LAB252 | 30291.1 | 0.116 | 0.745 | 9 | LAB252 | 30291.1 | — | — | — |
| LAB252 | 30292.3 | 0.169 | 0.144 | 59 | LAB252 | 30292.3 | 0.0097 | 0.167 | 66 |
| LAB252 | 30292.4 | 0.128 | 0.371 | 20 | LAB252 | 30292.4 | 0.0075 | 0.341 | 28 |
| LAB309 | 30052.2 | — | — | — | LAB309 | 30052.2 | 0.0061 | 0.820 | 4 |
| LAB309 | 30052.3 | 0.132 | 0.281 | 24 | LAB309 | 30052.3 | 0.0077 | 0.164 | 32 |
| LAB309 | 30054.2 | 0.166 | 0.017 | 56 | LAB309 | 30054.2 | 0.0090 | 0.025 | 54 |
| LAB309 | 30056.1 | — | — | — | LAB309 | 30056.1 | 0.0063 | 0.542 | 8 |
| LAB337 | 27265.2 | 0.130 | 0.204 | 22 | LAB337 | 27265.2 | 0.0069 | 0.302 | 17 |
| LAB346 | 29442.2 | 0.146 | 0.187 | 38 | LAB346 | 29442.2 | 0.0081 | 0.114 | 38 |
| LAB346 | 29443.2 | 0.113 | 0.757 | 6 | LAB346 | 29443.2 | 0.0059 | 0.954 | 1 |
| LAB346 | 29445.6 | 0.136 | 0.046 | 28 | LAB346 | 29445.6 | 0.0079 | 0.042 | 36 |
| LAB80 | 30671.2 | 0.108 | 0.907 | 2 | LAB80 | 30671.2 | — | — | — |
| LAB80 | 30673.2 | 0.140 | 0.089 | 32 | LAB80 | 30673.2 | 0.0081 | 0.046 | 39 |
| LAB80 | 30675.2 | 0.140 | 0.020 | 32 | LAB80 | 30675.2 | 0.0064 | 0.217 | 9 |
| LAB80 | 30675.5 | 0.115 | 0.622 | 8 | LAB80 | 30675.5 | 0.0060 | 0.886 | 2 |
| LAB84 | 30162.4 | 0.123 | 0.546 | 15 | LAB84 | 30162.4 | 0.0067 | 0.483 | 15 |
| LAB84 | 30164.2 | 0.138 | 0.257 | 30 | LAB84 | 30164.2 | 0.0072 | 0.464 | 23 |
| CONT | — | 0.106 | — | 0 | CONT | — | 0.0058 | — | 0 |
| LAB127 | 30811.4 | 0.157 | 0.614 | 9 | LAB127 | 30811.4 | — | — | — |
| LAB127 | 30812.1 | 0.156 | 0.350 | 9 | LAB127 | 30812.1 | 0.0079 | 0.827 | 4 |
| LAB127 | 30813.2 | 0.151 | 0.835 | 5 | LAB127 | 30813.2 | — | — | — |
| LAB128 | 28071.2 | 0.159 | 0.790 | 11 | LAB128 | 28071.2 | — | — | — |
| LAB128 | 28075.2 | 0.144 | 0.957 | 1 | LAB128 | 28075.2 | — | — | — |
| LAB147 | 31104.1 | — | — | — | LAB147 | 31104.1 | 0.0080 | 0.740 | 6 |
| LAB147 | 31104.2 | 0.189 | 0.086 | 32 | LAB147 | 31104.2 | — | — | — |
| LAB147 | 31105.6 | 0.152 | 0.735 | 6 | LAB147 | 31105.6 | 0.0078 | 0.844 | 3 |
| LAB147 | 31105.7 | 0.155 | 0.776 | 8 | LAB147 | 31105.7 | — | — | — |
| LAB186 | 31001.4 | 0.271 | 0.083 | 89 | LAB186 | 31001.4 | 0.0144 | 0.084 | 91 |
| LAB186 | 31002.1 | 0.226 | 0.141 | 58 | LAB186 | 31002.1 | 0.0122 | 0.083 | 61 |
| LAB186 | 31004.1 | 0.174 | 0.098 | 21 | LAB186 | 31004.1 | 0.0084 | 0.652 | 11 |
| LAB186 | 31004.2 | 0.164 | 0.328 | 15 | LAB186 | 31004.2 | — | — | — |
| LAB197 | 31083.1 | 0.194 | 0.254 | 35 | LAB197 | 31083.1 | — | — | — |

TABLE 56-continued

Genes showing improved plant performance under osmotic stress conditions (T2 generation)

| | Plant Biomass Fresh Weight [gr.] | | | | | Plant Biomass Dry Weight [gr.] | | | |
|---|---|---|---|---|---|---|---|---|---|
| Gene Name | Event # | Ave. | p-val. | % Incr. | Gene Name | Event # | Ave. | p-val. | % Incr. |
| LAB197 | 31084.3 | 0.222 | 0.117 | 55 | LAB197 | 31084.3 | 0.0107 | 0.014 | 41 |
| LAB197 | 31085.3 | 0.162 | 0.546 | 13 | LAB197 | 31085.3 | 0.0081 | 0.739 | 7 |
| LAB315 | 31061.1 | 0.156 | 0.689 | 9 | LAB315 | 31061.1 | 0.0078 | 0.878 | 3 |
| LAB315 | 31061.2 | 0.154 | 0.621 | 7 | LAB315 | 31061.2 | — | — | — |
| LAB315 | 31063.1 | 0.161 | 0.561 | 13 | LAB315 | 31063.1 | 0.0078 | 0.904 | 2 |
| LAB317 | 30951.4 | 0.159 | 0.281 | 11 | LAB317 | 30951.4 | 0.0077 | 0.903 | 1 |
| LAB317 | 30953.1 | 0.145 | 0.936 | 1 | LAB317 | 30953.1 | — | — | — |
| LAB324 | 30961.1 | 0.150 | 0.865 | 5 | LAB324 | 30961.1 | — | — | — |
| LAB325 | 30971.4 | 0.155 | 0.431 | 8 | LAB325 | 30971.4 | 0.0078 | 0.835 | 3 |
| LAB325 | 30972.2 | 0.238 | 0.126 | 66 | LAB325 | 30972.2 | 0.0133 | 0.075 | 75 |
| LAB325 | 30973.1 | 0.207 | 0.285 | 44 | LAB325 | 30973.1 | 0.0107 | 0.209 | 41 |
| LAB325 | 30975.1 | 0.155 | 0.399 | 8 | LAB325 | 30975.1 | 0.0090 | 0.166 | 19 |
| LAB325 | 30975.4 | 0.199 | 0.406 | 39 | LAB325 | 30975.4 | 0.0104 | 0.429 | 38 |
| LAB67 | 31021.4 | 0.147 | 0.787 | 3 | LAB67 | 31021.4 | — | — | — |
| LAB67 | 31022.1 | 0.219 | 0.024 | 53 | LAB67 | 31022.1 | 0.0121 | 0.000 | 60 |
| LAB67 | 31023.3 | 0.145 | 0.949 | 1 | LAB67 | 31023.3 | 0.0083 | 0.660 | 9 |
| LAB80 | 30671.2 | 0.160 | 0.744 | 12 | LAB80 | 30671.2 | — | — | — |
| CONT | — | 0.143 | — | 0 | CONT | — | 0.0076 | — | 0 |
| LAB147 | 31103.2 | 0.145 | 0.051 | 135 | LAB147 | 31103.2 | 0.0066 | 0.094 | 85 |
| LAB147 | 31104.1 | 0.094 | 0.037 | 52 | LAB147 | 31104.1 | 0.0058 | 0.001 | 63 |
| LAB147 | 31104.2 | 0.098 | 0.011 | 58 | LAB147 | 31104.2 | 0.0058 | 0.083 | 63 |
| LAB147 | 31105.6 | 0.119 | 0.003 | 92 | LAB147 | 31105.6 | 0.0071 | 0.004 | 100 |
| LAB147 | 31105.7 | 0.085 | 0.145 | 38 | LAB147 | 31105.7 | 0.0061 | 0.001 | 71 |
| LAB178 | 30631.2 | 0.076 | 0.259 | 23 | LAB178 | 30631.2 | 0.0042 | 0.414 | 20 |
| LAB178 | 30632.1 | 0.124 | 0.145 | 100 | LAB178 | 30632.1 | 0.0067 | 0.098 | 90 |
| LAB178 | 30633.3 | 0.115 | 0.006 | 86 | LAB178 | 30633.3 | 0.0062 | 0.002 | 76 |
| LAB178 | 30633.4 | 0.140 | 0.004 | 127 | LAB178 | 30633.4 | 0.0081 | 0.012 | 130 |
| LAB178 | 30635.1 | 0.077 | 0.253 | 24 | LAB178 | 30635.1 | 0.0046 | 0.083 | 29 |
| LAB186 | 31001.4 | 0.113 | 0.052 | 84 | LAB186 | 31001.4 | 0.0063 | 0.054 | 78 |
| LAB186 | 31002.1 | 0.095 | 0.064 | 54 | LAB186 | 31002.1 | 0.0057 | 0.019 | 61 |
| LAB186 | 31003.1 | 0.156 | 0.001 | 153 | LAB186 | 31003.1 | 0.0091 | 0.000 | 156 |
| LAB186 | 31004.1 | 0.112 | 0.028 | 82 | LAB186 | 31004.1 | 0.0057 | 0.038 | 61 |
| LAB186 | 31004.2 | 0.111 | 0.119 | 80 | LAB186 | 31004.2 | 0.0054 | 0.106 | 54 |
| LAB197 | 31081.3 | 0.080 | 0.045 | 30 | LAB197 | 31081.3 | 0.0049 | 0.078 | 38 |
| LAB197 | 31083.1 | 0.064 | 0.858 | 4 | LAB197 | 31083.1 | — | — | — |
| LAB197 | 31084.3 | 0.081 | 0.170 | 32 | LAB197 | 31084.3 | 0.0048 | 0.120 | 35 |
| LAB197 | 31084.4 | 0.103 | 0.014 | 67 | LAB197 | 31084.4 | 0.0054 | 0.001 | 52 |
| LAB197 | 31085.3 | 0.089 | 0.082 | 43 | LAB197 | 31085.3 | 0.0046 | 0.186 | 30 |
| LAB247 | 28091.4 | 0.108 | 0.039 | 75 | LAB247 | 28091.4 | 0.0054 | 0.024 | 52 |
| LAB247 | 28093.2 | 0.089 | 0.255 | 45 | LAB247 | 28093.2 | 0.0051 | 0.105 | 44 |
| LAB247 | 28094.1 | 0.081 | 0.018 | 31 | LAB247 | 28094.1 | 0.0047 | 0.007 | 34 |
| LAB247 | 28094.3 | 0.098 | 0.006 | 59 | LAB247 | 28094.3 | 0.0055 | 0.000 | 54 |
| LAB247 | 28095.4 | 0.070 | 0.509 | 13 | LAB247 | 28095.4 | — | — | — |
| LAB314 | 29292.4 | — | — | — | LAB314 | 29292.4 | 0.0040 | 0.541 | 12 |
| LAB314 | 29292.6 | 0.082 | 0.036 | 33 | LAB314 | 29292.6 | 0.0045 | 0.168 | 28 |
| LAB314 | 29294.1 | 0.072 | 0.455 | 16 | LAB314 | 29294.1 | 0.0039 | 0.612 | 10 |
| LAB314 | 29294.2 | 0.083 | 0.007 | 35 | LAB314 | 29294.2 | 0.0038 | 0.539 | 6 |
| LAB314 | 29295.1 | 0.083 | 0.134 | 34 | LAB314 | 29295.1 | 0.0045 | 0.425 | 27 |
| LAB315 | 31061.1 | 0.067 | 0.342 | 9 | LAB315 | 31061.1 | — | — | — |
| LAB315 | 31061.2 | 0.142 | 0.000 | 130 | LAB315 | 31061.2 | 0.0084 | 0.000 | 136 |
| LAB315 | 31063.1 | 0.110 | 0.051 | 78 | LAB315 | 31063.1 | 0.0065 | 0.053 | 83 |
| LAB315 | 31064.3 | 0.112 | 0.030 | 81 | LAB315 | 31064.3 | 0.0060 | 0.001 | 68 |
| LAB315 | 31065.4 | 0.086 | 0.118 | 40 | LAB315 | 31065.4 | 0.0042 | 0.110 | 20 |
| LAB317 | 30952.2 | 0.125 | 0.016 | 102 | LAB317 | 30952.2 | 0.0073 | 0.010 | 106 |
| LAB317 | 30952.3 | 0.124 | 0.001 | 101 | LAB317 | 30952.3 | 0.0071 | 0.000 | 102 |
| LAB317 | 30953.1 | 0.109 | 0.131 | 76 | LAB317 | 30953.1 | 0.0061 | 0.048 | 73 |
| LAB317 | 30953.4 | 0.073 | 0.075 | 19 | LAB317 | 30953.4 | 0.0043 | 0.132 | 20 |
| LAB317 | 30954.4 | 0.113 | 0.006 | 84 | LAB317 | 30954.4 | 0.0067 | 0.051 | 89 |
| LAB324 | 30961.1 | 0.133 | 0.011 | 115 | LAB324 | 30961.1 | 0.0072 | 0.010 | 104 |
| LAB324 | 30962.2 | 0.117 | 0.120 | 90 | LAB324 | 30962.2 | 0.0046 | 0.170 | 31 |
| LAB324 | 30963.1 | 0.104 | 0.106 | 68 | LAB324 | 30963.1 | 0.0064 | 0.069 | 80 |
| LAB324 | 30965.2 | 0.101 | 0.070 | 64 | LAB324 | 30965.2 | 0.0054 | 0.011 | 53 |
| LAB324 | 30965.3 | 0.092 | 0.013 | 48 | LAB324 | 30965.3 | 0.0056 | 0.010 | 59 |
| LAB325 | 30971.4 | 0.120 | 0.001 | 94 | LAB325 | 30971.4 | 0.0078 | 0.000 | 119 |
| LAB325 | 30972.2 | 0.119 | 0.001 | 92 | LAB325 | 30972.2 | 0.0064 | 0.098 | 81 |
| LAB325 | 30973.1 | 0.094 | 0.303 | 52 | LAB325 | 30973.1 | 0.0050 | 0.311 | 40 |
| LAB325 | 30975.2 | 0.107 | 0.081 | 74 | LAB325 | 30975.2 | 0.0058 | 0.091 | 65 |
| LAB325 | 30975.4 | 0.115 | 0.010 | 86 | LAB325 | 30975.4 | 0.0060 | 0.051 | 70 |
| LAB54 | 28133.1 | 0.075 | 0.119 | 21 | LAB54 | 28133.1 | 0.0039 | 0.423 | 10 |
| LAB54 | 28133.4 | 0.222 | 0.000 | 260 | LAB54 | 28133.4 | 0.0125 | 0.000 | 253 |
| LAB54 | 28134.1 | 0.106 | 0.000 | 72 | LAB54 | 28134.1 | 0.0062 | 0.005 | 76 |
| LAB54 | 28136.1 | 0.082 | 0.125 | 33 | LAB54 | 28136.1 | 0.0041 | 0.157 | 16 |

TABLE 56-continued

Genes showing improved plant performance under osmotic stress conditions (T2 generation)

| | | Plant Biomass Fresh Weight [gr.] | | | | | Plant Biomass Dry Weight [gr.] | | |
|---|---|---|---|---|---|---|---|---|---|
| Gene Name | Event # | Ave. | p-val. | % Incr. | Gene Name | Event # | Ave. | p-val. | % Incr. |
| LAB54 | 28136.2 | 0.146 | 0.067 | 137 | LAB54 | 28136.2 | 0.0095 | 0.073 | 167 |
| LAB67 | 31021.4 | 0.071 | 0.293 | 16 | LAB67 | 31021.4 | 0.0042 | 0.195 | 19 |
| LAB67 | 31022.1 | 0.145 | 0.007 | 136 | LAB67 | 31022.1 | 0.0100 | 0.002 | 183 |
| LAB67 | 31022.6 | 0.083 | 0.011 | 34 | LAB67 | 31022.6 | 0.0061 | 0.002 | 73 |
| LAB67 | 31023.3 | 0.130 | 0.043 | 110 | LAB67 | 31023.3 | 0.0068 | 0.016 | 91 |
| LAB67 | 31023.4 | 0.072 | 0.140 | 16 | LAB67 | 31023.4 | 0.0044 | 0.040 | 25 |
| LAB68 | 29331.5 | 0.070 | 0.431 | 13 | LAB68 | 29331.5 | 0.0045 | 0.153 | 27 |
| LAB68 | 29335.1 | 0.075 | 0.644 | 21 | LAB68 | 29335.1 | 0.0036 | 0.919 | 2 |
| LAB68 | 29335.3 | — | | — | LAB68 | 29335.3 | 0.0038 | 0.486 | 8 |
| LAB73 | 30151.1 | 0.067 | 0.434 | 8 | LAB73 | 30151.1 | 0.0036 | 0.835 | 2 |
| LAB73 | 30152.1 | 0.094 | 0.050 | 53 | LAB73 | 30152.1 | 0.0053 | 0.024 | 50 |
| LAB73 | 30152.2 | 0.093 | 0.188 | 50 | LAB73 | 30152.2 | 0.0059 | 0.126 | 66 |
| LAB73 | 30153.1 | 0.096 | 0.057 | 55 | LAB73 | 30153.1 | 0.0050 | 0.078 | 42 |
| LAB73 | 30154.3 | 0.067 | 0.367 | 8 | LAB73 | 30154.3 | 0.0040 | 0.289 | 13 |
| LAB74 | 28451.3 | 0.137 | 0.080 | 123 | LAB74 | 28451.3 | 0.0079 | 0.156 | 122 |
| LAB74 | 28452.1 | 0.089 | 0.181 | 44 | LAB74 | 28452.1 | 0.0042 | 0.150 | 17 |
| LAB74 | 28452.2 | 0.125 | 0.003 | 103 | LAB74 | 28452.2 | 0.0079 | 0.002 | 123 |
| LAB74 | 28453.5 | 0.096 | 0.235 | 55 | LAB74 | 28453.5 | — | | — |
| LAB74 | 28454.1 | 0.126 | 0.016 | 105 | LAB74 | 28454.1 | 0.0070 | 0.007 | 99 |
| CONT | — | 0.062 | — | 0 | CONT | — | 0.0035 | — | 0 |
| LAB133 | 28833.2 | 0.138 | 0.206 | 36 | LAB133 | 28833.2 | 0.0051 | 0.039 | 60 |
| LAB133 | 28833.5 | 0.107 | 0.720 | 5 | LAB133 | 28833.5 | 0.0042 | 0.111 | 31 |
| LAB158 | 29412.1 | 0.131 | 0.230 | 30 | LAB158 | 29412.1 | 0.0041 | 0.117 | 28 |
| LAB158 | 29414.3 | 0.103 | 0.920 | 2 | LAB158 | 29414.3 | 0.0037 | 0.229 | 16 |
| LAB158 | 29415.1 | 0.107 | 0.788 | 5 | LAB158 | 29415.1 | 0.0052 | 0.003 | 63 |
| LAB160 | 29312.1 | 0.107 | 0.708 | 5 | LAB160 | 29312.1 | 0.0044 | 0.105 | 38 |
| LAB160 | 29314.2 | 0.109 | 0.777 | 7 | LAB160 | 29314.2 | 0.0036 | 0.737 | 12 |
| LAB160 | 29315.2 | — | | — | LAB160 | 29315.2 | 0.0041 | 0.282 | 28 |
| LAB160 | 29315.3 | 0.108 | 0.693 | 7 | LAB160 | 29315.3 | 0.0038 | 0.472 | 18 |
| LAB162 | 29341.2 | — | | — | LAB162 | 29341.2 | 0.0039 | 0.140 | 23 |
| LAB162 | 29342.6 | 0.108 | 0.623 | 7 | LAB162 | 29342.6 | 0.0039 | 0.274 | 21 |
| LAB162 | 29344.1 | — | | — | LAB162 | 29344.1 | 0.0054 | 0.006 | 68 |
| LAB177 | 29422.1 | 0.119 | 0.394 | 17 | LAB177 | 29422.1 | 0.0054 | 0.080 | 71 |
| LAB177 | 29424.3 | 0.146 | 0.139 | 44 | LAB177 | 29424.3 | 0.0062 | 0.038 | 93 |
| LAB177 | 29424.4 | — | | — | LAB177 | 29424.4 | 0.0034 | 0.622 | 8 |
| LAB177 | 29425.1 | 0.103 | 0.950 | 1 | LAB177 | 29425.1 | 0.0040 | 0.088 | 25 |
| LAB179 | 29301.4 | 0.147 | 0.437 | 45 | LAB179 | 29301.4 | 0.0045 | 0.065 | 42 |
| LAB179 | 29302.4 | — | | — | LAB179 | 29302.4 | 0.0038 | 0.298 | 19 |
| LAB179 | 29303.2 | 0.176 | 0.001 | 74 | LAB179 | 29303.2 | 0.0088 | 0.001 | 177 |
| LAB179 | 29304.3 | — | | — | LAB179 | 29304.3 | 0.0033 | 0.880 | 4 |
| LAB179 | 29304.4 | 0.145 | 0.178 | 43 | LAB179 | 29304.4 | 0.0080 | 0.055 | 150 |
| LAB185 | 28172.4 | — | | — | LAB185 | 28172.4 | 0.0037 | 0.324 | 17 |
| LAB185 | 28174.2 | 0.108 | 0.640 | 7 | LAB185 | 28174.2 | 0.0038 | 0.584 | 19 |
| LAB185 | 28175.2 | — | | — | LAB185 | 28175.2 | 0.0040 | 0.208 | 26 |
| LAB185 | 28175.3 | 0.112 | 0.656 | 11 | LAB185 | 28175.3 | 0.0054 | 0.046 | 68 |
| LAB210 | 28331.3 | — | | — | LAB210 | 28331.3 | 0.0042 | 0.205 | 31 |
| LAB210 | 28333.2 | 0.112 | 0.651 | 11 | LAB210 | 28333.2 | — | | — |
| LAB210 | 28335.3 | 0.200 | 0.019 | 98 | LAB210 | 28335.3 | 0.0089 | 0.056 | 179 |
| LAB254 | 28811.1 | 0.114 | 0.521 | 12 | LAB254 | 28811.1 | 0.0034 | 0.613 | 8 |
| LAB254 | 28814.1 | — | | — | LAB254 | 28814.1 | 0.0046 | 0.039 | 43 |
| LAB254 | 28814.5 | 0.119 | 0.496 | 17 | LAB254 | 28814.5 | 0.0061 | 0.019 | 90 |
| LAB254 | 28815.3 | 0.137 | 0.163 | 36 | LAB254 | 28815.3 | 0.0057 | 0.042 | 78 |
| LAB254 | 28815.4 | 0.145 | 0.017 | 43 | LAB254 | 28815.4 | 0.0050 | 0.091 | 57 |
| LAB293 | 29232.2 | 0.118 | 0.261 | 16 | LAB293 | 29232.2 | 0.0047 | 0.193 | 48 |
| LAB293 | 29233.2 | 0.127 | 0.251 | 25 | LAB293 | 29233.2 | 0.0042 | 0.034 | 33 |
| LAB293 | 29233.3 | 0.121 | 0.215 | 19 | LAB293 | 29233.3 | 0.0043 | 0.035 | 34 |
| LAB293 | 29233.4 | — | | — | LAB293 | 29233.4 | 0.0039 | 0.284 | 21 |
| LAB293 | 29235.4 | — | | — | LAB293 | 29235.4 | 0.0034 | 0.810 | 6 |
| LAB297 | 29272.1 | — | | — | LAB297 | 29272.1 | 0.0036 | 0.493 | 12 |
| LAB297 | 29272.5 | — | | — | LAB297 | 29272.5 | 0.0038 | 0.507 | 19 |
| LAB297 | 29273.1 | 0.139 | 0.235 | 37 | LAB297 | 29273.1 | 0.0063 | 0.066 | 97 |
| LAB297 | 29273.4 | 0.128 | 0.532 | 26 | LAB297 | 29273.4 | 0.0038 | 0.355 | 19 |
| LAB297 | 29275.1 | 0.196 | 0.006 | 93 | LAB297 | 29275.1 | 0.0080 | 0.045 | 151 |
| LAB310 | 28181.3 | 0.102 | 0.993 | 0 | LAB310 | 28181.3 | 0.0035 | 0.600 | 9 |
| LAB310 | 28182.2 | — | | — | LAB310 | 28182.2 | 0.0039 | 0.171 | 22 |
| LAB310 | 28183.3 | — | | — | LAB310 | 28183.3 | 0.0043 | 0.234 | 34 |
| LAB318 | 28101.5 | — | | — | LAB318 | 28101.5 | 0.0042 | 0.254 | 33 |
| LAB318 | 28101.7 | 0.152 | 0.095 | 50 | LAB318 | 28101.7 | 0.0060 | 0.118 | 88 |
| LAB318 | 28104.3 | — | | — | LAB318 | 28104.3 | 0.0042 | 0.211 | 31 |
| LAB327 | 29221.2 | 0.134 | 0.213 | 32 | LAB327 | 29221.2 | 0.0041 | 0.525 | 28 |
| LAB327 | 29221.5 | — | | — | LAB327 | 29221.5 | 0.0037 | 0.230 | 16 |
| LAB327 | 29221.6 | 0.106 | 0.751 | 4 | LAB327 | 29221.6 | 0.0040 | 0.345 | 24 |

TABLE 56-continued

Genes showing improved plant performance under osmotic stress conditions (T2 generation)

| Gene Name | Event # | Plant Biomass Fresh Weight [gr.] Ave. | p-val. | % Incr. | Gene Name | Event # | Plant Biomass Dry Weight [gr.] Ave. | p-val. | % Incr. |
|---|---|---|---|---|---|---|---|---|---|
| LAB327 | 29221.8 | 0.123 | 0.412 | 21 | LAB327 | 29221.8 | 0.0060 | 0.076 | 89 |
| LAB327 | 29225.4 | 0.106 | 0.799 | 4 | LAB327 | 29225.4 | — | — | — |
| LAB335 | 27311.2 | — | — | — | LAB335 | 27311.2 | 0.0039 | 0.602 | 21 |
| LAB335 | 27314.1 | — | — | — | LAB335 | 27314.1 | 0.0036 | 0.440 | 12 |
| LAB335 | 27314.2 | 0.157 | 0.170 | 55 | LAB335 | 27314.2 | 0.0071 | 0.014 | 122 |
| LAB335 | 27315.4 | 0.114 | 0.690 | 13 | LAB335 | 27315.4 | 0.0040 | 0.425 | 25 |
| CONT | — | 0.101 | — | 0 | CONT | — | 0.0032 | — | 0 |
| LAB102 | 30312.2 | 0.112 | 0.439 | 27 | LAB102 | 30312.2 | 0.0072 | 0.146 | 76 |
| LAB102 | 30312.4 | 0.102 | 0.425 | 16 | LAB102 | 30312.4 | 0.0061 | 0.077 | 51 |
| LAB102 | 30313.2 | 0.111 | 0.004 | 25 | LAB102 | 30313.2 | 0.0056 | 0.080 | 37 |
| LAB102 | 30313.3 | 0.114 | 0.356 | 30 | LAB102 | 30313.3 | 0.0066 | 0.152 | 61 |
| LAB102 | 30314.3 | 0.093 | 0.495 | 5 | LAB102 | 30314.3 | 0.0042 | 0.791 | 4 |
| LAB126 | 30201.3 | 0.132 | 0.088 | 50 | LAB126 | 30201.3 | 0.0074 | 0.089 | 82 |
| LAB126 | 30202.3 | 0.136 | 0.056 | 55 | LAB126 | 30202.3 | 0.0068 | 0.018 | 67 |
| LAB126 | 30203.3 | 0.159 | 0.020 | 80 | LAB126 | 30203.3 | 0.0106 | 0.019 | 160 |
| LAB126 | 30205.1 | 0.159 | 0.019 | 80 | LAB126 | 30205.1 | 0.0095 | 0.022 | 134 |
| LAB126 | 30205.3 | 0.132 | 0.005 | 50 | LAB126 | 30205.3 | 0.0076 | 0.000 | 86 |
| LAB165 | 30231.1 | 0.148 | 0.224 | 68 | LAB165 | 30231.1 | 0.0078 | 0.146 | 91 |
| LAB165 | 30232.1 | 0.108 | 0.336 | 22 | LAB165 | 30232.1 | 0.0063 | 0.015 | 56 |
| LAB165 | 30233.1 | 0.166 | 0.009 | 89 | LAB165 | 30233.1 | 0.0101 | 0.016 | 147 |
| LAB165 | 30235.1 | 0.096 | 0.362 | 9 | LAB165 | 30235.1 | 0.0053 | 0.158 | 30 |
| LAB167 | 27321.3 | 0.107 | 0.571 | 21 | LAB167 | 27321.3 | 0.0045 | 0.727 | 11 |
| LAB167 | 27321.4 | 0.139 | 0.019 | 58 | LAB167 | 27321.4 | 0.0095 | 0.000 | 133 |
| LAB167 | 27321.6 | 0.098 | 0.449 | 11 | LAB167 | 27321.6 | 0.0064 | 0.012 | 57 |
| LAB167 | 27324.1 | 0.120 | 0.185 | 36 | LAB167 | 27324.1 | 0.0063 | 0.053 | 55 |
| LAB220 | 30321.4 | 0.195 | 0.001 | 121 | LAB220 | 30321.4 | 0.0115 | 0.004 | 182 |
| LAB220 | 30322.3 | — | — | — | LAB220 | 30322.3 | 0.0041 | 0.952 | 1 |
| LAB220 | 30323.1 | 0.102 | 0.108 | 15 | LAB220 | 30323.1 | 0.0048 | 0.228 | 18 |
| LAB220 | 30324.4 | 0.147 | 0.157 | 67 | LAB220 | 30324.4 | 0.0080 | 0.050 | 97 |
| LAB241 | 30212.2 | — | — | — | LAB241 | 30212.2 | 0.0056 | 0.087 | 38 |
| LAB241 | 30213.1 | 0.112 | 0.393 | 27 | LAB241 | 30213.1 | 0.0067 | 0.100 | 64 |
| LAB268 | 30392.2 | 0.197 | 0.023 | 123 | LAB268 | 30392.2 | 0.0100 | 0.003 | 145 |
| LAB268 | 30395.1 | 0.164 | 0.012 | 86 | LAB268 | 30395.1 | 0.0091 | 0.000 | 124 |
| LAB280 | 30041.1 | 0.199 | 0.021 | 126 | LAB280 | 30041.1 | 0.0116 | 0.007 | 185 |
| LAB280 | 30044.1 | 0.209 | 0.033 | 137 | LAB280 | 30044.1 | 0.0114 | 0.030 | 180 |
| LAB280 | 30045.1 | 0.089 | 0.967 | 0 | LAB280 | 30045.1 | 0.0048 | 0.476 | 17 |
| LAB280 | 30045.3 | 0.126 | 0.096 | 42 | LAB280 | 30045.3 | 0.0076 | 0.042 | 86 |
| LAB289 | 30371.2 | 0.094 | 0.707 | 7 | LAB289 | 30371.2 | 0.0051 | 0.362 | 26 |
| LAB289 | 30371.4 | 0.118 | 0.083 | 34 | LAB289 | 30371.4 | 0.0060 | 0.151 | 47 |
| LAB289 | 30371.6 | 0.125 | 0.022 | 42 | LAB289 | 30371.6 | 0.0082 | 0.000 | 102 |
| LAB289 | 30375.2 | 0.269 | 0.004 | 205 | LAB289 | 30375.2 | 0.0157 | 0.002 | 287 |
| LAB289 | 30375.3 | 0.149 | 0.032 | 69 | LAB289 | 30375.3 | 0.0091 | 0.017 | 124 |
| LAB303 | 30423.4 | 0.096 | 0.544 | 9 | LAB303 | 30423.4 | 0.0059 | 0.148 | 45 |
| LAB303 | 30424.3 | 0.121 | 0.015 | 37 | LAB303 | 30424.3 | 0.0069 | 0.002 | 69 |
| LAB303 | 30425.3 | 0.166 | 0.107 | 88 | LAB303 | 30425.3 | 0.0074 | 0.006 | 81 |
| CONT | — | 0.088 | — | 0 | CONT | — | 0.0041 | — | 0 |
| LAB303 | 30421.2 | — | — | — | LAB303 | 30421.2 | 0.0039 | 0.573 | 10 |
| LAB303 | 30421.3 | 0.073 | 0.942 | 1 | LAB303 | 30421.3 | 0.0039 | 0.461 | 10 |
| LAB303 | 30423.4 | 0.120 | 0.005 | 65 | LAB303 | 30423.4 | 0.0057 | 0.083 | 60 |
| LAB303 | 30425.3 | 0.082 | 0.255 | 13 | LAB303 | 30425.3 | 0.0043 | 0.153 | 21 |
| LAB311 | 30221.4 | 0.083 | 0.198 | 14 | LAB311 | 30221.4 | 0.0048 | 0.009 | 36 |
| LAB311 | 30222.2 | 0.088 | 0.298 | 21 | LAB311 | 30222.2 | 0.0051 | 0.054 | 43 |
| LAB311 | 30223.4 | 0.138 | 0.000 | 89 | LAB311 | 30223.4 | 0.0070 | 0.006 | 99 |
| LAB311 | 30224.2 | 0.084 | 0.519 | 15 | LAB311 | 30224.2 | 0.0050 | 0.250 | 41 |
| LAB344 | 30092.3 | 0.123 | 0.009 | 70 | LAB344 | 30092.3 | 0.0074 | 0.000 | 110 |
| LAB344 | 30093.3 | 0.136 | 0.343 | 87 | LAB344 | 30093.3 | 0.0065 | 0.239 | 84 |
| LAB344 | 30096.1 | — | — | — | LAB344 | 30096.1 | 0.0037 | 0.753 | 5 |
| LAB344 | 30096.3 | 0.112 | 0.217 | 54 | LAB344 | 30096.3 | 0.0070 | 0.138 | 98 |
| LAB355 | 29281.3 | 0.191 | 0.038 | 163 | LAB355 | 29281.3 | 0.0102 | 0.066 | 187 |
| LAB355 | 29282.1 | 0.074 | 0.850 | 2 | LAB355 | 29282.1 | 0.0047 | 0.205 | 34 |
| LAB355 | 29282.2 | 0.184 | 0.082 | 153 | LAB355 | 29282.2 | 0.0097 | 0.077 | 174 |
| LAB355 | 29282.3 | 0.099 | 0.018 | 36 | LAB355 | 29282.3 | 0.0049 | 0.008 | 38 |
| LAB355 | 29283.1 | 0.082 | 0.468 | 13 | LAB355 | 29283.1 | 0.0050 | 0.045 | 42 |
| LAB367 | 30171.3 | 0.119 | 0.083 | 64 | LAB367 | 30171.3 | 0.0086 | 0.010 | 143 |
| LAB367 | 30172.3 | — | — | — | LAB367 | 30172.3 | 0.0036 | 0.940 | 2 |
| LAB367 | 30173.1 | 0.084 | 0.568 | 16 | LAB367 | 30173.1 | 0.0046 | 0.192 | 31 |
| LAB367 | 30173.3 | 0.107 | 0.267 | 48 | LAB367 | 30173.3 | 0.0059 | 0.198 | 66 |
| LAB367 | 30174.1 | 0.097 | 0.406 | 33 | LAB367 | 30174.1 | 0.0045 | 0.322 | 28 |
| LAB381 | 30351.4 | 0.118 | 0.056 | 63 | LAB381 | 30351.4 | 0.0071 | 0.072 | 101 |
| LAB381 | 30352.2 | 0.170 | 0.008 | 134 | LAB381 | 30352.2 | 0.0091 | 0.017 | 158 |
| LAB381 | 30352.4 | 0.110 | 0.213 | 52 | LAB381 | 30352.4 | 0.0063 | 0.044 | 77 |
| LAB381 | 30354.2 | 0.135 | 0.067 | 86 | LAB381 | 30354.2 | 0.0058 | 0.000 | 65 |

TABLE 56-continued

Genes showing improved plant performance under osmotic stress conditions (T2 generation)

| Gene Name | Event # | Plant Biomass Fresh Weight [gr.] | | | Gene Name | Event # | Plant Biomass Dry Weight [gr.] | | |
|---|---|---|---|---|---|---|---|---|---|
| | | Ave. | p-val. | % Incr. | | | Ave. | p-val. | % Incr. |
| LAB381 | 30356.1 | 0.102 | 0.001 | 41 | LAB381 | 30356.1 | 0.0065 | 0.001 | 85 |
| LAB383 | 28111.1 | — | — | — | LAB383 | 28111.1 | 0.0042 | 0.386 | 19 |
| LAB383 | 28111.3 | 0.172 | 0.052 | 136 | LAB383 | 28111.3 | 0.0086 | 0.049 | 142 |
| LAB383 | 28111.4 | 0.131 | 0.208 | 81 | LAB383 | 28111.4 | 0.0077 | 0.166 | 116 |
| LAB383 | 28115.2 | 0.114 | 0.137 | 56 | LAB383 | 28115.2 | 0.0057 | 0.073 | 62 |
| LAB64 | 30271.2 | 0.185 | 0.065 | 154 | LAB64 | 30271.2 | 0.0089 | 0.027 | 152 |
| LAB64 | 30272.1 | 0.123 | 0.006 | 70 | LAB64 | 30272.1 | 0.0068 | 0.032 | 92 |
| LAB64 | 30273.2 | 0.181 | 0.056 | 149 | LAB64 | 30273.2 | 0.0104 | 0.025 | 194 |
| LAB64 | 30274.2 | — | — | — | LAB64 | 30274.2 | 0.0040 | 0.287 | 14 |
| LAB64 | 30274.3 | 0.089 | 0.313 | 22 | LAB64 | 30274.3 | 0.0044 | 0.384 | 24 |
| LAB65 | 30302.1 | 0.129 | 0.039 | 77 | LAB65 | 30302.1 | 0.0070 | 0.033 | 97 |
| LAB65 | 30304.3 | — | — | — | LAB65 | 30304.3 | 0.0043 | 0.171 | 20 |
| LAB92 | 29321.2 | 0.113 | 0.112 | 55 | LAB92 | 29321.2 | 0.0067 | 0.013 | 89 |
| LAB92 | 29322.1 | 0.110 | 0.005 | 52 | LAB92 | 29322.1 | 0.0067 | 0.004 | 89 |
| LAB92 | 29323.2 | 0.108 | 0.000 | 49 | LAB92 | 29323.2 | 0.0052 | 0.078 | 48 |
| LAB92 | 29324.2 | 0.118 | 0.081 | 62 | LAB92 | 29324.2 | 0.0073 | 0.076 | 106 |
| LAB92 | 29325.1 | — | — | — | LAB92 | 29325.1 | 0.0038 | 0.815 | 6 |
| CONT | — | 0.073 | — | 0 | CONT | — | 0.0035 | — | 0 |
| LAB172 | 30852.3 | 0.101 | 0.426 | 35 | LAB172 | 30852.3 | 0.0051 | 0.198 | 37 |
| LAB172 | 30852.4 | 0.088 | 0.247 | 17 | LAB172 | 30852.4 | 0.0048 | 0.052 | 29 |
| LAB172 | 30853.4 | 0.143 | 0.246 | 91 | LAB172 | 30853.4 | 0.0073 | 0.204 | 96 |
| LAB172 | 30854.1 | 0.091 | 0.194 | 22 | LAB172 | 30854.1 | 0.0052 | 0.143 | 39 |
| LAB172 | 30854.4 | 0.105 | 0.022 | 39 | LAB172 | 30854.4 | 0.0063 | 0.003 | 68 |
| LAB188 | 30722.2 | 0.130 | 0.116 | 73 | LAB188 | 30722.2 | 0.0076 | 0.059 | 105 |
| LAB188 | 30723.3 | 0.110 | 0.250 | 47 | LAB188 | 30723.3 | 0.0056 | 0.121 | 49 |
| LAB188 | 30724.1 | — | — | — | LAB188 | 30724.1 | 0.0039 | 0.613 | 5 |
| LAB188 | 30724.2 | 0.084 | 0.754 | 12 | LAB188 | 30724.2 | 0.0039 | 0.893 | 4 |
| LAB243 | 27101.1 | 0.104 | 0.016 | 38 | LAB243 | 27101.1 | 0.0059 | 0.001 | 58 |
| LAB243 | 30872.1 | 0.139 | 0.105 | 85 | LAB243 | 30872.1 | 0.0071 | 0.092 | 92 |
| LAB243 | 30873.2 | 0.130 | 0.081 | 74 | LAB243 | 30873.2 | 0.0062 | 0.160 | 68 |
| LAB243 | 30873.4 | 0.192 | 0.008 | 157 | LAB243 | 30873.4 | 0.0107 | 0.014 | 188 |
| LAB270 | 30591.2 | 0.103 | 0.120 | 38 | LAB270 | 30591.2 | 0.0064 | 0.033 | 72 |
| LAB270 | 30595.1 | 0.103 | 0.174 | 37 | LAB270 | 30595.1 | 0.0051 | 0.228 | 37 |
| LAB270 | 30595.2 | 0.091 | 0.280 | 22 | LAB270 | 30595.2 | 0.0056 | 0.020 | 52 |
| LAB291 | 31851.2 | 0.128 | 0.096 | 71 | LAB291 | 31851.2 | 0.0071 | 0.022 | 91 |
| LAB291 | 31851.3 | 0.226 | 0.008 | 201 | LAB291 | 31851.3 | 0.0141 | 0.000 | 280 |
| LAB291 | 31852.4 | 0.134 | 0.055 | 79 | LAB291 | 31852.4 | 0.0074 | 0.126 | 98 |
| LAB291 | 31853.3 | 0.185 | 0.008 | 147 | LAB291 | 31853.3 | 0.0112 | 0.001 | 202 |
| LAB291 | 31854.4 | 0.111 | 0.000 | 48 | LAB291 | 31854.4 | 0.0057 | 0.065 | 53 |
| LAB295 | 31861.3 | 0.171 | 0.030 | 129 | LAB295 | 31861.3 | 0.0096 | 0.020 | 159 |
| LAB295 | 31863.1 | 0.144 | 0.066 | 93 | LAB295 | 31863.1 | 0.0077 | 0.001 | 107 |
| LAB295 | 31864.3 | 0.143 | 0.148 | 90 | LAB295 | 31864.3 | 0.0077 | 0.126 | 107 |
| LAB295 | 31864.4 | 0.176 | 0.097 | 135 | LAB295 | 31864.4 | 0.0100 | 0.050 | 169 |
| LAB295 | 31865.1 | 0.099 | 0.059 | 32 | LAB295 | 31865.1 | 0.0061 | 0.006 | 65 |
| LAB323 | 30381.4 | 0.211 | 0.035 | 182 | LAB323 | 30381.4 | 0.0102 | 0.031 | 174 |
| LAB323 | 30383.1 | 0.080 | 0.822 | 7 | LAB323 | 30383.1 | — | — | — |
| LAB323 | 30383.2 | 0.113 | 0.005 | 51 | LAB323 | 30383.2 | 0.0070 | 0.025 | 89 |
| LAB347_H0 | 30441.1 | 0.091 | 0.140 | 21 | LAB347_H0 | 30441.1 | 0.0050 | 0.054 | 33 |
| LAB347_H0 | 30443.4 | — | — | — | LAB347_H0 | 30443.4 | 0.0049 | 0.014 | 32 |
| LAB347_H0 | 30444.1 | 0.101 | 0.046 | 34 | LAB347_H0 | 30444.1 | 0.0060 | 0.056 | 62 |
| LAB347_H0 | 30444.3 | 0.139 | 0.033 | 86 | LAB347_H0 | 30444.3 | 0.0080 | 0.020 | 114 |
| LAB55 | 30023.1 | 0.125 | 0.018 | 66 | LAB55 | 30023.1 | 0.0063 | 0.002 | 68 |
| LAB55 | 30023.3 | 0.084 | 0.587 | 12 | LAB55 | 30023.3 | 0.0043 | 0.300 | 16 |
| LAB55 | 30025.3 | 0.097 | 0.166 | 30 | LAB55 | 30025.3 | 0.0053 | 0.145 | 42 |
| LAB55 | 30025.4 | 0.084 | 0.336 | 12 | LAB55 | 30025.4 | 0.0050 | 0.095 | 35 |
| LAB94 | 30681.4 | 0.081 | 0.354 | 9 | LAB94 | 30681.4 | — | — | — |
| LAB94 | 30682.2 | 0.098 | 0.050 | 31 | LAB94 | 30682.2 | 0.0048 | 0.162 | 30 |
| CONT | — | 0.075 | — | 0 | CONT | — | 0.0037 | — | 0 |
| LAB243 | 30873.2 | 0.169 | 0.470 | 15 | LAB243 | 30873.2 | 0.0090 | 0.378 | 19 |
| LAB291 | 31851.3 | 0.185 | 0.193 | 26 | LAB291 | 31851.3 | 0.0093 | 0.351 | 23 |
| LAB291 | 31854.4 | 0.170 | 0.545 | 16 | LAB291 | 31854.4 | 0.0098 | 0.254 | 30 |
| LAB295 | 31863.1 | 0.164 | 0.622 | 12 | LAB295 | 31863.1 | 0.0076 | 0.960 | 1 |
| CONT | — | 0.147 | — | 0 | CONT | — | 0.0075 | — | 0 |

Table 56. "CONT."—Control; "Ave."—Average; "% Incr." = % increment; "p-val."—p-value.

TABLE 57

Genes showing improved plant performance under osmotic stress conditions (T2 generation)

| Gene Name | Event # | Leaf Area [cm2] Ave. | p-value | % Incr. |
|---|---|---|---|---|
| LAB115 | 27281.2 | 0.492581 | 0.550029 | 7.5041 |
| LAB115 | 27284.3 | 0.491238 | 0.409865 | 7.2108 |
| LAB115 | 27285.2 | 0.600376 | 0.073903 | 31.0299 |
| LAB123 | 28282.3 | 0.474588 | 0.719054 | 3.5772 |
| LAB123 | 28285.2 | 0.541201 | 0.064459 | 18.1151 |
| LAB183 | 27452.2 | 0.535593 | 0.26164 | 16.8911 |
| LAB189 | 28163.2 | 0.475895 | 0.665098 | 3.8623 |
| LAB212 | 28042.1 | 0.606956 | 0.001791 | 32.4661 |
| LAB212 | 28043.2 | 0.566207 | 0.144842 | 23.5726 |
| LAB217 | 28033.2 | 0.548179 | 0.401974 | 19.6381 |
| LAB217 | 28034.1 | 0.537861 | 0.409899 | 17.3863 |
| LAB326 | 28053.2 | 0.609536 | 0.219758 | 33.029 |
| LAB326 | 28054.1 | 0.470813 | 0.733727 | 2.7531 |
| LAB326 | 28056.2 | 0.487388 | 0.656455 | 6.3708 |
| CONTROL | — | 0.458198 | — | 0 |
| LAB115 | 27281.3 | 0.405226 | 0.470403 | 21.0703 |
| LAB115 | 27284.3 | 0.40826 | 0.250554 | 21.9768 |
| LAB115 | 27285.1 | 0.456307 | 0.165822 | 36.3319 |
| LAB123 | 28281.1 | 0.931889 | 0.001103 | 178.423 |
| LAB123 | 28282.3 | 0.517971 | 0.022203 | 54.7555 |
| LAB123 | 28283.1 | 0.664148 | 0.046241 | 98.4293 |
| LAB123 | 28284.1 | 0.569157 | 0.00031 | 70.0485 |
| LAB123 | 28285.2 | 0.666459 | 0.000298 | 99.1196 |
| LAB183 | 27453.1 | 0.344789 | 0.624562 | 3.0136 |
| LAB183 | 27453.4 | 0.541672 | 0.008339 | 61.8367 |
| LAB189 | 28163.2 | 0.34512 | 0.849484 | 3.1124 |
| LAB189 | 28164.2 | 0.352018 | 0.794778 | 5.1734 |
| LAB189 | 28166.2 | 0.521153 | 0.28994 | 55.7063 |
| LAB189 | 28166.5 | 0.351799 | 0.77102 | 5.108 |
| LAB206 | 30011.2 | 0.438581 | 0.000145 | 31.0361 |
| LAB206 | 30012.4 | 0.424324 | 0.071649 | 26.7764 |
| LAB206 | 30012.8 | 0.416905 | 0.242639 | 24.5598 |
| LAB212 | 28041.1 | 0.348075 | 0.812788 | 3.9954 |
| LAB212 | 28045.1 | 0.389928 | 0.072483 | 16.4997 |
| LAB217 | 28033.2 | 0.589107 | 0.005534 | 76.009 |
| LAB217 | 28034.1 | 0.490329 | 0.081787 | 46.4968 |
| LAB217 | 28034.3 | 0.407859 | 0.183291 | 21.857 |
| LAB217 | 28035.1 | 0.564533 | 0.058804 | 68.6669 |
| LAB217 | 28036.1 | 0.487975 | 0.113276 | 45.7935 |
| LAB250 | 30251.2 | 0.477266 | 0.047278 | 42.594 |
| LAB250 | 30252.1 | 0.432266 | 0.262131 | 29.1493 |
| LAB250 | 30253.1 | 0.340796 | 0.878908 | 1.8205 |
| LAB250 | 30254.3 | 0.373202 | 0.5178 | 11.5024 |
| LAB314 | 29292.6 | 0.458433 | 0.044845 | 36.9673 |
| LAB314 | 29294.1 | 0.347632 | 0.624312 | 3.8628 |
| LAB326 | 28052.4 | 0.384941 | 0.281381 | 15.0098 |
| LAB326 | 28056.3 | 0.391255 | 0.200582 | 16.8962 |
| LAB351 | 30112.1 | 0.393817 | 0.362382 | 17.6617 |
| LAB351 | 30114.2 | 0.335987 | 0.943057 | 0.3836 |
| LAB351 | 30115.1 | 0.39702 | 0.230711 | 18.6186 |
| LAB351 | 30115.3 | 0.357745 | 0.58414 | 6.8844 |
| LAB93 | 28271.3 | 0.452625 | 0.293431 | 35.2318 |
| LAB93 | 28271.4 | 0.366399 | 0.508579 | 9.4699 |
| LAB93 | 28272.3 | 0.609827 | 0.005631 | 82.1995 |
| LAB93 | 28274.2 | 0.424391 | 0.351458 | 26.7964 |
| LAB93 | 28274.3 | 0.397579 | 0.073034 | 18.7858 |
| CONTROL | — | 0.334703 | — | 0 |
| LAB106 | 30031.4 | 0.433242 | 0.809753 | 1.1617 |
| LAB106 | 30032.1 | 0.604263 | 0.010781 | 41.0951 |
| LAB106 | 30032.5 | 0.613151 | 0.0449 | 43.1703 |
| LAB206 | 30011.7 | 0.511335 | 0.123124 | 19.3964 |
| LAB206 | 30012.4 | 0.48376 | 0.52015 | 12.9576 |
| LAB206 | 30012.8 | 0.493725 | 0.26732 | 15.2845 |
| LAB207 | 28842.1 | 0.492689 | 0.215024 | 15.0426 |
| LAB207 | 28842.5 | 0.50988 | 0.138254 | 19.0566 |
| LAB207 | 28843.3 | 0.592716 | 0.009049 | 38.3988 |
| LAB207 | 28843.5 | 0.462581 | 0.470746 | 8.0124 |
| LAB218 | 29432.2 | 0.497758 | 0.005533 | 16.2261 |
| LAB218 | 29434.3 | 0.480693 | 0.592747 | 12.2414 |
| LAB250 | 30252.1 | 0.433915 | 0.888913 | 1.3189 |
| LAB250 | 30253.1 | 0.572333 | 0.112403 | 33.6393 |
| LAB252 | 30291.4 | 0.539245 | 0.082946 | 25.9132 |
| LAB252 | 30292.3 | 0.728927 | 0.015284 | 70.2039 |
| LAB309 | 30052.2 | 0.53437 | 0.082382 | 24.7749 |
| LAB309 | 30052.3 | 0.638199 | 0.104583 | 49.0189 |
| LAB314 | 29292.4 | 0.548978 | 0.108212 | 28.1859 |
| LAB314 | 29292.6 | 0.514209 | 0.296004 | 20.0673 |
| LAB314 | 29294.1 | 0.587109 | 0.078976 | 37.0896 |
| LAB314 | 29295.2 | 0.589143 | 0.166901 | 37.5644 |
| LAB346 | 29442.2 | 0.430409 | 0.91403 | 0.5001 |
| LAB346 | 29442.4 | 0.473001 | 0.011265 | 10.4454 |
| LAB346 | 29443.2 | 0.509608 | 0.408925 | 18.993 |
| LAB346 | 29445.3 | 0.607803 | 0.000412 | 41.9217 |
| LAB351 | 30111.2 | 0.582071 | 0.0824 | 35.9131 |
| LAB351 | 30114.2 | 0.547015 | 0.000989 | 27.7275 |
| LAB82 | 30181.3 | 0.446253 | 0.782242 | 4.1997 |
| LAB84 | 30161.4 | 0.620047 | 0.036393 | 44.7806 |
| LAB84 | 30162.2 | 0.463221 | 0.57883 | 8.1618 |
| LAB84 | 30162.4 | 0.75909 | 0.037918 | 77.2469 |
| LAB84 | 30163.4 | 0.586299 | 0.079822 | 36.9004 |
| LAB84 | 30164.2 | 0.725831 | 0.053685 | 69.481 |
| CONTROL | — | 0.428267 | — | 0 |
| LAB110 | 30571.3 | 0.536832 | 0.044102 | 27.9731 |
| LAB110 | 30572.1 | 0.434081 | 0.758985 | 3.4786 |
| LAB110 | 30573.2 | 0.544723 | 0.103607 | 29.8541 |
| LAB110 | 30574.2 | 0.585938 | 0.013378 | 39.6793 |
| LAB117 | 27291.1 | 0.48302 | 0.248833 | 15.145 |
| LAB117 | 27291.5 | 0.673927 | 0.049242 | 60.6545 |
| LAB117 | 27293.1 | 0.751263 | 0.028464 | 79.0904 |
| LAB117 | 27296.1 | 0.644995 | 0.051948 | 53.7576 |
| LAB124 | 30431.1 | 0.576713 | 0.135159 | 37.4802 |
| LAB124 | 30432.3 | 0.444879 | 0.450955 | 6.0528 |
| LAB124 | 30434.1 | 0.457703 | 0.644762 | 9.1099 |
| LAB124 | 30434.3 | 0.619718 | 0.007451 | 47.732 |
| LAB124 | 30435.2 | 0.547173 | 0.036318 | 30.4383 |
| LAB125 | 30581.3 | 0.479091 | 0.164977 | 14.2083 |
| LAB125 | 30583.1 | 0.430392 | 0.690373 | 2.5993 |
| LAB125 | 30583.2 | 0.545187 | 0.155513 | 29.9648 |
| LAB156 | 30401.4 | 0.493363 | 0.266154 | 17.6106 |
| LAB156 | 30402.2 | 0.629655 | 0.000094 | 50.1008 |
| LAB156 | 30403.1 | 0.514312 | 0.056065 | 22.6047 |
| LAB156 | 30403.4 | 0.46755 | 0.029832 | 11.4572 |
| LAB156 | 30405.3 | 0.445987 | 0.413778 | 6.317 |
| LAB228 | 30084.3 | 0.504385 | 0.066816 | 20.2383 |
| LAB275 | 30361.3 | 0.634276 | 0.037049 | 51.2024 |
| LAB275 | 30363.1 | 0.440686 | 0.640677 | 5.0533 |
| LAB275 | 30363.4 | 0.464658 | 0.276712 | 10.7678 |
| LAB275 | 30366.4 | 0.452122 | 0.170325 | 7.7794 |
| LAB276_H0 | 30331.1 | 0.743994 | 0.017181 | 77.3576 |
| LAB276_H0 | 30333.3 | 0.503326 | 0.057465 | 19.9858 |
| LAB276_H0 | 30333.7 | 0.475515 | 0.143282 | 13.3561 |
| LAB277 | 30651.2 | 0.462981 | 0.211085 | 10.368 |
| LAB277 | 30652.3 | 0.49313 | 0.182928 | 17.5553 |
| LAB277 | 30652.5 | 0.533964 | 0.000193 | 27.2893 |
| LAB277 | 30653.1 | 0.628786 | 0.023225 | 49.8937 |
| LAB278 | 30411.4 | 0.535183 | 0.146022 | 27.5801 |
| LAB278 | 30412.1 | 0.476332 | 0.200056 | 13.5508 |
| LAB278 | 30413.3 | 0.51687 | 0.184518 | 23.2144 |
| LAB278 | 30414.2 | 0.476043 | 0.459745 | 13.4819 |
| LAB281 | 30741.1 | 0.567167 | 0.046979 | 35.2046 |
| LAB281 | 30742.1 | 0.472732 | 0.275046 | 12.6926 |
| LAB281 | 30742.4 | 0.479067 | 0.303987 | 14.2028 |
| LAB281 | 30743.1 | 0.462929 | 0.058307 | 10.3556 |
| LAB282 | 30751.3 | 0.580444 | 0.000653 | 38.3695 |
| LAB282 | 30754.2 | 0.436443 | 0.767815 | 4.0418 |
| CONTROL | — | 0.419488 | — | 0 |
| LAB110 | 30572.2 | 0.779042 | 0 | 69.3998 |
| LAB110 | 30573.2 | 0.489878 | 0.48067 | 6.5221 |
| LAB110 | 30574.2 | 0.568641 | 0.081905 | 23.6488 |
| LAB117 | 27291.2 | 0.604603 | 0.14437 | 31.4685 |
| LAB117 | 27293.1 | 0.749335 | 0.04519 | 62.9401 |
| LAB117 | 27296.1 | 0.676169 | 0.061711 | 47.0304 |
| LAB124 | 30434.1 | 0.55654 | 0.201147 | 21.0176 |
| LAB125 | 30581.3 | 0.602427 | 0.172697 | 30.9956 |
| LAB125 | 30584.2 | 0.721511 | 0.022792 | 56.8898 |
| LAB156 | 30401.4 | 0.593774 | 0.055292 | 29.1138 |

TABLE 57-continued

Genes showing improved plant performance under osmotic stress conditions (T2 generation)

| Gene Name | Event # | Leaf Area [cm2] Ave. | p-value | % Incr. |
|---|---|---|---|---|
| LAB156 | 30403.4 | 0.471576 | 0.799002 | 2.5424 |
| LAB156 | 30405.3 | 0.571045 | 0.084402 | 24.1715 |
| LAB228 | 30082.3 | 0.71399 | 0.02019 | 55.2544 |
| LAB228 | 30084.4 | 0.484567 | 0.488401 | 5.3672 |
| LAB275 | 30361.3 | 0.472891 | 0.841761 | 2.8283 |
| LAB275 | 30363.1 | 0.525901 | 0.116218 | 14.3553 |
| LAB275 | 30363.4 | 0.467866 | 0.86448 | 1.7356 |
| LAB276_H0 | 30331.1 | 0.579806 | 0.411028 | 26.0765 |
| LAB276_H0 | 30331.4 | 0.741702 | 0.00215 | 61.2803 |
| LAB276_H0 | 30333.7 | 0.473788 | 0.763189 | 3.0234 |
| LAB277 | 30652.3 | 0.484435 | 0.511735 | 5.3385 |
| LAB277 | 30652.6 | 0.565196 | 0.018512 | 22.8997 |
| LAB277 | 30653.1 | 0.47342 | 0.696594 | 2.9435 |
| LAB278 | 30411.4 | 0.468236 | 0.911304 | 1.8163 |
| LAB278 | 30413.3 | 0.587589 | 0.249059 | 27.769 |
| LAB278 | 30414.1 | 0.663996 | 0.004889 | 44.3835 |
| LAB278 | 30414.2 | 0.551584 | 0.076912 | 19.9398 |
| LAB282 | 30752.2 | 0.469438 | 0.794792 | 2.0775 |
| LAB282 | 30753.4 | 0.504913 | 0.260512 | 9.7915 |
| CONTROL | — | 0.459884 | — | 0 |
| LAB106 | 30031.4 | 0.465433 | 0.455329 | 12.0166 |
| LAB106 | 30035.2 | 0.470797 | 0.287758 | 13.3077 |
| LAB127 | 30811.4 | 0.441931 | 0.628879 | 6.3604 |
| LAB128 | 28075.2 | 0.526959 | 0.020352 | 26.8242 |
| LAB207 | 28842.1 | 0.46412 | 0.580757 | 11.7007 |
| LAB207 | 28842.5 | 0.429851 | 0.860162 | 3.453 |
| LAB218 | 29431.3 | 0.459688 | 0.719811 | 10.634 |
| LAB218 | 29433.4 | 0.449736 | 0.497642 | 8.2388 |
| LAB218 | 29434.3 | 0.430604 | 0.645537 | 3.6343 |
| LAB252 | 30292.3 | 0.623292 | 0.209372 | 50.0088 |
| LAB252 | 30292.4 | 0.522909 | 0.283602 | 25.8496 |
| LAB309 | 30052.3 | 0.541754 | 0.078526 | 30.3849 |
| LAB309 | 30054.2 | 0.500653 | 0.061998 | 20.4932 |
| LAB309 | 30056.1 | 0.44214 | 0.703517 | 6.4107 |
| LAB337 | 27265.1 | 0.429209 | 0.830246 | 3.2986 |
| LAB337 | 27265.2 | 0.508096 | 0.309374 | 22.2844 |
| LAB346 | 29442.2 | 0.493886 | 0.450987 | 18.8644 |
| LAB346 | 29443.2 | 0.430175 | 0.841819 | 3.531 |
| LAB346 | 29445.6 | 0.460336 | 0.327389 | 10.79 |
| LAB80 | 30673.2 | 0.45865 | 0.250836 | 10.3843 |
| CONTROL | — | 0.415503 | — | 0 |
| LAB127 | 30811.4 | 0.565154 | 0.670346 | 4.469 |
| LAB127 | 30812.1 | 0.542791 | 0.977218 | 0.3352 |
| LAB128 | 28075.2 | 0.545578 | 0.946077 | 0.8503 |
| LAB147 | 31104.1 | 0.589211 | 0.508254 | 8.916 |
| LAB147 | 31104.2 | 0.58599 | 0.520365 | 8.3205 |
| LAB147 | 31105.6 | 0.585524 | 0.426867 | 8.2344 |
| LAB186 | 31001.4 | 0.839527 | 0.062035 | 55.187 |
| LAB186 | 31002.1 | 0.684112 | 0.110027 | 26.4585 |
| LAB186 | 31004.1 | 0.610187 | 0.324353 | 12.7934 |
| LAB186 | 31004.2 | 0.567542 | 0.64125 | 4.9103 |
| LAB197 | 31084.3 | 0.685466 | 0.042039 | 26.7087 |
| LAB315 | 31061.1 | 0.575347 | 0.735246 | 6.3531 |
| LAB315 | 31063.1 | 0.630407 | 0.129457 | 16.531 |
| LAB317 | 30951.4 | 0.577024 | 0.521638 | 6.6632 |
| LAB325 | 30971.4 | 0.573235 | 0.624246 | 5.9628 |
| LAB325 | 30972.2 | 0.851595 | 0.087823 | 57.4178 |
| LAB325 | 30973.1 | 0.684022 | 0.173355 | 26.4418 |
| LAB325 | 30975.1 | 0.595892 | 0.190482 | 10.1509 |
| LAB325 | 30975.2 | 0.751681 | 0.271172 | 38.9485 |
| LAB67 | 31021.4 | 0.610333 | 0.289083 | 12.8203 |
| LAB67 | 31022.1 | 0.924785 | 0.000412 | 70.947 |
| CONTROL | — | 0.540978 | — | 0 |
| LAB147 | 31103.2 | 0.424483 | 0.148617 | 55.16 |
| LAB147 | 31104.1 | 0.331882 | 0.140152 | 21.3119 |
| LAB147 | 31104.2 | 0.329353 | 0.194598 | 20.3874 |
| LAB147 | 31105.6 | 0.377447 | 0.061911 | 37.967 |
| LAB147 | 31105.7 | 0.376588 | 0.131288 | 37.6531 |
| LAB178 | 30632.1 | 0.36229 | 0.053255 | 32.4266 |
| LAB178 | 30633.3 | 0.398419 | 0.007803 | 45.633 |
| LAB178 | 30633.4 | 0.388219 | 0.030637 | 41.9045 |
| LAB186 | 31001.4 | 0.368203 | 0.013186 | 34.5882 |
| LAB186 | 31002.1 | 0.29727 | 0.537463 | 8.6603 |
| LAB186 | 31003.1 | 0.455729 | 0.014611 | 66.5811 |
| LAB186 | 31004.1 | 0.345937 | 0.265102 | 26.4492 |
| LAB186 | 31004.2 | 0.37409 | 0.232684 | 36.74 |
| LAB197 | 31081.3 | 0.33295 | 0.18789 | 21.7021 |
| LAB197 | 31084.3 | 0.2826 | 0.833002 | 3.2981 |
| LAB197 | 31084.4 | 0.387674 | 0.012062 | 41.7054 |
| LAB197 | 31085.3 | 0.288729 | 0.783107 | 5.5382 |
| LAB247 | 28091.4 | 0.300824 | 0.528273 | 9.9592 |
| LAB247 | 28094.3 | 0.316522 | 0.370158 | 15.6975 |
| LAB314 | 29292.6 | 0.342382 | 0.07535 | 25.1499 |
| LAB314 | 29294.1 | 0.301714 | 0.424111 | 10.2847 |
| LAB314 | 29295.1 | 0.278065 | 0.918831 | 1.6402 |
| LAB315 | 31061.2 | 0.499781 | 0.000044 | 82.6835 |
| LAB315 | 31063.1 | 0.411009 | 0.033191 | 50.2351 |
| LAB315 | 31064.3 | 0.376237 | 0.029749 | 37.5248 |
| LAB317 | 30952.2 | 0.331162 | 0.349316 | 21.0487 |
| LAB317 | 30952.3 | 0.368499 | 0.089009 | 34.6963 |
| LAB317 | 30953.1 | 0.357199 | 0.153688 | 30.5668 |
| LAB317 | 30954.4 | 0.36408 | 0.076628 | 33.0811 |
| LAB324 | 30961.1 | 0.372431 | 0.137357 | 36.1338 |
| LAB324 | 30963.1 | 0.392933 | 0.007852 | 43.6277 |
| LAB325 | 30971.4 | 0.363026 | 0.070271 | 32.6958 |
| LAB325 | 30972.2 | 0.433389 | 0.015891 | 58.4154 |
| LAB325 | 30973.1 | 0.287165 | 0.819366 | 4.9666 |
| LAB325 | 30975.2 | 0.370916 | 0.248236 | 35.5799 |
| LAB325 | 30975.4 | 0.379836 | 0.038539 | 38.8402 |
| LAB54 | 28133.4 | 0.707245 | 0.002196 | 158.517 |
| LAB54 | 28134.1 | 0.376218 | 0.039459 | 37.5179 |
| LAB54 | 28136.1 | 0.328516 | 0.29264 | 20.0816 |
| LAB54 | 28136.2 | 0.452787 | 0.018803 | 65.5058 |
| LAB67 | 31022.1 | 0.498288 | 0.001131 | 82.1376 |
| LAB67 | 31022.6 | 0.291578 | 0.751845 | 6.5798 |
| LAB67 | 31023.3 | 0.368188 | 0.022824 | 34.5827 |
| LAB67 | 31023.4 | 0.316952 | 0.464277 | 15.8545 |
| LAB73 | 30152.1 | 0.375887 | 0.132887 | 37.3968 |
| LAB73 | 30152.2 | 0.333882 | 0.159834 | 22.0429 |
| LAB73 | 30153.1 | 0.326093 | 0.419964 | 19.196 |
| LAB73 | 30154.3 | 0.286529 | 0.837266 | 4.7342 |
| LAB74 | 28451.3 | 0.501417 | 0.109506 | 83.2814 |
| LAB74 | 28452.2 | 0.424729 | 0.009466 | 55.2498 |
| LAB74 | 28454.1 | 0.434273 | 0.015961 | 58.7385 |
| CONTROL | — | 0.273578 | — | 0 |
| LAB133 | 28833.2 | 0.340892 | 0.307997 | 28.4461 |
| LAB133 | 28833.5 | 0.350463 | 0.066523 | 32.0524 |
| LAB158 | 29411.4 | 0.27109 | 0.844626 | 2.1451 |
| LAB158 | 29412.1 | 0.313925 | 0.128663 | 18.285 |
| LAB158 | 29414.3 | 0.323587 | 0.287175 | 21.9259 |
| LAB158 | 29415.1 | 0.34563 | 0.060786 | 30.2313 |
| LAB160 | 29312.1 | 0.35934 | 0.195939 | 35.3974 |
| LAB160 | 29314.2 | 0.316955 | 0.215346 | 19.4269 |
| LAB160 | 29315.2 | 0.291906 | 0.5666 | 9.9885 |
| LAB160 | 29315.3 | 0.307959 | 0.352371 | 16.0371 |
| LAB162 | 29341.2 | 0.30474 | 0.23163 | 14.8241 |
| LAB162 | 29342.6 | 0.306514 | 0.295222 | 15.4926 |
| LAB162 | 29344.1 | 0.309558 | 0.392925 | 16.6396 |
| LAB177 | 29422.1 | 0.37312 | 0.138235 | 40.5894 |
| LAB177 | 29424.3 | 0.465361 | 0.000998 | 75.3455 |
| LAB177 | 29424.4 | 0.295326 | 0.455037 | 11.277 |
| LAB177 | 29425.1 | 0.305501 | 0.373557 | 15.1112 |
| LAB179 | 29301.4 | 0.310381 | 0.187689 | 16.9499 |
| LAB179 | 29302.4 | 0.278489 | 0.71477 | 4.9331 |
| LAB179 | 29303.2 | 0.535918 | 0.000056 | 101.931 |
| LAB179 | 29304.3 | 0.285557 | 0.585268 | 7.5964 |
| LAB179 | 29304.4 | 0.451377 | 0.095538 | 70.0761 |
| LAB185 | 28172.4 | 0.296704 | 0.36514 | 11.7963 |
| LAB185 | 28174.2 | 0.300332 | 0.409349 | 13.1636 |
| LAB185 | 28175.2 | 0.275723 | 0.75459 | 3.8907 |
| LAB185 | 28175.3 | 0.373945 | 0.013385 | 40.9004 |
| LAB210 | 28331.3 | 0.268941 | 0.931731 | 1.3356 |
| LAB210 | 28333.2 | 0.270266 | 0.902819 | 1.8348 |
| LAB210 | 28333.3 | 0.288473 | 0.445704 | 8.6949 |
| LAB210 | 28335.3 | 0.564833 | 0.020279 | 112.826 |
| LAB254 | 28811.1 | 0.268492 | 0.939413 | 1.1663 |

TABLE 57-continued

Genes showing improved plant performance under osmotic stress conditions (T2 generation)

| Gene Name | Event # | Leaf Area [cm2] Ave. | p-value | % Incr. |
|---|---|---|---|---|
| LAB254 | 28814.1 | 0.357772 | 0.018758 | 34.8064 |
| LAB254 | 28814.5 | 0.39131 | 0.019069 | 47.4433 |
| LAB254 | 28815.3 | 0.387161 | 0.034381 | 45.8802 |
| LAB254 | 28815.4 | 0.270657 | 0.933994 | 1.9821 |
| LAB293 | 29232.2 | 0.406393 | 0.003783 | 53.1268 |
| LAB293 | 29233.2 | 0.357082 | 0.021152 | 34.5464 |
| LAB293 | 29233.3 | 0.379649 | 0.010432 | 43.0494 |
| LAB293 | 29233.4 | 0.292564 | 0.532652 | 10.2366 |
| LAB293 | 29235.4 | 0.32746 | 0.073601 | 23.3851 |
| LAB297 | 29272.1 | 0.303931 | 0.219252 | 14.5195 |
| LAB297 | 29272.5 | 0.296343 | 0.335333 | 11.6604 |
| LAB297 | 29273.1 | 0.377014 | 0.074132 | 42.0567 |
| LAB297 | 29273.4 | 0.303932 | 0.279946 | 14.5198 |
| LAB297 | 29275.1 | 0.532931 | 0.019069 | 100.805 |
| LAB310 | 28181.3 | 0.269727 | 0.875424 | 1.6315 |
| LAB310 | 28182.2 | 0.287101 | 0.48576 | 8.1781 |
| LAB310 | 28183.3 | 0.309661 | 0.340925 | 16.6786 |
| LAB318 | 28101.5 | 0.34235 | 0.082062 | 28.9956 |
| LAB318 | 28101.7 | 0.402919 | 0.167773 | 51.8174 |
| LAB318 | 28103.2 | 0.27395 | 0.80926 | 3.2228 |
| LAB327 | 29221.2 | 0.307034 | 0.409976 | 15.6887 |
| LAB327 | 29221.5 | 0.270627 | 0.845867 | 1.9708 |
| LAB327 | 29221.6 | 0.294868 | 0.444921 | 11.1045 |
| LAB327 | 29221.8 | 0.332527 | 0.174214 | 25.2943 |
| LAB327 | 29225.4 | 0.305729 | 0.27926 | 15.1968 |
| LAB335 | 27314.1 | 0.270331 | 0.855608 | 1.8594 |
| LAB335 | 27314.2 | 0.421045 | 0.078989 | 58.6473 |
| LAB335 | 27315.4 | 0.277605 | 0.695396 | 4.6001 |
| CONTROL | — | 0.265397 | — | 0 |
| LAB102 | 30312.2 | 0.50226 | 0.206938 | 37.3278 |
| LAB102 | 30312.4 | 0.459183 | 0.056697 | 25.5498 |
| LAB102 | 30313.2 | 0.407305 | 0.148632 | 11.3651 |
| LAB102 | 30313.3 | 0.464043 | 0.123122 | 26.8785 |
| LAB102 | 30314.3 | 0.384391 | 0.664152 | 5.1002 |
| LAB126 | 30201.3 | 0.52265 | 0.090536 | 42.9028 |
| LAB126 | 30202.3 | 0.513024 | 0.053463 | 40.2709 |
| LAB126 | 30203.3 | 0.660007 | 0.000202 | 80.4589 |
| LAB126 | 30205.1 | 0.661736 | 0.001306 | 80.9316 |
| LAB126 | 30205.3 | 0.562359 | 0.002691 | 53.7601 |
| LAB165 | 30231.1 | 0.511656 | 0.215715 | 39.8968 |
| LAB165 | 30233.1 | 0.673653 | 0.005304 | 84.1899 |
| LAB165 | 30235.1 | 0.475754 | 0.023038 | 30.0806 |
| LAB167 | 27321.3 | 0.379056 | 0.739650 | 3.6413 |
| LAB167 | 27321.4 | 0.606661 | 0.000378 | 65.873 |
| LAB167 | 27324.1 | 0.42178 | 0.191715 | 15.3229 |
| LAB220 | 30321.4 | 0.607839 | 0.007405 | 66.195 |
| LAB220 | 30323.1 | 0.382251 | 0.576082 | 4.515 |
| LAB220 | 30324.4 | 0.514024 | 0.177971 | 40.5444 |
| LAB241 | 30212.2 | 0.408671 | 0.235301 | 11.7385 |
| LAB241 | 30213.1 | 0.453615 | 0.139154 | 24.0273 |
| LAB268 | 30392.2 | 0.678247 | 0.001036 | 85.446 |
| LAB268 | 30395.1 | 0.676646 | 0.000737 | 85.0084 |
| LAB280 | 30041.1 | 0.683636 | 0.001593 | 86.9196 |
| LAB280 | 30044.1 | 0.740357 | 0.011918 | 102.428 |
| LAB280 | 30045.3 | 0.527843 | 0.053506 | 44.3228 |
| LAB289 | 30371.2 | 0.40623 | 0.45811 | 11.0712 |
| LAB289 | 30371.4 | 0.510303 | 0.045482 | 39.5268 |
| LAB289 | 30371.6 | 0.55547 | 0.000021 | 51.8763 |
| LAB289 | 30375.2 | 0.95694 | 0.000018 | 161.646 |
| LAB289 | 30375.3 | 0.576548 | 0.021054 | 57.6395 |
| LAB303 | 30423.4 | 0.374413 | 0.835659 | 2.3718 |
| LAB303 | 30424.3 | 0.493246 | 0.019303 | 34.8631 |
| LAB303 | 30425.3 | 0.552681 | 0.017897 | 51.1139 |
| CONTROL | — | 0.365738 | — | 0 |
| LAB303 | 30421.3 | 0.409815 | 0.459042 | 7.1327 |
| LAB303 | 30423.4 | 0.511628 | 0.104157 | 33.7482 |
| LAB303 | 30425.3 | 0.397345 | 0.593949 | 3.8729 |
| LAB311 | 30221.4 | 0.493731 | 0.001631 | 29.0699 |
| LAB311 | 30222.2 | 0.396091 | 0.738882 | 3.5449 |
| LAB311 | 30223.2 | 0.390541 | 0.877991 | 2.0941 |
| LAB311 | 30223.4 | 0.613702 | 0.000012 | 60.4324 |
| LAB311 | 30224.2 | 0.449738 | 0.351201 | 17.5692 |
| LAB344 | 30092.3 | 0.650905 | 0.007121 | 70.1579 |
| LAB344 | 30093.3 | 0.547598 | 0.296794 | 43.1514 |
| LAB344 | 30096.1 | 0.41722 | 0.228144 | 9.0685 |
| LAB344 | 30096.3 | 0.633404 | 0.143779 | 65.5827 |
| LAB355 | 29281.3 | 0.802823 | 0.016162 | 109.872 |
| LAB355 | 29282.1 | 0.422846 | 0.359207 | 10.5391 |
| LAB355 | 29282.2 | 0.774576 | 0.026067 | 102.488 |
| LAB355 | 29282.3 | 0.457924 | 0.050532 | 19.7091 |
| LAB355 | 29283.1 | 0.448685 | 0.301707 | 17.294 |
| LAB367 | 30171.3 | 0.647676 | 0.001533 | 69.3137 |
| LAB367 | 30173.3 | 0.502382 | 0.279815 | 31.3314 |
| LAB367 | 30174.1 | 0.39441 | 0.835721 | 3.1056 |
| LAB381 | 30351.4 | 0.591703 | 0.043368 | 54.6813 |
| LAB381 | 30352.2 | 0.757606 | 0.004948 | 98.0513 |
| LAB381 | 30352.4 | 0.611105 | 0.078322 | 59.7532 |
| LAB381 | 30354.2 | 0.513489 | 0.083253 | 34.2347 |
| LAB381 | 30356.1 | 0.592023 | 0.074526 | 54.7651 |
| LAB383 | 28111.1 | 0.445096 | 0.048898 | 16.3558 |
| LAB383 | 28111.3 | 0.775069 | 0.018554 | 102.616 |
| LAB383 | 28111.4 | 0.643364 | 0.081276 | 68.1865 |
| LAB383 | 28115.2 | 0.588124 | 0.0627 | 53.7456 |
| LAB383 | 28115.5 | 0.385958 | 0.908397 | 0.8962 |
| LAB64 | 30271.2 | 0.722862 | 0.001659 | 88.9687 |
| LAB64 | 30272.1 | 0.550807 | 0.010269 | 43.9904 |
| LAB64 | 30273.2 | 0.802716 | 0.019671 | 109.844 |
| LAB64 | 30274.2 | 0.397548 | 0.760272 | 3.9258 |
| LAB64 | 30274.3 | 0.408149 | 0.657566 | 6.6972 |
| LAB65 | 30302.1 | 0.56794 | 0.006719 | 48.4693 |
| LAB92 | 29321.2 | 0.537178 | 0.048359 | 40.4276 |
| LAB92 | 29322.1 | 0.502934 | 0.001099 | 31.4755 |
| LAB92 | 29323.2 | 0.501246 | 0.057879 | 31.0344 |
| LAB92 | 29324.2 | 0.514598 | 0.207781 | 34.5247 |
| CONTROL | — | 0.38253 | — | 0 |
| LAB172 | 30852.3 | 0.41849 | 0.412983 | 13.3029 |
| LAB172 | 30853.4 | 0.492365 | 0.468212 | 33.3039 |
| LAB172 | 30854.1 | 0.400971 | 0.379062 | 8.5595 |
| LAB172 | 30854.4 | 0.386082 | 0.506231 | 4.5286 |
| LAB188 | 30722.2 | 0.484092 | 0.119059 | 31.064 |
| LAB188 | 30723.3 | 0.44229 | 0.173446 | 19.7464 |
| LAB243 | 27101.1 | 0.514793 | 0.079918 | 39.3761 |
| LAB243 | 30872.1 | 0.379162 | 0.778531 | 2.6551 |
| LAB243 | 30873.2 | 0.444948 | 0.211592 | 20.466 |
| LAB243 | 30873.4 | 0.740696 | 0.071643 | 100.537 |
| LAB270 | 30591.2 | 0.437632 | 0.36711 | 18.4854 |
| LAB270 | 30595.1 | 0.44216 | 0.032356 | 19.7111 |
| LAB270 | 30595.2 | 0.395473 | 0.303151 | 7.071 |
| LAB291 | 31851.2 | 0.45086 | 0.247337 | 22.0667 |
| LAB291 | 31851.3 | 0.865096 | 0.013718 | 134.218 |
| LAB291 | 31852.4 | 0.596448 | 0.10691 | 61.4835 |
| LAB291 | 31853.3 | 0.747476 | 0.006986 | 102.373 |
| LAB291 | 31854.4 | 0.430748 | 0.169888 | 16.6214 |
| LAB295 | 31861.3 | 0.739697 | 0.003058 | 100.267 |
| LAB295 | 31863.1 | 0.518586 | 0.043257 | 40.4028 |
| LAB295 | 31864.3 | 0.581769 | 0.115725 | 57.5091 |
| LAB295 | 31864.4 | 0.640379 | 0.040494 | 73.3773 |
| LAB295 | 31865.1 | 0.420966 | 0.352877 | 13.9732 |
| LAB323 | 30381.4 | 0.635511 | 0.085311 | 72.0593 |
| LAB323 | 30383.2 | 0.447558 | 0.158693 | 21.1725 |
| LAB347_H0 | 30441.1 | 0.387903 | 0.411831 | 5.0216 |
| LAB347_H0 | 30443.4 | 0.389373 | 0.512305 | 5.4196 |
| LAB347_H0 | 30444.3 | 0.562538 | 0.047922 | 52.3026 |
| LAB55 | 30023.1 | 0.421292 | 0.052497 | 14.0614 |
| LAB55 | 30025.3 | 0.4093 | 0.276302 | 10.8147 |
| LAB55 | 30025.4 | 0.38526 | 0.603394 | 4.306 |
| CONTROL | — | 0.369356 | — | 0 |
| LAB243 | 30873.2 | 0.622271 | 0.124879 | 22.5 |
| LAB291 | 31851.3 | 0.557284 | 0.479312 | 9.7067 |

TABLE 57-continued

Genes showing improved plant performance under osmotic stress conditions (T2 generation)

| | | Leaf Area [cm2] | | |
|---|---|---|---|---|
| Gene Name | Event # | Ave. | p-value | % Incr. |
| LAB291 | 31854.4 | 0.572983 | 0.441766 | 12.7972 |
| CONTROL | — | 0.507976 | — | 0 |

Table 57.
"CONT."—Control;
"Ave."—Average;
"% Incr." = % increment;
"p-val."—p-value.

TABLE 58

Genes showing improved plant performance under osmotic stress conditions (T1 generation)

| | | Plant Biomass Fresh Weight [gr.] | | | | | Plant Biomass Dry Weight [gr.] | | |
|---|---|---|---|---|---|---|---|---|---|
| Gene Name | Event # | Ave. | p-val. | % Incr. | Gene Name | Event # | Ave. | p-val. | % Incr. |
| LAB109 | 32411 | 0.176 | 0.7327 | 11 | LAB109 | 32411 | 0.0076 | 0.076 | 29 |
| LAB274 | 32471 | 0.188 | 0.5603 | 18 | LAB211 | 32581 | 0.0075 | 0.091 | 26 |
| cont | — | 0.158 | — | 0 | LAB229 | 32911 | 0.0062 | 0.527 | 5 |
| LAB296 | 32441 | 0.140 | 0.0209 | 106 | LAB274 | 32471 | 0.0104 | 0.003 | 75 |
| LAB316 | 32421 | 0.081 | 0.1619 | 19 | LAB291 | 31851 | 0.0066 | 0.41 | 11 |
| LAB349 | 32391 | 0.121 | 0.0075 | 79 | cont | — | 0.0059 | — | 0 |
| LAB53 | 32461 | 0.091 | 0.0578 | 35 | LAB296 | 32441 | 0.007 | 0.011 | 83 |
| LAB69 | 32451 | 0.127 | 0.0430 | 88 | LAB316 | 32421 | 0.0043 | 0.221 | 12 |
| cont | — | 0.067 | — | 0 | LAB349 | 32391 | 0.0067 | 0.003 | 74 |
| | | | | | LAB53 | 32461 | 0.005 | 0.134 | 30 |
| | | | | | LAB69 | 32451 | 0.0077 | 0.062 | 100 |
| | | | | | LAB89 | 32432 | 0.0042 | 0.387 | 9 |
| | | | | | cont | — | 0.0038 | — | 0 |

Table 58.
"CONT."—Control;
"Ave."—Average;
"% Incr." = % increment;
"p-val."—p-value.

TABLE 59

Genes showing improved plant performance under osmotic stress conditions (T1 generation)

| | | Leaf Area [cm2] | | |
|---|---|---|---|---|
| Gene Name | Event # | Ave. | p-value | % Incr. |
| LAB109 | 32411 | 0.499868 | 0.015783 | 17.435 |
| LAB211 | 32581 | 0.498112 | 0.172222 | 17.0226 |
| LAB274 | 32471 | 0.519022 | 0.00997 | 21.9349 |
| control | — | 0.425655 | — | 0 |
| LAB296 | 32441 | 0.557944 | 0.003874 | 40.4796 |
| LAB316 | 32421 | 0.410844 | 0.497442 | 3.4426 |
| LAB349 | 32391 | 0.54001 | 0.002988 | 35.9642 |
| LAB53 | 32461 | 0.418472 | 0.186194 | 5.3632 |
| LAB69 | 32451 | 0.538879 | 0.118108 | 35.6793 |
| control | — | 0.397171 | — | 0 |
| LAB109 | 32411 | 0.28736 | 0.916972 | 0.4165 |
| LAB274 | 32471 | 0.308549 | 0.186289 | 7.8207 |
| control | — | 0.286168 | — | 0 |
| LAB296 | 32441 | 0.29731 | 0.119704 | 19.6666 |
| LAB316 | 32421 | 0.259721 | 0.416748 | 4.5372 |
| LAB349 | 32391 | 0.326058 | 0.00034 | 31.2376 |
| LAB53 | 32461 | 0.265747 | 0.38953 | 6.9626 |
| LAB69 | 32451 | 0.320632 | 0.062996 | 29.0536 |

TABLE 59-continued

Genes showing improved plant performance under osmotic stress conditions (T1 generation)

| | | Leaf Area [cm2] | | |
|---|---|---|---|---|
| Gene Name | Event # | Ave. | p-value | % Incr. |
| LAB89 | 32432 | 0.261392 | 0.400174 | 5.2096 |
| control | — | 0.248449 | — | 0 |

Table 59.
"CONT."—Control;
"Ave."—Average;
"% Incr." = % increment;
"p-val."—p-value.

The genes presented in Tables 60-61 showed a significant improvement in plant NUE since they produced a larger root biomass (root length and root coverage) when grown under osmotic stress conditions, compared to control plants. Plants producing larger root biomass have better possibilities to absorb larger amount of water from soil. The genes were cloned under the regulation of a constitutive promoter (At6669; SEQ ID NO:8741). The evaluation of each gene was performed by testing the performance of different number of events. Some of the genes were evaluated in more than one tissue culture assay. This second experiment confirmed the significant increment in root performance. Event with p-value <0.1 was considered statistically significant

TABLE 60

Genes showing improved root performance under osmotic stress conditions (T2 generation)

| Gene Name | Event # | Roots Length [cm] Ave. | p-val. | % | Gene Name | Event # | Roots Coverage [cm2] Ave. | p-val. | % |
|---|---|---|---|---|---|---|---|---|---|
| LAB115 | 27282.3 | 6.90 | 0.824 | 1 | LAB115 | 27282.3 | — | — | — |
| LAB123 | 28282.3 | 7.01 | 0.658 | 2 | LAB123 | 28282.3 | — | — | — |
| LAB123 | 28285.2 | 7.27 | 0.077 | 6 | LAB123 | 28285.2 | 9.37 | 0.021 | 42 |
| LAB183 | 27454.2 | 6.86 | 0.989 | 0 | LAB183 | 27454.2 | — | — | — |
| LAB189 | 28166.1 | 6.92 | 0.874 | 1 | LAB189 | 28166.1 | 6.61 | 0.988 | 0 |
| LAB212 | 28042.1 | 6.93 | 0.894 | 1 | LAB212 | 28042.1 | 7.30 | 0.391 | 11 |
| LAB212 | 28043.2 | 7.07 | 0.470 | 3 | LAB212 | 28043.2 | 7.65 | 0.196 | 16 |
| LAB212 | 28044.2 | — | — | — | LAB212 | 28044.2 | 6.86 | 0.793 | 4 |
| LAB212 | 28045.2 | 7.00 | 0.663 | 2 | LAB212 | 28045.2 | 7.92 | 0.106 | 20 |
| LAB217 | 28033.2 | — | — | — | LAB217 | 28033.2 | 6.86 | 0.809 | 4 |
| LAB326 | 28052.4 | 7.07 | 0.698 | 3 | LAB326 | 28052.4 | — | — | — |
| LAB326 | 28053.2 | 7.13 | 0.496 | 4 | LAB326 | 28053.2 | 9.10 | 0.114 | 38 |
| LAB326 | 28056.2 | 7.29 | 0.040 | 6 | LAB326 | 28056.2 | 7.88 | 0.098 | 19 |
| CONT | — | 6.86 | — | 0 | CONT | — | 6.60 | — | 0 |
| LAB115 | 27281.3 | 5.94 | 0.613 | 2 | LAB115 | 27281.3 | 4.57 | 0.617 | 5 |
| LAB123 | 28281.1 | 6.69 | 0.004 | 15 | LAB123 | 28281.1 | 7.81 | 0.001 | 80 |
| LAB123 | 28282.3 | 6.44 | 0.031 | 11 | LAB123 | 28282.3 | 5.69 | 0.041 | 31 |
| LAB123 | 28283.1 | 5.94 | 0.740 | 2 | LAB123 | 28283.1 | 6.59 | 0.156 | 52 |
| LAB123 | 28284.1 | 6.14 | 0.319 | 5 | LAB123 | 28284.1 | 6.36 | 0.029 | 46 |
| LAB123 | 28285.2 | 6.51 | 0.344 | 12 | LAB123 | 28285.2 | 6.84 | 0.109 | 58 |
| LAB183 | 27453.1 | — | — | — | LAB183 | 27453.1 | 4.79 | 0.410 | 10 |
| LAB183 | 27453.4 | 5.84 | 0.969 | 0 | LAB183 | 27453.4 | 5.30 | 0.127 | 22 |
| LAB189 | 28163.2 | 6.07 | 0.300 | 4 | LAB189 | 28163.2 | 5.53 | 0.309 | 27 |
| LAB189 | 28166.2 | 6.08 | 0.391 | 4 | LAB189 | 28166.2 | 5.76 | 0.090 | 33 |
| LAB206 | 30011.2 | — | — | — | LAB206 | 30011.2 | 4.51 | 0.550 | 4 |
| LAB212 | 28041.1 | 6.23 | 0.180 | 7 | LAB212 | 28041.1 | 4.90 | 0.511 | 13 |
| LAB217 | 28033.2 | 6.67 | 0.000 | 14 | LAB217 | 28033.2 | 6.01 | 0.052 | 39 |
| LAB217 | 28034.1 | — | — | — | LAB217 | 28034.1 | 4.99 | 0.527 | 15 |
| LAB217 | 28034.3 | 6.50 | 0.113 | 12 | LAB217 | 28034.3 | 4.68 | 0.463 | 8 |
| LAB217 | 28035.1 | — | — | — | LAB217 | 28035.1 | 6.38 | 0.064 | 47 |
| LAB217 | 28036.1 | — | — | — | LAB217 | 28036.1 | 4.51 | 0.843 | 4 |
| LAB250 | 30251.2 | 5.88 | 0.870 | 1 | LAB250 | 30251.2 | 5.54 | 0.226 | 28 |
| LAB250 | 30253.1 | 6.55 | 0.000 | 12 | LAB250 | 30253.1 | 5.38 | 0.015 | 24 |
| LAB314 | 29292.6 | — | — | — | LAB314 | 29292.6 | 4.38 | 0.920 | 1 |
| LAB326 | 28052.4 | 6.13 | 0.323 | 5 | LAB326 | 28052.4 | 4.69 | 0.691 | 8 |
| LAB326 | 28056.3 | 5.85 | 0.941 | 1 | LAB326 | 28056.3 | 4.64 | 0.793 | 7 |
| LAB351 | 30115.1 | 6.17 | 0.363 | 6 | LAB351 | 30115.1 | 5.26 | 0.001 | 21 |
| LAB351 | 30115.3 | 5.83 | 0.982 | 0 | LAB351 | 30115.3 | 5.22 | 0.299 | 20 |
| LAB93 | 28271.3 | — | — | — | LAB93 | 28271.3 | 5.10 | 0.253 | 18 |
| LAB93 | 28272.3 | — | — | — | LAB93 | 28272.3 | 4.65 | 0.698 | 7 |
| LAB93 | 28274.2 | — | — | — | LAB93 | 28274.2 | 5.04 | 0.373 | 16 |
| CONT | — | 5.82 | — | 0 | CONT | — | 4.34 | — | 0 |
| LAB106 | 30032.1 | 6.41 | 0.027 | 12 | LAB106 | 30032.1 | 6.30 | 0.035 | 20 |
| LAB106 | 30032.2 | 5.77 | 0.925 | 1 | LAB106 | 30032.2 | 5.94 | 0.473 | 13 |
| LAB106 | 30035.1 | 6.15 | 0.344 | 7 | LAB106 | 30035.1 | 5.63 | 0.614 | 7 |
| LAB206 | 30012.4 | 5.85 | 0.778 | 2 | LAB206 | 30012.4 | — | — | — |
| LAB207 | 28842.1 | 6.99 | 0.020 | 22 | LAB207 | 28842.1 | 8.45 | 0.101 | 60 |
| LAB207 | 28842.5 | 6.64 | 0.022 | 16 | LAB207 | 28842.5 | 6.76 | 0.030 | 28 |
| LAB207 | 28843.3 | 5.74 | 0.950 | 0 | LAB207 | 28843.3 | 5.32 | 0.926 | 1 |
| LAB207 | 28843.5 | 6.86 | 0.000 | 20 | LAB207 | 28843.5 | 7.03 | 0.004 | 33 |
| LAB207 | 28845.1 | 5.90 | 0.664 | 3 | LAB207 | 28845.1 | — | — | — |
| LAB218 | 29432.2 | 5.95 | 0.271 | 4 | LAB218 | 29432.2 | 5.28 | 0.991 | 0 |
| LAB250 | 30251.2 | 5.90 | 0.475 | 3 | LAB250 | 30251.2 | — | — | — |
| LAB250 | 30253.1 | 6.27 | 0.080 | 10 | LAB250 | 30253.1 | 6.16 | 0.374 | 17 |
| LAB250 | 30254.1 | 6.68 | 0.007 | 17 | LAB250 | 30254.1 | 5.99 | 0.279 | 14 |
| LAB252 | 30291.4 | 6.17 | 0.077 | 8 | LAB252 | 30291.4 | 5.77 | 0.281 | 10 |
| LAB252 | 30292.3 | 6.05 | 0.208 | 6 | LAB252 | 30292.3 | 6.02 | 0.303 | 14 |
| LAB252 | 30292.4 | 6.16 | 0.147 | 8 | LAB252 | 30292.4 | — | — | — |
| LAB309 | 30052.2 | 6.08 | 0.166 | 6 | LAB309 | 30052.2 | 5.90 | 0.492 | 12 |
| LAB309 | 30052.3 | 6.12 | 0.344 | 7 | LAB309 | 30052.3 | 6.15 | 0.403 | 17 |
| LAB309 | 30056.1 | 6.00 | 0.463 | 5 | LAB309 | 30056.1 | — | — | — |
| LAB314 | 29292.4 | 6.91 | 0.000 | 21 | LAB314 | 29292.4 | 6.79 | 0.151 | 29 |
| LAB314 | 29294.1 | 5.80 | 0.749 | 1 | LAB314 | 29294.1 | 5.32 | 0.940 | 1 |
| LAB314 | 29295.2 | 6.20 | 0.286 | 8 | LAB314 | 29295.2 | 5.36 | 0.892 | 2 |
| LAB346 | 29443.2 | 6.00 | 0.332 | 5 | LAB346 | 29443.2 | 5.76 | 0.203 | 9 |
| LAB351 | 30111.2 | 6.72 | 0.002 | 17 | LAB351 | 30111.2 | 7.04 | 0.012 | 33 |
| LAB351 | 30112.1 | 6.21 | 0.253 | 8 | LAB351 | 30112.1 | 5.39 | 0.856 | 2 |
| LAB351 | 30114.2 | 6.36 | 0.043 | 11 | LAB351 | 30114.2 | 6.22 | 0.076 | 18 |
| LAB82 | 30181.3 | 6.41 | 0.035 | 12 | LAB82 | 30181.3 | 6.21 | 0.044 | 18 |
| LAB82 | 30181.4 | 6.01 | 0.548 | 5 | LAB82 | 30181.4 | — | — | — |
| LAB82 | 30182.2 | 5.84 | 0.846 | 2 | LAB82 | 30182.2 | — | — | — |
| LAB82 | 30183.2 | 5.90 | 0.546 | 3 | LAB82 | 30183.2 | — | — | — |

TABLE 60-continued

Genes showing improved root performance under osmotic stress conditions (T2 generation)

| Gene Name | Event # | Roots Length [cm] Ave. | p-val. | % | Gene Name | Event # | Roots Coverage [cm2] Ave. | p-val. | % |
|---|---|---|---|---|---|---|---|---|---|
| LAB82 | 30184.2 | 5.79 | 0.866 | 1 | LAB82 | 30184.2 | — | — | — |
| LAB84 | 30161.4 | — | — | — | LAB84 | 30161.4 | 5.58 | 0.653 | 6 |
| LAB84 | 30162.2 | 6.16 | 0.163 | 8 | LAB84 | 30162.2 | 6.30 | 0.194 | 20 |
| LAB84 | 30162.4 | 6.03 | 0.458 | 5 | LAB84 | 30162.4 | 6.84 | 0.196 | 30 |
| LAB84 | 30163.4 | 6.63 | 0.074 | 16 | LAB84 | 30163.4 | 7.26 | 0.003 | 38 |
| LAB84 | 30164.2 | 6.17 | 0.481 | 8 | LAB84 | 30164.2 | 6.62 | 0.229 | 26 |
| CONT | — | 5.72 | — | 0 | CONT | — | 5.27 | — | 0 |
| LAB110 | 30571.3 | 6.52 | 0.186 | 12 | LAB110 | 30571.3 | 7.13 | 0.033 | 49 |
| LAB110 | 30572.1 | 6.71 | 0.028 | 15 | LAB110 | 30572.1 | 5.65 | 0.173 | 18 |
| LAB110 | 30572.2 | 5.89 | 0.749 | 1 | LAB110 | 30572.2 | — | — | — |
| LAB110 | 30573.2 | 6.14 | 0.483 | 5 | LAB110 | 30573.2 | 6.52 | 0.123 | 36 |
| LAB110 | 30574.2 | 7.29 | 0.001 | 25 | LAB110 | 30574.2 | 7.70 | 0.000 | 61 |
| LAB117 | 27291.1 | 6.60 | 0.024 | 13 | LAB117 | 27291.1 | 6.19 | 0.048 | 30 |
| LAB117 | 27291.5 | 6.56 | 0.006 | 13 | LAB117 | 27291.5 | 6.80 | 0.029 | 42 |
| LAB117 | 27293.1 | 6.71 | 0.085 | 15 | LAB117 | 27293.1 | 7.85 | 0.093 | 64 |
| LAB124 | 30431.1 | 6.66 | 0.002 | 14 | LAB124 | 30431.1 | 7.14 | 0.030 | 49 |
| LAB124 | 30432.3 | 6.94 | 0.000 | 19 | LAB124 | 30432.3 | 6.29 | 0.012 | 32 |
| LAB124 | 30434.1 | 5.95 | 0.731 | 2 | LAB124 | 30434.1 | 5.67 | 0.166 | 19 |
| LAB124 | 30434.3 | 6.58 | 0.003 | 13 | LAB124 | 30434.3 | 6.35 | 0.001 | 33 |
| LAB125 | 30581.3 | 6.18 | 0.168 | 6 | LAB125 | 30581.3 | 5.20 | 0.584 | 9 |
| LAB125 | 30582.2 | 6.88 | 0.028 | 18 | LAB125 | 30582.2 | 5.49 | 0.401 | 15 |
| LAB125 | 30583.2 | 6.86 | 0.005 | 18 | LAB125 | 30583.2 | 6.33 | 0.044 | 33 |
| LAB125 | 30584.2 | 6.00 | 0.399 | 3 | LAB125 | 30584.2 | — | — | — |
| LAB156 | 30401.4 | 6.44 | 0.079 | 11 | LAB156 | 30401.4 | 5.72 | 0.309 | 20 |
| LAB156 | 30402.2 | 6.33 | 0.098 | 9 | LAB156 | 30402.2 | 6.82 | 0.002 | 43 |
| LAB156 | 30403.1 | 6.29 | 0.224 | 8 | LAB156 | 30403.1 | 5.87 | 0.121 | 23 |
| LAB156 | 30403.4 | 6.07 | 0.418 | 4 | LAB156 | 30403.4 | 5.39 | 0.273 | 13 |
| LAB228 | 30081.4 | 6.82 | 0.003 | 17 | LAB228 | 30081.4 | 6.18 | 0.043 | 29 |
| LAB228 | 30084.3 | 6.09 | 0.415 | 5 | LAB228 | 30084.3 | 5.92 | 0.101 | 24 |
| LAB275 | 30361.3 | 6.71 | 0.028 | 15 | LAB275 | 30361.3 | 6.93 | 0.005 | 45 |
| LAB275 | 30366.4 | 6.28 | 0.301 | 8 | LAB275 | 30366.4 | 5.49 | 0.200 | 15 |
| LAB276_H0 | 30331.1 | 6.35 | 0.010 | 9 | LAB276_H0 | 30331.1 | 7.85 | 0.001 | 64 |
| LAB276_H0 | 30333.7 | 5.96 | 0.763 | 2 | LAB276_H0 | 30333.7 | 4.96 | 0.660 | 4 |
| LAB277 | 30651.2 | 6.57 | 0.016 | 13 | LAB277 | 30651.2 | 6.19 | 0.019 | 30 |
| LAB277 | 30652.3 | 6.33 | 0.324 | 9 | LAB277 | 30652.3 | 5.31 | 0.494 | 11 |
| LAB277 | 30652.5 | 6.15 | 0.332 | 6 | LAB277 | 30652.5 | 6.30 | 0.015 | 32 |
| LAB277 | 30653.1 | 6.04 | 0.464 | 4 | LAB277 | 30653.1 | 5.61 | 0.123 | 17 |
| LAB278 | 30414.1 | 6.44 | 0.066 | 11 | LAB278 | 30414.1 | 5.99 | 0.033 | 25 |
| LAB278 | 30414.2 | 6.34 | 0.427 | 9 | LAB278 | 30414.2 | 6.58 | 0.251 | 38 |
| LAB281 | 30741.1 | 5.99 | 0.718 | 3 | LAB281 | 30741.1 | 5.40 | 0.355 | 13 |
| LAB281 | 30742.4 | 6.00 | 0.632 | 3 | LAB281 | 30742.4 | 5.76 | 0.243 | 21 |
| LAB281 | 30743.4 | 6.49 | 0.196 | 11 | LAB281 | 30743.4 | 4.93 | 0.755 | 3 |
| LAB282 | 30751.3 | — | — | — | LAB282 | 30751.3 | 5.10 | 0.570 | 7 |
| LAB282 | 30753.4 | 6.32 | 0.111 | 9 | LAB282 | 30753.4 | 5.05 | 0.465 | 6 |
| LAB282 | 30754.2 | — | — | — | LAB282 | 30754.2 | 6.09 | 0.011 | 27 |
| CONT | — | 5.82 | — | 0 | CONT | — | 4.78 | — | 0 |
| LAB110 | 30571.3 | 6.42 | 0.776 | 1 | LAB110 | 30571.3 | 6.04 | 0.493 | 5 |
| LAB110 | 30572.1 | 6.62 | 0.458 | 4 | LAB110 | 30572.1 | 5.91 | 0.744 | 3 |
| LAB110 | 30572.2 | 7.01 | 0.133 | 10 | LAB110 | 30572.2 | 8.71 | 0.002 | 51 |
| LAB110 | 30573.2 | — | — | — | LAB110 | 30573.2 | 5.87 | 0.889 | 2 |
| LAB110 | 30574.2 | 7.05 | 0.098 | 11 | LAB110 | 30574.2 | 7.84 | 0.061 | 36 |
| LAB117 | 27291.2 | 6.68 | 0.448 | 5 | LAB117 | 27291.2 | 6.96 | 0.209 | 21 |
| LAB117 | 27293.1 | 6.77 | 0.122 | 6 | LAB117 | 27293.1 | 7.95 | 0.013 | 38 |
| LAB124 | 30431.1 | 6.54 | 0.409 | 3 | LAB124 | 30431.1 | — | — | — |
| LAB124 | 30434.1 | 7.08 | 0.083 | 11 | LAB124 | 30434.1 | 7.52 | 0.198 | 31 |
| LAB125 | 30581.3 | 6.98 | 0.010 | 10 | LAB125 | 30581.3 | 8.01 | 0.040 | 39 |
| LAB125 | 30582.2 | 6.72 | 0.484 | 6 | LAB125 | 30582.2 | 7.17 | 0.227 | 25 |
| LAB125 | 30584.2 | 6.75 | 0.100 | 6 | LAB125 | 30584.2 | 7.23 | 0.000 | 26 |
| LAB156 | 30401.4 | 7.42 | 0.002 | 17 | LAB156 | 30401.4 | 8.14 | 0.002 | 41 |
| LAB156 | 30403.1 | 6.87 | 0.134 | 8 | LAB156 | 30403.1 | — | — | — |
| LAB228 | 30081.4 | 7.11 | 0.002 | 12 | LAB228 | 30081.4 | 6.59 | 0.019 | 15 |
| LAB228 | 30082.3 | — | — | — | LAB228 | 30082.3 | 6.13 | 0.583 | 6 |
| LAB228 | 30084.3 | 6.41 | 0.920 | 1 | LAB228 | 30084.3 | 6.04 | 0.664 | 5 |
| LAB228 | 30084.4 | 6.53 | 0.623 | 3 | LAB228 | 30084.4 | 5.94 | 0.773 | 3 |
| LAB275 | 30361.2 | — | — | — | LAB275 | 30361.2 | 6.17 | 0.315 | 7 |
| LAB275 | 30361.3 | 7.14 | 0.102 | 12 | LAB275 | 30361.3 | 8.16 | 0.008 | 42 |
| LAB275 | 30363.4 | 6.43 | 0.777 | 1 | LAB275 | 30363.4 | 6.41 | 0.211 | 11 |
| LAB275 | 30366.4 | 6.97 | 0.082 | 10 | LAB275 | 30366.4 | 7.30 | 0.141 | 27 |
| LAB276_H0 | 30331.1 | — | — | — | LAB276_H0 | 30331.1 | 5.79 | 0.968 | 1 |
| LAB276_H0 | 30331.4 | — | — | — | LAB276_H0 | 30331.4 | 6.40 | 0.496 | 11 |
| LAB277 | 30651.2 | 6.45 | 0.837 | 1 | LAB277 | 30651.2 | 6.48 | 0.380 | 13 |
| LAB277 | 30652.3 | — | — | — | LAB277 | 30652.3 | 5.83 | 0.887 | 1 |

TABLE 60-continued

Genes showing improved root performance under osmotic stress conditions (T2 generation)

| Gene Name | Event # | Roots Length [cm] Ave. | p-val. | % | Gene Name | Event # | Roots Coverage [cm2] Ave. | p-val. | % |
|---|---|---|---|---|---|---|---|---|---|
| LAB277 | 30652.5 | 7.22 | 0.001 | 14 | LAB277 | 30652.5 | 8.70 | 0.001 | 51 |
| LAB277 | 30652.6 | 6.88 | 0.059 | 8 | LAB277 | 30652.6 | 8.84 | 0.030 | 54 |
| LAB277 | 30653.1 | 6.58 | 0.182 | 4 | LAB277 | 30653.1 | 5.77 | 0.979 | 0 |
| LAB278 | 30413.3 | 6.42 | 0.901 | 1 | LAB278 | 30413.3 | 6.35 | 0.485 | 10 |
| LAB278 | 30414.1 | 6.41 | 0.899 | 1 | LAB278 | 30414.1 | 7.82 | 0.112 | 36 |
| LAB278 | 30414.2 | 6.62 | 0.468 | 4 | LAB278 | 30414.2 | 8.45 | 0.034 | 47 |
| LAB281 | 30742.4 | — | — | — | LAB281 | 30742.4 | 5.93 | 0.854 | 3 |
| LAB281 | 30743.4 | 6.98 | 0.082 | 10 | LAB281 | 30743.4 | 7.63 | 0.115 | 32 |
| LAB281 | 30744.1 | — | — | — | LAB281 | 30744.1 | 5.85 | 0.919 | 2 |
| LAB282 | 30752.2 | 6.47 | 0.636 | 2 | LAB282 | 30752.2 | 6.74 | 0.087 | 17 |
| LAB282 | 30753.3 | 6.43 | 0.762 | 1 | LAB282 | 30753.3 | 5.92 | 0.653 | 3 |
| CONT | — | 6.36 | — | 0 | CONT | — | 5.76 | — | 0 |
| LAB127 | 30811.1 | 7.44 | 0.093 | 10 | LAB127 | 30811.1 | 7.41 | 0.826 | 3 |
| LAB127 | 30813.1 | 6.92 | 0.450 | 2 | LAB127 | 30813.1 | — | — | — |
| LAB127 | 30814.2 | 6.98 | 0.464 | 3 | LAB127 | 30814.2 | — | — | — |
| LAB128 | 28074.3 | 7.35 | 0.079 | 8 | LAB128 | 28074.3 | 7.87 | 0.623 | 10 |
| LAB128 | 28075.2 | 7.34 | 0.035 | 8 | LAB128 | 28075.2 | 9.93 | 0.070 | 38 |
| LAB207 | 28842.1 | 7.45 | 0.015 | 10 | LAB207 | 28842.1 | 9.09 | 0.154 | 27 |
| LAB207 | 28842.5 | 7.29 | 0.051 | 7 | LAB207 | 28842.5 | 8.64 | 0.413 | 21 |
| LAB207 | 28845.1 | 7.41 | 0.002 | 9 | LAB207 | 28845.1 | 8.59 | 0.109 | 20 |
| LAB218 | 29432.2 | 6.86 | 0.850 | 1 | LAB218 | 29432.2 | — | — | — |
| LAB218 | 29433.4 | 6.87 | 0.730 | 1 | LAB218 | 29433.4 | — | — | — |
| LAB252 | 30291.2 | 6.90 | 0.719 | 2 | LAB252 | 30291.2 | — | — | — |
| LAB252 | 30292.3 | — | — | — | LAB252 | 30292.3 | 8.53 | 0.512 | 19 |
| LAB252 | 30292.4 | 7.22 | 0.055 | 6 | LAB252 | 30292.4 | — | — | — |
| LAB309 | 30055.4 | 7.28 | 0.158 | 7 | LAB309 | 30055.4 | — | — | — |
| LAB309 | 30056.1 | 7.34 | 0.004 | 8 | LAB309 | 30056.1 | 8.87 | 0.106 | 24 |
| LAB337 | 27265.2 | — | — | — | LAB337 | 27265.2 | 7.28 | 0.945 | 1 |
| LAB80 | 30671.2 | 7.34 | 0.168 | 8 | LAB80 | 30671.2 | — | — | — |
| LAB82 | 30181.3 | 7.38 | 0.173 | 9 | LAB82 | 30181.3 | 7.25 | 0.932 | 1 |
| CONT | — | 6.79 | — | 0 | CONT | — | 7.17 | — | 0 |
| LAB127 | 30811.4 | 6.97 | 0.594 | 2 | LAB127 | 30811.4 | — | — | — |
| LAB127 | 30812.1 | 6.88 | 0.941 | 0 | LAB127 | 30812.1 | — | — | — |
| LAB128 | 28074.1 | — | — | — | LAB128 | 28074.1 | 8.04 | 0.699 | 5 |
| LAB128 | 28075.2 | — | — | — | LAB128 | 28075.2 | 8.20 | 0.583 | 7 |
| LAB186 | 31001.4 | — | — | — | LAB186 | 31001.4 | 9.57 | 0.348 | 25 |
| LAB186 | 31002.1 | — | — | — | LAB186 | 31002.1 | 7.89 | 0.811 | 3 |
| LAB186 | 31003.1 | 7.01 | 0.445 | 2 | LAB186 | 31003.1 | — | — | — |
| LAB186 | 31004.1 | — | — | — | LAB186 | 31004.1 | 7.89 | 0.815 | 3 |
| LAB315 | 31063.1 | 6.86 | 0.988 | 0 | LAB315 | 31063.1 | — | — | — |
| LAB317 | 30952.2 | 6.98 | 0.576 | 2 | LAB317 | 30952.2 | — | — | — |
| LAB325 | 30972.2 | — | — | — | LAB325 | 30972.2 | 8.08 | 0.764 | 5 |
| LAB325 | 30973.1 | — | — | — | LAB325 | 30973.1 | 7.81 | 0.846 | 2 |
| LAB325 | 30975.4 | — | — | — | LAB325 | 30975.4 | 8.27 | 0.646 | 8 |
| CONT | — | 6.86 | — | 0 | CONT | — | 7.68 | — | 0 |
| LAB147 | 31103.2 | 6.15 | 0.018 | 17 | LAB147 | 31103.2 | 5.87 | 0.320 | 16 |
| LAB147 | 31104.1 | 6.21 | 0.006 | 18 | LAB147 | 31104.1 | 5.57 | 0.260 | 10 |
| LAB147 | 31104.2 | 5.86 | 0.289 | 11 | LAB147 | 31104.2 | 5.37 | 0.794 | 6 |
| LAB147 | 31105.7 | 6.25 | 0.075 | 19 | LAB147 | 31105.7 | 5.69 | 0.310 | 12 |
| LAB178 | 30632.1 | 6.40 | 0.002 | 22 | LAB178 | 30632.1 | 6.18 | 0.065 | 22 |
| LAB178 | 30633.3 | 5.92 | 0.033 | 12 | LAB178 | 30633.3 | 5.26 | 0.713 | 4 |
| LAB178 | 30633.4 | 5.97 | 0.024 | 13 | LAB178 | 30633.4 | 5.37 | 0.608 | 6 |
| LAB178 | 30635.1 | 5.66 | 0.263 | 8 | LAB178 | 30635.1 | — | — | — |
| LAB186 | 31001.4 | 6.28 | 0.014 | 19 | LAB186 | 31001.4 | 6.00 | 0.074 | 18 |
| LAB186 | 31003.1 | 5.72 | 0.154 | 9 | LAB186 | 31003.1 | 5.64 | 0.493 | 11 |
| LAB197 | 31084.3 | 5.73 | 0.165 | 9 | LAB197 | 31084.3 | 5.18 | 0.878 | 2 |
| LAB247 | 28094.1 | 5.28 | 0.937 | 0 | LAB247 | 28094.1 | — | — | — |
| LAB247 | 28094.3 | 6.04 | 0.048 | 15 | LAB247 | 28094.3 | 5.64 | 0.426 | 11 |
| LAB314 | 29292.4 | 5.35 | 0.801 | 2 | LAB314 | 29292.4 | — | — | — |
| LAB315 | 31061.1 | 5.55 | 0.406 | 5 | LAB315 | 31061.1 | — | — | — |
| LAB315 | 31061.2 | 5.52 | 0.299 | 5 | LAB315 | 31061.2 | 5.63 | 0.326 | 11 |
| LAB315 | 31063.1 | — | — | — | LAB315 | 31063.1 | 5.07 | 0.998 | 0 |
| LAB317 | 30952.2 | 6.13 | 0.009 | 17 | LAB317 | 30952.2 | — | — | — |
| LAB317 | 30952.3 | 6.39 | 0.003 | 21 | LAB317 | 30952.3 | 5.55 | 0.491 | 10 |
| LAB317 | 30953.1 | 5.74 | 0.254 | 9 | LAB317 | 30953.1 | — | — | — |
| LAB317 | 30953.4 | 5.72 | 0.214 | 9 | LAB317 | 30953.4 | — | — | — |
| LAB317 | 30954.4 | 5.74 | 0.178 | 9 | LAB317 | 30954.4 | 5.68 | 0.350 | 12 |
| LAB324 | 30961.1 | 6.17 | 0.043 | 17 | LAB324 | 30961.1 | 5.90 | 0.219 | 16 |
| LAB324 | 30962.2 | 6.81 | 0.005 | 29 | LAB324 | 30962.2 | 6.53 | 0.070 | 29 |
| LAB324 | 30963.1 | 5.87 | 0.045 | 12 | LAB324 | 30963.1 | 5.08 | 0.984 | 0 |
| LAB324 | 30965.2 | 6.11 | 0.013 | 16 | LAB324 | 30965.2 | — | — | — |
| LAB324 | 30965.3 | 6.07 | 0.041 | 15 | LAB324 | 30965.3 | — | — | — |

TABLE 60-continued

Genes showing improved root performance under osmotic stress conditions (T2 generation)

| Gene Name | Event # | Roots Length [cm] Ave. | p-val. | % | Gene Name | Event # | Roots Coverage [cm2] Ave. | p-val. | % |
|---|---|---|---|---|---|---|---|---|---|
| LAB325 | 30971.4 | 6.03 | 0.031 | 15 | LAB325 | 30971.4 | 5.32 | 0.588 | 5 |
| LAB325 | 30972.2 | 5.63 | 0.238 | 7 | LAB325 | 30972.2 | — | — | — |
| LAB325 | 30973.1 | 5.33 | 0.906 | 1 | LAB325 | 30973.1 | — | — | — |
| LAB325 | 30975.2 | 5.65 | 0.488 | 7 | LAB325 | 30975.2 | — | — | — |
| LAB325 | 30975.4 | 6.61 | 0.007 | 26 | LAB325 | 30975.4 | 6.63 | 0.163 | 31 |
| LAB54 | 28133.4 | 6.45 | 0.016 | 23 | LAB54 | 28133.4 | 7.71 | 0.061 | 52 |
| LAB54 | 28134.1 | 5.92 | 0.054 | 12 | LAB54 | 28134.1 | 5.39 | 0.486 | 6 |
| LAB54 | 28136.1 | 6.08 | 0.040 | 16 | LAB54 | 28136.1 | — | — | — |
| LAB54 | 28136.2 | 6.47 | 0.013 | 23 | LAB54 | 28136.2 | 5.51 | 0.504 | 9 |
| LAB67 | 31022.1 | 5.46 | 0.800 | 4 | LAB67 | 31022.1 | 5.59 | 0.591 | 10 |
| LAB68 | 29332.3 | 5.84 | 0.277 | 11 | LAB68 | 29332.3 | 5.61 | 0.593 | 11 |
| LAB68 | 29335.1 | 6.13 | 0.030 | 16 | LAB68 | 29335.1 | 6.39 | 0.202 | 26 |
| LAB68 | 29335.3 | 6.19 | 0.008 | 18 | LAB68 | 29335.3 | 6.10 | 0.062 | 20 |
| LAB73 | 30152.1 | 5.72 | 0.108 | 9 | LAB73 | 30152.1 | 5.15 | 0.920 | 2 |
| LAB73 | 30152.2 | 5.27 | 0.962 | 0 | LAB73 | 30152.2 | — | — | — |
| LAB73 | 30154.3 | 5.61 | 0.697 | 7 | LAB73 | 30154.3 | — | — | — |
| LAB74 | 28451.3 | 5.75 | 0.346 | 9 | LAB74 | 28451.3 | 5.26 | 0.825 | 4 |
| LAB74 | 28452.1 | 5.47 | 0.479 | 4 | LAB74 | 28452.1 | — | — | — |
| LAB74 | 28452.2 | 5.45 | 0.706 | 4 | LAB74 | 28452.2 | — | — | — |
| LAB74 | 28453.5 | 5.29 | 0.948 | 0 | LAB74 | 28453.5 | — | — | — |
| LAB74 | 28454.1 | 6.03 | 0.166 | 15 | LAB74 | 28454.1 | 5.22 | 0.855 | 3 |
| CONT | — | 5.26 | — | 0 | CONT | — | 5.07 | — | 0 |
| LAB133 | 28832.5 | — | — | — | LAB133 | 28832.5 | 3.85 | 0.388 | 19 |
| LAB133 | 28833.1 | 5.85 | 0.098 | 17 | LAB133 | 28833.1 | 4.75 | 0.089 | 47 |
| LAB133 | 28833.2 | 6.07 | 0.047 | 22 | LAB133 | 28833.2 | 5.38 | 0.012 | 66 |
| LAB133 | 28833.5 | 5.95 | 0.065 | 19 | LAB133 | 28833.5 | 4.59 | 0.026 | 42 |
| LAB158 | 29411.3 | 6.11 | 0.052 | 23 | LAB158 | 29411.3 | 5.15 | 0.034 | 59 |
| LAB158 | 29411.4 | — | — | — | LAB158 | 29411.4 | 3.68 | 0.410 | 14 |
| LAB158 | 29412.1 | 5.69 | 0.163 | 14 | LAB158 | 29412.1 | 4.03 | 0.122 | 25 |
| LAB158 | 29414.3 | 6.30 | 0.024 | 26 | LAB158 | 29414.3 | 7.44 | 0.004 | 130 |
| LAB158 | 29415.1 | 6.14 | 0.038 | 23 | LAB158 | 29415.1 | 5.12 | 0.006 | 58 |
| LAB160 | 29311.2 | 6.14 | 0.037 | 23 | LAB160 | 29311.2 | 5.06 | 0.031 | 56 |
| LAB160 | 29312.1 | 5.42 | 0.356 | 9 | LAB160 | 29312.1 | 5.29 | 0.005 | 63 |
| LAB160 | 29314.2 | 5.76 | 0.146 | 15 | LAB160 | 29314.2 | 4.10 | 0.115 | 27 |
| LAB160 | 29315.2 | 5.46 | 0.291 | 9 | LAB160 | 29315.2 | 5.19 | 0.018 | 60 |
| LAB160 | 29315.3 | 5.18 | 0.661 | 4 | LAB160 | 29315.3 | 4.03 | 0.191 | 24 |
| LAB162 | 29341.2 | — | — | — | LAB162 | 29341.2 | 3.64 | 0.596 | 13 |
| LAB162 | 29342.6 | 5.96 | 0.063 | 19 | LAB162 | 29342.6 | 4.33 | 0.062 | 34 |
| LAB162 | 29342.7 | 6.08 | 0.045 | 22 | LAB162 | 29342.7 | 5.47 | 0.042 | 69 |
| LAB162 | 29344.1 | 5.90 | 0.147 | 18 | LAB162 | 29344.1 | 5.44 | 0.042 | 68 |
| LAB177 | 29421.2 | 5.32 | 0.455 | 7 | LAB177 | 29421.2 | 3.49 | 0.566 | 8 |
| LAB177 | 29422.1 | 6.77 | 0.007 | 36 | LAB177 | 29422.1 | 6.95 | 0.000 | 115 |
| LAB177 | 29424.3 | 6.05 | 0.051 | 21 | LAB177 | 29424.3 | 6.12 | 0.008 | 89 |
| LAB177 | 29424.4 | 5.15 | 0.739 | 3 | LAB177 | 29424.4 | 4.59 | 0.066 | 42 |
| LAB177 | 29425.1 | 5.66 | 0.164 | 13 | LAB177 | 29425.1 | 4.12 | 0.151 | 27 |
| LAB179 | 29301.4 | 6.01 | 0.096 | 20 | LAB179 | 29301.4 | 5.08 | 0.105 | 57 |
| LAB179 | 29302.4 | 5.75 | 0.117 | 15 | LAB179 | 29302.4 | 4.06 | 0.115 | 26 |
| LAB179 | 29303.2 | 6.48 | 0.015 | 30 | LAB179 | 29303.2 | 8.31 | 0.000 | 157 |
| LAB179 | 29304.3 | 6.15 | 0.036 | 23 | LAB179 | 29304.3 | 5.66 | 0.003 | 75 |
| LAB179 | 29304.4 | — | — | — | LAB179 | 29304.4 | 5.17 | 0.225 | 60 |
| LAB185 | 28172.2 | 5.61 | 0.186 | 12 | LAB185 | 28172.2 | 4.47 | 0.033 | 38 |
| LAB185 | 28172.4 | — | — | — | LAB185 | 28172.4 | 3.56 | 0.600 | 10 |
| LAB185 | 28174.2 | — | — | — | LAB185 | 28174.2 | 3.55 | 0.525 | 10 |
| LAB185 | 28175.2 | — | — | — | LAB185 | 28175.2 | 3.47 | 0.737 | 7 |
| LAB185 | 28175.3 | 6.20 | 0.032 | 24 | LAB185 | 28175.3 | 5.30 | 0.014 | 64 |
| LAB210 | 28331.2 | 6.08 | 0.043 | 22 | LAB210 | 28331.2 | 5.01 | 0.018 | 55 |
| LAB210 | 28331.3 | 5.94 | 0.080 | 19 | LAB210 | 28331.3 | 4.28 | 0.132 | 32 |
| LAB210 | 28333.2 | 6.40 | 0.017 | 28 | LAB210 | 28333.2 | 4.86 | 0.066 | 50 |
| LAB210 | 28333.3 | 6.32 | 0.023 | 27 | LAB210 | 28333.3 | 5.61 | 0.035 | 73 |
| LAB210 | 28335.3 | 5.63 | 0.289 | 13 | LAB210 | 28335.3 | 5.87 | 0.072 | 81 |
| LAB254 | 28811.1 | 5.44 | 0.325 | 9 | LAB254 | 28811.1 | 4.54 | 0.052 | 40 |
| LAB254 | 28814.1 | 5.78 | 0.166 | 16 | LAB254 | 28814.1 | 5.23 | 0.014 | 61 |
| LAB254 | 28814.5 | 5.41 | 0.374 | 8 | LAB254 | 28814.5 | 5.22 | 0.017 | 61 |
| LAB254 | 28815.3 | 6.30 | 0.023 | 26 | LAB254 | 28815.3 | 5.79 | 0.003 | 79 |
| LAB254 | 28815.4 | — | — | — | LAB254 | 28815.4 | 3.62 | 0.692 | 12 |
| LAB293 | 29232.2 | 5.26 | 0.618 | 6 | LAB293 | 29232.2 | 3.88 | 0.266 | 20 |
| LAB293 | 29233.3 | 5.88 | 0.078 | 18 | LAB293 | 29233.3 | 4.74 | 0.021 | 46 |
| LAB293 | 29235.4 | — | — | — | LAB293 | 29235.4 | 4.81 | 0.049 | 49 |
| LAB297 | 29272.1 | 6.05 | 0.056 | 21 | LAB297 | 29272.1 | 4.54 | 0.134 | 40 |
| LAB297 | 29272.5 | 5.93 | 0.068 | 19 | LAB297 | 29272.5 | 4.34 | 0.056 | 34 |
| LAB297 | 29273.1 | 6.41 | 0.017 | 29 | LAB297 | 29273.1 | 7.06 | 0.000 | 118 |
| LAB297 | 29273.4 | 6.03 | 0.056 | 21 | LAB297 | 29273.4 | 5.98 | 0.005 | 85 |

TABLE 60-continued

Genes showing improved root performance under osmotic stress conditions (T2 generation)

| Gene Name | Event # | Roots Length [cm] Ave. | p-val. | % | Gene Name | Event # | Roots Coverage [cm2] Ave. | p-val. | % |
|---|---|---|---|---|---|---|---|---|---|
| LAB297 | 29275.1 | 6.18 | 0.034 | 24 | LAB297 | 29275.1 | 6.28 | 0.003 | 94 |
| LAB310 | 28181.2 | 5.43 | 0.368 | 9 | LAB310 | 28181.2 | 3.54 | 0.620 | 9 |
| LAB310 | 28181.3 | 6.48 | 0.015 | 30 | LAB310 | 28181.3 | 5.92 | 0.002 | 83 |
| LAB310 | 28182.2 | 6.70 | 0.009 | 34 | LAB310 | 28182.2 | 5.78 | 0.005 | 79 |
| LAB310 | 28183.3 | 6.03 | 0.052 | 21 | LAB310 | 28183.3 | 4.39 | 0.191 | 36 |
| LAB318 | 28101.3 | 5.38 | 0.404 | 8 | LAB318 | 28101.3 | — | — | — |
| LAB318 | 28101.5 | 6.38 | 0.019 | 28 | LAB318 | 28101.5 | 5.93 | 0.022 | 83 |
| LAB318 | 28101.7 | 6.36 | 0.021 | 28 | LAB318 | 28101.7 | 7.45 | 0.054 | 130 |
| LAB318 | 28103.2 | 5.89 | 0.091 | 18 | LAB318 | 28103.2 | 5.02 | 0.113 | 55 |
| LAB318 | 28104.3 | 5.56 | 0.323 | 11 | LAB318 | 28104.3 | 4.55 | 0.159 | 40 |
| LAB327 | 29221.2 | 6.16 | 0.035 | 23 | LAB327 | 29221.2 | 4.42 | 0.077 | 37 |
| LAB327 | 29221.5 | 5.35 | 0.463 | 7 | LAB327 | 29221.5 | 4.24 | 0.184 | 31 |
| LAB327 | 29221.6 | 6.49 | 0.013 | 30 | LAB327 | 29221.6 | 5.95 | 0.002 | 84 |
| LAB327 | 29221.8 | 5.38 | 0.435 | 8 | LAB327 | 29221.8 | 4.38 | 0.066 | 35 |
| LAB327 | 29225.4 | 6.08 | 0.058 | 22 | LAB327 | 29225.4 | 4.28 | 0.219 | 32 |
| LAB335 | 27314.1 | — | — | — | LAB335 | 27314.1 | 3.69 | 0.492 | 14 |
| LAB335 | 27314.2 | — | — | — | LAB335 | 27314.2 | 4.01 | 0.288 | 24 |
| CONT | — | 4.99 | — | 0 | CONT | — | 3.24 | — | 0 |
| LAB102 | 30312.2 | 6.81 | 0.007 | 18 | LAB102 | 30312.2 | 8.12 | 0.033 | 57 |
| LAB102 | 30312.4 | 6.89 | 0.003 | 19 | LAB102 | 30312.4 | 8.18 | 0.041 | 58 |
| LAB102 | 30313.2 | 6.22 | 0.222 | 7 | LAB102 | 30313.2 | 6.18 | 0.237 | 19 |
| LAB102 | 30313.3 | 6.38 | 0.094 | 10 | LAB102 | 30313.3 | 5.78 | 0.449 | 12 |
| LAB102 | 30314.3 | 6.40 | 0.048 | 11 | LAB102 | 30314.3 | 6.32 | 0.083 | 22 |
| LAB126 | 30201.3 | 6.45 | 0.214 | 11 | LAB126 | 30201.3 | 6.42 | 0.253 | 24 |
| LAB126 | 30202.3 | 6.76 | 0.040 | 17 | LAB126 | 30202.3 | 7.37 | 0.322 | 42 |
| LAB126 | 30203.3 | 6.87 | 0.003 | 19 | LAB126 | 30203.3 | 8.39 | 0.002 | 62 |
| LAB126 | 30205.1 | 7.04 | 0.001 | 22 | LAB126 | 30205.1 | 8.93 | 0.002 | 72 |
| LAB126 | 30205.3 | 7.37 | 0.001 | 27 | LAB126 | 30205.3 | 7.78 | 0.001 | 50 |
| LAB165 | 30231.1 | 7.06 | 0.003 | 22 | LAB165 | 30231.1 | 8.65 | 0.038 | 67 |
| LAB165 | 30232.1 | 6.41 | 0.052 | 11 | LAB165 | 30232.1 | 6.02 | 0.134 | 16 |
| LAB165 | 30233.1 | 7.19 | 0.001 | 24 | LAB165 | 30233.1 | 11.32 | 0.001 | 119 |
| LAB165 | 30235.1 | 6.86 | 0.059 | 19 | LAB165 | 30235.1 | 7.87 | 0.011 | 52 |
| LAB167 | 27321.4 | 7.37 | 0.001 | 27 | LAB167 | 27321.4 | 9.35 | 0.003 | 81 |
| LAB167 | 27321.6 | 6.46 | 0.082 | 12 | LAB167 | 27321.6 | 6.20 | 0.081 | 20 |
| LAB167 | 27324.1 | 6.57 | 0.024 | 14 | LAB167 | 27324.1 | 8.87 | 0.000 | 71 |
| LAB220 | 30321.4 | 7.08 | 0.005 | 22 | LAB220 | 30321.4 | 9.87 | 0.007 | 91 |
| LAB220 | 30322.2 | 7.52 | 0.000 | 30 | LAB220 | 30322.2 | 8.32 | 0.007 | 61 |
| LAB220 | 30322.3 | 6.74 | 0.008 | 16 | LAB220 | 30322.3 | 6.59 | 0.028 | 27 |
| LAB220 | 30323.1 | 7.17 | 0.012 | 24 | LAB220 | 30323.1 | 6.89 | 0.066 | 33 |
| LAB220 | 30324.4 | 7.49 | 0.006 | 29 | LAB220 | 30324.4 | 9.77 | 0.102 | 89 |
| LAB241 | 30211.3 | 7.10 | 0.018 | 23 | LAB241 | 30211.3 | 6.68 | 0.141 | 29 |
| LAB241 | 30212.1 | 5.99 | 0.586 | 4 | LAB241 | 30212.1 | 5.61 | 0.421 | 8 |
| LAB241 | 30212.2 | 6.12 | 0.420 | 6 | LAB241 | 30212.2 | 6.24 | 0.164 | 20 |
| LAB241 | 30213.1 | 5.92 | 0.835 | 2 | LAB241 | 30213.1 | 5.54 | 0.651 | 7 |
| LAB241 | 30214.4 | 6.58 | 0.100 | 14 | LAB241 | 30214.4 | 5.30 | 0.875 | 2 |
| LAB268 | 30391.4 | 6.04 | 0.583 | 4 | LAB268 | 30391.4 | 6.70 | 0.238 | 29 |
| LAB268 | 30392.1 | 6.65 | 0.058 | 15 | LAB268 | 30392.1 | 6.80 | 0.067 | 31 |
| LAB268 | 30392.2 | 6.64 | 0.150 | 15 | LAB268 | 30392.2 | 9.06 | 0.040 | 75 |
| LAB268 | 30395.1 | 7.37 | 0.004 | 27 | LAB268 | 30395.1 | 10.20 | 0.006 | 97 |
| LAB280 | 30041.1 | 7.48 | 0.000 | 29 | LAB280 | 30041.1 | 10.97 | 0.002 | 112 |
| LAB280 | 30044.1 | 6.57 | 0.020 | 14 | LAB280 | 30044.1 | 8.68 | 0.001 | 68 |
| LAB280 | 30045.3 | 7.13 | 0.011 | 23 | LAB280 | 30045.3 | 10.63 | 0.053 | 105 |
| LAB289 | 30371.2 | 5.99 | 0.524 | 4 | LAB289 | 30371.2 | 5.78 | 0.525 | 12 |
| LAB289 | 30371.4 | 6.72 | 0.074 | 16 | LAB289 | 30371.4 | 8.61 | 0.048 | 66 |
| LAB289 | 30371.6 | 6.98 | 0.008 | 21 | LAB289 | 30371.6 | 8.06 | 0.000 | 56 |
| LAB289 | 30375.2 | 6.38 | 0.099 | 10 | LAB289 | 30375.2 | 9.51 | 0.000 | 84 |
| LAB289 | 30375.3 | 7.25 | 0.001 | 25 | LAB289 | 30375.3 | 10.11 | 0.000 | 95 |
| LAB303 | 30424.3 | 6.26 | 0.288 | 8 | LAB303 | 30424.3 | 9.24 | 0.069 | 78 |
| LAB303 | 30425.3 | 7.28 | 0.001 | 26 | LAB303 | 30425.3 | 11.28 | 0.000 | 118 |
| CONT | — | 5.78 | — | 0 | CONT | — | 5.18 | — | 0 |
| LAB303 | 30421.2 | 6.92 | 0.706 | 1 | LAB303 | 30421.2 | 8.21 | 0.510 | 11 |
| LAB311 | 30223.2 | 7.49 | 0.094 | 10 | LAB311 | 30223.2 | 7.62 | 0.871 | 3 |
| LAB311 | 30223.4 | 7.14 | 0.447 | 5 | LAB311 | 30223.4 | 8.67 | 0.264 | 17 |
| LAB311 | 30224.2 | 7.14 | 0.387 | 5 | LAB311 | 30224.2 | 7.64 | 0.896 | 4 |
| LAB344 | 30092.3 | 6.87 | 0.921 | 1 | LAB344 | 30092.3 | — | — | — |
| LAB344 | 30093.3 | — | — | — | LAB344 | 30093.3 | 7.76 | 0.762 | 5 |
| LAB344 | 30096.1 | 7.03 | 0.474 | 3 | LAB344 | 30096.1 | — | — | — |
| LAB344 | 30096.3 | — | — | — | LAB344 | 30096.3 | 8.37 | 0.530 | 14 |
| LAB355 | 29281.3 | — | — | — | LAB355 | 29281.3 | 8.70 | 0.179 | 18 |
| LAB355 | 29282.2 | 7.41 | 0.026 | 8 | LAB355 | 29282.2 | 9.48 | 0.062 | 28 |
| LAB367 | 30171.3 | — | — | — | LAB367 | 30171.3 | 7.84 | 0.597 | 6 |
| LAB381 | 30352.2 | — | — | — | LAB381 | 30352.2 | 8.09 | 0.529 | 10 |

TABLE 60-continued

Genes showing improved root performance under osmotic stress conditions (T2 generation)

| Gene Name | Event # | Roots Length [cm] Ave. | p-val. | % | Gene Name | Event # | Roots Coverage [cm2] Ave. | p-val. | % |
|---|---|---|---|---|---|---|---|---|---|
| LAB381 | 30352.4 | 7.45 | 0.041 | 9 | LAB381 | 30352.4 | 9.09 | 0.146 | 23 |
| LAB381 | 30356.1 | 6.93 | 0.681 | 2 | LAB381 | 30356.1 | 7.58 | 0.866 | 3 |
| LAB383 | 28111.3 | — | — | — | LAB383 | 28111.3 | 8.59 | 0.472 | 16 |
| LAB383 | 28111.4 | 7.13 | 0.198 | 4 | LAB383 | 28111.4 | 9.33 | 0.075 | 26 |
| LAB383 | 28115.2 | 7.12 | 0.254 | 4 | LAB383 | 28115.2 | 9.60 | 0.270 | 30 |
| LAB64 | 30273.2 | 7.18 | 0.198 | 5 | LAB64 | 30273.2 | 10.71 | 0.069 | 45 |
| LAB64 | 30274.2 | 7.28 | 0.065 | 7 | LAB64 | 30274.2 | 8.61 | 0.273 | 17 |
| LAB64 | 30274.3 | — | — | — | LAB64 | 30274.3 | 7.43 | 0.970 | 1 |
| LAB92 | 29322.1 | 7.06 | 0.439 | 3 | LAB92 | 29322.1 | 8.80 | 0.230 | 19 |
| LAB92 | 29323.2 | — | — | — | LAB92 | 29323.2 | 7.89 | 0.708 | 7 |
| LAB92 | 29325.1 | 7.05 | 0.331 | 3 | LAB92 | 29325.1 | 7.85 | 0.750 | 6 |
| CONT | — | 6.83 | — | 0 | CONT | — | 7.38 | — | 0 |
| LAB172 | 30853.4 | — | — | — | LAB172 | 30853.4 | 7.70 | 0.426 | 21 |
| LAB172 | 30854.4 | — | — | — | LAB172 | 30854.4 | 7.23 | 0.160 | 13 |
| LAB188 | 30722.2 | 7.24 | 0.116 | 7 | LAB188 | 30722.2 | 9.18 | 0.013 | 44 |
| LAB188 | 30724.1 | 6.95 | 0.554 | 2 | LAB188 | 30724.1 | — | — | — |
| LAB243 | 27101.1 | — | — | — | LAB243 | 27101.1 | 6.54 | 0.793 | 2 |
| LAB243 | 30872.1 | 6.86 | 0.832 | 1 | LAB243 | 30872.1 | 6.98 | 0.556 | 9 |
| LAB243 | 30873.4 | 7.64 | 0.004 | 12 | LAB243 | 30873.4 | 10.25 | 0.014 | 61 |
| LAB270 | 30595.2 | 6.93 | 0.449 | 2 | LAB270 | 30595.2 | 6.43 | 0.927 | 1 |
| LAB291 | 31851.2 | 6.85 | 0.795 | 1 | LAB291 | 31851.2 | 7.15 | 0.251 | 12 |
| LAB291 | 31851.3 | 6.89 | 0.721 | 1 | LAB291 | 31851.3 | 8.43 | 0.027 | 32 |
| LAB291 | 31852.4 | 6.89 | 0.794 | 1 | LAB291 | 31852.4 | 7.84 | 0.096 | 23 |
| LAB291 | 31853.3 | — | — | — | LAB291 | 31853.3 | 7.64 | 0.322 | 20 |
| LAB291 | 31854.4 | 7.16 | 0.107 | 5 | LAB291 | 31854.4 | 7.47 | 0.018 | 17 |
| LAB295 | 31861.3 | — | — | — | LAB295 | 31861.3 | 9.55 | 0.000 | 50 |
| LAB295 | 31863.1 | — | — | — | LAB295 | 31863.1 | 7.25 | 0.149 | 14 |
| LAB295 | 31864.3 | 7.07 | 0.543 | 4 | LAB295 | 31864.3 | 7.58 | 0.247 | 19 |
| LAB295 | 31864.4 | — | — | — | LAB295 | 31864.4 | 7.81 | 0.008 | 22 |
| LAB323 | 30381.4 | 7.06 | 0.335 | 4 | LAB323 | 30381.4 | 8.00 | 0.201 | 25 |
| LAB323 | 30383.1 | 7.19 | 0.040 | 6 | LAB323 | 30383.1 | 7.06 | 0.179 | 11 |
| LAB347_H0 | 30441.1 | — | — | — | LAB347_H0 | 30441.1 | 7.81 | 0.014 | 22 |
| LAB347_H0 | 30444.1 | 7.10 | 0.209 | 5 | LAB347_H0 | 30444.1 | 8.28 | 0.003 | 30 |
| LAB347_H0 | 30444.3 | 7.42 | 0.033 | 9 | LAB347_H0 | 30444.3 | 8.52 | 0.115 | 33 |
| LAB55 | 30023.1 | — | — | — | LAB55 | 30023.1 | 7.97 | 0.081 | 25 |
| CONT | — | 6.79 | — | 0 | CONT | — | 6.38 | — | 0 |
| LAB243 | 30872.1 | 7.64 | 0.252 | 3 | LAB243 | 30872.1 | — | — | — |
| LAB291 | 31851.3 | 7.50 | 0.808 | 1 | LAB291 | 31851.3 | — | — | — |
| LAB291 | 31854.4 | 7.46 | 0.934 | 0 | LAB291 | 31854.4 | — | — | — |
| CONT | — | 7.44 | — | 0 | CONT | — | — | — | — |

Table 60.
"CONT."—Control;
"Ave."—Average;
"% Incr." = % increment;
"p-val."—p-value.

TABLE 61

Genes showing improved root performance under osmotic stress conditions (T1 generation)

| Gene Name | Event # | Roots Length [cm] Ave. | p-val. | % | Gene Name | Event # | Roots Coverage [cm2] Ave. | p-val. | % |
|---|---|---|---|---|---|---|---|---|---|
| | | | | | LAB89 | 32432 | 1.2292 | 0.901453 | 2.5704 |
| | | | | | CONT | — | 1.1984 | — | 0 |
| | | | | | LAB349 | 32391 | 2.76448 | 0.957419 | 0.8879 |
| | | | | | LAB69 | 32451 | 2.93895 | 0.743258 | 7.2552 |
| | | | | | LAB89 | 32432 | 3.02692 | 0.617587 | 10.4656 |
| | | | | | CONT | — | 2.74015 | — | 0 |

Table 61.
"CONT."—Control;
"Ave."—Average;
"% Incr." = % increment;
"p-val."—p-value.

The genes listed in Tables 62-65 have improved plant growth rate (growth rate of the leaf area, root coverage and root length) when grown under osmotic stress conditions, compared to control plants. Plants showing fast growth rate show a better plant establishment in soil under osmotic stress conditions. Faster growth was observed when growth rate of leaf area and root length and coverage was measured. The genes were cloned under the regulation of a constitutive promoter (At6669; SEQ ID NO:8741). The evaluation of each gene was performed by testing the performance of different number of events. Some of the genes were evaluated in more than one tissue culture assay and the results obtained where positive as well. Event with p-value <.0.1 was considered statistically significant.

TABLE 62

Genes showing improved plant growth rate under osmotic stress conditions (T2 generation)

| Gene Name | Event # | RGR Of Leaf Area Ave. | p-val. | % | Gene Name | Event # | RGR Of Roots Coverage Ave. | p-val. | % |
|---|---|---|---|---|---|---|---|---|---|
| LAB115 | 27282.3 | — | | — | LAB115 | 27282.3 | 0.36 | 0.84 | 16 |
| LAB115 | 27284.3 | 0.02 | 0.73 | 29 | LAB115 | 27284.3 | — | | — |
| LAB115 | 27285.2 | 0.03 | 0.44 | 69 | LAB115 | 27285.2 | 0.42 | 0.67 | 35 |
| LAB123 | 28282.3 | 0.02 | 0.85 | 17 | LAB123 | 28282.3 | 0.38 | 0.79 | 23 |
| LAB123 | 28283.1 | — | | — | LAB123 | 28283.1 | 0.35 | 0.89 | 12 |
| LAB123 | 28284.2 | 0.02 | 0.77 | 25 | LAB123 | 28284.2 | 0.41 | 0.71 | 32 |
| LAB123 | 28284.3 | — | | — | LAB123 | 28284.3 | 0.43 | 0.64 | 38 |
| LAB123 | 28285.2 | 0.03 | 0.57 | 51 | LAB123 | 28285.2 | 0.56 | 0.40 | 82 |
| LAB183 | 27452.2 | 0.02 | 0.93 | 8 | LAB183 | 27452.2 | 0.33 | 0.94 | 6 |
| LAB183 | 27453.1 | 0.02 | 0.73 | 27 | LAB183 | 27453.1 | — | | — |
| LAB183 | 27453.4 | 0.03 | 0.58 | 44 | LAB183 | 27453.4 | — | | — |
| LAB189 | 28163.2 | 0.03 | 0.45 | 66 | LAB189 | 28163.2 | — | | — |
| LAB189 | 28165.2 | 0.02 | 0.85 | 15 | LAB189 | 28165.2 | — | | — |
| LAB189 | 28166.1 | — | | — | LAB189 | 28166.1 | 0.45 | 0.61 | 44 |
| LAB212 | 28041.1 | 0.02 | 0.92 | 9 | LAB212 | 28041.1 | 0.31 | 1.00 | 0 |
| LAB212 | 28042.1 | 0.02 | 0.71 | 33 | LAB212 | 28042.1 | 0.39 | 0.78 | 25 |
| LAB212 | 28043.2 | — | | — | LAB212 | 28043.2 | 0.56 | 0.36 | 81 |
| LAB212 | 28044.2 | 0.02 | 0.75 | 25 | LAB212 | 28044.2 | — | | — |
| LAB212 | 28045.2 | — | | — | LAB212 | 28045.2 | 0.45 | 0.63 | 45 |
| LAB217 | 28033.2 | 0.04 | 0.11 | 141 | LAB217 | 28033.2 | — | | — |
| LAB217 | 28034.1 | 0.03 | 0.42 | 73 | LAB217 | 28034.1 | — | | — |
| LAB217 | 28036.4 | 0.03 | 0.27 | 91 | LAB217 | 28036.4 | — | | — |
| LAB326 | 28052.4 | 0.02 | 0.99 | 1 | LAB326 | 28052.4 | 0.34 | 0.90 | 11 |
| LAB326 | 28053.2 | 0.04 | 0.20 | 121 | LAB326 | 28053.2 | 0.39 | 0.80 | 26 |
| LAB326 | 28054.1 | 0.02 | 0.67 | 35 | LAB326 | 28054.1 | — | | — |
| LAB326 | 28056.2 | 0.03 | 0.63 | 43 | LAB326 | 28056.2 | 0.47 | 0.58 | 51 |
| LAB326 | 28056.3 | 0.02 | 1.00 | 0 | LAB326 | 28056.3 | — | | — |
| cont | — | 0.02 | — | 0 | cont | — | 0.31 | — | 0 |
| LAB115 | 27281.3 | 0.04 | 0.25 | 22 | LAB115 | 27281.3 | 0.55 | 0.71 | 4 |
| LAB115 | 27284.3 | 0.04 | 0.31 | 16 | LAB115 | 27284.3 | — | | — |
| LAB115 | 27285.1 | 0.04 | 0.03 | 40 | LAB115 | 27285.1 | — | | — |
| LAB123 | 28281.1 | 0.09 | 0.00 | 186 | LAB123 | 28281.1 | 0.95 | 0.00 | 82 |
| LAB123 | 28282.3 | 0.05 | 0.00 | 46 | LAB123 | 28282.3 | 0.68 | 0.02 | 30 |
| LAB123 | 28283.1 | 0.06 | 0.00 | 96 | LAB123 | 28283.1 | 0.81 | 0.00 | 54 |
| LAB123 | 28284.1 | 0.05 | 0.00 | 72 | LAB123 | 28284.1 | 0.77 | 0.00 | 47 |
| LAB123 | 28285.2 | 0.06 | 0.00 | 87 | LAB123 | 28285.2 | 0.82 | 0.00 | 56 |
| LAB183 | 27453.1 | 0.03 | 0.91 | 2 | LAB183 | 27453.1 | 0.57 | 0.47 | 9 |
| LAB183 | 27453.4 | 0.05 | 0.00 | 52 | LAB183 | 27453.4 | 0.63 | 0.11 | 20 |
| LAB189 | 28163.2 | 0.04 | 0.44 | 12 | LAB189 | 28163.2 | 0.66 | 0.08 | 26 |
| LAB189 | 28164.2 | 0.04 | 0.45 | 13 | LAB189 | 28164.2 | — | | — |
| LAB189 | 28165.2 | 0.03 | 0.96 | 1 | LAB189 | 28165.2 | — | | — |
| LAB189 | 28166.2 | 0.05 | 0.03 | 65 | LAB189 | 28166.2 | 0.71 | 0.01 | 35 |
| LAB189 | 28166.5 | 0.04 | 0.44 | 13 | LAB189 | 28166.5 | — | | — |
| LAB206 | 30011.2 | 0.04 | 0.06 | 27 | LAB206 | 30011.2 | 0.57 | 0.51 | 8 |
| LAB206 | 30012.4 | 0.04 | 0.33 | 15 | LAB206 | 30012.4 | — | | — |
| LAB206 | 30012.8 | 0.04 | 0.04 | 34 | LAB206 | 30012.8 | — | | — |
| LAB212 | 28041.1 | 0.03 | 0.74 | 5 | LAB212 | 28041.1 | 0.60 | 0.27 | 15 |
| LAB212 | 28045.1 | 0.04 | 0.21 | 18 | LAB212 | 28045.1 | — | | — |
| LAB217 | 28033.2 | 0.06 | 0.00 | 79 | LAB217 | 28033.2 | 0.77 | 0.00 | 47 |
| LAB217 | 28034.1 | 0.04 | 0.03 | 39 | LAB217 | 28034.1 | 0.59 | 0.35 | 13 |
| LAB217 | 28034.3 | 0.03 | 0.63 | 7 | LAB217 | 28034.3 | 0.56 | 0.57 | 7 |
| LAB217 | 28035.1 | 0.05 | 0.01 | 60 | LAB217 | 28035.1 | 0.76 | 0.00 | 45 |
| LAB217 | 28036.1 | 0.04 | 0.04 | 40 | LAB217 | 28036.1 | 0.55 | 0.72 | 5 |
| LAB250 | 30251.2 | 0.05 | 0.01 | 45 | LAB250 | 30251.2 | 0.67 | 0.05 | 28 |
| LAB250 | 30252.1 | 0.04 | 0.07 | 35 | LAB250 | 30252.1 | — | | — |
| LAB250 | 30253.1 | 0.03 | 0.98 | 0 | LAB250 | 30253.1 | 0.64 | 0.06 | 23 |
| LAB250 | 30254.3 | 0.03 | 0.58 | 9 | LAB250 | 30254.3 | — | | — |
| LAB314 | 29292.6 | 0.04 | 0.01 | 39 | LAB314 | 29292.6 | — | | — |
| LAB314 | 29294.1 | 0.04 | 0.41 | 13 | LAB314 | 29294.1 | — | | — |
| LAB326 | 28052.4 | 0.04 | 0.31 | 16 | LAB326 | 28052.4 | 0.57 | 0.51 | 9 |
| LAB326 | 28056.3 | 0.04 | 0.35 | 14 | LAB326 | 28056.3 | 0.60 | 0.40 | 14 |
| LAB351 | 30112.1 | 0.04 | 0.23 | 20 | LAB351 | 30112.1 | — | | — |

TABLE 62-continued

Genes showing improved plant growth rate under osmotic stress conditions (T2 generation)

| Gene Name | Event # | RGR Of Leaf Area Ave. | p-val. | % | Gene Name | Event # | RGR Of Roots Coverage Ave. | p-val. | % |
|---|---|---|---|---|---|---|---|---|---|
| LAB351 | 30115.1 | 0.04 | 0.14 | 22 | LAB351 | 30115.1 | 0.66 | 0.03 | 26 |
| LAB351 | 30115.3 | 0.04 | 0.33 | 15 | LAB351 | 30115.3 | 0.63 | 0.13 | 20 |
| LAB93 | 28271.3 | 0.04 | 0.16 | 30 | LAB93 | 28271.3 | 0.63 | 0.13 | 21 |
| LAB93 | 28272.3 | 0.06 | 0.00 | 74 | LAB93 | 28272.3 | 0.57 | 0.50 | 9 |
| LAB93 | 28274.2 | 0.04 | 0.30 | 20 | LAB93 | 28274.2 | 0.60 | 0.27 | 15 |
| LAB93 | 28274.3 | 0.03 | 0.52 | 10 | LAB93 | 28274.3 | — | — | — |
| cont | — | 0.03 | — | 0 | cont | — | 0.52 | — | 0 |
| LAB106 | 30031.4 | 0.04 | 0.72 | 4 | LAB106 | 30031.4 | — | — | — |
| LAB106 | 30032.1 | 0.06 | 0.00 | 43 | LAB106 | 30032.1 | 0.70 | 0.07 | 19 |
| LAB106 | 30032.2 | 0.06 | 0.02 | 34 | LAB106 | 30032.2 | 0.64 | 0.60 | 7 |
| LAB106 | 30035.1 | — | — | — | LAB106 | 30035.1 | 0.65 | 0.46 | 9 |
| LAB206 | 30011.7 | 0.05 | 0.21 | 15 | LAB206 | 30011.7 | — | — | — |
| LAB206 | 30012.4 | 0.05 | 0.49 | 12 | LAB206 | 30012.4 | — | — | — |
| LAB206 | 30012.8 | 0.04 | 0.72 | 5 | LAB206 | 30012.8 | — | — | — |
| LAB207 | 28842.1 | 0.05 | 0.24 | 15 | LAB207 | 28842.1 | 0.97 | 0.00 | 63 |
| LAB207 | 28842.5 | 0.05 | 0.13 | 20 | LAB207 | 28842.5 | 0.77 | 0.01 | 30 |
| LAB207 | 28843.3 | 0.06 | 0.01 | 34 | LAB207 | 28843.3 | 0.61 | 0.83 | 2 |
| LAB207 | 28843.5 | 0.05 | 0.09 | 23 | LAB207 | 28843.5 | 0.82 | 0.00 | 39 |
| LAB218 | 29432.2 | 0.05 | 0.19 | 14 | LAB218 | 29432.2 | — | — | — |
| LAB218 | 29433.4 | — | — | — | LAB218 | 29433.4 | 0.59 | 0.97 | 0 |
| LAB218 | 29434.3 | 0.05 | 0.49 | 12 | LAB218 | 29434.3 | — | — | — |
| LAB250 | 30253.1 | 0.05 | 0.10 | 25 | LAB250 | 30253.1 | 0.70 | 0.18 | 19 |
| LAB250 | 30254.1 | — | — | — | LAB250 | 30254.1 | 0.69 | 0.14 | 17 |
| LAB252 | 30291.4 | 0.05 | 0.08 | 23 | LAB252 | 30291.4 | 0.63 | 0.50 | 7 |
| LAB252 | 30292.3 | 0.07 | 0.29 | 62 | LAB252 | 30292.3 | 0.67 | 0.29 | 14 |
| LAB309 | 30052.2 | 0.05 | 0.14 | 20 | LAB309 | 30052.2 | 0.66 | 0.41 | 11 |
| LAB309 | 30052.3 | 0.06 | 0.05 | 39 | LAB309 | 30052.3 | 0.70 | 0.19 | 19 |
| LAB314 | 29292.4 | 0.05 | 0.17 | 20 | LAB314 | 29292.4 | 0.74 | 0.08 | 25 |
| LAB314 | 29292.6 | 0.05 | 0.13 | 23 | LAB314 | 29292.6 | — | — | — |
| LAB314 | 29294.1 | 0.06 | 0.01 | 43 | LAB314 | 29294.1 | 0.61 | 0.77 | 3 |
| LAB314 | 29295.2 | 0.05 | 0.38 | 16 | LAB314 | 29295.2 | — | — | — |
| LAB346 | 29442.2 | 0.04 | 0.85 | 2 | LAB346 | 29442.2 | — | — | — |
| LAB346 | 29442.4 | 0.05 | 0.15 | 16 | LAB346 | 29442.4 | — | — | — |
| LAB346 | 29443.2 | 0.05 | 0.38 | 15 | LAB346 | 29443.2 | 0.65 | 0.34 | 9 |
| LAB346 | 29445.3 | 0.06 | 0.00 | 36 | LAB346 | 29445.3 | — | — | — |
| LAB351 | 30111.2 | 0.06 | 0.01 | 43 | LAB351 | 30111.2 | 0.80 | 0.00 | 35 |
| LAB351 | 30112.1 | — | — | — | LAB351 | 30112.1 | 0.62 | 0.70 | 5 |
| LAB351 | 30114.2 | 0.05 | 0.01 | 29 | LAB351 | 30114.2 | 0.68 | 0.17 | 15 |
| LAB351 | 30115.3 | — | — | — | LAB351 | 30115.3 | 0.60 | 0.88 | 2 |
| LAB82 | 30181.3 | — | — | — | LAB82 | 30181.3 | 0.69 | 0.12 | 16 |
| LAB84 | 30161.4 | 0.06 | 0.00 | 51 | LAB84 | 30161.4 | 0.65 | 0.40 | 10 |
| LAB84 | 30162.2 | — | — | — | LAB84 | 30162.2 | 0.70 | 0.14 | 18 |
| LAB84 | 30162.4 | 0.08 | 0.00 | 86 | LAB84 | 30162.4 | 0.77 | 0.06 | 30 |
| LAB84 | 30163.4 | 0.06 | 0.03 | 35 | LAB84 | 30163.4 | 0.83 | 0.00 | 39 |
| LAB84 | 30164.2 | 0.08 | 0.00 | 82 | LAB84 | 30164.2 | 0.75 | 0.07 | 27 |
| cont | — | 0.04 | — | 0 | cont | — | 0.59 | — | 0 |
| LAB110 | 30571.3 | 0.05 | 0.01 | 35 | LAB110 | 30571.3 | 0.84 | 0.00 | 48 |
| LAB110 | 30572.1 | 0.04 | 0.80 | 3 | LAB110 | 30572.1 | 0.65 | 0.24 | 15 |
| LAB110 | 30572.2 | 0.04 | 0.96 | 1 | LAB110 | 30572.2 | — | — | — |
| LAB110 | 30573.2 | 0.06 | 0.00 | 41 | LAB110 | 30573.2 | 0.77 | 0.02 | 35 |
| LAB110 | 30574.2 | 0.06 | 0.00 | 43 | LAB110 | 30574.2 | 0.92 | 0.00 | 62 |
| LAB117 | 27291.1 | 0.05 | 0.11 | 21 | LAB117 | 27291.1 | 0.73 | 0.03 | 28 |
| LAB117 | 27291.5 | 0.07 | 0.00 | 66 | LAB117 | 27291.5 | 0.79 | 0.00 | 39 |
| LAB117 | 27293.1 | 0.08 | 0.00 | 90 | LAB117 | 27293.1 | 0.93 | 0.00 | 63 |
| LAB117 | 27293.2 | 0.04 | 0.94 | 1 | LAB117 | 27293.2 | — | — | — |
| LAB117 | 27296.1 | 0.06 | 0.00 | 55 | LAB117 | 27296.1 | — | — | — |
| LAB124 | 30431.1 | 0.05 | 0.02 | 35 | LAB124 | 30431.1 | 0.83 | 0.00 | 45 |
| LAB124 | 30432.3 | 0.04 | 0.55 | 7 | LAB124 | 30432.3 | 0.75 | 0.01 | 32 |
| LAB124 | 30434.1 | 0.05 | 0.16 | 20 | LAB124 | 30434.1 | 0.68 | 0.13 | 19 |
| LAB124 | 30434.3 | 0.06 | 0.00 | 46 | LAB124 | 30434.3 | 0.76 | 0.01 | 34 |
| LAB124 | 30435.2 | 0.05 | 0.12 | 20 | LAB124 | 30435.2 | — | — | — |
| LAB125 | 30581.3 | 0.05 | 0.23 | 15 | LAB125 | 30581.3 | 0.61 | 0.55 | 8 |
| LAB125 | 30582.2 | 0.04 | 0.64 | 6 | LAB125 | 30582.2 | 0.64 | 0.36 | 12 |
| LAB125 | 30583.1 | 0.04 | 0.75 | 4 | LAB125 | 30583.1 | — | — | — |
| LAB125 | 30583.2 | 0.05 | 0.02 | 33 | LAB125 | 30583.2 | 0.75 | 0.01 | 32 |
| LAB156 | 30401.4 | 0.04 | 0.99 | 0 | LAB156 | 30401.4 | 0.68 | 0.13 | 21 |
| LAB156 | 30402.2 | 0.06 | 0.00 | 52 | LAB156 | 30402.2 | 0.81 | 0.00 | 42 |
| LAB156 | 30403.1 | 0.05 | 0.12 | 18 | LAB156 | 30403.1 | 0.67 | 0.18 | 17 |
| LAB156 | 30403.4 | 0.04 | 0.47 | 8 | LAB156 | 30403.4 | 0.63 | 0.38 | 11 |
| LAB156 | 30405.3 | 0.04 | 0.55 | 7 | LAB156 | 30405.3 | — | — | — |
| LAB228 | 30081.4 | — | — | — | LAB228 | 30081.4 | 0.73 | 0.03 | 28 |
| LAB228 | 30082.3 | 0.04 | 0.58 | 8 | LAB228 | 30082.3 | — | — | — |

TABLE 62-continued

Genes showing improved plant growth rate under osmotic stress conditions (T2 generation)

| Gene Name | Event # | RGR Of Leaf Area Ave. | p-val. | % | Gene Name | Event # | RGR Of Roots Coverage Ave. | p-val. | % |
|---|---|---|---|---|---|---|---|---|---|
| LAB228 | 30084.3 | 0.05 | 0.12 | 19 | LAB228 | 30084.3 | 0.69 | 0.09 | 22 |
| LAB275 | 30361.3 | 0.06 | 0.00 | 53 | LAB275 | 30361.3 | 0.83 | 0.00 | 46 |
| LAB275 | 30363.1 | 0.04 | 0.48 | 9 | LAB275 | 30363.1 | — | | — |
| LAB275 | 30363.4 | 0.04 | 0.46 | 9 | LAB275 | 30363.4 | — | | — |
| LAB275 | 30366.4 | 0.04 | 0.38 | 10 | LAB275 | 30366.4 | 0.65 | 0.25 | 14 |
| LAB276_H0 | 30331.1 | 0.07 | 0.00 | 78 | LAB276_H0 | 30331.1 | 0.94 | 0.00 | 66 |
| LAB276_H0 | 30333.3 | 0.05 | 0.14 | 18 | LAB276_H0 | 30333.3 | — | | — |
| LAB276_H0 | 30333.7 | 0.05 | 0.23 | 14 | LAB276_H0 | 30333.7 | 0.59 | 0.77 | 3 |
| LAB277 | 30651.2 | 0.05 | 0.11 | 19 | LAB277 | 30651.2 | 0.74 | 0.02 | 30 |
| LAB277 | 30652.3 | 0.04 | 0.55 | 7 | LAB277 | 30652.3 | 0.59 | 0.73 | 5 |
| LAB277 | 30652.5 | 0.05 | 0.01 | 31 | LAB277 | 30652.5 | 0.75 | 0.01 | 32 |
| LAB277 | 30653.1 | 0.06 | 0.00 | 46 | LAB277 | 30653.1 | 0.66 | 0.20 | 16 |
| LAB278 | 30411.4 | 0.05 | 0.03 | 31 | LAB278 | 30411.4 | — | | — |
| LAB278 | 30412.1 | 0.05 | 0.10 | 20 | LAB278 | 30412.1 | — | | — |
| LAB278 | 30413.3 | 0.05 | 0.32 | 13 | LAB278 | 30413.3 | — | | — |
| LAB278 | 30414.1 | — | | — | LAB278 | 30414.1 | 0.71 | 0.05 | 25 |
| LAB278 | 30414.2 | 0.05 | 0.11 | 23 | LAB278 | 30414.2 | 0.78 | 0.02 | 38 |
| LAB281 | 30741.1 | 0.05 | 0.04 | 27 | LAB281 | 30741.1 | 0.64 | 0.30 | 13 |
| LAB281 | 30742.1 | 0.04 | 0.54 | 8 | LAB281 | 30742.1 | — | | — |
| LAB281 | 30742.4 | 0.05 | 0.09 | 22 | LAB281 | 30742.4 | 0.69 | 0.11 | 22 |
| LAB282 | 30751.3 | 0.05 | 0.01 | 31 | LAB282 | 30751.3 | 0.61 | 0.61 | 7 |
| LAB282 | 30753.3 | 0.04 | 0.98 | 0 | LAB282 | 30753.3 | — | | — |
| LAB282 | 30753.4 | — | | — | LAB282 | 30753.4 | 0.60 | 0.65 | 6 |
| LAB282 | 30754.2 | 0.05 | 0.16 | 18 | LAB282 | 30754.2 | 0.74 | 0.03 | 30 |
| cont | — | 0.04 | — | 0 | cont | — | 0.57 | — | 0 |
| LAB110 | 30571.3 | 0.04 | 0.87 | 3 | LAB110 | 30571.3 | 0.67 | 0.62 | 6 |
| LAB110 | 30572.1 | — | | — | LAB110 | 30572.1 | 0.64 | 0.93 | 1 |
| LAB110 | 30572.2 | 0.07 | 0.00 | 67 | LAB110 | 30572.2 | 1.02 | 0.00 | 61 |
| LAB110 | 30573.2 | 0.05 | 0.71 | 7 | LAB110 | 30573.2 | — | | — |
| LAB110 | 30574.2 | 0.05 | 0.19 | 25 | LAB110 | 30574.2 | 0.87 | 0.01 | 37 |
| LAB117 | 27291.2 | 0.06 | 0.05 | 40 | LAB117 | 27291.2 | 0.76 | 0.14 | 20 |
| LAB117 | 27293.1 | 0.07 | 0.00 | 69 | LAB117 | 27293.1 | 0.85 | 0.01 | 35 |
| LAB117 | 27293.2 | 0.04 | 0.79 | 5 | LAB117 | 27293.2 | — | | — |
| LAB117 | 27296.1 | 0.07 | 0.01 | 54 | LAB117 | 27296.1 | — | | — |
| LAB124 | 30431.1 | — | | — | LAB124 | 30431.1 | 0.66 | 0.77 | 4 |
| LAB124 | 30434.1 | 0.05 | 0.14 | 28 | LAB124 | 30434.1 | 0.86 | 0.02 | 37 |
| LAB125 | 30581.3 | 0.06 | 0.04 | 41 | LAB125 | 30581.3 | 0.89 | 0.00 | 42 |
| LAB125 | 30582.2 | — | | — | LAB125 | 30582.2 | 0.78 | 0.10 | 24 |
| LAB125 | 30584.2 | 0.06 | 0.01 | 51 | LAB125 | 30584.2 | 0.76 | 0.12 | 20 |
| LAB156 | 30401.4 | 0.05 | 0.25 | 22 | LAB156 | 30401.4 | 0.91 | 0.00 | 45 |
| LAB156 | 30403.4 | 0.04 | 1.00 | 0 | LAB156 | 30403.4 | — | | — |
| LAB156 | 30405.3 | 0.05 | 0.23 | 23 | LAB156 | 30405.3 | — | | — |
| LAB228 | 30081.4 | — | | — | LAB228 | 30081.4 | 0.74 | 0.17 | 17 |
| LAB228 | 30082.3 | 0.07 | 0.00 | 60 | LAB228 | 30082.3 | 0.70 | 0.43 | 11 |
| LAB228 | 30084.3 | — | | — | LAB228 | 30084.3 | 0.64 | 0.87 | 2 |
| LAB228 | 30084.4 | 0.05 | 0.58 | 10 | LAB228 | 30084.4 | — | | — |
| LAB275 | 30361.2 | — | | — | LAB275 | 30361.2 | 0.72 | 0.28 | 14 |
| LAB275 | 30361.3 | 0.05 | 0.53 | 12 | LAB275 | 30361.3 | 0.93 | 0.00 | 48 |
| LAB275 | 30363.1 | 0.05 | 0.26 | 21 | LAB275 | 30363.1 | 0.64 | 0.92 | 1 |
| LAB275 | 30363.4 | — | | — | LAB275 | 30363.4 | 0.72 | 0.26 | 14 |
| LAB275 | 30366.4 | — | | — | LAB275 | 30366.4 | 0.82 | 0.03 | 30 |
| LAB276_H0 | 30331.1 | 0.05 | 0.31 | 24 | LAB276_H0 | 30331.1 | 0.64 | 0.91 | 2 |
| LAB276_H0 | 30331.4 | 0.07 | 0.00 | 64 | LAB276_H0 | 30331.4 | 0.71 | 0.37 | 13 |
| LAB276_H0 | 30333.7 | 0.05 | 0.58 | 11 | LAB276_H0 | 30333.7 | — | | — |
| LAB277 | 30651.2 | 0.04 | 0.87 | 3 | LAB277 | 30651.2 | 0.73 | 0.23 | 16 |
| LAB277 | 30652.3 | 0.05 | 0.54 | 11 | LAB277 | 30652.3 | 0.67 | 0.64 | 6 |
| LAB277 | 30652.5 | — | | — | LAB277 | 30652.5 | 1.03 | 0.00 | 63 |
| LAB277 | 30652.6 | 0.05 | 0.12 | 28 | LAB277 | 30652.6 | 0.95 | 0.00 | 51 |
| LAB277 | 30653.1 | 0.04 | 0.83 | 4 | LAB277 | 30653.1 | — | | — |
| LAB278 | 30411.4 | 0.04 | 0.98 | 0 | LAB278 | 30411.4 | — | | — |
| LAB278 | 30413.3 | 0.05 | 0.20 | 27 | LAB278 | 30413.3 | 0.69 | 0.50 | 9 |
| LAB278 | 30414.1 | 0.06 | 0.03 | 41 | LAB278 | 30414.1 | 0.93 | 0.00 | 48 |
| LAB278 | 30414.2 | 0.06 | 0.09 | 32 | LAB278 | 30414.2 | 0.95 | 0.00 | 51 |
| LAB281 | 30741.1 | — | | — | LAB281 | 30741.1 | 0.63 | 1.00 | 0 |
| LAB281 | 30742.4 | — | | — | LAB281 | 30742.4 | 0.66 | 0.73 | 5 |
| LAB281 | 30743.4 | — | | — | LAB281 | 30743.4 | 0.88 | 0.01 | 40 |
| LAB281 | 30744.1 | — | | — | LAB281 | 30744.1 | 0.66 | 0.70 | 5 |
| LAB282 | 30752.2 | 0.05 | 0.54 | 11 | LAB282 | 30752.2 | 0.78 | 0.06 | 24 |
| LAB282 | 30753.3 | — | | — | LAB282 | 30753.3 | 0.67 | 0.66 | 5 |
| LAB282 | 30753.4 | 0.05 | 0.41 | 15 | LAB282 | 30753.4 | — | | — |
| cont | — | 0.04 | — | 0 | cont | — | 0.63 | — | 0 |
| LAB106 | 30031.4 | 0.04 | 0.46 | 15 | LAB106 | 30031.4 | — | | — |

TABLE 62-continued

Genes showing improved plant growth rate under
osmotic stress conditions (T2 generation)

| Gene Name | Event # | RGR Of Leaf Area Ave. | p-val. | % | Gene Name | Event # | RGR Of Roots Coverage Ave. | p-val. | % |
|---|---|---|---|---|---|---|---|---|---|
| LAB106 | 30035.2 | 0.04 | 0.42 | 15 | LAB106 | 30035.2 | — | — | — |
| LAB127 | 30811.1 | — | — | — | LAB127 | 30811.1 | 0.88 | 0.69 | 4 |
| LAB127 | 30811.4 | 0.04 | 0.60 | 10 | LAB127 | 30811.4 | — | — | — |
| LAB128 | 28074.1 | 0.04 | 0.46 | 15 | LAB128 | 28074.1 | — | — | — |
| LAB128 | 28074.3 | 0.04 | 0.78 | 6 | LAB128 | 28074.3 | 0.94 | 0.39 | 10 |
| LAB128 | 28075.2 | 0.05 | 0.01 | 53 | LAB128 | 28075.2 | 1.20 | 0.00 | 41 |
| LAB207 | 28842.1 | 0.05 | 0.14 | 32 | LAB207 | 28842.1 | 1.10 | 0.01 | 30 |
| LAB207 | 28842.5 | 0.04 | 0.45 | 16 | LAB207 | 28842.5 | 1.03 | 0.13 | 21 |
| LAB207 | 28845.1 | — | — | — | LAB207 | 28845.1 | 1.03 | 0.03 | 21 |
| LAB218 | 29431.3 | 0.04 | 0.35 | 25 | LAB218 | 29431.3 | — | — | — |
| LAB218 | 29433.4 | 0.04 | 0.29 | 20 | LAB218 | 29433.4 | — | — | — |
| LAB218 | 29434.3 | 0.04 | 0.64 | 8 | LAB218 | 29434.3 | — | — | — |
| LAB252 | 30292.3 | 0.06 | 0.02 | 71 | LAB252 | 30292.3 | 1.03 | 0.17 | 22 |
| LAB252 | 30292.4 | 0.04 | 0.24 | 27 | LAB252 | 30292.4 | — | — | — |
| LAB309 | 30052.3 | 0.05 | 0.08 | 36 | LAB309 | 30052.3 | — | — | — |
| LAB309 | 30054.2 | 0.04 | 0.15 | 27 | LAB309 | 30054.2 | — | — | — |
| LAB309 | 30056.1 | 0.04 | 0.68 | 8 | LAB309 | 30056.1 | 1.07 | 0.01 | 26 |
| LAB337 | 27264.1 | 0.04 | 0.75 | 6 | LAB337 | 27264.1 | — | — | — |
| LAB337 | 27265.1 | 0.04 | 0.66 | 9 | LAB337 | 27265.1 | — | — | — |
| LAB337 | 27265.2 | 0.05 | 0.15 | 32 | LAB337 | 27265.2 | 0.88 | 0.77 | 4 |
| LAB346 | 29442.2 | 0.05 | 0.19 | 32 | LAB346 | 29442.2 | — | — | — |
| LAB346 | 29443.2 | 0.04 | 0.64 | 10 | LAB346 | 29443.2 | — | — | — |
| LAB346 | 29445.6 | 0.04 | 0.31 | 20 | LAB346 | 29445.6 | — | — | — |
| LAB80 | 30673.2 | 0.04 | 0.52 | 12 | LAB80 | 30673.2 | — | — | — |
| LAB82 | 30181.3 | — | — | — | LAB82 | 30181.3 | 0.88 | 0.74 | 3 |
| LAB84 | 30164.2 | 0.04 | 0.96 | 1 | LAB84 | 30164.2 | — | — | — |
| cont | — | 0.04 | — | 0 | cont | — | 0.85 | — | 0 |
| LAB127 | 30811.1 | 0.03 | 0.74 | 26 | LAB127 | 30811.1 | — | — | — |
| LAB127 | 30811.4 | 0.03 | 0.84 | 16 | LAB127 | 30811.4 | — | — | — |
| LAB127 | 30812.1 | — | — | — | LAB127 | 30812.1 | 0.46 | 0.84 | 13 |
| LAB127 | 30814.2 | 0.02 | 0.96 | 3 | LAB127 | 30814.2 | — | — | — |
| LAB128 | 28071.2 | 0.03 | 0.77 | 22 | LAB128 | 28071.2 | — | — | — |
| LAB128 | 28071.8 | — | — | — | LAB128 | 28071.8 | 0.41 | 0.99 | 1 |
| LAB128 | 28074.1 | — | — | — | LAB128 | 28074.1 | 0.49 | 0.77 | 21 |
| LAB128 | 28075.2 | 0.03 | 0.80 | 20 | LAB128 | 28075.2 | 0.44 | 0.90 | 8 |
| LAB147 | 31104.1 | 0.03 | 0.71 | 31 | LAB147 | 31104.1 | — | — | — |
| LAB147 | 31104.2 | 0.03 | 0.52 | 53 | LAB147 | 31104.2 | — | — | — |
| LAB147 | 31105.6 | 0.03 | 0.85 | 15 | LAB147 | 31105.6 | — | — | — |
| LAB186 | 31001.4 | 0.07 | 0.02 | 203 | LAB186 | 31001.4 | — | — | — |
| LAB186 | 31002.1 | — | — | — | LAB186 | 31002.1 | 0.55 | 0.60 | 35 |
| LAB186 | 31003.1 | — | — | — | LAB186 | 31003.1 | 0.45 | 0.87 | 11 |
| LAB186 | 31004.1 | 0.04 | 0.23 | 96 | LAB186 | 31004.1 | — | — | — |
| LAB186 | 31004.2 | 0.03 | 0.56 | 48 | LAB186 | 31004.2 | — | — | — |
| LAB197 | 31083.1 | 0.03 | 0.84 | 16 | LAB197 | 31083.1 | — | — | — |
| LAB197 | 31084.3 | 0.04 | 0.35 | 75 | LAB197 | 31084.3 | — | — | — |
| LAB197 | 31085.3 | 0.03 | 0.49 | 54 | LAB197 | 31085.3 | — | — | — |
| LAB315 | 31061.1 | 0.04 | 0.35 | 76 | LAB315 | 31061.1 | — | — | — |
| LAB315 | 31063.1 | 0.02 | 0.91 | 9 | LAB315 | 31063.1 | 0.45 | 0.89 | 9 |
| LAB317 | 30951.4 | 0.03 | 0.70 | 32 | LAB317 | 30951.4 | — | — | — |
| LAB317 | 30953.4 | 0.03 | 0.88 | 11 | LAB317 | 30953.4 | — | — | — |
| LAB317 | 30954.4 | 0.02 | 1.00 | 0 | LAB317 | 30954.4 | — | — | — |
| LAB324 | 30961.1 | 0.02 | 0.99 | 1 | LAB324 | 30961.1 | — | — | — |
| LAB324 | 30962.2 | — | — | — | LAB324 | 30962.2 | 0.42 | 0.97 | 3 |
| LAB324 | 30963.1 | 0.02 | 0.93 | 7 | LAB324 | 30963.1 | — | — | — |
| LAB325 | 30971.4 | — | — | — | LAB325 | 30971.4 | 0.43 | 0.93 | 6 |
| LAB325 | 30972.2 | — | — | — | LAB325 | 30972.2 | 0.61 | 0.47 | 48 |
| LAB325 | 30973.1 | 0.04 | 0.36 | 78 | LAB325 | 30973.1 | 0.49 | 0.78 | 19 |
| LAB325 | 30975.1 | 0.02 | 1.00 | 0 | LAB325 | 30975.1 | — | — | — |
| LAB325 | 30975.4 | — | — | — | LAB325 | 30975.4 | 0.41 | 1.00 | 0 |
| LAB67 | 31021.4 | 0.03 | 0.55 | 48 | LAB67 | 31021.4 | — | — | — |
| LAB67 | 31022.1 | 0.05 | 0.20 | 117 | LAB67 | 31022.1 | — | — | — |
| LAB80 | 30673.1 | 0.03 | 0.88 | 11 | LAB80 | 30673.1 | — | — | — |
| cont | — | 0.02 | — | 0 | cont | — | 0.41 | — | 0 |
| LAB147 | 31103.2 | 0.03 | 0.19 | 42 | LAB147 | 31103.2 | 0.70 | 0.24 | 19 |
| LAB147 | 31104.1 | 0.03 | 0.16 | 27 | LAB147 | 31104.1 | 0.67 | 0.28 | 14 |
| LAB147 | 31104.2 | 0.03 | 0.55 | 10 | LAB147 | 31104.2 | 0.63 | 0.70 | 7 |
| LAB147 | 31105.6 | 0.03 | 0.27 | 22 | LAB147 | 31105.6 | — | — | — |
| LAB147 | 31105.7 | 0.03 | 0.34 | 21 | LAB147 | 31105.7 | 0.67 | 0.29 | 15 |
| LAB178 | 30631.2 | 0.03 | 0.56 | 13 | LAB178 | 30631.2 | — | — | — |
| LAB178 | 30632.1 | 0.04 | 0.02 | 44 | LAB178 | 30632.1 | 0.73 | 0.08 | 25 |
| LAB178 | 30633.3 | 0.04 | 0.00 | 58 | LAB178 | 30633.3 | 0.62 | 0.70 | 5 |
| LAB178 | 30633.4 | 0.04 | 0.01 | 53 | LAB178 | 30633.4 | 0.63 | 0.60 | 7 |

TABLE 62-continued

Genes showing improved plant growth rate under osmotic stress conditions (T2 generation)

| Gene Name | Event # | RGR Of Leaf Area Ave. | p-val. | % | Gene Name | Event # | RGR Of Roots Coverage Ave. | p-val. | % |
|---|---|---|---|---|---|---|---|---|---|
| LAB186 | 31001.4 | 0.04 | 0.01 | 48 | LAB186 | 31001.4 | 0.71 | 0.12 | 20 |
| LAB186 | 31002.1 | 0.02 | 0.99 | 0 | LAB186 | 31002.1 | — | — | — |
| LAB186 | 31003.1 | 0.04 | 0.01 | 64 | LAB186 | 31003.1 | 0.66 | 0.43 | 13 |
| LAB186 | 31004.1 | 0.03 | 0.17 | 31 | LAB186 | 31004.1 | — | — | — |
| LAB186 | 31004.2 | 0.03 | 0.11 | 43 | LAB186 | 31004.2 | — | — | — |
| LAB197 | 31081.3 | 0.03 | 0.27 | 21 | LAB197 | 31081.3 | — | — | — |
| LAB197 | 31084.3 | 0.03 | 0.50 | 13 | LAB197 | 31084.3 | 0.62 | 0.72 | 6 |
| LAB197 | 31084.4 | 0.04 | 0.01 | 48 | LAB197 | 31084.4 | — | — | — |
| LAB197 | 31085.3 | 0.03 | 0.62 | 11 | LAB197 | 31085.3 | — | — | — |
| LAB247 | 28094.3 | 0.03 | 0.27 | 22 | LAB247 | 28094.3 | 0.67 | 0.38 | 14 |
| LAB314 | 29292.6 | 0.03 | 0.24 | 20 | LAB314 | 29292.6 | — | — | — |
| LAB314 | 29294.1 | 0.03 | 0.61 | 9 | LAB314 | 29294.1 | — | — | — |
| LAB314 | 29294.2 | 0.03 | 0.58 | 8 | LAB314 | 29294.2 | — | — | — |
| LAB315 | 31061.2 | 0.04 | 0.00 | 76 | LAB315 | 31061.2 | 0.65 | 0.44 | 10 |
| LAB315 | 31063.1 | 0.04 | 0.01 | 61 | LAB315 | 31063.1 | — | — | — |
| LAB315 | 31064.3 | 0.04 | 0.02 | 44 | LAB315 | 31064.3 | — | — | — |
| LAB317 | 30952.2 | 0.03 | 0.58 | 13 | LAB317 | 30952.2 | 0.59 | 0.96 | 1 |
| LAB317 | 30952.3 | 0.03 | 0.19 | 26 | LAB317 | 30952.3 | 0.65 | 0.44 | 12 |
| LAB317 | 30953.1 | 0.03 | 0.38 | 20 | LAB317 | 30953.1 | — | — | — |
| LAB317 | 30953.4 | 0.02 | 1.00 | 0 | LAB317 | 30953.4 | — | — | — |
| LAB317 | 30954.4 | 0.03 | 0.08 | 34 | LAB317 | 30954.4 | 0.68 | 0.28 | 16 |
| LAB324 | 30961.1 | 0.03 | 0.27 | 24 | LAB324 | 30961.1 | 0.70 | 0.19 | 19 |
| LAB324 | 30962.2 | 0.03 | 0.41 | 16 | LAB324 | 30962.2 | 0.78 | 0.05 | 32 |
| LAB324 | 30963.1 | 0.03 | 0.09 | 33 | LAB324 | 30963.1 | 0.60 | 0.83 | 3 |
| LAB325 | 30971.4 | 0.03 | 0.50 | 12 | LAB325 | 30971.4 | 0.63 | 0.58 | 7 |
| LAB325 | 30972.2 | 0.04 | 0.02 | 55 | LAB325 | 30972.2 | — | — | — |
| LAB325 | 30973.1 | 0.03 | 0.64 | 11 | LAB325 | 30973.1 | — | — | — |
| LAB325 | 30975.2 | 0.03 | 0.36 | 27 | LAB325 | 30975.2 | — | — | — |
| LAB325 | 30975.4 | 0.04 | 0.01 | 49 | LAB325 | 30975.4 | 0.80 | 0.05 | 36 |
| LAB54 | 28133.4 | 0.06 | 0.00 | 160 | LAB54 | 28133.4 | 0.91 | 0.01 | 54 |
| LAB54 | 28134.1 | 0.03 | 0.14 | 27 | LAB54 | 28134.1 | 0.63 | 0.59 | 7 |
| LAB54 | 28136.1 | 0.03 | 0.26 | 23 | LAB54 | 28136.1 | — | — | — |
| LAB54 | 28136.2 | 0.04 | 0.02 | 52 | LAB54 | 28136.2 | 0.64 | 0.50 | 10 |
| LAB67 | 31021.4 | 0.03 | 0.62 | 8 | LAB67 | 31021.4 | — | — | — |
| LAB67 | 31022.1 | 0.05 | 0.00 | 104 | LAB67 | 31022.1 | 0.67 | 0.45 | 14 |
| LAB67 | 31023.3 | 0.03 | 0.28 | 21 | LAB67 | 31023.3 | — | — | — |
| LAB67 | 31023.4 | 0.03 | 0.71 | 9 | LAB67 | 31023.4 | — | — | — |
| LAB68 | 29332.3 | — | — | — | LAB68 | 29332.3 | 0.66 | 0.49 | 13 |
| LAB68 | 29335.1 | — | — | — | LAB68 | 29335.1 | 0.76 | 0.09 | 30 |
| LAB68 | 29335.3 | 0.03 | 0.72 | 5 | LAB68 | 29335.3 | 0.72 | 0.12 | 22 |
| LAB73 | 30152.1 | 0.03 | 0.11 | 37 | LAB73 | 30152.1 | 0.61 | 0.79 | 4 |
| LAB73 | 30152.2 | 0.03 | 0.23 | 21 | LAB73 | 30152.2 | — | — | — |
| LAB73 | 30153.1 | 0.03 | 0.52 | 15 | LAB73 | 30153.1 | — | — | — |
| LAB74 | 28451.3 | 0.04 | 0.05 | 84 | LAB74 | 28451.3 | 0.62 | 0.71 | 6 |
| LAB74 | 28452.2 | 0.04 | 0.03 | 44 | LAB74 | 28452.2 | — | — | — |
| LAB74 | 28454.1 | 0.04 | 0.04 | 45 | LAB74 | 28454.1 | 0.61 | 0.77 | 5 |
| cont | — | 0.02 | — | 0 | cont | — | 0.59 | — | 0 |
| LAB133 | 28832.5 | — | — | — | LAB133 | 28832.5 | 0.43 | 0.49 | 13 |
| LAB133 | 28833.1 | — | — | — | LAB133 | 28833.1 | 0.55 | 0.03 | 47 |
| LAB133 | 28833.2 | 0.03 | 0.44 | 22 | LAB133 | 28833.2 | 0.62 | 0.00 | 65 |
| LAB133 | 28833.5 | 0.03 | 0.45 | 14 | LAB133 | 28833.5 | 0.52 | 0.02 | 39 |
| LAB158 | 29411.3 | — | — | — | LAB158 | 29411.3 | 0.60 | 0.01 | 60 |
| LAB158 | 29411.4 | 0.03 | 0.44 | 12 | LAB158 | 29411.4 | 0.43 | 0.34 | 15 |
| LAB158 | 29412.1 | 0.03 | 0.06 | 29 | LAB158 | 29412.1 | 0.47 | 0.08 | 26 |
| LAB158 | 29414.3 | 0.03 | 0.12 | 34 | LAB158 | 29414.3 | 0.88 | 0.00 | 134 |
| LAB158 | 29415.1 | 0.03 | 0.16 | 26 | LAB158 | 29415.1 | 0.58 | 0.00 | 54 |
| LAB160 | 29311.2 | — | — | — | LAB160 | 29311.2 | 0.60 | 0.00 | 59 |
| LAB160 | 29312.1 | 0.04 | 0.06 | 48 | LAB160 | 29312.1 | 0.60 | 0.00 | 58 |
| LAB160 | 29314.2 | 0.02 | 0.92 | 2 | LAB160 | 29314.2 | 0.48 | 0.08 | 28 |
| LAB160 | 29315.2 | 0.03 | 0.23 | 23 | LAB160 | 29315.2 | 0.59 | 0.00 | 58 |
| LAB160 | 29315.3 | 0.03 | 0.73 | 7 | LAB160 | 29315.3 | 0.45 | 0.25 | 19 |
| LAB162 | 29341.2 | 0.03 | 0.03 | 36 | LAB162 | 29341.2 | 0.44 | 0.43 | 16 |
| LAB162 | 29342.6 | 0.03 | 0.15 | 26 | LAB162 | 29342.6 | 0.49 | 0.07 | 29 |
| LAB162 | 29342.7 | — | — | — | LAB162 | 29342.7 | 0.63 | 0.01 | 68 |
| LAB162 | 29344.1 | 0.03 | 0.35 | 20 | LAB162 | 29344.1 | 0.63 | 0.00 | 68 |
| LAB177 | 29421.2 | — | — | — | LAB177 | 29421.2 | 0.41 | 0.49 | 9 |
| LAB177 | 29422.1 | 0.04 | 0.09 | 49 | LAB177 | 29422.1 | 0.82 | 0.00 | 118 |
| LAB177 | 29424.3 | 0.04 | 0.00 | 79 | LAB177 | 29424.3 | 0.71 | 0.00 | 90 |
| LAB177 | 29424.4 | 0.03 | 0.28 | 19 | LAB177 | 29424.4 | 0.55 | 0.02 | 46 |
| LAB177 | 29425.1 | 0.03 | 0.33 | 20 | LAB177 | 29425.1 | 0.48 | 0.11 | 27 |
| LAB179 | 29301.4 | 0.03 | 0.37 | 14 | LAB179 | 29301.4 | 0.58 | 0.04 | 55 |
| LAB179 | 29302.4 | 0.03 | 0.66 | 8 | LAB179 | 29302.4 | 0.48 | 0.08 | 26 |

TABLE 62-continued

Genes showing improved plant growth rate under osmotic stress conditions (T2 generation)

| Gene Name | Event # | RGR Of Leaf Area Ave. | p-val. | % | Gene Name | Event # | RGR Of Roots Coverage Ave. | p-val. | % |
|---|---|---|---|---|---|---|---|---|---|
| LAB179 | 29303.2 | 0.05 | 0.00 | 103 | LAB179 | 29303.2 | 0.95 | 0.00 | 154 |
| LAB179 | 29304.3 | 0.03 | 0.73 | 6 | LAB179 | 29304.3 | 0.64 | 0.00 | 70 |
| LAB179 | 29304.4 | 0.04 | 0.06 | 74 | LAB179 | 29304.4 | 0.61 | 0.10 | 62 |
| LAB185 | 28172.2 | — | — | — | LAB185 | 28172.2 | 0.51 | 0.02 | 36 |
| LAB185 | 28172.4 | 0.03 | 0.62 | 9 | LAB185 | 28172.4 | 0.41 | 0.59 | 10 |
| LAB185 | 28174.2 | 0.03 | 0.51 | 12 | LAB185 | 28174.2 | 0.42 | 0.41 | 12 |
| LAB185 | 28175.2 | 0.03 | 0.71 | 7 | LAB185 | 28175.2 | 0.41 | 0.65 | 9 |
| LAB185 | 28175.3 | 0.03 | 0.01 | 43 | LAB185 | 28175.3 | 0.61 | 0.00 | 62 |
| LAB210 | 28331.2 | — | — | — | LAB210 | 28331.2 | 0.59 | 0.00 | 56 |
| LAB210 | 28331.3 | — | — | — | LAB210 | 28331.3 | 0.49 | 0.10 | 30 |
| LAB210 | 28333.2 | — | — | — | LAB210 | 28333.2 | 0.56 | 0.02 | 50 |
| LAB210 | 28333.3 | 0.03 | 0.40 | 14 | LAB210 | 28333.3 | 0.65 | 0.00 | 73 |
| LAB210 | 28335.3 | 0.05 | 0.00 | 112 | LAB210 | 28335.3 | 0.68 | 0.02 | 82 |
| LAB254 | 28811.1 | 0.03 | 0.77 | 5 | LAB254 | 28811.1 | 0.50 | 0.08 | 33 |
| LAB254 | 28814.1 | 0.03 | 0.44 | 14 | LAB254 | 28814.1 | 0.59 | 0.00 | 56 |
| LAB254 | 28814.5 | 0.04 | 0.02 | 48 | LAB254 | 28814.5 | 0.60 | 0.00 | 58 |
| LAB254 | 28815.3 | 0.04 | 0.05 | 46 | LAB254 | 28815.3 | 0.65 | 0.00 | 72 |
| LAB254 | 28815.4 | — | — | — | LAB254 | 28815.4 | 0.41 | 0.72 | 9 |
| LAB293 | 29232.2 | 0.04 | 0.00 | 59 | LAB293 | 29232.2 | 0.43 | 0.42 | 13 |
| LAB293 | 29233.2 | 0.04 | 0.01 | 48 | LAB293 | 29233.2 | — | — | — |
| LAB293 | 29233.3 | 0.03 | 0.10 | 30 | LAB293 | 29233.3 | 0.55 | 0.01 | 45 |
| LAB293 | 29233.4 | 0.03 | 0.53 | 12 | LAB293 | 29233.4 | — | — | — |
| LAB293 | 29235.4 | 0.03 | 0.06 | 30 | LAB293 | 29235.4 | 0.56 | 0.02 | 48 |
| LAB297 | 29272.1 | — | — | — | LAB297 | 29272.1 | 0.49 | 0.16 | 29 |
| LAB297 | 29272.5 | 0.03 | 0.47 | 12 | LAB297 | 29272.5 | 0.50 | 0.04 | 34 |
| LAB297 | 29273.1 | 0.04 | 0.05 | 46 | LAB297 | 29273.1 | 0.84 | 0.00 | 123 |
| LAB297 | 29273.4 | 0.03 | 0.51 | 12 | LAB297 | 29273.4 | 0.69 | 0.00 | 84 |
| LAB297 | 29275.1 | 0.05 | 0.00 | 90 | LAB297 | 29275.1 | 0.73 | 0.00 | 94 |
| LAB310 | 28181.2 | — | — | — | LAB310 | 28181.2 | 0.40 | 0.76 | 5 |
| LAB310 | 28181.3 | 0.03 | 0.66 | 7 | LAB310 | 28181.3 | 0.69 | 0.00 | 83 |
| LAB310 | 28182.2 | 0.03 | 0.51 | 10 | LAB310 | 28182.2 | 0.68 | 0.00 | 81 |
| LAB310 | 28183.3 | 0.03 | 0.42 | 17 | LAB310 | 28183.3 | 0.50 | 0.12 | 34 |
| LAB318 | 28101.5 | 0.03 | 0.04 | 42 | LAB318 | 28101.5 | 0.71 | 0.00 | 88 |
| LAB318 | 28101.7 | 0.04 | 0.05 | 69 | LAB318 | 28101.7 | 0.88 | 0.00 | 134 |
| LAB318 | 28103.2 | — | — | — | LAB318 | 28103.2 | 0.58 | 0.04 | 53 |
| LAB318 | 28104.3 | 0.02 | 0.91 | 3 | LAB318 | 28104.3 | 0.54 | 0.06 | 43 |
| LAB327 | 29221.2 | 0.03 | 0.63 | 10 | LAB327 | 29221.2 | 0.51 | 0.04 | 35 |
| LAB327 | 29221.5 | 0.02 | 0.83 | 3 | LAB327 | 29221.5 | 0.50 | 0.09 | 34 |
| LAB327 | 29221.6 | 0.03 | 0.38 | 15 | LAB327 | 29221.6 | 0.71 | 0.00 | 88 |
| LAB327 | 29221.8 | 0.03 | 0.42 | 16 | LAB327 | 29221.8 | 0.51 | 0.04 | 35 |
| LAB327 | 29225.4 | 0.02 | 0.87 | 3 | LAB327 | 29225.4 | 0.50 | 0.13 | 32 |
| LAB335 | 27311.2 | 0.03 | 0.69 | 8 | LAB335 | 27311.2 | 0.38 | 0.91 | 2 |
| LAB335 | 27314.1 | 0.03 | 0.34 | 14 | LAB335 | 27314.1 | 0.43 | 0.43 | 14 |
| LAB335 | 27314.2 | 0.04 | 0.04 | 63 | LAB335 | 27314.2 | 0.48 | 0.15 | 27 |
| LAB335 | 27315.4 | 0.02 | 0.88 | 2 | LAB335 | 27315.4 | — | — | — |
| cont | — | 0.02 | — | 0 | cont | — | 0.38 | — | 0 |
| LAB102 | 30312.2 | 0.05 | 0.05 | 42 | LAB102 | 30312.2 | 0.96 | 0.00 | 56 |
| LAB102 | 30312.4 | 0.05 | 0.01 | 38 | LAB102 | 30312.4 | 0.98 | 0.00 | 60 |
| LAB102 | 30313.2 | 0.04 | 0.33 | 13 | LAB102 | 30313.2 | 0.75 | 0.13 | 21 |
| LAB102 | 30313.3 | 0.04 | 0.04 | 35 | LAB102 | 30313.3 | 0.69 | 0.40 | 12 |
| LAB102 | 30314.3 | 0.04 | 0.49 | 10 | LAB102 | 30314.3 | 0.75 | 0.11 | 23 |
| LAB126 | 30201.3 | 0.05 | 0.03 | 42 | LAB126 | 30201.3 | 0.76 | 0.11 | 24 |
| LAB126 | 30202.3 | 0.05 | 0.01 | 45 | LAB126 | 30202.3 | 0.88 | 0.07 | 43 |
| LAB126 | 30203.3 | 0.06 | 0.00 | 85 | LAB126 | 30203.3 | 1.01 | 0.00 | 64 |
| LAB126 | 30205.1 | 0.06 | 0.00 | 77 | LAB126 | 30205.1 | 1.07 | 0.00 | 74 |
| LAB126 | 30205.3 | 0.05 | 0.00 | 58 | LAB126 | 30205.3 | 0.93 | 0.00 | 51 |
| LAB165 | 30231.1 | 0.05 | 0.04 | 48 | LAB165 | 30231.1 | 1.03 | 0.00 | 68 |
| LAB165 | 30232.1 | 0.03 | 0.94 | 1 | LAB165 | 30232.1 | 0.73 | 0.14 | 18 |
| LAB165 | 30233.1 | 0.07 | 0.00 | 104 | LAB165 | 30233.1 | 1.39 | 0.00 | 125 |
| LAB165 | 30235.1 | 0.04 | 0.03 | 35 | LAB165 | 30235.1 | 0.95 | 0.00 | 54 |
| LAB167 | 27321.3 | 0.03 | 0.63 | 7 | LAB167 | 27321.3 | — | — | — |
| LAB167 | 27321.4 | 0.05 | 0.00 | 67 | LAB167 | 27321.4 | 1.12 | 0.00 | 82 |
| LAB167 | 27321.6 | 0.03 | 0.78 | 4 | LAB167 | 27321.6 | 0.74 | 0.10 | 21 |
| LAB167 | 27324.1 | 0.05 | 0.01 | 39 | LAB167 | 27324.1 | 1.09 | 0.00 | 77 |
| LAB220 | 30321.4 | 0.06 | 0.00 | 91 | LAB220 | 30321.4 | 1.19 | 0.00 | 94 |
| LAB220 | 30322.2 | 0.03 | 0.63 | 7 | LAB220 | 30322.2 | 1.02 | 0.00 | 65 |
| LAB220 | 30322.3 | 0.03 | 0.80 | 4 | LAB220 | 30322.3 | 0.79 | 0.03 | 29 |
| LAB220 | 30323.1 | 0.04 | 0.26 | 15 | LAB220 | 30323.1 | 0.83 | 0.02 | 34 |
| LAB220 | 30324.4 | 0.05 | 0.04 | 47 | LAB220 | 30324.4 | 1.18 | 0.00 | 92 |
| LAB241 | 30211.3 | — | — | — | LAB241 | 30211.3 | 0.79 | 0.05 | 28 |
| LAB241 | 30212.1 | 0.03 | 0.97 | 0 | LAB241 | 30212.1 | 0.69 | 0.39 | 11 |
| LAB241 | 30212.2 | 0.04 | 0.59 | 7 | LAB241 | 30212.2 | 0.75 | 0.12 | 21 |

TABLE 62-continued

Genes showing improved plant growth rate under osmotic stress conditions (T2 generation)

| Gene Name | Event # | RGR Of Leaf Area Ave. | p-val. | % | Gene Name | Event # | RGR Of Roots Coverage Ave. | p-val. | % |
|---|---|---|---|---|---|---|---|---|---|
| LAB241 | 30213.1 | 0.04 | 0.08 | 28 | LAB241 | 30213.1 | 0.67 | 0.52 | 9 |
| LAB241 | 30214.4 | — | — | — | LAB241 | 30214.4 | 0.62 | 0.93 | 1 |
| LAB268 | 30391.4 | 0.03 | 0.66 | 7 | LAB268 | 30391.4 | 0.81 | 0.06 | 31 |
| LAB268 | 30392.1 | — | — | — | LAB268 | 30392.1 | 0.80 | 0.04 | 29 |
| LAB268 | 30392.2 | 0.06 | 0.00 | 86 | LAB268 | 30392.2 | 1.09 | 0.00 | 77 |
| LAB268 | 30395.1 | 0.07 | 0.00 | 100 | LAB268 | 30395.1 | 1.24 | 0.00 | 101 |
| LAB280 | 30041.1 | 0.06 | 0.00 | 85 | LAB280 | 30041.1 | 1.33 | 0.00 | 116 |
| LAB280 | 30042.1 | 0.03 | 0.80 | 4 | LAB280 | 30042.1 | — | — | — |
| LAB280 | 30044.1 | 0.07 | 0.00 | 116 | LAB280 | 30044.1 | 1.05 | 0.00 | 70 |
| LAB280 | 30045.3 | 0.05 | 0.00 | 64 | LAB280 | 30045.3 | 1.30 | 0.00 | 111 |
| LAB289 | 30371.2 | 0.04 | 0.36 | 15 | LAB289 | 30371.2 | 0.70 | 0.34 | 14 |
| LAB289 | 30371.4 | 0.05 | 0.01 | 45 | LAB289 | 30371.4 | 1.03 | 0.00 | 67 |
| LAB289 | 30371.6 | 0.05 | 0.00 | 56 | LAB289 | 30371.6 | 0.97 | 0.00 | 57 |
| LAB289 | 30375.2 | 0.10 | 0.00 | 197 | LAB289 | 30375.2 | 1.16 | 0.00 | 88 |
| LAB289 | 30375.3 | 0.05 | 0.00 | 66 | LAB289 | 30375.3 | 1.22 | 0.00 | 98 |
| LAB303 | 30423.4 | 0.04 | 0.30 | 15 | LAB303 | 30423.4 | — | — | — |
| LAB303 | 30424.3 | 0.05 | 0.01 | 42 | LAB303 | 30424.3 | 1.10 | 0.00 | 79 |
| LAB303 | 30425.3 | 0.05 | 0.00 | 54 | LAB303 | 30425.3 | 1.37 | 0.00 | 122 |
| cont | — | 0.03 | — | 0 | cont | — | 0.62 | — | 0 |
| LAB303 | 30421.2 | — | — | — | LAB303 | 30421.2 | 0.99 | 0.36 | 13 |
| LAB303 | 30423.4 | 0.04 | 0.33 | 17 | LAB303 | 30423.4 | — | — | — |
| LAB311 | 30221.4 | 0.04 | 0.34 | 14 | LAB311 | 30221.4 | — | — | — |
| LAB311 | 30223.2 | — | — | — | LAB311 | 30223.2 | 0.90 | 0.83 | 3 |
| LAB311 | 30223.4 | 0.06 | 0.00 | 60 | LAB311 | 30223.4 | 1.00 | 0.29 | 15 |
| LAB311 | 30224.2 | 0.04 | 0.71 | 7 | LAB311 | 30224.2 | — | — | — |
| LAB344 | 30092.3 | 0.06 | 0.00 | 67 | LAB344 | 30092.3 | — | — | — |
| LAB344 | 30093.3 | 0.05 | 0.20 | 34 | LAB344 | 30093.3 | 0.91 | 0.75 | 5 |
| LAB344 | 30096.3 | 0.05 | 0.08 | 48 | LAB344 | 30096.3 | 1.00 | 0.38 | 14 |
| LAB355 | 29281.3 | 0.08 | 0.00 | 104 | LAB355 | 29281.3 | 1.03 | 0.18 | 18 |
| LAB355 | 29282.1 | 0.04 | 0.85 | 3 | LAB355 | 29282.1 | — | — | — |
| LAB355 | 29282.2 | 0.07 | 0.00 | 93 | LAB355 | 29282.2 | 1.11 | 0.05 | 28 |
| LAB355 | 29282.3 | 0.04 | 0.47 | 11 | LAB355 | 29282.3 | — | — | — |
| LAB355 | 29283.1 | 0.04 | 0.45 | 13 | LAB355 | 29283.1 | — | — | — |
| LAB367 | 30171.3 | 0.06 | 0.00 | 59 | LAB367 | 30171.3 | 0.93 | 0.65 | 6 |
| LAB367 | 30173.3 | 0.05 | 0.19 | 28 | LAB367 | 30173.3 | — | — | — |
| LAB381 | 30351.4 | 0.06 | 0.00 | 63 | LAB381 | 30351.4 | — | — | — |
| LAB381 | 30352.2 | 0.07 | 0.00 | 87 | LAB381 | 30352.2 | 0.92 | 0.68 | 6 |
| LAB381 | 30352.4 | 0.05 | 0.03 | 45 | LAB381 | 30352.4 | 1.07 | 0.12 | 22 |
| LAB381 | 30354.2 | 0.05 | 0.03 | 39 | LAB381 | 30354.2 | — | — | — |
| LAB381 | 30356.1 | 0.05 | 0.04 | 39 | LAB381 | 30356.1 | — | — | — |
| LAB383 | 28111.3 | 0.07 | 0.00 | 98 | LAB383 | 28111.3 | 1.02 | 0.29 | 17 |
| LAB383 | 28111.4 | 0.06 | 0.02 | 54 | LAB383 | 28111.4 | 1.09 | 0.10 | 24 |
| LAB383 | 28115.2 | 0.06 | 0.01 | 52 | LAB383 | 28115.2 | 1.13 | 0.08 | 30 |
| LAB64 | 30271.2 | 0.07 | 0.00 | 79 | LAB64 | 30271.2 | — | — | — |
| LAB64 | 30272.1 | 0.04 | 0.26 | 18 | LAB64 | 30272.1 | — | 0.01 | 45 |
| LAB64 | 30273.2 | 0.08 | 0.00 | 106 | LAB64 | 30273.2 | 1.26 | 0.01 | 45 |
| LAB64 | 30274.2 | 0.04 | 0.85 | 3 | LAB64 | 30274.2 | 1.02 | 0.23 | 17 |
| LAB64 | 30274.3 | 0.04 | 0.87 | 3 | LAB64 | 30274.3 | 0.88 | 0.97 | 1 |
| LAB65 | 30302.1 | 0.05 | 0.01 | 45 | LAB65 | 30302.1 | — | — | — |
| LAB92 | 29321.2 | 0.05 | 0.17 | 24 | LAB92 | 29321.2 | — | — | — |
| LAB92 | 29322.1 | 0.04 | 0.25 | 18 | LAB92 | 29322.1 | 1.03 | 0.21 | 18 |
| LAB92 | 29323.2 | 0.04 | 0.29 | 18 | LAB92 | 29323.2 | 0.93 | 0.67 | 6 |
| LAB92 | 29324.2 | 0.05 | 0.16 | 28 | LAB92 | 29324.2 | — | — | — |
| LAB92 | 29325.1 | — | — | — | LAB92 | 29325.1 | 0.94 | 0.60 | 8 |
| cont | — | 0.04 | — | 0 | cont | — | 0.87 | — | 0 |
| LAB172 | 30852.3 | 0.04 | 0.28 | 15 | LAB172 | 30852.3 | — | — | — |
| LAB172 | 30853.4 | 0.04 | 0.18 | 33 | LAB172 | 30853.4 | 0.93 | 0.13 | 23 |
| LAB172 | 30854.1 | 0.03 | 0.91 | 1 | LAB172 | 30854.1 | — | — | — |
| LAB172 | 30854.4 | 0.04 | 0.05 | 23 | LAB172 | 30854.4 | 0.88 | 0.21 | 16 |
| LAB188 | 30722.2 | 0.04 | 0.04 | 30 | LAB188 | 30722.2 | 1.09 | 0.00 | 43 |
| LAB188 | 30723.3 | 0.04 | 0.29 | 14 | LAB188 | 30723.3 | — | — | — |
| LAB243 | 27101.1 | 0.05 | 0.00 | 41 | LAB243 | 27101.1 | 0.79 | 0.76 | 4 |
| LAB243 | 30872.1 | 0.03 | 0.91 | 1 | LAB243 | 30872.1 | 0.84 | 0.40 | 11 |
| LAB243 | 30873.2 | 0.04 | 0.02 | 30 | LAB243 | 30873.2 | — | — | — |
| LAB243 | 30873.4 | 0.08 | 0.00 | 126 | LAB243 | 30873.4 | 1.25 | 0.00 | 65 |
| LAB270 | 30591.2 | 0.04 | 0.24 | 18 | LAB270 | 30591.2 | — | — | — |
| LAB270 | 30595.1 | 0.04 | 0.19 | 15 | LAB270 | 30595.1 | — | — | — |
| LAB270 | 30595.2 | 0.03 | 0.95 | 1 | LAB270 | 30595.2 | 0.76 | 0.97 | 0 |
| LAB291 | 31851.2 | 0.05 | 0.01 | 38 | LAB291 | 31851.2 | 0.88 | 0.20 | 16 |
| LAB291 | 31851.3 | 0.09 | 0.00 | 164 | LAB291 | 31851.3 | 1.02 | 0.01 | 35 |
| LAB291 | 31852.4 | 0.06 | 0.00 | 72 | LAB291 | 31852.4 | 0.94 | 0.06 | 24 |
| LAB291 | 31853.3 | 0.07 | 0.00 | 122 | LAB291 | 31853.3 | 0.93 | 0.09 | 23 |

TABLE 62-continued

Genes showing improved plant growth rate under osmotic stress conditions (T2 generation)

| Gene Name | Event # | RGR Of Leaf Area Ave. | p-val. | % | Gene Name | Event # | RGR Of Roots Coverage Ave. | p-val. | % |
|---|---|---|---|---|---|---|---|---|---|
| LAB291 | 31854.4 | 0.05 | 0.01 | 35 | LAB291 | 31854.4 | 0.90 | 0.11 | 19 |
| LAB295 | 31861.3 | 0.07 | 0.00 | 119 | LAB295 | 31861.3 | 1.16 | 0.00 | 53 |
| LAB295 | 31863.1 | 0.05 | 0.00 | 39 | LAB295 | 31863.1 | 0.87 | 0.22 | 14 |
| LAB295 | 31864.3 | 0.06 | 0.00 | 68 | LAB295 | 31864.3 | 0.90 | 0.15 | 18 |
| LAB295 | 31864.4 | 0.06 | 0.00 | 87 | LAB295 | 31864.4 | 0.93 | 0.06 | 23 |
| LAB295 | 31865.1 | 0.04 | 0.13 | 20 | LAB295 | 31865.1 | — | — | — |
| LAB323 | 30381.4 | 0.06 | 0.00 | 82 | LAB323 | 30381.4 | 0.96 | 0.04 | 27 |
| LAB323 | 30383.1 | — | — | — | LAB323 | 30383.1 | 0.85 | 0.31 | 12 |
| LAB323 | 30383.2 | 0.04 | 0.23 | 15 | LAB323 | 30383.2 | — | — | — |
| LAB347_H0 | 30441.1 | 0.04 | 0.03 | 25 | LAB347_H0 | 30441.1 | 0.95 | 0.05 | 25 |
| LAB347_H0 | 30443.4 | 0.04 | 0.26 | 13 | LAB347_H0 | 30443.4 | — | — | — |
| LAB347_H0 | 30444.1 | 0.03 | 0.78 | 3 | LAB347_H0 | 30444.1 | 1.00 | 0.01 | 33 |
| LAB347_H0 | 30444.3 | 0.05 | 0.00 | 49 | LAB347_H0 | 30444.3 | 1.02 | 0.01 | 35 |
| LAB55 | 30023.1 | 0.05 | 0.00 | 36 | LAB55 | 30023.1 | 0.96 | 0.04 | 27 |
| LAB55 | 30023.3 | 0.03 | 0.76 | 3 | LAB55 | 30023.3 | — | — | — |
| LAB55 | 30025.3 | 0.04 | 0.40 | 10 | LAB55 | 30025.3 | — | — | — |
| LAB55 | 30025.4 | 0.03 | 0.89 | 2 | LAB55 | 30025.4 | — | — | — |
| cont | — | 0.03 | — | 0 | cont | — | 0.76 | — | 0 |
| LAB243 | 30873.2 | 0.06 | 0.37 | 17 | LAB243 | 30873.2 | — | — | — |
| LAB291 | 31851.3 | 0.06 | 0.63 | 9 | LAB291 | 31851.3 | — | — | — |
| LAB291 | 31854.4 | 0.06 | 0.80 | 5 | LAB291 | 31854.4 | — | — | — |
| cont | — | 0.05 | — | 0 | cont | — | — | — | — |

Table 62.
"CONT."—Control;
"Ave."—Average;
"% Incr." = % increment;
"p-val."—p-value.

TABLE 63

Genes showing improved plant growth rate under osmotic stress conditions (T2 generation)

| Gene Name | Event # | RGR Of Roots Length Average | p-value | % |
|---|---|---|---|---|
| LAB183 | 27454.2 | 0.376996 | 0.845272 | 10.9332 |
| LAB189 | 28163.2 | 0.34382 | 0.983173 | 1.171 |
| LAB212 | 28045.2 | 0.351899 | 0.949503 | 3.5482 |
| control | — | 0.339841 | — | 0 |
| LAB115 | 27284.3 | 0.563532 | 0.903889 | 1.0235 |
| LAB123 | 28284.1 | 0.606689 | 0.305424 | 8.7602 |
| LAB123 | 28281.1 | 0.593223 | 0.452482 | 6.3462 |
| LAB123 | 28282.3 | 0.581439 | 0.601156 | 4.2337 |
| LAB123 | 28285.2 | 0.573428 | 0.7819 | 2.7975 |
| LAB189 | 28166.2 | 0.577308 | 0.671005 | 3.4931 |
| LAB189 | 28163.2 | 0.571087 | 0.766146 | 2.3778 |
| LAB212 | 28041.1 | 0.590451 | 0.476374 | 5.8493 |
| LAB217 | 28033.2 | 0.639631 | 0.086236 | 14.6657 |
| LAB217 | 28034.3 | 0.60218 | 0.344375 | 7.9518 |
| LAB217 | 28036.1 | 0.565741 | 0.87449 | 1.4196 |
| LAB250 | 30253.1 | 0.589349 | 0.488222 | 5.6516 |
| LAB250 | 30251.1 | 0.559542 | 0.970742 | 0.3082 |
| LAB326 | 28052.4 | 0.606446 | 0.304063 | 8.7167 |
| LAB351 | 30115.1 | 0.608302 | 0.283364 | 9.0494 |
| LAB351 | 30115.3 | 0.588436 | 0.503735 | 5.488 |
| control | — | 0.557823 | — | 0 |
| LAB106 | 30035.1 | 0.527018 | 0.119174 | 18.7557 |
| LAB106 | 30032.1 | 0.520657 | 0.071412 | 17.3225 |
| LAB106 | 30032.2 | 0.448585 | 0.933274 | 1.0821 |
| LAB206 | 30011.4 | 0.475676 | 0.497286 | 7.1866 |
| LAB206 | 30012.4 | 0.472342 | 0.587812 | 6.4354 |
| LAB207 | 28843.5 | 0.598082 | 0.000713 | 34.769 |
| LAB207 | 28842.1 | 0.572033 | 0.009243 | 28.8993 |
| LAB207 | 28842.5 | 0.520691 | 0.122364 | 17.3301 |
| LAB207 | 28843.3 | 0.482431 | 0.340374 | 8.7088 |
| LAB207 | 28845.1 | 0.462987 | 0.683514 | 4.3273 |
| LAB218 | 29432.2 | 0.471361 | 0.497609 | 6.2143 |
| LAB218 | 29433.4 | 0.462953 | 0.675091 | 4.3196 |
| LAB250 | 30254.1 | 0.537931 | 0.047718 | 21.2148 |
| LAB250 | 30252.1 | 0.514333 | 0.175422 | 15.8974 |
| LAB250 | 30253.1 | 0.503396 | 0.170513 | 13.4329 |
| LAB250 | 30251.2 | 0.487883 | 0.285495 | 9.9372 |
| LAB252 | 30292.3 | 0.496006 | 0.241372 | 11.7677 |
| LAB309 | 30052.3 | 0.50214 | 0.213283 | 13.15 |
| LAB309 | 30056.1 | 0.49983 | 0.229493 | 12.6295 |
| LAB309 | 30052.2 | 0.490623 | 0.274074 | 10.5547 |
| LAB314 | 29294.1 | 0.511971 | 0.094495 | 15.3653 |
| LAB314 | 29292.4 | 0.498334 | 0.220749 | 12.2922 |
| LAB314 | 29295.2 | 0.462994 | 0.713503 | 4.329 |
| LAB346 | 29442.4 | 0.507819 | 0.152332 | 14.4297 |
| LAB346 | 29443.2 | 0.479556 | 0.445713 | 8.0608 |
| LAB346 | 29445.3 | 0.444403 | 0.988817 | 0.1397 |
| LAB351 | 30112.1 | 0.532481 | 0.095983 | 19.9869 |
| LAB351 | 30111.2 | 0.511672 | 0.14645 | 15.2979 |
| LAB351 | 30114.2 | 0.50761 | 0.133889 | 14.3824 |
| LAB351 | 30115.3 | 0.481112 | 0.410026 | 8.4116 |
| LAB351 | 30115.1 | 0.449972 | 0.897155 | 1.3947 |
| LAB82 | 30182.2 | 0.50766 | 0.276675 | 14.3939 |
| LAB82 | 30181.4 | 0.491321 | 0.384729 | 10.712 |
| LAB82 | 30181.3 | 0.487217 | 0.346809 | 9.7872 |
| LAB82 | 30184.2 | 0.485756 | 0.384154 | 9.4579 |
| LAB82 | 30183.2 | 0.464009 | 0.643484 | 4.5576 |
| LAB84 | 30163.4 | 0.560831 | 0.020939 | 26.3752 |
| LAB84 | 30164.2 | 0.511953 | 0.219222 | 15.3611 |
| LAB84 | 30161.4 | 0.50212 | 0.206609 | 13.1453 |
| LAB84 | 30162.4 | 0.48881 | 0.356436 | 10.1462 |
| LAB84 | 30162.2 | 0.475373 | 0.498558 | 7.1183 |
| control | — | 0.443783 | — | 0 |
| LAB110 | 30574.2 | 0.635835 | 0.015527 | 26.4436 |

TABLE 63-continued

Genes showing improved plant growth rate under osmotic stress conditions (T2 generation)

| Gene Name | Event # | RGR Of Roots Length Average | p-value | % |
|---|---|---|---|---|
| LAB110 | 30571.3 | 0.538491 | 0.535688 | 7.0856 |
| LAB110 | 30572.1 | 0.522797 | 0.714865 | 3.9646 |
| LAB110 | 30573.2 | 0.519415 | 0.770338 | 3.292 |
| LAB110 | 30572.2 | 0.51252 | 0.853888 | 1.9208 |
| LAB117 | 27291.1 | 0.562695 | 0.266713 | 11.8987 |
| LAB117 | 27293.1 | 0.547988 | 0.436221 | 8.9741 |
| LAB117 | 27291.5 | 0.531545 | 0.58475 | 5.7042 |
| LAB124 | 30432.3 | 0.611027 | 0.042775 | 21.5101 |
| LAB124 | 30434.3 | 0.570365 | 0.20451 | 13.424 |
| LAB124 | 30431.1 | 0.536721 | 0.524013 | 6.7336 |
| LAB124 | 30434.1 | 0.517959 | 0.781905 | 3.0025 |
| LAB125 | 30582.2 | 0.597422 | 0.087233 | 18.8047 |
| LAB125 | 30583.2 | 0.572551 | 0.196789 | 13.8588 |
| LAB125 | 30581.3 | 0.508821 | 0.910111 | 1.1852 |
| LAB125 | 30584.2 | 0.503595 | 0.988928 | 0.1461 |
| LAB156 | 30401.4 | 0.551862 | 0.363946 | 9.7446 |
| LAB156 | 30403.4 | 0.545148 | 0.428069 | 8.4095 |
| LAB156 | 30402.2 | 0.520807 | 0.743949 | 3.5689 |
| LAB228 | 30081.4 | 0.582749 | 0.150274 | 15.8868 |
| LAB228 | 30084.3 | 0.505457 | 0.961753 | 0.5164 |
| LAB275 | 30361.3 | 0.587622 | 0.120771 | 16.8558 |
| LAB275 | 30366.4 | 0.552437 | 0.37033 | 9.8589 |
| LAB276_H0 | 30331.2 | 0.570873 | 0.202945 | 13.5251 |
| LAB276_H0 | 30331.4 | 0.505868 | 0.956989 | 0.5981 |
| LAB277 | 30651.2 | 0.587724 | 0.113087 | 16.8762 |
| LAB277 | 30652.5 | 0.517561 | 0.787705 | 2.9234 |
| LAB277 | 30652.3 | 0.506817 | 0.945305 | 0.7868 |
| LAB278 | 30414.2 | 0.555382 | 0.381084 | 10.4446 |
| LAB278 | 30414.1 | 0.553121 | 0.355002 | 9.995 |
| LAB281 | 30743.4 | 0.550198 | 0.398602 | 9.4135 |
| LAB281 | 30741.1 | 0.538753 | 0.525669 | 7.1377 |
| LAB281 | 30742.4 | 0.534991 | 0.553164 | 6.3895 |
| LAB282 | 30753.4 | 0.563048 | 0.27183 | 11.9691 |
| LAB282 | 30754.2 | 0.529678 | 0.649158 | 5.333 |
| control | — | 0.502861 | — | 0 |
| LAB110 | 30572.2 | 0.614639 | 0.026322 | 19.3284 |
| LAB110 | 30574.2 | 0.594119 | 0.08039 | 15.3445 |
| LAB110 | 30571.3 | 0.55649 | 0.338129 | 8.0392 |
| LAB110 | 30572.1 | 0.544754 | 0.496207 | 5.7606 |
| LAB117 | 27291.4 | 0.547918 | 0.47323 | 6.3749 |
| LAB117 | 27293.1 | 0.537562 | 0.597839 | 4.3645 |
| LAB117 | 27293.2 | 0.527821 | 0.765229 | 2.4732 |
| LAB124 | 30434.1 | 0.611119 | 0.034446 | 18.645 |
| LAB124 | 30431.1 | 0.559458 | 0.300425 | 8.6153 |
| LAB124 | 30435.2 | 0.526919 | 0.775283 | 2.2981 |
| LAB125 | 30581.3 | 0.603226 | 0.043907 | 17.1127 |
| LAB125 | 30584.2 | 0.548869 | 0.414847 | 6.5596 |
| LAB156 | 30401.4 | 0.615277 | 0.029936 | 19.4522 |
| LAB156 | 30403.1 | 0.557903 | 0.328447 | 8.3135 |
| LAB228 | 30081.4 | 0.605436 | 0.034044 | 17.5417 |
| LAB228 | 30084.4 | 0.550851 | 0.415848 | 6.9444 |
| LAB228 | 30084.3 | 0.517273 | 0.961398 | 0.4253 |
| LAB275 | 30361.3 | 0.620489 | 0.020572 | 20.4641 |
| LAB275 | 30366.4 | 0.600916 | 0.068758 | 16.6641 |
| LAB275 | 30361.2 | 0.55011 | 0.415054 | 6.8006 |
| LAB275 | 30363.1 | 0.529326 | 0.75873 | 2.7654 |
| LAB275 | 30363.4 | 0.519343 | 0.919947 | 0.8272 |
| LAB276_H0 | 30333.7 | 0.564737 | 0.255711 | 9.6402 |
| LAB276_H0 | 30331.1 | 0.545965 | 0.471658 | 5.9957 |
| LAB276_H0 | 30331.4 | 0.545093 | 0.558968 | 5.8265 |
| LAB277 | 30652.5 | 0.641417 | 0.005972 | 24.5271 |
| LAB277 | 30653.1 | 0.551181 | 0.382399 | 7.0084 |
| LAB278 | 30414.1 | 0.568766 | 0.222344 | 10.4225 |
| LAB278 | 30414.2 | 0.56494 | 0.283016 | 9.6796 |
| LAB278 | 30413.3 | 0.551053 | 0.449547 | 6.9836 |
| LAB281 | 30743.4 | 0.612173 | 0.031929 | 18.8496 |
| LAB281 | 30744.1 | 0.537008 | 0.655852 | 4.2569 |
| LAB281 | 30741.1 | 0.529583 | 0.744364 | 2.8153 |
| LAB282 | 30752.2 | 0.572947 | 0.164736 | 11.2341 |
| LAB282 | 30753.4 | 0.53615 | 0.70918 | 4.0903 |
| control | — | 0.515082 | — | 0 |
| LAB106 | 30035.2 | 0.572744 | 0.911487 | 1.073 |
| LAB127 | 30811.1 | 0.634769 | 0.173807 | 12.0185 |
| LAB127 | 30813.1 | 0.610475 | 0.366808 | 7.7313 |
| LAB127 | 30812.1 | 0.567164 | 0.991833 | 0.0883 |
| LAB128 | 28075.2 | 0.626908 | 0.241906 | 10.6313 |
| LAB128 | 28074.3 | 0.621088 | 0.29738 | 9.6043 |
| LAB207 | 28842.1 | 0.674866 | 0.032393 | 19.0945 |
| LAB207 | 28845.1 | 0.643542 | 0.126916 | 13.5667 |
| LAB207 | 28843.3 | 0.616019 | 0.306002 | 8.7097 |
| LAB207 | 28842.5 | 0.609134 | 0.415599 | 7.4946 |
| LAB207 | 28843.5 | 0.583969 | 0.722401 | 3.0538 |
| LAB218 | 29432.2 | 0.605194 | 0.475346 | 6.7994 |
| LAB218 | 29433.4 | 0.576288 | 0.843833 | 1.6983 |
| LAB218 | 29431.3 | 0.567734 | 0.98344 | 0.1889 |
| LAB252 | 30292.4 | 0.631953 | 0.189265 | 11.5216 |
| LAB252 | 30292.3 | 0.629497 | 0.265918 | 11.0882 |
| LAB252 | 30291.2 | 0.618202 | 0.321196 | 9.095 |
| LAB309 | 30055.4 | 0.669638 | 0.050338 | 18.1719 |
| LAB309 | 30056.1 | 0.661289 | 0.061409 | 16.6986 |
| LAB337 | 27265.1 | 0.583048 | 0.766112 | 2.8914 |
| LAB337 | 27265.2 | 0.578383 | 0.841488 | 2.068 |
| LAB80 | 30671.2 | 0.61449 | 0.350191 | 8.4399 |
| LAB80 | 30673.2 | 0.589072 | 0.664932 | 3.9543 |
| LAB80 | 30673.1 | 0.569767 | 0.955456 | 0.5475 |
| LAB82 | 30181.3 | 0.643291 | 0.149784 | 13.5225 |
| LAB82 | 30183.2 | 0.57259 | 0.897551 | 1.0457 |
| LAB84 | 30163.4 | 0.592338 | 0.64275 | 4.5307 |
| LAB84 | 30162.2 | 0.571874 | 0.914455 | 0.9194 |
| control | — | 0.566664 | — | 0 |
| LAB127 | 30814.2 | 0.319903 | 0.631301 | 34.4814 |
| LAB127 | 30811.4 | 0.293522 | 0.755759 | 23.3914 |
| LAB127 | 30813.2 | 0.274277 | 0.834903 | 15.3012 |
| LAB127 | 30811.1 | 0.247397 | 0.956134 | 4.0012 |
| LAB128 | 28075.2 | 0.268398 | 0.860525 | 12.8295 |
| LAB128 | 28075.1 | 0.250268 | 0.94512 | 5.2082 |
| LAB128 | 28074.1 | 0.240636 | 0.987941 | 1.1591 |
| LAB147 | 31105.7 | 0.288743 | 0.772193 | 21.3824 |
| LAB147 | 31103.2 | 0.261951 | 0.89081 | 10.1195 |
| LAB147 | 31105.6 | 0.257213 | 0.910632 | 8.1279 |
| LAB147 | 31104.2 | 0.249513 | 0.946016 | 4.8905 |
| LAB186 | 31001.4 | 0.31396 | 0.656783 | 31.9832 |
| LAB186 | 31003.1 | 0.257541 | 0.91495 | 8.2654 |
| LAB197 | 31084.3 | 0.310646 | 0.668247 | 30.59 |
| LAB197 | 31081.3 | 0.279119 | 0.802732 | 17.3366 |
| LAB317 | 30951.4 | 0.297923 | 0.724187 | 25.2413 |
| LAB317 | 30952.2 | 0.28626 | 0.787123 | 20.3386 |
| LAB317 | 30954.4 | 0.277063 | 0.824179 | 16.4724 |
| LAB317 | 30953.4 | 0.238096 | 0.999036 | 0.0912 |
| LAB324 | 30961.1 | 0.267402 | 0.863393 | 12.411 |
| LAB324 | 30965.2 | 0.264086 | 0.878874 | 11.0168 |
| LAB324 | 30962.2 | 0.238173 | 0.998685 | 0.1235 |
| LAB325 | 30973.1 | 0.310678 | 0.683921 | 30.6035 |
| LAB325 | 30975.4 | 0.267279 | 0.867368 | 12.3591 |
| LAB325 | 30971.4 | 0.248566 | 0.951636 | 4.4926 |
| LAB80 | 30673.1 | 0.301974 | 0.701995 | 26.9444 |
| LAB80 | 30671.2 | 0.241108 | 0.984761 | 1.3573 |
| LAB80 | 30675.5 | 0.238984 | 0.994757 | 0.4645 |
| control | — | 0.237879 | — | 0 |
| LAB147 | 31104.1 | 0.557658 | 0.00422 | 34.5764 |
| LAB147 | 31105.7 | 0.53365 | 0.048012 | 28.7827 |
| LAB147 | 31103.2 | 0.518816 | 0.037519 | 25.203 |
| LAB147 | 31104.2 | 0.517286 | 0.119903 | 24.8337 |
| LAB147 | 31105.6 | 0.428586 | 0.764726 | 3.4283 |
| LAB178 | 30632.1 | 0.540823 | 0.017569 | 30.5144 |
| LAB178 | 30633.4 | 0.4802 | 0.16773 | 15.8841 |
| LAB178 | 30635.1 | 0.47658 | 0.237807 | 15.0104 |
| LAB178 | 30633.3 | 0.473108 | 0.210228 | 14.1726 |
| LAB186 | 31003.1 | 0.52315 | 0.035304 | 26.249 |
| LAB186 | 31001.4 | 0.523103 | 0.036909 | 26.2375 |
| LAB186 | 31002.1 | 0.414414 | 0.999502 | 0.0083 |

TABLE 63-continued

Genes showing improved plant growth rate under osmotic stress conditions (T2 generation)

| Gene Name | Event # | RGR Of Roots Length Average | p-value | % |
|---|---|---|---|---|
| LAB197 | 31084.3 | 0.498298 | 0.098013 | 20.2515 |
| LAB197 | 31081.3 | 0.486199 | 0.257778 | 17.3317 |
| LAB197 | 31085.3 | 0.442038 | 0.557421 | 6.6747 |
| LAB247 | 28094.3 | 0.498356 | 0.089576 | 20.2655 |
| LAB247 | 28094.1 | 0.456589 | 0.395274 | 10.1861 |
| LAB247 | 28093.2 | 0.438042 | 0.616338 | 5.7103 |
| LAB247 | 28091.4 | 0.436225 | 0.634083 | 5.2717 |
| LAB315 | 31061.1 | 0.451349 | 0.464069 | 8.9216 |
| LAB315 | 31061.2 | 0.430298 | 0.73596 | 3.8415 |
| LAB315 | 31063.1 | 0.418788 | 0.936202 | 1.0638 |
| LAB317 | 30954.4 | 0.541623 | 0.014457 | 30.7069 |
| LAB317 | 30952.3 | 0.53825 | 0.015064 | 29.8929 |
| LAB317 | 30952.2 | 0.524747 | 0.028877 | 26.6342 |
| LAB317 | 30953.4 | 0.504971 | 0.087386 | 21.8618 |
| LAB324 | 30962.2 | 0.584806 | 0.003157 | 41.1279 |
| LAB324 | 30965.3 | 0.544787 | 0.01385 | 31.4704 |
| LAB324 | 30961.1 | 0.527302 | 0.031762 | 27.2509 |
| LAB324 | 30963.1 | 0.489634 | 0.122678 | 18.1606 |
| LAB324 | 30965.2 | 0.479629 | 0.191951 | 15.7461 |
| LAB325 | 30975.4 | 0.616324 | 0.00059 | 48.734 |
| LAB325 | 30971.4 | 0.536043 | 0.017624 | 29.3604 |
| LAB325 | 30975.2 | 0.498202 | 0.176144 | 20.2282 |
| LAB325 | 30973.1 | 0.495056 | 0.184454 | 19.4692 |
| LAB325 | 30972.2 | 0.49174 | 0.124333 | 18.6689 |
| LAB54 | 28133.4 | 0.561569 | 0.015378 | 35.5203 |
| LAB54 | 28136.2 | 0.54137 | 0.023449 | 30.6458 |
| LAB54 | 28134.1 | 0.504381 | 0.070454 | 21.7196 |
| LAB54 | 28136.1 | 0.491261 | 0.145637 | 18.5533 |
| LAB67 | 31022.1 | 0.515893 | 0.182407 | 24.4977 |
| LAB68 | 29335.3 | 0.522314 | 0.029841 | 26.0472 |
| LAB68 | 29335.1 | 0.507735 | 0.062517 | 22.5288 |
| LAB68 | 29332.3 | 0.475233 | 0.323802 | 14.6853 |
| LAB68 | 29331.6 | 0.463436 | 0.420803 | 11.8384 |
| LAB73 | 30152.1 | 0.525294 | 0.026359 | 26.7663 |
| LAB73 | 30154.3 | 0.484444 | 0.343706 | 16.9082 |
| LAB73 | 30153.1 | 0.473966 | 0.255725 | 14.3795 |
| LAB73 | 30152.2 | 0.465984 | 0.283263 | 12.4533 |
| LAB73 | 30151.1 | 0.438007 | 0.608481 | 5.7018 |
| LAB74 | 28454.1 | 0.510933 | 0.093693 | 23.3007 |
| LAB74 | 28451.3 | 0.485246 | 0.246157 | 17.1016 |
| LAB74 | 28453.5 | 0.456779 | 0.432494 | 10.232 |
| LAB74 | 28452.1 | 0.452021 | 0.422857 | 9.0836 |
| LAB74 | 28452.2 | 0.447408 | 0.57731 | 7.9704 |
| control | — | 0.41438 | — | 0 |
| LAB133 | 28833.2 | 0.515482 | 0.254826 | 20.4995 |
| LAB133 | 28833.1 | 0.489279 | 0.4113 | 14.3742 |
| LAB133 | 28833.5 | 0.475499 | 0.51345 | 11.153 |
| LAB158 | 29414.3 | 0.517896 | 0.249971 | 21.0638 |
| LAB158 | 29412.1 | 0.492696 | 0.391215 | 15.173 |
| LAB158 | 29411.3 | 0.469148 | 0.58699 | 9.6683 |
| LAB158 | 29415.1 | 0.439102 | 0.878793 | 2.6447 |
| LAB160 | 29311.2 | 0.528653 | 0.175055 | 23.5783 |
| LAB160 | 29314.2 | 0.498241 | 0.31956 | 16.4692 |
| LAB160 | 29315.2 | 0.428124 | 0.996729 | 0.0786 |
| LAB162 | 29342.7 | 0.525874 | 0.171754 | 22.9286 |
| LAB162 | 29342.6 | 0.516558 | 0.232251 | 20.7509 |
| LAB162 | 29344.1 | 0.492819 | 0.456278 | 15.2016 |
| LAB177 | 29422.1 | 0.555065 | 0.132635 | 29.7523 |
| LAB177 | 29421.2 | 0.481563 | 0.430917 | 12.5706 |
| LAB177 | 29425.1 | 0.481356 | 0.457828 | 12.5222 |
| LAB177 | 29424.4 | 0.468187 | 0.564027 | 9.4437 |
| LAB177 | 29424.3 | 0.451423 | 0.787907 | 5.5248 |
| LAB179 | 29304.3 | 0.512847 | 0.263707 | 19.8834 |
| LAB179 | 29303.2 | 0.493921 | 0.432699 | 15.4593 |
| LAB179 | 29301.4 | 0.487921 | 0.487115 | 14.0567 |
| LAB179 | 29302.4 | 0.484305 | 0.418594 | 13.2114 |
| LAB179 | 29304.4 | 0.436265 | 0.926321 | 1.9816 |
| LAB185 | 28175.3 | 0.480678 | 0.498133 | 12.3635 |
| LAB210 | 28331.2 | 0.532022 | 0.132963 | 24.3658 |
| LAB210 | 28333.3 | 0.521309 | 0.253837 | 21.8615 |
| LAB210 | 28333.2 | 0.517444 | 0.263138 | 20.9582 |
| LAB210 | 28331.3 | 0.50623 | 0.301622 | 18.3368 |
| LAB210 | 28335.3 | 0.475665 | 0.591156 | 11.1918 |
| LAB254 | 28815.3 | 0.520183 | 0.253908 | 21.5984 |
| LAB254 | 28814.1 | 0.458318 | 0.691151 | 7.1367 |
| LAB254 | 28811.1 | 0.442333 | 0.844465 | 3.4 |
| LAB254 | 28814.5 | 0.431601 | 0.959624 | 0.8913 |
| LAB293 | 29233.3 | 0.504182 | 0.283306 | 17.8578 |
| LAB293 | 29232.2 | 0.432405 | 0.953277 | 1.0793 |
| LAB293 | 29235.4 | 0.429232 | 0.983514 | 0.3377 |
| LAB297 | 29273.1 | 0.550541 | 0.154472 | 28.695 |
| LAB297 | 29275.1 | 0.50695 | 0.292986 | 18.505 |
| LAB297 | 29273.4 | 0.485643 | 0.466793 | 13.5242 |
| LAB297 | 29272.5 | 0.480033 | 0.466088 | 12.2129 |
| LAB310 | 28182.2 | 0.56388 | 0.086345 | 31.8229 |
| LAB310 | 28181.3 | 0.520604 | 0.22659 | 21.6966 |
| LAB310 | 28183.3 | 0.496231 | 0.342031 | 15.9992 |
| LAB318 | 28101.7 | 0.560723 | 0.103747 | 31.075 |
| LAB318 | 28101.5 | 0.555137 | 0.112318 | 29.7691 |
| LAB318 | 28104.3 | 0.504637 | 0.337176 | 17.9643 |
| LAB318 | 28103.2 | 0.436814 | 0.905906 | 2.1099 |
| LAB327 | 29221.6 | 0.547594 | 0.12194 | 28.0059 |
| LAB327 | 29225.4 | 0.51002 | 0.291145 | 19.2227 |
| LAB327 | 29221.2 | 0.50954 | 0.253652 | 19.1104 |
| LAB327 | 29221.8 | 0.450059 | 0.778052 | 5.2062 |
| LAB327 | 29221.5 | 0.437607 | 0.895282 | 2.2954 |
| LAB335 | 27314.2 | 0.480047 | 0.469721 | 12.2161 |
| LAB335 | 27312.1 | 0.434943 | 0.93103 | 1.6726 |
| control | — | 0.427788 | — | 0 |
| LAB102 | 30312.4 | 0.627067 | 0.023255 | 27.036 |
| LAB102 | 30312.2 | 0.607715 | 0.04974 | 23.1157 |
| LAB102 | 30313.2 | 0.578944 | 0.163391 | 17.287 |
| LAB102 | 30314.3 | 0.567608 | 0.197348 | 14.9905 |
| LAB102 | 30313.3 | 0.550739 | 0.344418 | 11.573 |
| LAB126 | 30205.3 | 0.612519 | 0.058611 | 24.0889 |
| LAB126 | 30203.3 | 0.60798 | 0.047513 | 23.1692 |
| LAB126 | 30202.3 | 0.576056 | 0.208096 | 16.7019 |
| LAB126 | 30205.1 | 0.560757 | 0.243928 | 13.6024 |
| LAB126 | 30201.3 | 0.528905 | 0.585389 | 7.1497 |
| LAB165 | 30233.1 | 0.703765 | 0.000728 | 42.5742 |
| LAB165 | 30232.1 | 0.612193 | 0.050015 | 24.0228 |
| LAB165 | 30231.1 | 0.610728 | 0.066209 | 23.7259 |
| LAB165 | 30235.1 | 0.60902 | 0.064714 | 23.3799 |
| LAB167 | 27324.1 | 0.706808 | 0.000643 | 43.1906 |
| LAB167 | 27321.4 | 0.63726 | 0.024587 | 29.1011 |
| LAB167 | 27321.6 | 0.569332 | 0.225828 | 15.3396 |
| LAB167 | 27321.3 | 0.507783 | 0.811332 | 2.8706 |
| LAB220 | 30322.2 | 0.727931 | 0.000414 | 47.4699 |
| LAB220 | 30324.4 | 0.681312 | 0.007193 | 38.0255 |
| LAB220 | 30321.4 | 0.641041 | 0.015643 | 29.867 |
| LAB220 | 30322.3 | 0.627381 | 0.022332 | 27.0096 |
| LAB220 | 30323.1 | 0.625662 | 0.047604 | 26.7515 |
| LAB241 | 30211.3 | 0.633554 | 0.037011 | 28.3502 |
| LAB241 | 30212.2 | 0.593662 | 0.115124 | 20.2687 |
| LAB241 | 30212.1 | 0.582116 | 0.140292 | 17.9296 |
| LAB241 | 30213.1 | 0.577721 | 0.246789 | 17.0391 |
| LAB241 | 30214.4 | 0.571915 | 0.222401 | 15.863 |
| LAB268 | 30395.1 | 0.676721 | 0.005562 | 37.0954 |
| LAB268 | 30392.2 | 0.581186 | 0.223061 | 17.7412 |
| LAB268 | 30392.1 | 0.571513 | 0.221279 | 15.7815 |
| LAB268 | 30391.4 | 0.556859 | 0.327987 | 12.8128 |
| LAB280 | 30041.1 | 0.683012 | 0.004636 | 38.3698 |
| LAB280 | 30045.3 | 0.662195 | 0.016859 | 34.1525 |
| LAB280 | 30044.1 | 0.608872 | 0.051337 | 23.3499 |
| LAB289 | 30375.3 | 0.621777 | 0.053223 | 25.9644 |
| LAB289 | 30375.2 | 0.607167 | 0.056937 | 23.0045 |
| LAB289 | 30371.6 | 0.575721 | 0.166626 | 16.634 |
| LAB289 | 30371.4 | 0.549266 | 0.3932 | 11.2745 |
| LAB289 | 30371.2 | 0.549028 | 0.346848 | 11.2264 |
| LAB303 | 30425.3 | 0.645104 | 0.013668 | 30.6901 |
| LAB303 | 30424.3 | 0.538799 | 0.485388 | 9.154 |
| control | — | 0.493613 | — | 0 |

TABLE 63-continued

Genes showing improved plant growth rate under osmotic stress conditions (T2 generation)

| | | RGR Of Roots Length | | |
|---|---|---|---|---|
| Gene Name | Event # | Average | p-value | % |
| LAB303 | 30421.2 | 0.62597 | 0.152851 | 10.784 |
| LAB311 | 30223.2 | 0.623301 | 0.229411 | 10.3117 |
| LAB311 | 30223.4 | 0.593289 | 0.551287 | 5.0002 |
| LAB344 | 30096.1 | 0.614094 | 0.249466 | 8.6821 |
| LAB344 | 30096.3 | 0.611292 | 0.35619 | 8.1863 |
| LAB344 | 30092.3 | 0.589716 | 0.605336 | 4.3678 |
| LAB355 | 29282.2 | 0.628791 | 0.167542 | 11.2833 |
| LAB355 | 29282.3 | 0.56882 | 0.930134 | 0.6697 |
| LAB367 | 30172.3 | 0.615977 | 0.272029 | 9.0155 |
| LAB381 | 30352.4 | 0.615836 | 0.260767 | 8.9906 |
| LAB381 | 30351.4 | 0.594273 | 0.482209 | 5.1744 |
| LAB383 | 28111.4 | 0.596952 | 0.488994 | 5.6484 |
| LAB383 | 28115.2 | 0.587836 | 0.612042 | 4.0351 |
| LAB64 | 30274.2 | 0.620778 | 0.243556 | 9.8652 |
| LAB64 | 30273.2 | 0.577782 | 0.784732 | 2.2556 |
| LAB65 | 30301.4 | 0.578559 | 0.74591 | 2.3933 |
| LAB92 | 29325.1 | 0.623273 | 0.189068 | 10.3067 |
| control | — | 0.565036 | — | 0 |
| LAB172 | 30854.1 | 0.622493 | 0.791671 | 2.454 |
| LAB172 | 30854.4 | 0.61269 | 0.916379 | 0.8406 |
| LAB188 | 30724.1 | 0.671964 | 0.188716 | 10.5964 |
| LAB188 | 30724.2 | 0.624065 | 0.733371 | 2.7128 |
| LAB243 | 30873.4 | 0.745151 | 0.007139 | 22.6419 |
| LAB243 | 30872.1 | 0.64231 | 0.484828 | 5.7156 |
| LAB270 | 30594.3 | 0.636532 | 0.560952 | 4.7646 |
| LAB270 | 30595.2 | 0.62908 | 0.65672 | 3.5381 |
| LAB270 | 30594.1 | 0.623537 | 0.748377 | 2.6258 |
| LAB291 | 31854.4 | 0.725863 | 0.018008 | 19.4674 |
| LAB291 | 31851.2 | 0.720694 | 0.023277 | 18.6166 |
| LAB291 | 31851.3 | 0.674839 | 0.170535 | 11.0695 |
| LAB291 | 31852.4 | 0.654209 | 0.368034 | 7.6741 |
| LAB291 | 31853.3 | 0.612874 | 0.926175 | 0.8709 |
| LAB295 | 31861.3 | 0.63014 | 0.651774 | 3.7126 |
| LAB295 | 31865.1 | 0.618059 | 0.830474 | 1.7243 |
| LAB295 | 31864.4 | 0.617828 | 0.838549 | 1.6863 |
| LAB295 | 31863.1 | 0.608425 | 0.986897 | 0.1386 |
| LAB323 | 30381.4 | 0.678999 | 0.148611 | 11.7542 |
| LAB323 | 30383.1 | 0.65805 | 0.302426 | 8.3063 |
| LAB347_H0 | 30444.3 | 0.688252 | 0.115228 | 13.277 |
| LAB347_H0 | 30444.1 | 0.662432 | 0.267101 | 9.0275 |
| LAB347_H0 | 30441.1 | 0.635185 | 0.56454 | 4.5429 |
| LAB347_H0 | 30442.4 | 0.632052 | 0.625908 | 4.0273 |
| LAB55 | 30023.1 | 0.631171 | 0.630222 | 3.8824 |
| LAB94 | 30681.8 | 0.63945 | 0.512548 | 5.245 |
| control | — | 0.607583 | — | 0 |
| LAB243 | 30872.1 | 0.729005 | 0.232515 | 9.9873 |
| LAB243 | 30872.2 | 0.693991 | 0.61627 | 4.7046 |
| LAB243 | 27101.1 | 0.687736 | 0.656918 | 3.7609 |
| LAB291 | 31851.3 | 0.688359 | 0.656598 | 3.8549 |
| LAB291 | 31851.2 | 0.676579 | 0.833265 | 2.0776 |
| LAB291 | 31854.4 | 0.670952 | 0.90645 | 1.2286 |
| LAB295 | 31864.4 | 0.698267 | 0.548677 | 5.3498 |
| LAB295 | 31863.1 | 0.67677 | 0.805681 | 2.1065 |
| LAB295 | 31861.3 | 0.671286 | 0.882904 | 1.2791 |
| control | — | 0.662809 | — | 0 |

Table 63.
"CONT."—Control;
"Ave."—Average;
"% Incr." = % increment;
"p-val."—p-value.

TABLE 64

Genes showing improved plant growth rate under osmotic stress conditions (T1 generation)

| Gene Name | Event # | RGR Of Leaf Area Ave. | p-val. | % | Gene Name | Event # | RGR Of Roots Coverage Ave. | p-val. | % |
|---|---|---|---|---|---|---|---|---|---|
| LAB109 | 32411 | 0.050 | 0.01 | 22 | LAB349 | 32391 | 0.34 | 0.73 | 5 |
| LAB211 | 32581 | 0.051 | 0.02 | 25 | LAB69 | 32451 | 0.36 | 0.51 | 12 |
| LAB229 | 32911 | 0.041 | 0.86 | 2 | LAB89 | 32432 | 0.37 | 0.36 | 16 |
| LAB274 | 32471 | 0.052 | 0.00 | 29 | cont | — | 0.32 | — | 0 |
| cont | — | 0.041 | — | 0 | | | | | |
| LAB296 | 32441 | 0.056 | 0.00 | 58 | | | | | |
| LAB316 | 32421 | 0.039 | 0.21 | 9 | | | | | |
| LAB349 | 32391 | 0.049 | 0.00 | 38 | | | | | |
| LAB53 | 32461 | 0.038 | 0.36 | 7 | | | | | |
| LAB69 | 32451 | 0.051 | 0.01 | 44 | | | | | |
| cont | — | 0.035 | — | 0 | | | | | |

Table 64.
"CONT."—Control;
"Ave."—Average;
"% Incr." = % increment;
"p-val."—p-value.

TABLE 65

Genes showing improved plant growth rate under osmotic stress conditions (T1 generation)

| Gene Name | Event # | RGR Of Roots Length Average | p-value | % |
|---|---|---|---|---|
| LAB69 | 32451 | 0.368306 | 0.797942 | 3.5004 |
| LAB89 | 32432 | 0.378998 | 0.641537 | 6.5051 |
| CONTROL | — | 0.35585 | — | 0 |

Table 65.
"CONT."—Control;
"Ave."—Average;
"% Incr." = % increment;
"p-val."—p-value.

The genes listed in Tables 66-69 improved plant biomass when grown at standard conditions. These genes produced larger plant biomass (plant fresh and dry weight and leaf area) when grown under standard conditions, compared to control plants. Larger plant biomass under this growth conditions indicates the high ability of the plant to better metabolize the nutrients present in the medium. The genes were cloned under the regulation of a constitutive promoter (At6669; SEQ ID NO:8741). The evaluation of each gene was performed by testing the performance of different number of events. Some of the genes were evaluated in more than one tissue culture assay and the results obtained where positive as well. Event with p-value <0.1 was considered statistically significant

TABLE 66

Genes showing improved plant performance at standard growth conditions (T2 generation)

| Gene Name | Event # | Plant Fresh Weight [gr.] Ave. | p-val. | % Incr. | Gene Name | Event # | Plant Dry Weight [gr.] Ave. | p-val. | % Incr. |
|---|---|---|---|---|---|---|---|---|---|
| LAB115 | 27281.2 | 0.194 | 0.11 | 91 | LAB115 | 27281.2 | 0.010 | 0.08 | 128 |
| LAB115 | 27282.3 | 0.133 | 0.12 | 31 | LAB115 | 27282.3 | 0.006 | 0.22 | 31 |
| LAB115 | 27284.3 | 0.104 | 0.80 | 2 | LAB115 | 27284.3 | 0.005 | 0.18 | 18 |
| LAB115 | 27285.2 | 0.121 | 0.16 | 19 | LAB115 | 27285.2 | 0.006 | 0.03 | 29 |
| LAB115 | 27285.4 | 0.118 | 0.49 | 16 | LAB115 | 27285.4 | 0.005 | 0.31 | 19 |
| LAB123 | 28282.3 | 0.143 | 0.10 | 41 | LAB123 | 28282.3 | 0.008 | 0.13 | 67 |
| LAB123 | 28284.2 | 0.109 | 0.55 | 7 | LAB123 | 28284.2 | 0.005 | 0.57 | 10 |
| LAB123 | 28285.2 | 0.186 | 0.01 | 83 | LAB123 | 28285.2 | 0.010 | 0.01 | 124 |
| LAB183 | 27452.2 | 0.182 | 0.16 | 79 | LAB183 | 27452.2 | 0.007 | 0.08 | 56 |
| LAB183 | 27453.1 | 0.115 | 0.28 | 12 | LAB183 | 27453.1 | 0.006 | 0.19 | 24 |
| LAB183 | 27453.4 | 0.106 | 0.87 | 4 | LAB183 | 27453.4 | 0.005 | 0.73 | 4 |
| LAB183 | 27454.2 | 0.127 | 0.26 | 25 | LAB183 | 27454.2 | 0.005 | 0.27 | 20 |
| LAB189 | 28163.2 | 0.125 | 0.05 | 23 | LAB189 | 28163.2 | 0.007 | 0.00 | 45 |
| LAB189 | 28165.2 | 0.112 | 0.72 | 10 | LAB189 | 28165.2 | 0.006 | 0.13 | 35 |
| LAB189 | 28166.1 | 0.105 | 0.81 | 3 | LAB189 | 28166.1 | 0.005 | 0.99 | 0 |
| LAB212 | 28041.1 | — | — | — | LAB212 | 28041.1 | 0.005 | 0.35 | 20 |
| LAB212 | 28042.1 | 0.171 | 0.02 | 68 | LAB212 | 28042.1 | 0.010 | 0.00 | 127 |
| LAB212 | 28043.2 | 0.227 | 0.00 | 123 | LAB212 | 28043.2 | 0.012 | 0.00 | 160 |
| LAB212 | 28044.2 | 0.114 | 0.47 | 12 | LAB212 | 28044.2 | 0.006 | 0.13 | 27 |
| LAB212 | 28045.2 | — | — | — | LAB212 | 28045.2 | 0.005 | 0.25 | 15 |
| LAB217 | 28033.2 | 0.148 | 0.01 | 45 | LAB217 | 28033.2 | 0.007 | 0.15 | 62 |
| LAB217 | 28035.1 | — | — | — | LAB217 | 28035.1 | 0.005 | 0.44 | 7 |
| LAB217 | 28035.3 | 0.120 | 0.39 | 18 | LAB217 | 28035.3 | 0.006 | 0.24 | 40 |
| LAB217 | 28036.4 | 0.115 | 0.41 | 13 | LAB217 | 28036.4 | 0.005 | 0.07 | 21 |
| LAB326 | 28052.4 | — | — | — | LAB326 | 28052.4 | 0.006 | 0.35 | 22 |
| LAB326 | 28053.2 | 0.118 | 0.50 | 16 | LAB326 | 28053.2 | 0.006 | 0.39 | 27 |
| LAB326 | 28054.1 | 0.132 | 0.03 | 30 | LAB326 | 28054.1 | 0.007 | 0.01 | 45 |
| LAB326 | 28056.2 | 0.161 | 0.04 | 58 | LAB326 | 28056.2 | 0.009 | 0.01 | 98 |
| LAB326 | 28056.3 | 0.146 | 0.24 | 43 | LAB326 | 28056.3 | 0.007 | 0.06 | 58 |
| cont | — | 0.102 | — | 0 | cont | — | 0.005 | — | 0 |
| LAB115 | 27284.3 | 0.136 | 0.33 | 13 | LAB115 | 27284.3 | 0.006 | 0.77 | 5 |
| LAB115 | 27285.1 | 0.186 | 0.14 | 54 | LAB115 | 27285.1 | 0.009 | 0.09 | 72 |
| LAB123 | 28281.1 | 0.236 | 0.08 | 95 | LAB123 | 28281.1 | 0.013 | 0.06 | 135 |
| LAB123 | 28282.3 | 0.186 | 0.00 | 54 | LAB123 | 28282.3 | 0.010 | 0.01 | 79 |
| LAB123 | 28283.1 | 0.240 | 0.03 | 99 | LAB123 | 28283.1 | 0.011 | 0.03 | 94 |
| LAB123 | 28284.1 | 0.173 | 0.04 | 43 | LAB123 | 28284.1 | 0.008 | 0.01 | 52 |
| LAB123 | 28285.2 | 0.212 | 0.02 | 76 | LAB123 | 28285.2 | 0.010 | 0.01 | 91 |
| LAB183 | 27453.4 | 0.161 | 0.01 | 33 | LAB183 | 27453.4 | 0.006 | 0.24 | 17 |
| LAB189 | 28166.2 | 0.156 | 0.33 | 29 | LAB189 | 28166.2 | 0.007 | 0.43 | 22 |
| LAB189 | 28166.5 | 0.181 | 0.15 | 50 | LAB189 | 28166.5 | 0.010 | 0.16 | 80 |
| LAB206 | 30011.2 | 0.165 | 0.00 | 37 | LAB206 | 30011.2 | 0.009 | 0.00 | 60 |
| LAB206 | 30012.4 | 0.143 | 0.29 | 18 | LAB206 | 30012.4 | 0.008 | 0.07 | 38 |
| LAB206 | 30012.8 | 0.158 | 0.19 | 30 | LAB206 | 30012.8 | 0.008 | 0.07 | 50 |
| LAB212 | 28042.1 | 0.127 | 0.77 | 5 | LAB212 | 28042.1 | 0.006 | 0.60 | 8 |
| LAB212 | 28045.1 | 0.129 | 0.68 | 7 | LAB212 | 28045.1 | 0.007 | 0.28 | 26 |
| LAB217 | 28033.2 | 0.211 | 0.06 | 75 | LAB217 | 28033.2 | 0.010 | 0.08 | 92 |
| LAB217 | 28034.1 | 0.238 | 0.22 | 97 | LAB217 | 28034.1 | 0.011 | 0.14 | 110 |
| LAB217 | 28034.3 | 0.188 | 0.01 | 55 | LAB217 | 28034.3 | 0.010 | 0.00 | 82 |
| LAB217 | 28035.1 | 0.220 | 0.06 | 82 | LAB217 | 28035.1 | 0.009 | 0.05 | 73 |
| LAB217 | 28036.1 | 0.216 | 0.06 | 79 | LAB217 | 28036.1 | 0.009 | 0.08 | 74 |
| LAB250 | 30251.2 | 0.133 | 0.65 | 10 | LAB250 | 30251.2 | 0.006 | 0.90 | 3 |

TABLE 66-continued

Genes showing improved plant performance at standard growth conditions (T2 generation)

| | | Plant Fresh Weight [gr.] | | | | | Plant Dry Weight [gr.] | | |
|---|---|---|---|---|---|---|---|---|---|
| Gene Name | Event # | Ave. | p-val. | % Incr. | Gene Name | Event # | Ave. | p-val. | % Incr. |
| LAB314 | 29292.4 | 0.132 | 0.76 | 10 | LAB314 | 29292.4 | — | | — |
| LAB314 | 29292.6 | 0.156 | 0.06 | 29 | LAB314 | 29292.6 | 0.008 | 0.01 | 41 |
| LAB314 | 29295.2 | — | | — | LAB314 | 29295.2 | 0.006 | 0.17 | 16 |
| LAB326 | 28052.4 | — | | — | LAB326 | 28052.4 | 0.006 | 0.35 | 18 |
| LAB326 | 28056.3 | 0.148 | 0.27 | 23 | LAB326 | 28056.3 | 0.007 | 0.08 | 35 |
| LAB351 | 30114.2 | 0.142 | 0.11 | 17 | LAB351 | 30114.2 | 0.007 | 0.13 | 22 |
| LAB351 | 30115.1 | — | | — | LAB351 | 30115.1 | 0.006 | 0.59 | 11 |
| LAB93 | 28271.3 | 0.123 | 0.92 | 2 | LAB93 | 28271.3 | — | | — |
| LAB93 | 28271.4 | 0.182 | 0.17 | 50 | LAB93 | 28271.4 | 0.010 | 0.20 | 77 |
| LAB93 | 28272.3 | 0.195 | 0.00 | 61 | LAB93 | 28272.3 | 0.010 | 0.02 | 77 |
| LAB93 | 28274.2 | 0.143 | 0.32 | 18 | LAB93 | 28274.2 | 0.007 | 0.37 | 25 |
| cont | — | 0.121 | — | 0 | cont | — | 0.005 | — | 0 |
| LAB106 | 30032.1 | 0.159 | 0.00 | 64 | LAB106 | 30032.1 | 0.008 | 0.00 | 66 |
| LAB106 | 30032.2 | 0.166 | 0.01 | 72 | LAB106 | 30032.2 | 0.009 | 0.00 | 92 |
| LAB206 | 30011.7 | 0.171 | 0.01 | 77 | LAB206 | 30011.7 | 0.009 | 0.01 | 86 |
| LAB206 | 30012.4 | 0.119 | 0.40 | 23 | LAB206 | 30012.4 | 0.007 | 0.30 | 47 |
| LAB206 | 30012.8 | 0.099 | 0.86 | 2 | LAB206 | 30012.8 | 0.005 | 0.20 | 13 |
| LAB207 | 28842.1 | 0.119 | 0.48 | 23 | LAB207 | 28842.1 | 0.005 | 0.69 | 9 |
| LAB207 | 28843.3 | 0.152 | 0.02 | 57 | LAB207 | 28843.3 | 0.008 | 0.04 | 72 |
| LAB207 | 28843.5 | — | | — | LAB207 | 28843.5 | 0.005 | 0.68 | 6 |
| LAB207 | 28845.1 | 0.115 | 0.27 | 18 | LAB207 | 28845.1 | — | | — |
| LAB218 | 29432.2 | 0.126 | 0.18 | 30 | LAB218 | 29432.2 | 0.006 | 0.23 | 27 |
| LAB218 | 29434.3 | 0.140 | 0.23 | 44 | LAB218 | 29434.3 | 0.006 | 0.18 | 28 |
| LAB250 | 30252.1 | 0.105 | 0.52 | 9 | LAB250 | 30252.1 | 0.005 | 0.85 | 2 |
| LAB250 | 30253.1 | 0.153 | 0.15 | 58 | LAB250 | 30253.1 | 0.007 | 0.17 | 49 |
| LAB250 | 30254.1 | 0.097 | 0.98 | 0 | LAB250 | 30254.1 | 0.005 | 0.66 | 7 |
| LAB252 | 30291.4 | 0.115 | 0.28 | 19 | LAB252 | 30291.4 | 0.006 | 0.14 | 23 |
| LAB252 | 30292.3 | 0.208 | 0.03 | 115 | LAB252 | 30292.3 | 0.011 | 0.03 | 145 |
| LAB309 | 30052.2 | 0.147 | 0.03 | 52 | LAB309 | 30052.2 | 0.007 | 0.01 | 60 |
| LAB309 | 30052.3 | 0.138 | 0.04 | 42 | LAB309 | 30052.3 | 0.007 | 0.03 | 50 |
| LAB314 | 29292.4 | 0.143 | 0.15 | 47 | LAB314 | 29292.4 | 0.007 | 0.12 | 46 |
| LAB314 | 29292.6 | 0.133 | 0.07 | 37 | LAB314 | 29292.6 | 0.008 | 0.02 | 65 |
| LAB314 | 29294.1 | 0.127 | 0.02 | 31 | LAB314 | 29294.1 | 0.006 | 0.01 | 38 |
| LAB314 | 29295.2 | 0.151 | 0.01 | 56 | LAB314 | 29295.2 | 0.007 | 0.01 | 58 |
| LAB346 | 29442.4 | 0.105 | 0.42 | 8 | LAB346 | 29442.4 | — | | — |
| LAB346 | 29443.2 | 0.132 | 0.06 | 37 | LAB346 | 29443.2 | 0.007 | 0.02 | 51 |
| LAB346 | 29445.2 | — | | — | LAB346 | 29445.2 | 0.005 | 0.88 | 2 |
| LAB346 | 29445.3 | 0.114 | 0.18 | 18 | LAB346 | 29445.3 | 0.006 | 0.04 | 26 |
| LAB351 | 30111.2 | 0.116 | 0.13 | 20 | LAB351 | 30111.2 | 0.006 | 0.03 | 35 |
| LAB351 | 30112.1 | 0.122 | 0.04 | 26 | LAB351 | 30112.1 | 0.006 | 0.01 | 30 |
| LAB351 | 30114.2 | 0.131 | 0.06 | 36 | LAB351 | 30114.2 | 0.007 | 0.01 | 53 |
| LAB82 | 30181.3 | 0.106 | 0.59 | 9 | LAB82 | 30181.3 | — | | — |
| LAB82 | 30181.4 | 0.114 | 0.59 | 18 | LAB82 | 30181.4 | — | | — |
| LAB82 | 30182.2 | 0.123 | 0.22 | 27 | LAB82 | 30182.2 | 0.006 | 0.22 | 30 |
| LAB82 | 30184.2 | — | | — | LAB82 | 30184.2 | 0.005 | 0.85 | 4 |
| LAB84 | 30161.4 | 0.113 | 0.29 | 17 | LAB84 | 30161.4 | 0.005 | 0.18 | 14 |
| LAB84 | 30162.2 | 0.159 | 0.06 | 64 | LAB84 | 30162.2 | 0.008 | 0.02 | 80 |
| LAB84 | 30162.4 | 0.153 | 0.08 | 58 | LAB84 | 30162.4 | 0.008 | 0.05 | 70 |
| LAB84 | 30163.4 | 0.155 | 0.01 | 60 | LAB84 | 30163.4 | 0.009 | 0.01 | 99 |
| LAB84 | 30164.2 | 0.129 | 0.13 | 33 | LAB84 | 30164.2 | 0.007 | 0.01 | 47 |
| cont | — | 0.097 | — | 0 | cont | — | 0.005 | — | 0 |
| LAB110 | 30571.3 | 0.153 | 0.19 | 40 | LAB110 | 30571.3 | 0.006 | 0.61 | 35 |
| LAB110 | 30572.1 | 0.139 | 0.01 | 27 | LAB110 | 30572.1 | 0.006 | 0.20 | 35 |
| LAB110 | 30572.2 | — | | — | LAB110 | 30572.2 | 0.004 | 0.99 | 0 |
| LAB110 | 30573.2 | 0.131 | 0.32 | 20 | LAB110 | 30573.2 | — | | — |
| LAB110 | 30574.2 | 0.158 | 0.18 | 45 | LAB110 | 30574.2 | 0.006 | 0.10 | 41 |
| LAB117 | 27291.1 | 0.136 | 0.39 | 24 | LAB117 | 27291.1 | 0.005 | 0.56 | 26 |
| LAB117 | 27291.5 | 0.126 | 0.20 | 15 | LAB117 | 27291.5 | 0.006 | 0.03 | 41 |
| LAB117 | 27293.1 | 0.196 | 0.05 | 79 | LAB117 | 27293.1 | 0.009 | 0.13 | 113 |
| LAB124 | 30431.1 | 0.131 | 0.24 | 20 | LAB124 | 30431.1 | 0.005 | 0.60 | 18 |
| LAB124 | 30434.3 | 0.154 | 0.00 | 41 | LAB124 | 30434.3 | 0.007 | 0.00 | 72 |
| LAB124 | 30435.2 | 0.156 | 0.10 | 43 | LAB124 | 30435.2 | 0.008 | 0.01 | 80 |
| LAB125 | 30581.3 | — | | — | LAB125 | 30581.3 | 0.005 | 0.46 | 20 |
| LAB125 | 30583.1 | — | | — | LAB125 | 30583.1 | 0.004 | 0.78 | 5 |
| LAB125 | 30583.2 | 0.150 | 0.12 | 37 | LAB125 | 30583.2 | 0.006 | 0.26 | 39 |
| LAB156 | 30401.4 | 0.151 | 0.04 | 38 | LAB156 | 30401.4 | 0.006 | 0.02 | 50 |
| LAB156 | 30402.2 | 0.166 | 0.11 | 52 | LAB156 | 30402.2 | 0.007 | 0.12 | 71 |
| LAB156 | 30403.1 | — | | — | LAB156 | 30403.1 | 0.004 | 0.66 | 8 |
| LAB228 | 30081.4 | 0.112 | 0.85 | 2 | LAB228 | 30081.4 | 0.005 | 0.19 | 21 |
| LAB228 | 30082.3 | — | | — | LAB228 | 30082.3 | 0.005 | 0.27 | 21 |
| LAB228 | 30084.3 | — | | — | LAB228 | 30084.3 | 0.005 | 0.48 | 30 |
| LAB275 | 30361.3 | 0.216 | 0.08 | 98 | LAB275 | 30361.3 | 0.008 | 0.09 | 89 |

TABLE 66-continued

Genes showing improved plant performance at standard growth conditions (T2 generation)

| | | Plant Fresh Weight [gr.] | | | | | Plant Dry Weight [gr.] | | |
|---|---|---|---|---|---|---|---|---|---|
| Gene Name | Event # | Ave. | p-val. | % Incr. | Gene Name | Event # | Ave. | p-val. | % Incr. |
| LAB275 | 30363.4 | 0.113 | 0.85 | 3 | LAB275 | 30363.4 | 0.004 | 0.93 | 2 |
| LAB275 | 30366.4 | — | | — | LAB275 | 30366.4 | 0.005 | 0.49 | 15 |
| LAB276_H0 | 30331.1 | 0.196 | 0.00 | 80 | LAB276_H0 | 30331.1 | 0.009 | 0.00 | 123 |
| LAB276_H0 | 30331.4 | 0.143 | 0.09 | 30 | LAB276_H0 | 30331.4 | 0.005 | 0.58 | 15 |
| LAB276_H0 | 30333.7 | 0.148 | 0.20 | 35 | LAB276_H0 | 30333.7 | 0.005 | 0.46 | 29 |
| LAB277 | 30651.2 | 0.115 | 0.62 | 5 | LAB277 | 30651.2 | — | | — |
| LAB277 | 30652.3 | 0.158 | 0.08 | 44 | LAB277 | 30652.3 | 0.008 | 0.00 | 86 |
| LAB277 | 30652.5 | 0.118 | 0.61 | 8 | LAB277 | 30652.5 | 0.005 | 0.41 | 21 |
| LAB277 | 30653.1 | 0.113 | 0.81 | 3 | LAB277 | 30653.1 | 0.005 | 0.52 | 13 |
| LAB278 | 30411.4 | 0.110 | 0.94 | 1 | LAB278 | 30411.4 | 0.005 | 0.27 | 23 |
| LAB278 | 30412.1 | 0.117 | 0.74 | 7 | LAB278 | 30412.1 | 0.005 | 0.41 | 32 |
| LAB278 | 30413.3 | 0.133 | 0.15 | 21 | LAB278 | 30413.3 | 0.005 | 0.57 | 14 |
| LAB278 | 30414.1 | 0.117 | 0.44 | 7 | LAB278 | 30414.1 | 0.006 | 0.04 | 39 |
| LAB278 | 30414.2 | — | | — | LAB278 | 30414.2 | 0.005 | 0.76 | 9 |
| LAB281 | 30741.1 | 0.124 | 0.44 | 13 | LAB281 | 30741.1 | 0.005 | 0.44 | 15 |
| LAB281 | 30742.1 | 0.129 | 0.60 | 18 | LAB281 | 30742.1 | — | | — |
| LAB282 | 30751.3 | 0.116 | 0.63 | 6 | LAB282 | 30751.3 | 0.005 | 0.53 | 18 |
| LAB282 | 30754.2 | — | | — | LAB282 | 30754.2 | 0.005 | 0.47 | 13 |
| cont | — | 0.109 | — | 0 | cont | — | 0.004 | — | 0 |
| LAB110 | 30571.3 | — | | — | LAB110 | 30571.3 | 0.006 | 0.16 | 22 |
| LAB110 | 30572.1 | 0.108 | 0.95 | 1 | LAB110 | 30572.1 | 0.006 | 0.34 | 26 |
| LAB110 | 30572.2 | 0.148 | 0.02 | 39 | LAB110 | 30572.2 | 0.008 | 0.00 | 60 |
| LAB110 | 30573.2 | 0.124 | 0.11 | 16 | LAB110 | 30573.2 | 0.007 | 0.00 | 41 |
| LAB110 | 30574.2 | 0.147 | 0.08 | 38 | LAB110 | 30574.2 | 0.009 | 0.00 | 77 |
| LAB117 | 27291.2 | 0.113 | 0.46 | 6 | LAB117 | 27291.2 | 0.006 | 0.17 | 19 |
| LAB117 | 27293.1 | 0.177 | 0.09 | 66 | LAB117 | 27293.1 | 0.009 | 0.05 | 82 |
| LAB117 | 27296.1 | 0.139 | 0.02 | 31 | LAB117 | 27296.1 | 0.008 | 0.01 | 66 |
| LAB124 | 30432.3 | 0.115 | 0.65 | 8 | LAB124 | 30432.3 | — | | — |
| LAB124 | 30434.1 | 0.133 | 0.21 | 25 | LAB124 | 30434.1 | 0.007 | 0.20 | 32 |
| LAB125 | 30581.3 | 0.124 | 0.40 | 16 | LAB125 | 30581.3 | 0.007 | 0.07 | 42 |
| LAB125 | 30582.2 | 0.144 | 0.20 | 35 | LAB125 | 30582.2 | 0.008 | 0.06 | 56 |
| LAB125 | 30584.2 | 0.158 | 0.04 | 49 | LAB125 | 30584.2 | 0.008 | 0.04 | 55 |
| LAB156 | 30401.4 | 0.157 | 0.00 | 48 | LAB156 | 30401.4 | 0.007 | 0.01 | 46 |
| LAB156 | 30402.2 | 0.118 | 0.21 | 11 | LAB156 | 30402.2 | 0.005 | 0.85 | 3 |
| LAB156 | 30405.3 | 0.114 | 0.70 | 7 | LAB156 | 30405.3 | 0.006 | 0.24 | 25 |
| LAB228 | 30082.3 | 0.125 | 0.20 | 18 | LAB228 | 30082.3 | 0.006 | 0.10 | 21 |
| LAB228 | 30084.3 | 0.120 | 0.36 | 12 | LAB228 | 30084.3 | 0.006 | 0.18 | 16 |
| LAB228 | 30084.4 | 0.120 | 0.40 | 12 | LAB228 | 30084.4 | 0.005 | 0.46 | 8 |
| LAB275 | 30361.2 | 0.142 | 0.20 | 34 | LAB275 | 30361.2 | 0.008 | 0.15 | 52 |
| LAB275 | 30361.3 | — | | — | LAB275 | 30361.3 | 0.006 | 0.38 | 17 |
| LAB275 | 30363.1 | 0.156 | 0.14 | 46 | LAB275 | 30363.1 | 0.008 | 0.05 | 60 |
| LAB275 | 30363.4 | 0.127 | 0.31 | 19 | LAB275 | 30363.4 | 0.005 | 0.80 | 8 |
| LAB275 | 30366.4 | 0.135 | 0.12 | 27 | LAB275 | 30366.4 | 0.007 | 0.00 | 39 |
| LAB276_H0 | 30331.1 | 0.116 | 0.44 | 9 | LAB276_H0 | 30331.1 | 0.005 | 0.88 | 5 |
| LAB276_H0 | 30331.4 | 0.147 | 0.05 | 38 | LAB276_H0 | 30331.4 | 0.008 | 0.06 | 63 |
| LAB277 | 30651.2 | 0.111 | 0.77 | 4 | LAB277 | 30651.2 | 0.005 | 0.61 | 11 |
| LAB277 | 30652.5 | 0.136 | 0.13 | 27 | LAB277 | 30652.5 | 0.007 | 0.11 | 44 |
| LAB277 | 30652.6 | 0.149 | 0.05 | 40 | LAB277 | 30652.6 | 0.007 | 0.04 | 51 |
| LAB277 | 30653.1 | — | | — | LAB277 | 30653.1 | 0.006 | 0.33 | 12 |
| LAB278 | 30411.4 | 0.144 | 0.14 | 35 | LAB278 | 30411.4 | 0.008 | 0.12 | 67 |
| LAB278 | 30413.3 | 0.153 | 0.00 | 44 | LAB278 | 30413.3 | 0.008 | 0.00 | 63 |
| LAB278 | 30414.1 | 0.161 | 0.08 | 51 | LAB278 | 30414.1 | 0.009 | 0.03 | 77 |
| LAB278 | 30414.2 | 0.108 | 0.94 | 1 | LAB278 | 30414.2 | — | | — |
| LAB281 | 30742.4 | 0.120 | 0.31 | 13 | LAB281 | 30742.4 | 0.007 | 0.00 | 35 |
| LAB281 | 30743.4 | — | | — | LAB281 | 30743.4 | 0.006 | 0.16 | 24 |
| LAB281 | 30744.1 | — | | — | LAB281 | 30744.1 | 0.005 | 0.50 | 9 |
| LAB282 | 30753.4 | — | | — | LAB282 | 30753.4 | 0.005 | 0.83 | 3 |
| cont | — | 0.106 | — | 0 | cont | — | 0.005 | — | 0 |
| LAB106 | 30031.4 | 0.162 | 0.44 | 25 | LAB106 | 30031.4 | 0.007 | 0.89 | 3 |
| LAB106 | 30032.1 | 0.144 | 0.34 | 11 | LAB106 | 30032.1 | — | | — |
| LAB106 | 30035.2 | 0.137 | 0.69 | 6 | LAB106 | 30035.2 | 0.007 | 0.74 | 4 |
| LAB128 | 28074.1 | 0.156 | 0.18 | 20 | LAB128 | 28074.1 | 0.008 | 0.61 | 9 |
| LAB128 | 28074.3 | 0.144 | 0.61 | 12 | LAB128 | 28074.3 | 0.008 | 0.65 | 9 |
| LAB207 | 28842.1 | 0.159 | 0.17 | 24 | LAB207 | 28842.1 | 0.008 | 0.53 | 17 |
| LAB218 | 29431.3 | 0.152 | 0.28 | 18 | LAB218 | 29431.3 | 0.008 | 0.30 | 18 |
| LAB218 | 29433.4 | 0.154 | 0.26 | 19 | LAB218 | 29433.4 | 0.007 | 0.82 | 4 |
| LAB252 | 30292.3 | 0.185 | 0.17 | 44 | LAB252 | 30292.3 | 0.009 | 0.26 | 23 |
| LAB252 | 30292.4 | 0.136 | 0.76 | 5 | LAB252 | 30292.4 | — | | — |
| LAB309 | 30052.2 | 0.130 | 0.96 | 1 | LAB309 | 30052.2 | — | | — |
| LAB309 | 30052.3 | 0.153 | 0.53 | 19 | LAB309 | 30052.3 | 0.008 | 0.43 | 18 |
| LAB309 | 30055.4 | 0.136 | 0.69 | 5 | LAB309 | 30055.4 | 0.007 | 0.95 | 1 |
| LAB309 | 30056.1 | 0.151 | 0.48 | 17 | LAB309 | 30056.1 | 0.009 | 0.37 | 23 |

TABLE 66-continued

Genes showing improved plant performance at standard growth conditions (T2 generation)

| | | Plant Fresh Weight [gr.] | | | | | Plant Dry Weight [gr.] | | |
|---|---|---|---|---|---|---|---|---|---|
| Gene Name | Event # | Ave. | p-val. | % Incr. | Gene Name | Event # | Ave. | p-val. | % Incr. |
| LAB337 | 27265.2 | 0.193 | 0.01 | 49 | LAB337 | 27265.2 | 0.009 | 0.01 | 32 |
| LAB346 | 29442.2 | 0.143 | 0.70 | 11 | LAB346 | 29442.2 | — | | — |
| LAB84 | 30162.4 | 0.186 | 0.25 | 44 | LAB84 | 30162.4 | 0.008 | 0.24 | 15 |
| cont | — | 0.129 | — | 0 | cont | — | 0.007 | — | 0 |
| LAB127 | 30811.1 | 0.160 | 0.76 | 6 | LAB127 | 30811.1 | 0.008 | 0.41 | 14 |
| LAB127 | 30811.4 | 0.161 | 0.68 | 7 | LAB127 | 30811.4 | — | | — |
| LAB128 | 28075.1 | 0.190 | 0.20 | 26 | LAB128 | 28075.1 | 0.008 | 0.31 | 18 |
| LAB128 | 28075.2 | 0.204 | 0.22 | 36 | LAB128 | 28075.2 | 0.009 | 0.17 | 41 |
| LAB147 | 31104.1 | 0.160 | 0.48 | 7 | LAB147 | 31104.1 | — | | — |
| LAB147 | 31104.2 | 0.165 | 0.56 | 10 | LAB147 | 31104.2 | — | | — |
| LAB147 | 31105.6 | 0.171 | 0.49 | 14 | LAB147 | 31105.6 | 0.008 | 0.44 | 15 |
| LAB186 | 31001.4 | 0.162 | 0.60 | 8 | LAB186 | 31001.4 | 0.007 | 0.93 | 2 |
| LAB186 | 31002.1 | 0.166 | 0.45 | 11 | LAB186 | 31002.1 | 0.008 | 0.36 | 15 |
| LAB186 | 31003.1 | — | | — | LAB186 | 31003.1 | 0.007 | 0.47 | 6 |
| LAB186 | 31004.2 | — | | — | LAB186 | 31004.2 | 0.007 | 0.80 | 5 |
| LAB197 | 31081.3 | 0.172 | 0.57 | 15 | LAB197 | 31081.3 | 0.007 | 0.86 | 5 |
| LAB197 | 31084.3 | 0.166 | 0.23 | 11 | LAB197 | 31084.3 | — | | — |
| LAB197 | 31085.3 | 0.158 | 0.81 | 5 | LAB197 | 31085.3 | 0.007 | 0.86 | 4 |
| LAB315 | 31061.1 | — | | — | LAB315 | 31061.1 | 0.007 | 0.77 | 7 |
| LAB315 | 31063.1 | 0.166 | 0.46 | 10 | LAB315 | 31063.1 | 0.007 | 0.77 | 6 |
| LAB317 | 30951.4 | 0.161 | 0.58 | 7 | LAB317 | 30951.4 | 0.008 | 0.28 | 18 |
| LAB317 | 30952.2 | 0.166 | 0.58 | 11 | LAB317 | 30952.2 | — | | — |
| LAB324 | 30961.1 | 0.156 | 0.66 | 4 | LAB324 | 30961.1 | 0.008 | 0.43 | 12 |
| LAB325 | 30972.2 | 0.207 | 0.43 | 38 | LAB325 | 30972.2 | 0.008 | 0.55 | 20 |
| LAB325 | 30973.1 | 0.183 | 0.38 | 22 | LAB325 | 30973.1 | 0.007 | 0.90 | 2 |
| LAB325 | 30975.1 | 0.194 | 0.21 | 29 | LAB325 | 30975.1 | 0.008 | 0.21 | 25 |
| LAB325 | 30975.4 | 0.193 | 0.40 | 29 | LAB325 | 30975.4 | 0.009 | 0.24 | 32 |
| LAB67 | 31022.1 | 0.206 | 0.07 | 38 | LAB67 | 31022.1 | 0.011 | 0.00 | 65 |
| LAB67 | 31022.6 | 0.172 | 0.24 | 14 | LAB67 | 31022.6 | 0.008 | 0.24 | 19 |
| LAB67 | 31023.3 | — | | — | LAB67 | 31023.3 | 0.008 | 0.16 | 14 |
| cont | — | 0.150 | — | 0 | cont | — | 0.007 | — | 0 |
| LAB147 | 31103.2 | 0.108 | 0.08 | 29 | LAB147 | 31103.2 | 0.006 | 0.01 | 53 |
| LAB147 | 31104.1 | — | | — | LAB147 | 31104.1 | 0.004 | 0.38 | 19 |
| LAB147 | 31104.2 | 0.113 | 0.22 | 34 | LAB147 | 31104.2 | 0.006 | 0.03 | 48 |
| LAB147 | 31105.6 | 0.126 | 0.00 | 51 | LAB147 | 31105.6 | 0.006 | 0.00 | 72 |
| LAB147 | 31105.7 | 0.148 | 0.00 | 77 | LAB147 | 31105.7 | 0.007 | 0.00 | 91 |
| LAB178 | 30632.1 | 0.110 | 0.20 | 31 | LAB178 | 30632.1 | 0.005 | 0.12 | 37 |
| LAB178 | 30633.3 | 0.092 | 0.28 | 10 | LAB178 | 30633.3 | 0.005 | 0.16 | 30 |
| LAB178 | 30633.4 | 0.157 | 0.03 | 87 | LAB178 | 30633.4 | 0.008 | 0.09 | 119 |
| LAB178 | 30635.1 | 0.102 | 0.19 | 22 | LAB178 | 30635.1 | 0.005 | 0.12 | 40 |
| LAB186 | 31001.4 | 0.138 | 0.00 | 64 | LAB186 | 31001.4 | 0.006 | 0.00 | 68 |
| LAB186 | 31002.1 | 0.127 | 0.14 | 51 | LAB186 | 31002.1 | 0.005 | 0.07 | 38 |
| LAB186 | 31003.1 | 0.183 | 0.09 | 118 | LAB186 | 31003.1 | 0.007 | 0.01 | 74 |
| LAB186 | 31004.1 | 0.098 | 0.34 | 17 | LAB186 | 31004.1 | 0.005 | 0.02 | 44 |
| LAB186 | 31004.2 | 0.108 | 0.13 | 29 | LAB186 | 31004.2 | 0.005 | 0.04 | 36 |
| LAB197 | 31081.3 | 0.124 | 0.03 | 48 | LAB197 | 31081.3 | 0.006 | 0.01 | 58 |
| LAB197 | 31083.1 | 0.099 | 0.37 | 19 | LAB197 | 31083.1 | 0.005 | 0.36 | 28 |
| LAB197 | 31084.3 | 0.089 | 0.49 | 6 | LAB197 | 31084.3 | 0.005 | 0.17 | 21 |
| LAB197 | 31084.4 | 0.105 | 0.32 | 26 | LAB197 | 31084.4 | 0.005 | 0.21 | 37 |
| LAB197 | 31085.3 | 0.085 | 0.93 | 2 | LAB197 | 31085.3 | 0.004 | 0.95 | 1 |
| LAB247 | 28091.4 | 0.129 | 0.29 | 54 | LAB247 | 28091.4 | 0.005 | 0.16 | 29 |
| LAB247 | 28094.1 | 0.147 | 0.08 | 76 | LAB247 | 28094.1 | 0.006 | 0.02 | 48 |
| LAB247 | 28094.3 | 0.150 | 0.00 | 79 | LAB247 | 28094.3 | 0.006 | 0.00 | 73 |
| LAB247 | 28095.4 | — | | — | LAB247 | 28095.4 | 0.004 | 0.97 | 1 |
| LAB314 | 29292.4 | — | | — | LAB314 | 29292.4 | 0.004 | 0.97 | 1 |
| LAB314 | 29294.1 | — | | — | LAB314 | 29294.1 | 0.004 | 0.97 | 1 |
| LAB314 | 29294.2 | 0.092 | 0.65 | 10 | LAB314 | 29294.2 | 0.005 | 0.40 | 24 |
| LAB314 | 29295.1 | 0.091 | 0.27 | 9 | LAB314 | 29295.1 | 0.005 | 0.17 | 21 |
| LAB315 | 31061.2 | 0.116 | 0.05 | 38 | LAB315 | 31061.2 | 0.005 | 0.02 | 47 |
| LAB315 | 31063.1 | — | | — | LAB315 | 31063.1 | 0.004 | 0.28 | 19 |
| LAB315 | 31064.3 | 0.103 | 0.38 | 23 | LAB315 | 31064.3 | 0.005 | 0.03 | 44 |
| LAB317 | 30952.2 | 0.126 | 0.00 | 50 | LAB317 | 30952.2 | 0.006 | 0.04 | 64 |
| LAB317 | 30952.3 | 0.115 | 0.02 | 37 | LAB317 | 30952.3 | 0.005 | 0.16 | 39 |
| LAB317 | 30953.1 | 0.141 | 0.02 | 68 | LAB317 | 30953.1 | 0.007 | 0.00 | 83 |
| LAB317 | 30953.4 | 0.090 | 0.60 | 7 | LAB317 | 30953.4 | 0.004 | 0.48 | 19 |
| LAB317 | 30954.4 | 0.125 | 0.06 | 49 | LAB317 | 30954.4 | 0.008 | 0.00 | 107 |
| LAB324 | 30961.1 | 0.183 | 0.03 | 119 | LAB324 | 30961.1 | 0.008 | 0.05 | 126 |
| LAB324 | 30963.1 | 0.110 | 0.11 | 31 | LAB324 | 30963.1 | 0.005 | 0.02 | 42 |
| LAB324 | 30965.2 | 0.111 | 0.25 | 33 | LAB324 | 30965.2 | 0.006 | 0.20 | 51 |
| LAB324 | 30965.3 | 0.144 | 0.00 | 71 | LAB324 | 30965.3 | 0.008 | 0.00 | 108 |
| LAB325 | 30971.4 | 0.125 | 0.01 | 49 | LAB325 | 30971.4 | 0.007 | 0.02 | 74 |
| LAB325 | 30972.2 | 0.122 | 0.12 | 46 | LAB325 | 30972.2 | 0.007 | 0.01 | 78 |

TABLE 66-continued

Genes showing improved plant performance at standard growth conditions (T2 generation)

| Gene Name | Event # | Plant Fresh Weight [gr.] Ave. | p-val. | % Incr. | Gene Name | Event # | Plant Dry Weight [gr.] Ave. | p-val. | % Incr. |
|---|---|---|---|---|---|---|---|---|---|
| LAB325 | 30973.1 | 0.114 | 0.19 | 37 | LAB325 | 30973.1 | 0.005 | 0.03 | 43 |
| LAB325 | 30975.2 | 0.121 | 0.12 | 45 | LAB325 | 30975.2 | 0.006 | 0.15 | 55 |
| LAB325 | 30975.4 | 0.136 | 0.04 | 62 | LAB325 | 30975.4 | 0.006 | 0.07 | 61 |
| LAB54 | 28133.4 | 0.143 | 0.02 | 70 | LAB54 | 28133.4 | 0.007 | 0.00 | 87 |
| LAB54 | 28134.1 | 0.088 | 0.75 | 5 | LAB54 | 28134.1 | 0.005 | 0.26 | 23 |
| LAB54 | 28136.2 | 0.145 | 0.03 | 73 | LAB54 | 28136.2 | 0.007 | 0.01 | 97 |
| LAB67 | 31021.4 | — | — | — | LAB67 | 31021.4 | 0.004 | 0.35 | 17 |
| LAB67 | 31022.1 | 0.121 | 0.10 | 44 | LAB67 | 31022.1 | 0.007 | 0.03 | 87 |
| LAB67 | 31022.6 | 0.113 | 0.09 | 35 | LAB67 | 31022.6 | 0.007 | 0.00 | 81 |
| LAB67 | 31023.3 | 0.130 | 0.01 | 55 | LAB67 | 31023.3 | 0.008 | 0.00 | 104 |
| LAB67 | 31023.4 | 0.115 | 0.05 | 37 | LAB67 | 31023.4 | 0.005 | 0.06 | 30 |
| LAB68 | 29331.5 | 0.093 | 0.54 | 10 | LAB68 | 29331.5 | 0.005 | 0.18 | 23 |
| LAB73 | 30152.1 | 0.091 | 0.65 | 8 | LAB73 | 30152.1 | 0.005 | 0.16 | 23 |
| LAB73 | 30152.2 | 0.124 | 0.02 | 48 | LAB73 | 30152.2 | 0.006 | 0.01 | 59 |
| LAB73 | 30154.3 | 0.093 | 0.52 | 11 | LAB73 | 30154.3 | 0.004 | 0.30 | 17 |
| LAB74 | 28451.3 | 0.110 | 0.20 | 31 | LAB74 | 28451.3 | 0.005 | 0.21 | 39 |
| LAB74 | 28452.1 | — | — | — | LAB74 | 28452.1 | 0.004 | 0.85 | 3 |
| LAB74 | 28452.2 | 0.162 | 0.06 | 93 | LAB74 | 28452.2 | 0.008 | 0.05 | 128 |
| LAB74 | 28454.1 | 0.122 | 0.02 | 46 | LAB74 | 28454.1 | 0.006 | 0.00 | 64 |
| cont | — | 0.084 | — | 0 | cont | — | 0.004 | — | 0 |
| LAB133 | 28833.2 | — | — | — | LAB133 | 28833.2 | 0.005 | 0.16 | 36 |
| LAB133 | 28833.5 | 0.155 | 0.66 | 14 | LAB133 | 28833.5 | 0.004 | 0.91 | 2 |
| LAB158 | 29411.4 | — | — | — | LAB158 | 29411.4 | 0.004 | 0.98 | 1 |
| LAB158 | 29412.1 | 0.194 | 0.45 | 42 | LAB158 | 29412.1 | 0.005 | 0.26 | 19 |
| LAB158 | 29415.1 | — | — | — | LAB158 | 29415.1 | 0.005 | 0.38 | 15 |
| LAB160 | 29312.1 | — | — | — | LAB160 | 29312.1 | 0.005 | 0.18 | 24 |
| LAB160 | 29314.2 | — | — | — | LAB160 | 29314.2 | 0.005 | 0.13 | 37 |
| LAB162 | 29342.6 | 0.140 | 0.90 | 3 | LAB162 | 29342.6 | 0.005 | 0.48 | 15 |
| LAB162 | 29344.1 | — | — | — | LAB162 | 29344.1 | 0.005 | 0.58 | 14 |
| LAB177 | 29422.1 | — | — | — | LAB177 | 29422.1 | 0.005 | 0.36 | 17 |
| LAB177 | 29424.3 | 0.199 | 0.00 | 46 | LAB177 | 29424.3 | 0.007 | 0.01 | 75 |
| LAB177 | 29424.4 | 0.144 | 0.81 | 5 | LAB177 | 29424.4 | 0.004 | 0.70 | 9 |
| LAB179 | 29302.4 | — | — | — | LAB179 | 29302.4 | 0.004 | 0.51 | 11 |
| LAB179 | 29303.2 | 0.142 | 0.82 | 4 | LAB179 | 29303.2 | 0.006 | 0.06 | 45 |
| LAB179 | 29304.4 | — | — | — | LAB179 | 29304.4 | 0.004 | 0.90 | 3 |
| LAB185 | 28175.2 | — | — | — | LAB185 | 28175.2 | 0.004 | 0.62 | 8 |
| LAB185 | 28175.3 | 0.141 | 0.88 | 3 | LAB185 | 28175.3 | 0.005 | 0.34 | 31 |
| LAB210 | 28331.2 | — | — | — | LAB210 | 28331.2 | 0.004 | 0.93 | 2 |
| LAB210 | 28331.3 | — | — | — | LAB210 | 28331.3 | 0.004 | 0.73 | 9 |
| LAB210 | 28335.3 | — | — | — | LAB210 | 28335.3 | 0.005 | 0.17 | 37 |
| LAB254 | 28814.1 | 0.150 | 0.26 | 10 | LAB254 | 28814.1 | — | — | — |
| LAB254 | 28814.5 | — | — | — | LAB254 | 28814.5 | 0.006 | 0.03 | 58 |
| LAB254 | 28815.3 | 0.141 | 0.81 | 4 | LAB254 | 28815.3 | 0.005 | 0.37 | 15 |
| LAB254 | 28815.4 | 0.146 | 0.65 | 7 | LAB254 | 28815.4 | 0.006 | 0.04 | 56 |
| LAB293 | 29232.2 | 0.147 | 0.67 | 8 | LAB293 | 29232.2 | 0.006 | 0.09 | 46 |
| LAB293 | 29233.2 | — | — | — | LAB293 | 29233.2 | 0.006 | 0.11 | 49 |
| LAB293 | 29233.3 | — | — | — | LAB293 | 29233.3 | 0.006 | 0.14 | 50 |
| LAB293 | 29233.4 | — | — | — | LAB293 | 29233.4 | 0.004 | 0.80 | 4 |
| LAB293 | 29235.4 | 0.141 | 0.63 | 3 | LAB293 | 29235.4 | 0.006 | 0.02 | 53 |
| LAB297 | 29272.1 | — | — | — | LAB297 | 29272.1 | 0.005 | 0.38 | 15 |
| LAB297 | 29272.5 | — | — | — | LAB297 | 29272.5 | 0.005 | 0.15 | 25 |
| LAB297 | 29273.1 | 0.170 | 0.25 | 25 | LAB297 | 29273.1 | 0.007 | 0.00 | 73 |
| LAB297 | 29273.4 | 0.143 | 0.76 | 5 | LAB297 | 29273.4 | 0.005 | 0.30 | 23 |
| LAB297 | 29275.1 | 0.176 | 0.06 | 29 | LAB297 | 29275.1 | 0.008 | 0.00 | 113 |
| LAB310 | 28182.2 | — | — | — | LAB310 | 28182.2 | 0.004 | 0.42 | 13 |
| LAB310 | 28183.3 | 0.166 | 0.27 | 22 | LAB310 | 28183.3 | 0.006 | 0.06 | 59 |
| LAB318 | 28101.5 | — | — | — | LAB318 | 28101.5 | 0.005 | 0.31 | 20 |
| LAB318 | 28101.7 | 0.144 | 0.82 | 6 | LAB318 | 28101.7 | 0.005 | 0.49 | 37 |
| LAB327 | 29221.2 | — | — | — | LAB327 | 29221.2 | 0.004 | 0.94 | 1 |
| LAB327 | 29221.5 | — | — | — | LAB327 | 29221.5 | 0.004 | 0.56 | 11 |
| LAB327 | 29221.6 | — | — | — | LAB327 | 29221.6 | 0.006 | 0.21 | 47 |
| LAB327 | 29221.8 | 0.166 | 0.47 | 22 | LAB327 | 29221.8 | 0.006 | 0.04 | 51 |
| LAB327 | 29225.4 | 0.152 | 0.52 | 11 | LAB327 | 29225.4 | 0.006 | 0.02 | 51 |
| LAB335 | 27311.2 | — | — | — | LAB335 | 27311.2 | 0.004 | 0.97 | 1 |
| LAB335 | 27314.1 | — | — | — | LAB335 | 27314.1 | 0.006 | 0.18 | 43 |
| LAB335 | 27314.2 | 0.168 | 0.06 | 23 | LAB335 | 27314.2 | 0.007 | 0.01 | 70 |
| LAB335 | 27315.4 | — | — | — | LAB335 | 27315.4 | 0.004 | 0.75 | 6 |
| cont | — | 0.136 | — | 0 | cont | — | 0.004 | — | 0 |
| LAB102 | 30313.2 | 0.136 | 0.41 | 36 | LAB102 | 30313.2 | 0.007 | 0.34 | 37 |
| LAB102 | 30313.3 | 0.177 | 0.10 | 77 | LAB102 | 30313.3 | 0.010 | 0.08 | 77 |
| LAB102 | 30314.3 | 0.137 | 0.25 | 38 | LAB102 | 30314.3 | 0.008 | 0.32 | 44 |
| LAB126 | 30201.3 | 0.177 | 0.00 | 77 | LAB126 | 30201.3 | 0.010 | 0.03 | 77 |

TABLE 66-continued

Genes showing improved plant performance at standard growth conditions (T2 generation)

| Gene Name | Event # | Plant Fresh Weight [gr.] Ave. | p-val. | % Incr. | Gene Name | Event # | Plant Dry Weight [gr.] Ave. | p-val. | % Incr. |
|---|---|---|---|---|---|---|---|---|---|
| LAB126 | 30202.3 | 0.142 | 0.04 | 42 | LAB126 | 30202.3 | 0.007 | 0.19 | 24 |
| LAB126 | 30203.3 | 0.149 | 0.07 | 49 | LAB126 | 30203.3 | 0.008 | 0.13 | 42 |
| LAB126 | 30205.1 | 0.181 | 0.00 | 82 | LAB126 | 30205.1 | 0.010 | 0.01 | 81 |
| LAB126 | 30205.3 | 0.126 | 0.09 | 27 | LAB126 | 30205.3 | 0.006 | 0.63 | 11 |
| LAB165 | 30231.1 | 0.220 | 0.08 | 120 | LAB165 | 30231.1 | 0.013 | 0.07 | 137 |
| LAB165 | 30231.2 | 0.134 | 0.71 | 34 | LAB165 | 30231.2 | — | | — |
| LAB165 | 30232.1 | 0.167 | 0.03 | 68 | LAB165 | 30232.1 | 0.010 | 0.06 | 81 |
| LAB165 | 30233.1 | 0.178 | 0.00 | 78 | LAB165 | 30233.1 | 0.009 | 0.02 | 60 |
| LAB165 | 30235.1 | 0.117 | 0.37 | 18 | LAB165 | 30235.1 | 0.007 | 0.30 | 25 |
| LAB167 | 27321.4 | 0.142 | 0.08 | 42 | LAB167 | 27321.4 | 0.008 | 0.15 | 45 |
| LAB167 | 27321.6 | 0.134 | 0.01 | 34 | LAB167 | 27321.6 | 0.006 | 0.56 | 10 |
| LAB167 | 27324.1 | 0.109 | 0.43 | 9 | LAB167 | 27324.1 | 0.005 | 0.88 | 2 |
| LAB220 | 30321.4 | 0.223 | 0.00 | 124 | LAB220 | 30321.4 | 0.010 | 0.05 | 94 |
| LAB220 | 30322.2 | 0.113 | 0.70 | 13 | LAB220 | 30322.2 | — | | — |
| LAB220 | 30322.3 | 0.150 | 0.09 | 50 | LAB220 | 30322.3 | 0.009 | 0.12 | 60 |
| LAB220 | 30323.1 | 0.146 | 0.07 | 47 | LAB220 | 30323.1 | 0.006 | 0.72 | 14 |
| LAB220 | 30324.4 | 0.167 | 0.01 | 67 | LAB220 | 30324.4 | 0.009 | 0.03 | 73 |
| LAB241 | 30211.3 | 0.119 | 0.02 | 19 | LAB241 | 30211.3 | — | | — |
| LAB241 | 30212.1 | 0.115 | 0.02 | 15 | LAB241 | 30212.1 | 0.006 | 0.29 | 14 |
| LAB241 | 30212.2 | 0.106 | 0.66 | 7 | LAB241 | 30212.2 | — | | — |
| LAB241 | 30213.1 | 0.134 | 0.11 | 34 | LAB241 | 30213.1 | 0.007 | 0.34 | 26 |
| LAB268 | 30392.2 | 0.127 | 0.33 | 27 | LAB268 | 30392.2 | 0.007 | 0.27 | 34 |
| LAB268 | 30393.3 | 0.112 | 0.65 | 12 | LAB268 | 30393.3 | — | | — |
| LAB268 | 30395.1 | 0.172 | 0.01 | 72 | LAB268 | 30395.1 | 0.010 | 0.00 | 79 |
| LAB280 | 30041.1 | 0.190 | 0.05 | 90 | LAB280 | 30041.1 | 0.010 | 0.03 | 81 |
| LAB280 | 30044.1 | 0.141 | 0.03 | 41 | LAB280 | 30044.1 | 0.007 | 0.24 | 29 |
| LAB280 | 30045.1 | 0.103 | 0.83 | 3 | LAB280 | 30045.1 | — | | — |
| LAB280 | 30045.3 | 0.138 | 0.06 | 38 | LAB280 | 30045.3 | 0.008 | 0.07 | 48 |
| LAB289 | 30371.2 | 0.103 | 0.72 | 3 | LAB289 | 30371.2 | — | | — |
| LAB289 | 30371.4 | 0.175 | 0.03 | 76 | LAB289 | 30371.4 | 0.010 | 0.04 | 90 |
| LAB289 | 30371.6 | 0.149 | 0.06 | 50 | LAB289 | 30371.6 | 0.007 | 0.16 | 36 |
| LAB289 | 30375.2 | 0.255 | 0.00 | 156 | LAB289 | 30375.2 | 0.013 | 0.00 | 151 |
| LAB289 | 30375.3 | 0.201 | 0.04 | 102 | LAB289 | 30375.3 | 0.010 | 0.00 | 92 |
| LAB303 | 30423.4 | 0.116 | 0.22 | 16 | LAB303 | 30423.4 | 0.006 | 0.51 | 8 |
| LAB303 | 30424.3 | 0.113 | 0.04 | 13 | LAB303 | 30424.3 | 0.007 | 0.13 | 37 |
| LAB303 | 30425.3 | 0.109 | 0.70 | 9 | LAB303 | 30425.3 | 0.006 | 0.74 | 7 |
| cont | — | 0.100 | — | 0 | cont | — | 0.005 | — | 0 |
| LAB303 | 30421.2 | — | | — | LAB303 | 30421.2 | 0.005 | 0.55 | 11 |
| LAB311 | 30221.4 | — | | — | LAB311 | 30221.4 | 0.005 | 0.43 | 11 |
| LAB311 | 30223.4 | 0.160 | 0.05 | 78 | LAB311 | 30223.4 | 0.008 | 0.08 | 80 |
| LAB311 | 30224.2 | — | | — | LAB311 | 30224.2 | 0.005 | 0.98 | 0 |
| LAB344 | 30092.3 | 0.127 | 0.22 | 41 | LAB344 | 30092.3 | 0.005 | 0.45 | 14 |
| LAB344 | 30096.1 | 0.113 | 0.04 | 25 | LAB344 | 30096.1 | 0.006 | 0.18 | 22 |
| LAB344 | 30096.3 | 0.106 | 0.11 | 18 | LAB344 | 30096.3 | 0.006 | 0.13 | 22 |
| LAB355 | 29281.3 | 0.138 | 0.13 | 53 | LAB355 | 29281.3 | 0.007 | 0.12 | 59 |
| LAB355 | 29282.1 | 0.093 | 0.85 | 3 | LAB355 | 29282.1 | — | | — |
| LAB355 | 29282.2 | 0.154 | 0.01 | 71 | LAB355 | 29282.2 | 0.008 | 0.04 | 85 |
| LAB355 | 29282.3 | 0.092 | 0.84 | 2 | LAB355 | 29282.3 | 0.005 | 0.81 | 4 |
| LAB367 | 30171.3 | 0.111 | 0.18 | 23 | LAB367 | 30171.3 | 0.005 | 0.29 | 17 |
| LAB367 | 30173.1 | 0.101 | 0.29 | 12 | LAB367 | 30173.1 | 0.005 | 0.65 | 9 |
| LAB367 | 30173.3 | 0.116 | 0.22 | 29 | LAB367 | 30173.3 | 0.006 | 0.33 | 28 |
| LAB381 | 30351.4 | 0.104 | 0.39 | 16 | LAB381 | 30351.4 | 0.005 | 0.06 | 22 |
| LAB381 | 30352.2 | 0.155 | 0.04 | 72 | LAB381 | 30352.2 | 0.007 | 0.04 | 58 |
| LAB381 | 30352.4 | 0.117 | 0.13 | 30 | LAB381 | 30352.4 | 0.006 | 0.32 | 26 |
| LAB381 | 30354.2 | 0.185 | 0.00 | 106 | LAB381 | 30354.2 | 0.009 | 0.00 | 98 |
| LAB381 | 30356.1 | 0.146 | 0.02 | 62 | LAB381 | 30356.1 | 0.007 | 0.02 | 52 |
| LAB383 | 28111.1 | 0.100 | 0.43 | 11 | LAB383 | 28111.1 | 0.005 | 0.09 | 20 |
| LAB383 | 28111.3 | 0.139 | 0.19 | 54 | LAB383 | 28111.3 | 0.006 | 0.41 | 38 |
| LAB383 | 28111.4 | 0.102 | 0.53 | 14 | LAB383 | 28111.4 | 0.005 | 0.48 | 13 |
| LAB383 | 28115.2 | 0.110 | 0.06 | 22 | LAB383 | 28115.2 | 0.006 | 0.02 | 36 |
| LAB383 | 28115.5 | 0.105 | 0.68 | 16 | LAB383 | 28115.5 | — | | — |
| LAB64 | 30271.2 | 0.165 | 0.21 | 84 | LAB64 | 30271.2 | 0.008 | 0.15 | 71 |
| LAB64 | 30272.1 | 0.140 | 0.10 | 55 | LAB64 | 30272.1 | 0.007 | 0.01 | 48 |
| LAB64 | 30273.2 | 0.173 | 0.16 | 92 | LAB64 | 30273.2 | 0.008 | 0.14 | 77 |
| LAB64 | 30274.2 | 0.101 | 0.61 | 12 | LAB64 | 30274.2 | 0.005 | 0.79 | 5 |
| LAB65 | 30303.4 | 0.111 | 0.02 | 23 | LAB65 | 30303.4 | 0.005 | 0.72 | 6 |
| LAB65 | 30304.3 | 0.102 | 0.58 | 14 | LAB65 | 30304.3 | 0.005 | 0.73 | 8 |
| LAB92 | 29321.2 | 0.117 | 0.03 | 30 | LAB92 | 29321.2 | 0.007 | 0.05 | 48 |
| LAB92 | 29322.1 | 0.112 | 0.30 | 25 | LAB92 | 29322.1 | 0.006 | 0.09 | 38 |
| LAB92 | 29323.2 | 0.118 | 0.00 | 31 | LAB92 | 29323.2 | 0.007 | 0.00 | 58 |
| LAB92 | 29324.2 | 0.123 | 0.21 | 36 | LAB92 | 29324.2 | 0.006 | 0.35 | 33 |
| cont | — | 0.090 | — | 0 | cont | — | 0.004 | — | 0 |

TABLE 66-continued

Genes showing improved plant performance at standard growth conditions (T2 generation)

| Gene Name | Event # | Plant Fresh Weight [gr.] Ave. | p-val. | % Incr. | Gene Name | Event # | Plant Dry Weight [gr.] Ave. | p-val. | % Incr. |
|---|---|---|---|---|---|---|---|---|---|
| LAB172 | 30852.3 | 0.110 | 0.85 | 6 | LAB172 | 30852.3 | 0.006 | 0.63 | 19 |
| LAB172 | 30852.4 | 0.114 | 0.61 | 10 | LAB172 | 30852.4 | 0.005 | 0.66 | 5 |
| LAB172 | 30853.4 | 0.113 | 0.60 | 9 | LAB172 | 30853.4 | 0.006 | 0.14 | 17 |
| LAB172 | 30854.1 | 0.137 | 0.09 | 32 | LAB172 | 30854.1 | 0.006 | 0.12 | 24 |
| LAB172 | 30854.4 | 0.109 | 0.56 | 5 | LAB172 | 30854.4 | 0.005 | 0.39 | 11 |
| LAB188 | 30722.2 | 0.127 | 0.00 | 22 | LAB188 | 30722.2 | 0.006 | 0.18 | 19 |
| LAB188 | 30724.1 | 0.104 | 0.98 | 0 | LAB188 | 30724.1 | — | — | — |
| LAB243 | 27101.1 | — | — | — | LAB243 | 27101.1 | 0.005 | 0.81 | 6 |
| LAB243 | 30872.1 | 0.126 | 0.03 | 21 | LAB243 | 30872.1 | 0.005 | 0.90 | 2 |
| LAB243 | 30873.2 | 0.119 | 0.26 | 15 | LAB243 | 30873.2 | 0.005 | 0.56 | 11 |
| LAB243 | 30873.4 | 0.132 | 0.32 | 27 | LAB243 | 30873.4 | 0.005 | 0.56 | 15 |
| LAB270 | 30591.2 | 0.109 | 0.79 | 5 | LAB270 | 30591.2 | 0.005 | 0.81 | 5 |
| LAB270 | 30594.1 | 0.115 | 0.73 | 11 | LAB270 | 30594.1 | 0.005 | 0.95 | 3 |
| LAB270 | 30595.1 | 0.113 | 0.55 | 9 | LAB270 | 30595.1 | 0.006 | 0.08 | 25 |
| LAB270 | 30595.2 | 0.107 | 0.78 | 3 | LAB270 | 30595.2 | 0.005 | 0.99 | 0 |
| LAB291 | 31851.2 | 0.143 | 0.20 | 37 | LAB291 | 31851.2 | 0.008 | 0.10 | 60 |
| LAB291 | 31851.3 | 0.174 | 0.00 | 68 | LAB291 | 31851.3 | 0.010 | 0.00 | 108 |
| LAB291 | 31852.4 | 0.104 | 0.91 | 1 | LAB291 | 31852.4 | 0.005 | 0.30 | 14 |
| LAB291 | 31853.3 | 0.168 | 0.09 | 62 | LAB291 | 31853.3 | 0.008 | 0.08 | 77 |
| LAB295 | 31861.3 | 0.205 | 0.02 | 97 | LAB295 | 31861.3 | 0.010 | 0.05 | 105 |
| LAB295 | 31863.1 | 0.176 | 0.00 | 70 | LAB295 | 31863.1 | 0.007 | 0.05 | 55 |
| LAB295 | 31864.3 | — | — | — | LAB295 | 31864.3 | 0.005 | 0.39 | 14 |
| LAB295 | 31864.4 | 0.179 | 0.04 | 73 | LAB295 | 31864.4 | 0.010 | 0.03 | 107 |
| LAB295 | 31865.1 | 0.133 | 0.08 | 28 | LAB295 | 31865.1 | 0.006 | 0.28 | 30 |
| LAB323 | 30381.4 | 0.179 | 0.01 | 72 | LAB323 | 30381.4 | 0.009 | 0.02 | 91 |
| LAB323 | 30383.2 | 0.125 | 0.19 | 20 | LAB323 | 30383.2 | 0.006 | 0.22 | 22 |
| LAB347_H0 | 30443.4 | 0.113 | 0.48 | 9 | LAB347_H0 | 30443.4 | — | — | — |
| LAB347_H0 | 30444.3 | — | — | — | LAB347_H0 | 30444.3 | 0.005 | 0.47 | 13 |
| LAB55 | 30023.1 | 0.105 | 0.95 | 1 | LAB55 | 30023.1 | 0.005 | 0.90 | 3 |
| LAB55 | 30023.3 | 0.109 | 0.70 | 5 | LAB55 | 30023.3 | 0.005 | 0.82 | 2 |
| LAB55 | 30025.4 | 0.117 | 0.41 | 13 | LAB55 | 30025.4 | 0.005 | 0.26 | 11 |
| cont | — | 0.104 | — | 0 | cont | — | 0.005 | — | 0 |

Table 66.
"CONT."—Control;
"Ave."—Average;
"% Incr." = % increment;
"p-val."—p-value.

TABLE 67

Genes showing improved plant performance at standard growth conditions (T2 generation)

| Gene Name | Event # | Leaf Area cm2 Average | p-value | % |
|---|---|---|---|---|
| LAB115 | 27281.2 | 0.964339 | 0.013896 | 87.0544 |
| LAB115 | 27285.2 | 0.703859 | 0.034395 | 36.5287 |
| LAB115 | 27282.3 | 0.691498 | 0.011799 | 34.131 |
| LAB115 | 27284.3 | 0.637459 | 0.018631 | 23.6489 |
| LAB115 | 27285.4 | 0.581055 | 0.346956 | 12.7082 |
| LAB123 | 28285.2 | 0.880773 | 0.003678 | 70.845 |
| LAB123 | 28282.3 | 0.684156 | 0.185972 | 32.7068 |
| LAB123 | 28284.2 | 0.561489 | 0.202145 | 8.9129 |
| LAB183 | 27452.2 | 0.729433 | 0.011883 | 41.4893 |
| LAB183 | 27453.1 | 0.551671 | 0.46273 | 7.0085 |
| LAB183 | 27453.4 | 0.55158 | 0.374386 | 6.991 |
| LAB183 | 27454.2 | 0.549893 | 0.635914 | 6.6637 |
| LAB189 | 28165.2 | 0.617244 | 0.329471 | 19.7279 |
| LAB189 | 28163.2 | 0.614309 | 0.012452 | 19.1585 |
| LAB212 | 28043.2 | 1.00535 | 0.000013 | 95.0089 |
| LAB212 | 28042.1 | 0.838401 | 0.003372 | 62.626 |
| LAB217 | 28036.4 | 0.623324 | 0.040456 | 20.9071 |
| LAB217 | 28033.2 | 0.587875 | 0.288119 | 14.031 |
| LAB217 | 28035.3 | 0.579953 | 0.294639 | 12.4943 |
| LAB217 | 28034.1 | 0.574177 | 0.425468 | 11.3741 |
| LAB217 | 28035.1 | 0.547847 | 0.522663 | 6.2667 |
| LAB326 | 28056.2 | 0.740571 | 0.013877 | 43.6498 |
| LAB326 | 28054.1 | 0.63084 | 0.004147 | 22.365 |
| LAB326 | 28056.3 | 0.615326 | 0.018674 | 19.3558 |
| LAB326 | 28053.2 | 0.587856 | 0.428896 | 14.0274 |
| LAB326 | 28052.4 | 0.525676 | 0.758332 | 1.9662 |
| control | — | 0.515539 | — | 0 |
| LAB115 | 27285.1 | 0.654835 | 0.181339 | 50.3918 |
| LAB115 | 27284.3 | 0.464371 | 0.656973 | 6.6491 |
| LAB123 | 28285.2 | 0.79278 | 0.000306 | 82.0727 |
| LAB123 | 28281.1 | 0.760842 | 0 | 74.7379 |
| LAB123 | 28283.1 | 0.737626 | 0.009246 | 69.4059 |
| LAB123 | 28282.3 | 0.674296 | 0.00804 | 54.8613 |
| LAB123 | 28284.1 | 0.561539 | 0.0622 | 28.9651 |
| LAB183 | 27453.4 | 0.557416 | 0.060135 | 28.0182 |
| LAB189 | 28166.5 | 0.618046 | 0.221622 | 41.9427 |
| LAB189 | 28166.2 | 0.560812 | 0.078502 | 28.7982 |
| LAB206 | 30011.2 | 0.719182 | 0.000224 | 65.17 |
| LAB206 | 30012.8 | 0.63377 | 0.007427 | 45.554 |
| LAB206 | 30012.4 | 0.528598 | 0.272686 | 21.3997 |
| LAB212 | 28045.1 | 0.561399 | 0.055832 | 28.9329 |
| LAB212 | 28044.2 | 0.443899 | 0.880761 | 1.9475 |

TABLE 67-continued

Genes showing improved plant performance at standard growth conditions (T2 generation)

| Gene Name | Event # | Leaf Area cm2 Average | p-value | % |
|---|---|---|---|---|
| LAB217 | 28034.1 | 0.720073 | 0.147853 | 65.3745 |
| LAB217 | 28034.3 | 0.693277 | 0.000384 | 59.2207 |
| LAB217 | 28033.2 | 0.649519 | 0.050889 | 49.1709 |
| LAB217 | 28035.1 | 0.647442 | 0.021799 | 48.694 |
| LAB217 | 28036.1 | 0.625611 | 0.014278 | 43.6801 |
| LAB250 | 30254.3 | 0.509265 | 0.211666 | 16.9597 |
| LAB250 | 30251.2 | 0.498755 | 0.587892 | 14.546 |
| LAB314 | 29292.6 | 0.626665 | 0.005137 | 43.9222 |
| LAB314 | 29295.2 | 0.583407 | 0.100763 | 33.9875 |
| LAB314 | 29292.4 | 0.483902 | 0.294668 | 11.1348 |
| LAB314 | 29294.1 | 0.47026 | 0.742945 | 8.0016 |
| LAB326 | 28052.4 | 0.503017 | 0.214763 | 15.5248 |
| LAB326 | 28056.3 | 0.499111 | 0.242952 | 14.6277 |
| LAB351 | 30114.2 | 0.516579 | 0.195965 | 18.6395 |
| LAB351 | 30112.1 | 0.458559 | 0.543647 | 5.3143 |
| LAB93 | 28272.3 | 0.771691 | 0.007464 | 77.2295 |
| LAB93 | 28274.2 | 0.581733 | 0.054986 | 33.6031 |
| LAB93 | 28271.4 | 0.579812 | 0.280953 | 33.1618 |
| LAB93 | 28271.3 | 0.533924 | 0.054653 | 22.6229 |
| LAB93 | 28274.3 | 0.491127 | 0.564728 | 12.7941 |
| control | — | 0.435419 | — | 0 |
| LAB106 | 30032.1 | 0.723816 | 0.012801 | 29.8087 |
| LAB106 | 30032.2 | 0.722682 | 0.011628 | 29.6053 |
| LAB206 | 30011.7 | 0.704816 | 0.00301 | 26.4013 |
| LAB206 | 30012.4 | 0.657192 | 0.45519 | 17.8604 |
| LAB206 | 30012.8 | 0.57122 | 0.777785 | 2.4423 |
| LAB207 | 28843.3 | 0.782921 | 0.03371 | 40.4086 |
| LAB207 | 28842.1 | 0.616624 | 0.38537 | 10.585 |
| LAB218 | 29432.2 | 0.695563 | 0.136561 | 24.7418 |
| LAB218 | 29434.3 | 0.624576 | 0.247453 | 12.0111 |
| LAB250 | 30253.1 | 0.706539 | 0.196507 | 26.7102 |
| LAB252 | 30292.3 | 0.968018 | 0.023801 | 73.6036 |
| LAB252 | 30291.4 | 0.57611 | 0.619725 | 3.3192 |
| LAB309 | 30052.2 | 0.897472 | 0.113733 | 60.9521 |
| LAB309 | 30052.3 | 0.674209 | 0.053248 | 20.9122 |
| LAB314 | 29292.4 | 0.787998 | 0.239493 | 41.3191 |
| LAB314 | 29295.2 | 0.768455 | 0.005633 | 37.8143 |
| LAB314 | 29292.6 | 0.724321 | 0.037385 | 29.8992 |
| LAB314 | 29294.1 | 0.600479 | 0.398186 | 7.6896 |
| LAB346 | 29443.2 | 0.64071 | 0.202974 | 14.9044 |
| LAB346 | 29445.3 | 0.632711 | 0.097448 | 13.4699 |
| LAB346 | 29445.2 | 0.562424 | 0.907563 | 0.8648 |
| LAB351 | 30111.2 | 0.65342 | 0.178377 | 17.1839 |
| LAB351 | 30114.2 | 0.610448 | 0.293404 | 9.4773 |
| LAB351 | 30112.1 | 0.585823 | 0.615092 | 5.0611 |
| LAB84 | 30163.4 | 0.806793 | 0.055434 | 44.6897 |
| LAB84 | 30162.3 | 0.788386 | 0.015253 | 41.3886 |
| LAB84 | 30164.2 | 0.720826 | 0.017483 | 29.2724 |
| LAB84 | 30162.4 | 0.690753 | 0.190995 | 23.8792 |
| control | — | 0.557602 | — | 0 |
| LAB110 | 30574.2 | 0.734487 | 0.028921 | 29.3177 |
| LAB110 | 30571.3 | 0.711639 | 0.128819 | 25.295 |
| LAB110 | 30572.1 | 0.622355 | 0.321196 | 9.5751 |
| LAB117 | 27293.1 | 0.77058 | 0.036891 | 35.6725 |
| LAB117 | 27291.5 | 0.69631 | 0.176156 | 22.596 |
| LAB117 | 27291.1 | 0.632048 | 0.555526 | 11.2817 |
| LAB124 | 30435.2 | 0.77462 | 0.010017 | 36.3837 |
| LAB124 | 30434.3 | 0.758946 | 0.001541 | 33.6241 |
| LAB124 | 30431.1 | 0.704273 | 0.058834 | 23.9982 |
| LAB124 | 30432.3 | 0.570278 | 0.96687 | 0.4062 |
| LAB125 | 30583.2 | 0.76278 | 0.097554 | 34.2992 |
| LAB156 | 30402.2 | 0.83601 | 0.009952 | 47.1924 |
| LAB156 | 30401.4 | 0.783884 | 0.029835 | 38.0147 |
| LAB156 | 30403.1 | 0.673501 | 0.114477 | 18.5801 |
| LAB228 | 30081.4 | 0.630465 | 0.404999 | 11.0031 |
| LAB275 | 30361.3 | 0.866078 | 0.013576 | 52.4864 |
| LAB275 | 30363.4 | 0.621543 | 0.146929 | 9.4321 |
| LAB275 | 30366.2 | 0.577829 | 0.87588 | 1.7357 |
| LAB276_H0 | 30331.1 | 0.944038 | 0.006298 | 66.2123 |
| LAB276_H0 | 30333.7 | 0.68324 | 0.006713 | 20.295 |
| LAB276_H0 | 30331.4 | 0.645969 | 0.192398 | 13.7327 |
| LAB277 | 30652.3 | 0.796859 | 0.005764 | 40.2993 |
| LAB277 | 30651.2 | 0.628342 | 0.170612 | 10.6293 |
| LAB277 | 30652.5 | 0.608001 | 0.413544 | 7.0479 |
| LAB277 | 30653.1 | 0.572323 | 0.950563 | 0.7662 |
| LAB278 | 30413.3 | 0.792076 | 0.079166 | 39.4572 |
| LAB278 | 30412.1 | 0.633165 | 0.56395 | 11.4785 |
| LAB278 | 30411.4 | 0.597489 | 0.337027 | 5.1971 |
| LAB278 | 30414.2 | 0.589101 | 0.845278 | 3.7203 |
| LAB281 | 30741.1 | 0.639101 | 0.089129 | 12.5235 |
| LAB282 | 30751.3 | 0.643967 | 0.239754 | 13.3804 |
| control | — | 0.567971 | — | 0 |
| LAB110 | 30572.2 | 0.77759 | 0.000004 | 51.7564 |
| LAB110 | 30574.2 | 0.720859 | 0.051278 | 40.6846 |
| LAB110 | 30573.2 | 0.67729 | 0.035153 | 32.1816 |
| LAB110 | 30572.1 | 0.516731 | 0.963941 | 0.8465 |
| LAB117 | 27293.1 | 0.842982 | 0.013726 | 64.5183 |
| LAB117 | 27291.2 | 0.649287 | 0.000129 | 26.7164 |
| LAB117 | 27296.1 | 0.577627 | 0.029784 | 12.7311 |
| LAB124 | 30434.1 | 0.667085 | 0.07449 | 30.19 |
| LAB124 | 30432.3 | 0.560015 | 0.528639 | 9.2939 |
| LAB125 | 30584.2 | 0.772097 | 0.021392 | 50.6843 |
| LAB125 | 30582.2 | 0.718997 | 0.016148 | 40.3211 |
| LAB125 | 30581.3 | 0.622918 | 0.021646 | 21.5701 |
| LAB156 | 30401.4 | 0.742146 | 0.113185 | 44.839 |
| LAB156 | 30405.3 | 0.651716 | 0.202407 | 27.1904 |
| LAB156 | 30402.2 | 0.581865 | 0.012844 | 13.5581 |
| LAB156 | 30403.1 | 0.525099 | 0.681278 | 2.4796 |
| LAB228 | 30082.5 | 0.616243 | 0.011956 | 20.2675 |
| LAB228 | 30084.4 | 0.613138 | 0.1517 | 19.6614 |
| LAB228 | 30084.3 | 0.550483 | 0.371091 | 7.4335 |
| LAB275 | 30363.1 | 0.746834 | 0.022118 | 45.7539 |
| LAB275 | 30361.2 | 0.696946 | 0.199151 | 36.0176 |
| LAB275 | 30363.4 | 0.679313 | 0.124318 | 32.5763 |
| LAB275 | 30366.4 | 0.608945 | 0.133068 | 18.843 |
| LAB275 | 30361.3 | 0.516182 | 0.952809 | 0.7392 |
| LAB276_H0 | 30331.4 | 0.84916 | 0.003316 | 65.724 |
| LAB276_H0 | 30331.1 | 0.650013 | 0.000417 | 26.8581 |
| LAB276_H0 | 30333.7 | 0.518971 | 0.928342 | 1.2836 |
| LAB277 | 30652.6 | 0.655957 | 0.041979 | 28.0182 |
| LAB277 | 30653.1 | 0.609947 | 0.049875 | 19.0387 |
| LAB277 | 30651.2 | 0.579057 | 0.368045 | 13.0102 |
| LAB277 | 30652.5 | 0.539384 | 0.525711 | 5.2674 |
| LAB278 | 30414.1 | 0.822146 | 0.033628 | 60.4519 |
| LAB278 | 30413.3 | 0.791388 | 0.011441 | 54.4491 |
| LAB278 | 30411.4 | 0.771579 | 0.076921 | 50.5833 |
| LAB278 | 30414.2 | 0.532084 | 0.71557 | 3.8428 |
| LAB281 | 30742.4 | 0.670126 | 0.000053 | 30.7834 |
| LAB281 | 30743.4 | 0.581568 | 0.372204 | 13.5001 |
| LAB282 | 30753.4 | 0.625978 | 0.177394 | 22.1674 |
| control | — | 0.512394 | — | 0 |
| LAB106 | 30035.2 | 0.637126 | 0.265528 | 21.2285 |
| LAB128 | 28074.1 | 0.570778 | 0.615867 | 8.604 |
| LAB207 | 28842.1 | 0.570128 | 0.690075 | 8.4804 |
| LAB218 | 29433.4 | 0.552941 | 0.717344 | 5.2102 |
| LAB218 | 29432.2 | 0.530023 | 0.952308 | 0.8495 |
| LAB252 | 30292.3 | 0.612765 | 0.266241 | 16.5932 |
| LAB252 | 30292.4 | 0.559078 | 0.474401 | 6.378 |
| LAB309 | 30056.1 | 0.682104 | 0.104587 | 29.7866 |
| LAB309 | 30052.3 | 0.639407 | 0.141064 | 21.6624 |
| LAB309 | 30052.2 | 0.568337 | 0.431813 | 8.1396 |
| LAB309 | 30055.4 | 0.531642 | 0.925308 | 1.1575 |
| LAB337 | 27265.2 | 0.63099 | 0.068733 | 20.0609 |
| LAB346 | 29445.6 | 0.549668 | 0.741571 | 4.5875 |
| LAB84 | 30162.4 | 0.675773 | 0.009133 | 28.5819 |
| control | — | 0.525558 | — | 0 |
| LAB127 | 30811.1 | 0.699933 | 0.078768 | 21.4292 |
| LAB127 | 30813.2 | 0.649248 | 0.317551 | 12.636 |
| LAB127 | 30811.4 | 0.611186 | 0.558994 | 6.0328 |
| LAB128 | 28075.2 | 0.83949 | 0.060961 | 45.6405 |
| LAB128 | 28075.1 | 0.612047 | 0.54639 | 6.1821 |
| LAB128 | 28071.2 | 0.594551 | 0.697508 | 3.1468 |
| LAB147 | 31104.1 | 0.763106 | 0.002039 | 32.3889 |
| LAB147 | 31105.6 | 0.720308 | 0.002157 | 24.964 |
| LAB147 | 31105.7 | 0.652608 | 0.271404 | 13.2189 |
| LAB147 | 31104.2 | 0.584448 | 0.907044 | 1.3941 |

TABLE 67-continued

Genes showing improved plant performance at standard growth conditions (T2 generation)

| Gene Name | Event # | Leaf Area cm2 Average | p-value | % |
|---|---|---|---|---|
| LAB186 | 31001.4 | 0.693651 | 0.314768 | 20.3394 |
| LAB186 | 31003.1 | 0.650882 | 0.134514 | 12.9195 |
| LAB186 | 31004.2 | 0.622266 | 0.408928 | 7.955 |
| LAB186 | 31002.1 | 0.593455 | 0.839586 | 2.9567 |
| LAB197 | 31084.3 | 0.734428 | 0.116216 | 27.4136 |
| LAB197 | 31081.2 | 0.629811 | 0.589594 | 9.2639 |
| LAB197 | 31085.3 | 0.592205 | 0.820728 | 2.7398 |
| LAB315 | 31063.1 | 0.67026 | 0.170578 | 16.2812 |
| LAB315 | 31061.1 | 0.588105 | 0.877249 | 2.0285 |
| LAB317 | 30951.1 | 0.718688 | 0.000645 | 24.6829 |
| LAB317 | 30953.1 | 0.609517 | 0.6212 | 5.7432 |
| LAB317 | 30952.2 | 0.585028 | 0.84186 | 1.4947 |
| LAB324 | 30961.1 | 0.663113 | 0.268961 | 15.0413 |
| LAB325 | 30972.2 | 0.843869 | 0.083553 | 46.4002 |
| LAB325 | 30975.4 | 0.810423 | 0.028732 | 40.5977 |
| LAB325 | 30975.1 | 0.777681 | 0.101742 | 34.9174 |
| LAB325 | 30973.1 | 0.626675 | 0.447471 | 8.7198 |
| LAB325 | 30971.4 | 0.596059 | 0.681488 | 3.4084 |
| LAB67 | 31022.1 | 1.13073 | 0.000111 | 96.1664 |
| LAB67 | 31023.3 | 0.764159 | 0.01857 | 32.5715 |
| LAB67 | 31022.6 | 0.745947 | 0.003061 | 29.412 |
| LAB67 | 31021.4 | 0.680635 | 0.414787 | 18.0813 |
| LAB67 | 31023.4 | 0.579657 | 0.95393 | 0.5629 |
| LAB80 | 30671.2 | 0.58512 | 0.885718 | 1.5106 |
| control | — | 0.576413 | — | 0 |
| LAB147 | 31103.2 | 0.579468 | 0.024022 | 60.0769 |
| LAB147 | 31105.6 | 0.563769 | 0.031791 | 55.7401 |
| LAB147 | 31105.7 | 0.520099 | 0.066036 | 43.6764 |
| LAB147 | 31104.2 | 0.459623 | 0.250372 | 26.9699 |
| LAB147 | 31104.1 | 0.399038 | 0.684285 | 10.2334 |
| LAB178 | 30633.4 | 0.566679 | 0.174168 | 56.5441 |
| LAB178 | 30633.3 | 0.412041 | 0.573475 | 13.8254 |
| LAB178 | 30632.1 | 0.364484 | 0.973995 | 0.6881 |
| LAB186 | 31001.4 | 0.543608 | 0.121179 | 50.1707 |
| LAB186 | 31003.1 | 0.458824 | 0.305864 | 26.7493 |
| LAB186 | 31002.1 | 0.429298 | 0.372677 | 18.5926 |
| LAB186 | 31004.1 | 0.421352 | 0.405664 | 16.3977 |
| LAB186 | 31004.2 | 0.381056 | 0.790908 | 5.2659 |
| LAB197 | 31081.3 | 0.447132 | 0.317767 | 23.5192 |
| LAB197 | 31084.4 | 0.441373 | 0.268369 | 21.9284 |
| LAB247 | 28094.3 | 0.501037 | 0.127168 | 38.4106 |
| LAB247 | 28094.1 | 0.500962 | 0.155536 | 38.3898 |
| LAB247 | 28091.4 | 0.405734 | 0.582216 | 12.0831 |
| LAB315 | 31061.2 | 0.509847 | 0.083665 | 40.8441 |
| LAB315 | 31064.3 | 0.450695 | 0.25215 | 24.5036 |
| LAB315 | 31063.1 | 0.40337 | 0.628302 | 11.4303 |
| LAB317 | 30954.4 | 0.559928 | 0.035218 | 54.6791 |
| LAB317 | 30952.2 | 0.49429 | 0.174476 | 36.5466 |
| LAB317 | 30953.1 | 0.454966 | 0.293941 | 25.6834 |
| LAB317 | 30952.3 | 0.429779 | 0.477825 | 18.7256 |
| LAB324 | 30961.1 | 0.571411 | 0.027953 | 57.8511 |
| LAB324 | 30965.3 | 0.501905 | 0.133545 | 38.6501 |
| LAB324 | 30965.2 | 0.487534 | 0.196838 | 34.6804 |
| LAB324 | 30963.1 | 0.458051 | 0.236222 | 26.5356 |
| LAB325 | 30971.4 | 0.524431 | 0.068823 | 44.8731 |
| LAB325 | 30972.2 | 0.515318 | 0.186879 | 42.3556 |
| LAB325 | 30975.2 | 0.509229 | 0.148937 | 40.6734 |
| LAB325 | 30975.4 | 0.46759 | 0.173195 | 29.1708 |
| LAB325 | 30973.1 | 0.437435 | 0.299599 | 20.8406 |
| LAB54 | 28136.2 | 0.601963 | 0.018381 | 66.2911 |
| LAB54 | 28133.4 | 0.557787 | 0.041597 | 54.0875 |
| LAB54 | 28134.1 | 0.413286 | 0.543945 | 14.1695 |
| LAB54 | 28133.1 | 0.375629 | 0.843555 | 3.7667 |
| LAB54 | 28136.1 | 0.374874 | 0.875692 | 3.5582 |
| LAB67 | 31023.3 | 0.558919 | 0.120713 | 54.4004 |
| LAB67 | 31022.6 | 0.536363 | 0.064522 | 48.1691 |
| LAB67 | 31022.1 | 0.475211 | 0.376614 | 31.2762 |
| LAB67 | 31023.4 | 0.465101 | 0.268764 | 28.4832 |
| LAB73 | 30152.1 | 0.427346 | 0.369466 | 18.0536 |
| LAB73 | 30154.3 | 0.389267 | 0.741543 | 7.5342 |
| LAB73 | 30152.2 | 0.362926 | 0.988979 | 0.2575 |
| LAB74 | 28452.2 | 0.588345 | 0.072823 | 62.5292 |
| LAB74 | 28454.1 | 0.516461 | 0.102621 | 42.6713 |
| LAB74 | 28451.3 | 0.483615 | 0.147453 | 33.5977 |
| control | — | 0.361994 | — | 0 |
| LAB133 | 28833.2 | 0.43867 | 0.175841 | 15.9088 |
| LAB133 | 28833.5 | 0.403819 | 0.59656 | 6.7002 |
| LAB158 | 29411.4 | 0.393777 | 0.514806 | 4.0469 |
| LAB160 | 29314.2 | 0.503705 | 0.071763 | 33.093 |
| LAB160 | 29312.1 | 0.446023 | 0.076057 | 17.8516 |
| LAB160 | 29311.2 | 0.380338 | 0.962448 | 0.496 |
| LAB162 | 29341.2 | 0.390865 | 0.794938 | 3.2774 |
| LAB177 | 29424.3 | 0.541166 | 0.002961 | 42.9911 |
| LAB177 | 29422.1 | 0.402434 | 0.450392 | 6.3343 |
| LAB177 | 29425.1 | 0.387949 | 0.757547 | 2.507 |
| LAB177 | 29424.4 | 0.387818 | 0.754189 | 2.4724 |
| LAB179 | 29303.2 | 0.482723 | 0.067964 | 27.5489 |
| LAB185 | 28175.3 | 0.388827 | 0.84495 | 2.7389 |
| LAB210 | 28335.3 | 0.45284 | 0.028836 | 19.6531 |
| LAB210 | 28331.2 | 0.381437 | 0.934228 | 0.7864 |
| LAB254 | 28814.5 | 0.530141 | 0.009716 | 40.7071 |
| LAB254 | 28815.4 | 0.461687 | 0.023655 | 21.9905 |
| LAB254 | 28815.3 | 0.4508 | 0.139133 | 19.114 |
| LAB254 | 28814.1 | 0.447571 | 0.050948 | 18.2608 |
| LAB293 | 29232.2 | 0.530435 | 0.113439 | 40.1558 |
| LAB293 | 29233.3 | 0.476306 | 0.013212 | 25.8532 |
| LAB293 | 29235.4 | 0.450124 | 0.033179 | 18.9353 |
| LAB293 | 29233.2 | 0.434914 | 0.354441 | 14.9164 |
| LAB293 | 29233.4 | 0.425819 | 0.094369 | 12.5134 |
| LAB297 | 29275.1 | 0.626685 | 0.02963 | 65.5876 |
| LAB297 | 29272.1 | 0.455254 | 0.028798 | 20.2909 |
| LAB297 | 29273.1 | 0.453776 | 0.08355 | 19.9001 |
| LAB297 | 29273.4 | 0.434415 | 0.109485 | 14.7845 |
| LAB310 | 28183.3 | 0.409771 | 0.439527 | 8.2728 |
| LAB318 | 28101.7 | 0.490377 | 0.224802 | 29.5713 |
| LAB318 | 28101.5 | 0.398978 | 0.66208 | 5.4211 |
| LAB318 | 28104.3 | 0.393665 | 0.773993 | 4.0173 |
| LAB327 | 29221.8 | 0.476698 | 0.015066 | 25.9569 |
| LAB327 | 29225.4 | 0.415827 | 0.266042 | 9.8732 |
| LAB335 | 27314.2 | 0.625741 | 0.000019 | 65.3382 |
| LAB335 | 27315.4 | 0.432664 | 0.110098 | 14.3219 |
| control | — | 0.378461 | — | 0 |
| LAB102 | 30313.3 | 0.740878 | 0.002653 | 43.4002 |
| LAB102 | 30314.3 | 0.704653 | 0.150452 | 36.3885 |
| LAB102 | 30313.2 | 0.58444 | 0.337721 | 13.1208 |
| LAB102 | 30312.1 | 0.543041 | 0.712082 | 5.1079 |
| LAB102 | 30312.4 | 0.538778 | 0.568505 | 4.2829 |
| LAB126 | 30205.1 | 0.849536 | 0.013168 | 64.4313 |
| LAB126 | 30201.3 | 0.814985 | 0.000212 | 57.7439 |
| LAB126 | 30203.3 | 0.773442 | 0.000185 | 49.703 |
| LAB126 | 30202.3 | 0.67621 | 0.049114 | 30.8834 |
| LAB126 | 30205.3 | 0.662122 | 0.036897 | 28.1566 |
| LAB165 | 30231.1 | 0.909805 | 0.018314 | 76.0966 |
| LAB165 | 30233.1 | 0.775353 | 0.02434 | 50.073 |
| LAB165 | 30232.1 | 0.76477 | 0.057263 | 48.0244 |
| LAB165 | 30235.1 | 0.573407 | 0.422803 | 10.9854 |
| LAB165 | 30231.2 | 0.527539 | 0.723622 | 2.1073 |
| LAB167 | 27321.4 | 0.829222 | 0.019594 | 60.4996 |
| LAB167 | 27321.6 | 0.593667 | 0.056842 | 14.9067 |
| LAB220 | 30321.4 | 0.743829 | 0.061313 | 43.9712 |
| LAB220 | 30324.4 | 0.743543 | 0.000007 | 43.9159 |
| LAB220 | 30322.3 | 0.613724 | 0.180205 | 18.7889 |
| LAB241 | 30213.1 | 0.683439 | 0.051518 | 32.2826 |
| LAB241 | 30212.2 | 0.587234 | 0.255597 | 13.6617 |
| LAB241 | 30212.1 | 0.555172 | 0.465848 | 7.456 |
| LAB241 | 30211.3 | 0.539955 | 0.591827 | 4.5105 |
| LAB268 | 30395.1 | 0.771294 | 0.000071 | 49.2872 |
| LAB268 | 30392.2 | 0.74018 | 0.000023 | 43.265 |
| LAB268 | 30393.3 | 0.548812 | 0.292202 | 6.225 |
| LAB280 | 30041.1 | 0.869184 | 0.013491 | 68.2342 |
| LAB280 | 30045.3 | 0.716382 | 0.08677 | 38.6588 |
| LAB280 | 30044.1 | 0.697359 | 0.008234 | 34.9768 |
| LAB280 | 30045.1 | 0.540115 | 0.697243 | 4.5416 |
| LAB289 | 30375.2 | 1.0458 | 0.002996 | 102.418 |
| LAB289 | 30371.4 | 0.851453 | 0.004296 | 64.8025 |
| LAB289 | 30375.3 | 0.836293 | 0.013653 | 61.868 |

TABLE 67-continued

Genes showing improved plant performance at standard growth conditions (T2 generation)

| Gene Name | Event # | Average | p-value | % |
|---|---|---|---|---|
| LAB289 | 30371.6 | 0.758036 | 0.000235 | 46.7211 |
| LAB289 | 30371.2 | 0.572784 | 0.219773 | 10.8648 |
| control | — | 0.516651 | — | 0 |
| LAB303 | 30423.4 | 0.523691 | 0.641622 | 3.4458 |
| LAB311 | 30223.4 | 0.774039 | 0.028776 | 52.8975 |
| LAB311 | 30221.4 | 0.573861 | 0.240006 | 13.3561 |
| LAB311 | 30222.2 | 0.538505 | 0.714321 | 6.3721 |
| LAB311 | 30224.2 | 0.507671 | 0.955212 | 0.2815 |
| LAB344 | 30096.1 | 0.674272 | 0.001634 | 33.1904 |
| LAB344 | 30096.3 | 0.664823 | 0.00334 | 31.324 |
| LAB344 | 30092.3 | 0.570462 | 0.197755 | 12.6846 |
| LAB355 | 29282.2 | 0.870031 | 0.015634 | 71.8591 |
| LAB355 | 29281.3 | 0.824252 | 0.00032 | 62.8164 |
| LAB355 | 29282.3 | 0.592536 | 0.138593 | 17.0449 |
| LAB367 | 30173.3 | 0.663261 | 0.072228 | 31.0155 |
| LAB367 | 30171.3 | 0.620022 | 0.027507 | 22.4744 |
| LAB367 | 30173.1 | 0.545516 | 0.505431 | 7.757 |
| LAB381 | 30356.1 | 0.763829 | 0.000163 | 50.8809 |
| LAB381 | 30352.2 | 0.751966 | 0.001439 | 48.5375 |
| LAB381 | 30352.4 | 0.726992 | 0.11955 | 43.6043 |
| LAB381 | 30354.2 | 0.72695 | 0.028004 | 43.5961 |
| LAB381 | 30351.4 | 0.547099 | 0.229827 | 8.0696 |
| LAB383 | 28115.2 | 0.674169 | 0.032357 | 33.17 |
| LAB383 | 28111.3 | 0.667704 | 0.086363 | 31.8929 |
| LAB383 | 28111.1 | 0.621265 | 0.100634 | 22.7199 |
| LAB383 | 28111.4 | 0.524647 | 0.796852 | 3.6346 |
| LAB64 | 30271.2 | 0.806203 | 0.061741 | 59.251 |
| LAB64 | 30273.2 | 0.747974 | 0.178143 | 47.7488 |
| LAB64 | 30272.1 | 0.689605 | 0.072756 | 36.2191 |
| LAB64 | 30274.2 | 0.568083 | 0.290886 | 12.2146 |
| LAB65 | 30304.3 | 0.570605 | 0.360647 | 12.7128 |
| LAB65 | 30303.4 | 0.519507 | 0.726314 | 2.6193 |
| LAB65 | 30301.4 | 0.507876 | 0.965275 | 0.3219 |
| LAB92 | 29321.2 | 0.633822 | 0.000201 | 25.2002 |
| LAB92 | 29323.2 | 0.611123 | 0.0064 | 20.7164 |
| LAB92 | 29324.2 | 0.600865 | 0.17948 | 18.6903 |
| LAB92 | 29322.1 | 0.541834 | 0.340737 | 7.0297 |
| control | — | 0.506247 | — | 0 |
| LAB172 | 30854.1 | 0.599345 | 0.01145 | 20.6037 |
| LAB172 | 30854.4 | 0.548834 | 0.050366 | 10.4395 |
| LAB172 | 30853.4 | 0.539843 | 0.305545 | 8.6302 |
| LAB188 | 30722.2 | 0.54367 | 0.060374 | 9.4004 |
| LAB243 | 30873.4 | 0.603662 | 0.094926 | 21.4723 |
| LAB243 | 30872.1 | 0.57263 | 0.390324 | 15.228 |
| LAB243 | 27101.1 | 0.531341 | 0.717023 | 6.9195 |
| LAB243 | 30873.2 | 0.498511 | 0.953523 | 0.3134 |
| LAB270 | 30595.1 | 0.589781 | 0.185674 | 18.6791 |
| LAB270 | 30591.2 | 0.523517 | 0.398437 | 5.3452 |
| LAB291 | 31851.3 | 0.737427 | 0.00741 | 48.3893 |
| LAB291 | 31853.3 | 0.6838 | 0.087686 | 37.5982 |
| LAB291 | 31851.2 | 0.550252 | 0.429759 | 10.7249 |
| LAB291 | 31852.4 | 0.545837 | 0.036156 | 9.8364 |
| LAB295 | 31864.4 | 0.804594 | 0.009476 | 61.9051 |
| LAB295 | 31861.3 | 0.765832 | 0.039437 | 54.1052 |
| LAB295 | 31863.1 | 0.732329 | 0.031519 | 47.3634 |
| LAB295 | 31864.3 | 0.555825 | 0.408432 | 11.8464 |
| LAB295 | 31865.1 | 0.52262 | 0.656801 | 5.1647 |
| LAB323 | 30381.4 | 0.807638 | 0.021243 | 62.5176 |
| LAB323 | 30383.2 | 0.583376 | 0.009209 | 17.3902 |
| LAB347_H0 | 30444.3 | 0.605528 | 0.103346 | 21.8479 |
| LAB55 | 30023.1 | 0.510378 | 0.849708 | 2.7012 |
| control | — | 0.496954 | — | 0 |
| LAB291 | 31851.2 | 0.691094 | 0.501853 | 9.7389 |
| control | — | 0.629762 | — | 0 |

Table 67.
"CONT."—Control;
"Ave."—Average;
"% Incr." = % increment;
"p-val."—p-value.

TABLE 68

Genes showing improved plant performance at standard growth conditions (T1 generation)

| Gene Name | Event # | Plant Fresh Weight [gr.] Ave. | p-val. | % Incr. | Gene Name | Event # | Plant Dry Weight [gr.] Ave. | p-val. | % Incr. |
|---|---|---|---|---|---|---|---|---|---|
| LAB109 | 32411 | 0.16 | 0.44 | 16 | LAB109 | 32411 | 0.01 | 0.11 | 19 |
| LAB211 | 32581 | 0.23 | 0.02 | 64 | LAB211 | 32581 | 0.01 | 0.01 | 68 |
| LAB229 | 32911 | 0.16 | 0.62 | 11 | LAB229 | 32911 | 0.01 | 0.23 | 23 |
| LAB236 | 33201 | 0.15 | 0.75 | 4 | LAB236 | 33201 | 0.01 | 0.31 | 25 |
| LAB274 | 32471 | 0.16 | 0.33 | 17 | LAB274 | 32471 | 0.01 | 0.13 | 46 |
| cont | — | 0.14 | — | 0 | LAB291 | 31851 | 0.01 | 0.23 | 15 |
| LAB296 | 32441 | 0.16 | 0.04 | 84 | cont | — | 0.01 | — | 0 |
| LAB349 | 32391 | 0.15 | 0.00 | 71 | LAB296 | 32441 | 0.01 | 0.04 | 27 |
| LAB53 | 32461 | 0.11 | 0.16 | 25 | LAB349 | 32391 | 0.01 | 0.00 | 57 |
| LAB69 | 32451 | 0.11 | 0.08 | 23 | LAB53 | 32461 | 0.01 | 0.10 | 50 |
| LAB89 | 32432 | 0.12 | 0.09 | 33 | LAB69 | 32451 | 0.01 | 0.06 | 35 |
| cont | — | 0.09 | — | 0 | LAB89 | 32432 | 0.01 | 0.11 | 23 |
|  |  |  |  |  | cont | — | 0.00 | — | 0 |

Table 68.
CONT."—Control;
"Ave."—Average;
"% Incr." = % increment;
"p-val."—p-value.

TABLE 69

Genes showing improved plant performance at standard growth conditions (T1 generation)

| Gene Name | Event # | Leaf Area cm2 Ave. | p-val. | % |
|---|---|---|---|---|
| LAB211 | 32581 | 0.366213 | 0.024144 | 19.6782 |
| LAB274 | 32471 | 0.324199 | 0.657402 | 5.9479 |
| control | — | 0.305998 | — | 0 |
| LAB296 | 32441 | 0.327599 | 0.005819 | 10.1024 |
| LAB349 | 32391 | 0.342415 | 0.058998 | 15.0821 |
| LAB53 | 32461 | 0.330121 | 0.333846 | 10.9502 |
| LAB69 | 32451 | 0.329548 | 0.248384 | 10.7576 |
| LAB89 | 32432 | 0.30556 | 0.383124 | 2.6954 |
| control | — | 0.29754 | — | 0 |
| LAB109 | 32411 | 0.623775 | 0.252783 | 11.8492 |
| LAB211 | 32581 | 0.776762 | 0.000047 | 39.2814 |
| LAB274 | 32471 | 0.609411 | 0.454178 | 9.2736 |
| LAB291 | 31851 | 0.591488 | 0.468855 | 6.0599 |
| control | — | 0.557692 | — | 0 |
| LAB296 | 32441 | 0.623235 | 0.061446 | 19.5505 |
| LAB349 | 32391 | 0.662302 | 0.000101 | 27.0444 |
| LAB53 | 32461 | 0.65129 | 0.094666 | 24.932 |
| LAB69 | 32451 | 0.617607 | 0.10789 | 18.4708 |
| LAB89 | 32432 | 0.592895 | 0.045231 | 13.7305 |
| control | — | 0.521315 | — | 0 |

Table 69.
"CONT."—Control;
"Ave."—Average;
"% Incr." = % increment;
"p-val."—p-value.

The genes listed in Tables 70-71 improved plant NUE when grown at standard conditions. These genes produced larger root biomass (root length and root coverage) when grown under standard growth conditions, compared to control plants. Plants producing larger root biomass have better possibilities to absorb larger amount of water from soil. The genes were cloned under the regulation of a constitutive promoter (At6669; SEQ ID NO:8741). The evaluation of each gene was performed by testing the performance of different number of events. Some of the genes were evaluated in more than one tissue culture assay resulting in positive results as well. Event with p-value <0.1 was considered statistically significant

TABLE 70

Genes showing improved root performance at standard growth conditions (T2 generation)

| Gene Name | Event # | Roots Length [cm] Ave. | p-val. | % Incr. | Roots Coverage [cm2] Ave. | p-val. | % Incr. |
|---|---|---|---|---|---|---|---|
| LAB115 | 27281.2 | 6.92126 | 0.00022 | 37.4158 | 8.72452 | 0.000084 | 138.078 |
| LAB115 | 27282.3 | 6.58397 | 0.002324 | 30.7192 | 6.40647 | 0.044019 | 74.8223 |
| LAB115 | 27284.3 | 6.44265 | 0.000327 | 27.9134 | 6.05146 | 0.01033 | 65.1346 |
| LAB115 | 27285.2 | 5.83048 | 0.109222 | 15.7594 | 5.72956 | 0.154192 | 56.3503 |
| LAB115 | 27285.4 | — | — | — | 3.86045 | 0.59653 | 5.3456 |
| LAB123 | 28282.3 | 6.46747 | 0.015033 | 28.4062 | 5.94276 | 0.032404 | 62.1684 |
| LAB123 | 28283.1 | 6.56239 | 0.000544 | 30.2907 | 5.12657 | 0.097131 | 39.8958 |
| LAB123 | 28284.1 | 5.7067 | 0.169588 | 13.3018 | 4.89252 | 0.098364 | 33.509 |
| LAB123 | 28284.3 | 6.77048 | 0.000063 | 34.4221 | 5.43132 | 0.009792 | 48.2119 |
| LAB123 | 28285.2 | 7.23784 | 0.000003 | 43.7013 | 8.2884 | 0.010696 | 126.177 |
| LAB183 | 27451.4 | 5.37875 | 0.139141 | 6.7905 | 4.01634 | 0.26987 | 9.5993 |
| LAB183 | 27452.2 | 5.44989 | 0.277925 | 8.203 | 5.27761 | 0.103011 | 44.0174 |
| LAB183 | 27453.2 | 6.30752 | 0.002407 | 25.2306 | 5.58023 | 0.012728 | 52.2754 |
| LAB183 | 27453.4 | 5.77023 | 0.111957 | 14.5631 | 4.76236 | 0.031322 | 29.957 |
| LAB183 | 27454.2 | 6.54092 | 0.012332 | 29.8644 | 5.59611 | 0.066385 | 52.7088 |
| LAB189 | 28163.2 | — | — | — | 4.28062 | 0.109297 | 16.8113 |
| LAB189 | 28166.1 | 5.93918 | 0.122427 | 17.9174 | 5.04826 | 0.261108 | 37.7587 |
| LAB189 | 28166.5 | 5.34615 | 0.632554 | 6.1433 | 3.91245 | 0.714453 | 6.7644 |
| LAB212 | 28041.1 | 6.27509 | 0.053113 | 24.5866 | 5.40195 | 0.028054 | 47.4105 |
| LAB212 | 28042.1 | 6.82297 | 0.000137 | 35.4644 | 8.16518 | 0.000008 | 122.815 |
| LAB212 | 28043.2 | 6.39231 | 0.036937 | 26.914 | 8.17911 | 0.006824 | 123.195 |
| LAB212 | 28044.2 | 5.68266 | 0.092213 | 12.8244 | 4.68161 | 0.005923 | 27.7534 |
| LAB212 | 28045.2 | 5.26443 | 0.35043 | 4.5208 | 4.62425 | 0.038367 | 26.1884 |
| LAB217 | 28033.2 | 6.00195 | 0.096214 | 19.1636 | 4.83902 | 0.314637 | 32.0491 |
| LAB217 | 28035.1 | 6.41444 | 0.000178 | 27.3533 | 5.22352 | 0.000259 | 42.5413 |
| LAB217 | 28035.3 | 6.06757 | 0.001093 | 20.4665 | 5.00997 | 0.000758 | 36.714 |
| LAB217 | 28036.4 | 5.59102 | 0.097122 | 11.0051 | 4.64235 | 0.06131 | 26.6822 |
| LAB326 | 28052.4 | 5.60726 | 0.124158 | 11.3275 | 4.29401 | 0.059341 | 17.1766 |
| LAB326 | 28053.2 | 5.82089 | 0.030162 | 15.5689 | 4.53257 | 0.095633 | 23.6864 |
| LAB326 | 28054.1 | — | — | — | 3.91827 | 0.592809 | 6.9233 |
| LAB326 | 28056.2 | 6.10315 | 0.055618 | 21.173 | 5.9185 | 0.075488 | 61.5061 |
| LAB326 | 28056.3 | 5.4934 | 0.091886 | 9.0669 | 4.82158 | 0.008135 | 31.573 |
| LAB93 | 28271.3 | 5.10421 | 0.827838 | 1.3399 | — | — | — |
| LAB93 | 28274.2 | 5.25138 | 0.739752 | 4.2617 | 3.9103 | 0.73877 | 6.7057 |
| LAB93 | 28275.2 | 6.52143 | 0.000254 | 29.4774 | 5.23039 | 0.017098 | 42.7289 |
| CONT | — | 5.03673 | — | 0 | 3.66456 | — | 0 |
| LAB115 | 27281.3 | 5.87159 | 0.242 | 12.5116 | — | — | — |
| LAB115 | 27285.1 | — | — | — | 4.63178 | 0.615313 | 12.7929 |
| LAB123 | 28281.1 | 6.34844 | 0.038716 | 21.649 | 6.89095 | 0.027857 | 67.8079 |

TABLE 70-continued

Genes showing improved root performance at standard growth conditions (T2 generation)

| Gene Name | Event # | Roots Length [cm] | | | Roots Coverage [cm2] | | |
|---|---|---|---|---|---|---|---|
| | | Ave. | p-val. | % Incr. | Ave. | p-val. | % Incr. |
| LAB123 | 28282.3 | 5.86941 | 0.151286 | 12.4699 | 5.70879 | 0.006856 | 39.02 |
| LAB123 | 28283.1 | 5.75102 | 0.060407 | 10.2012 | 5.38053 | 0.081187 | 31.0264 |
| LAB123 | 28284.1 | 6.3559 | 0.017879 | 21.7919 | 5.8484 | 0.003677 | 42.4199 |
| LAB123 | 28285.2 | 6.45446 | 0.043775 | 23.6806 | 6.83654 | 0.035212 | 66.4831 |
| LAB183 | 27453.1 | 5.52408 | 0.521974 | 5.8526 | 4.37409 | 0.633286 | 6.5175 |
| LAB183 | 27453.4 | 5.44647 | 0.482816 | 4.3653 | 4.76126 | 0.083491 | 15.946 |
| LAB183 | 27454.1 | 5.71781 | 0.289426 | 9.5648 | — | | |
| LAB189 | 28163.2 | 5.8526 | 0.121852 | 12.1476 | 4.88233 | 0.41329 | 18.8941 |
| LAB189 | 28164.2 | 5.50957 | 0.624945 | 5.5745 | — | | |
| LAB189 | 28166.2 | 5.54473 | 0.535372 | 6.2483 | 5.26721 | 0.146143 | 28.2669 |
| LAB189 | 28166.5 | 5.69749 | 0.354228 | 9.1755 | 6.31946 | 0.229675 | 53.891 |
| LAB206 | 30011.2 | — | | — | 4.7477 | 0.201819 | 15.6157 |
| LAB206 | 30012.4 | 6.45673 | 0.007774 | 23.7241 | 5.66383 | 0.107403 | 37.9254 |
| LAB206 | 30012.7 | 5.28288 | 0.919214 | 1.2307 | — | | — |
| LAB206 | 30012.8 | 5.40728 | 0.573884 | 3.6144 | 5.60317 | 0.223921 | 36.448 |
| LAB212 | 28041.1 | 6.06581 | 0.022244 | 16.2331 | 4.49121 | 0.530042 | 9.3697 |
| LAB212 | 28045.1 | — | | — | 4.57879 | 0.608095 | 11.5025 |
| LAB217 | 28033.2 | 6.2188 | 0.094976 | 19.1647 | 6.21 | 0.03467 | 51.2256 |
| LAB217 | 28034.1 | — | | — | 5.21291 | 0.403844 | 26.9446 |
| LAB217 | 28034.3 | 6.31133 | 0.018148 | 20.9378 | 5.68911 | 0.001558 | 38.5409 |
| LAB217 | 28035.1 | 5.803 | 0.003127 | 11.1973 | 5.62948 | 0.021598 | 37.0887 |
| LAB217 | 28036.1 | 6.04013 | 0.007888 | 15.7412 | 5.63381 | 0.050971 | 37.1943 |
| LAB250 | 30251.2 | — | | — | 4.29343 | 0.814363 | 4.5535 |
| LAB250 | 30253.1 | 5.66588 | 0.489208 | 8.5698 | 4.2899 | 0.676837 | 4.4674 |
| LAB250 | 30254.1 | 6.15173 | 0.099476 | 17.8796 | 4.64588 | 0.405943 | 13.1361 |
| LAB250 | 30254.3 | 5.50212 | 0.500887 | 5.4318 | 4.12556 | 0.96939 | 0.4653 |
| LAB314 | 29292.4 | 5.90362 | 0.000287 | 13.1253 | — | | — |
| LAB314 | 29292.6 | — | | — | 4.41809 | 0.525615 | 7.589 |
| LAB314 | 29294.2 | 5.31263 | 0.824419 | 1.8008 | — | | — |
| LAB314 | 29295.2 | 6.21962 | 0.000454 | 19.1806 | 4.65117 | 0.244226 | 13.2651 |
| LAB326 | 28052.4 | 6.19075 | 0.064088 | 18.6273 | 5.52203 | 0.090647 | 34.4722 |
| LAB326 | 28053.2 | 5.75988 | 0.264701 | 10.371 | 4.19768 | 0.880605 | 2.2216 |
| LAB326 | 28056.2 | 5.54147 | 0.063315 | 6.1859 | — | | — |
| LAB326 | 28056.3 | 6.37666 | 0.000096 | 22.1897 | 5.6408 | 0.019674 | 37.3644 |
| LAB351 | 30112.1 | 5.30048 | 0.67012 | 1.568 | — | | |
| LAB351 | 30114.2 | 6.30653 | 0.076817 | 20.8458 | 5.01369 | 0.230101 | 22.0931 |
| LAB351 | 30115.3 | 5.50366 | 0.585698 | 5.4613 | — | | |
| LAB93 | 28271.3 | 5.39029 | 0.524124 | 3.2889 | 4.58129 | 0.441849 | 11.5634 |
| LAB93 | 28272.3 | — | | — | 4.58853 | 0.591122 | 11.7395 |
| LAB93 | 28274.2 | — | | — | 4.40606 | 0.82849 | 7.2962 |
| LAB93 | 28274.3 | 5.28917 | 0.892575 | 1.3512 | — | | |
| CONT | — | 5.21866 | — | 0 | 4.10645 | — | 0 |
| LAB106 | 30032.1 | 6.2468 | 0.277802 | 5.735 | 6.42463 | 0.130801 | 16.5113 |
| LAB106 | 30032.2 | — | | — | 5.76701 | 0.591158 | 4.5854 |
| LAB206 | 30011.7 | — | | — | 6.29092 | 0.072486 | 14.0865 |
| LAB206 | 30012.4 | 6.62714 | 0.116111 | 12.1727 | 7.26529 | 0.218057 | 31.7567 |
| LAB206 | 30012.8 | 6.74985 | 0.028324 | 14.2498 | 6.25273 | 0.216935 | 13.3939 |
| LAB207 | 28842.1 | 6.52224 | 0.178178 | 10.3971 | 6.87737 | 0.040472 | 24.7218 |
| LAB207 | 28842.5 | 7.14088 | 0.080295 | 20.8685 | 7.14807 | 0.08448 | 29.631 |
| LAB207 | 28843.3 | — | | — | 5.70806 | 0.605271 | 3.5162 |
| LAB207 | 28843.5 | 6.66122 | 0.025305 | 12.7496 | 6.91163 | 0.045764 | 25.3432 |
| LAB207 | 28845.1 | 6.79041 | 0.013482 | 14.9363 | 6.6758 | 0.015492 | 21.0664 |
| LAB218 | 29431.1 | 6.70931 | 0.045503 | 13.5636 | 6.17215 | 0.369883 | 11.9326 |
| LAB218 | 29431.3 | 6.17574 | 0.421197 | 4.5323 | — | | |
| LAB218 | 29432.2 | 6.84933 | 0.028774 | 15.9335 | 6.81169 | 0.165301 | 23.5306 |
| LAB218 | 29433.4 | 6.74958 | 0.044691 | 14.2453 | — | | |
| LAB250 | 30252.1 | 6.50136 | 0.208147 | 10.0437 | 6.32674 | 0.131009 | 14.736 |
| LAB250 | 30253.1 | 6.59731 | 0.11459 | 11.6679 | 7.51798 | 0.085297 | 36.3393 |
| LAB250 | 30254.1 | 6.65538 | 0.048671 | 12.6507 | 5.91927 | 0.477276 | 7.3465 |
| LAB250 | 30254.3 | 6.60695 | 0.147536 | 11.831 | 6.17398 | 0.209321 | 11.9658 |
| LAB252 | 30291.2 | 6.04293 | 0.765047 | 2.2843 | — | | |
| LAB252 | 30292.3 | 7.08186 | 0.002316 | 19.8695 | 8.123 | 0.041064 | 47.3114 |
| LAB252 | 30292.4 | 6.2713 | 0.427461 | 6.1496 | — | | |
| LAB309 | 30052.2 | 6.66571 | 0.18904 | 12.8257 | 7.47086 | 0.063826 | 35.4849 |
| LAB309 | 30052.3 | — | | — | 5.94218 | 0.598347 | 7.7621 |
| LAB309 | 30054.2 | 6.1102 | 0.543777 | 3.4229 | — | | — |
| LAB309 | 30055.4 | 6.29475 | 0.19296 | 6.5466 | — | | — |
| LAB309 | 30056.1 | 6.11559 | 0.645114 | 3.5141 | — | | — |
| LAB314 | 29292.4 | 7.25878 | 0.000941 | 22.8641 | 8.08658 | 0.04527 | 46.651 |
| LAB314 | 29292.6 | 6.01168 | 0.809812 | 1.7553 | 6.95781 | 0.204403 | 26.1806 |
| LAB314 | 29294.1 | 6.05617 | 0.689684 | 2.5084 | 6.25217 | 0.159089 | 13.3837 |
| LAB314 | 29295.2 | 6.4724 | 0.167288 | 9.5536 | 6.89993 | 0.288312 | 25.1309 |
| LAB346 | 29442.4 | 6.23585 | 0.421096 | 5.5497 | 5.95547 | 0.55829 | 8.0031 |
| LAB346 | 29443.2 | 6.51772 | 0.304569 | 10.3206 | 7.78338 | 0.073268 | 41.1523 |

TABLE 70-continued

Genes showing improved root performance at standard growth conditions (T2 generation)

| Gene Name | Event # | Roots Length [cm] Ave. | p-val. | % Incr. | Roots Coverage [cm2] Ave. | p-val. | % Incr. |
|---|---|---|---|---|---|---|---|
| LAB346 | 29445.3 | — | | — | 5.52865 | 0.97965 | 0.2627 |
| LAB351 | 30111.2 | 7.03318 | 0.010552 | 19.0455 | 8.23542 | 0.018296 | 49.3502 |
| LAB351 | 30114.2 | 6.32458 | 0.462569 | 7.0515 | 6.24081 | 0.563362 | 13.1778 |
| LAB351 | 30115.1 | 6.36884 | 0.165578 | 7.8007 | — | | — |
| LAB351 | 30115.3 | 6.80724 | 0.03646 | 15.2211 | 6.40063 | 0.038181 | 16.076 |
| LAB82 | 30181.3 | 7.38313 | 0.009128 | 24.9688 | 6.88039 | 0.24341 | 24.7766 |
| LAB82 | 30182.2 | 6.54751 | 0.287013 | 10.8249 | 6.51206 | 0.374234 | 18.0969 |
| LAB82 | 30183.2 | 6.47619 | 0.194031 | 9.6177 | 5.52023 | 0.988042 | 0.1099 |
| LAB84 | 30162.2 | 7.20964 | 0.001621 | 22.0323 | 9.70146 | 0.013196 | 75.937 |
| LAB84 | 30162.4 | 6.30825 | 0.371379 | 6.7752 | 6.81364 | 0.090895 | 23.5661 |
| LAB84 | 30163.4 | 6.79567 | 0.010564 | 15.0253 | 7.25368 | 0.001111 | 31.5463 |
| LAB84 | 30164.2 | 6.58221 | 0.084938 | 11.4122 | 6.49352 | 0.281819 | 17.7606 |
| CONT | — | 5.90798 | — | 0 | 5.51417 | — | 0 |
| LAB110 | 30571.3 | 6.75828 | 0.207274 | 6.9367 | 8.32106 | 0.028433 | 50.3611 |
| LAB110 | 30572.1 | 7.24998 | 0.050625 | 14.7169 | 6.42353 | 0.120979 | 16.073 |
| LAB110 | 30573.2 | — | | — | 5.59621 | 0.909479 | 1.1233 |
| LAB110 | 30574.2 | 6.927 | 0.233709 | 9.6062 | 6.90237 | 0.007346 | 24.7256 |
| LAB117 | 27291.1 | 7.02041 | 0.032937 | 11.0844 | 8.24299 | 0.155914 | 48.9504 |
| LAB117 | 27291.5 | 6.56152 | 0.529516 | 3.8232 | 6.2125 | 0.568058 | 12.2595 |
| LAB117 | 27293.1 | 6.99187 | 0.054898 | 10.6259 | 8.38551 | 0.055805 | 51.5257 |
| LAB117 | 27293.2 | 6.3643 | 0.747196 | 0.7026 | — | | — |
| LAB124 | 30431.1 | 6.79319 | 0.064501 | 7.489 | 6.53043 | 0.37245 | 18.0045 |
| LAB124 | 30432.3 | 7.07881 | 0.000449 | 12.0083 | 5.92039 | 0.605275 | 6.9812 |
| LAB124 | 30434.3 | 6.60565 | 0.619291 | 4.5215 | 6.58976 | 0.248288 | 19.0766 |
| LAB124 | 30435.2 | 6.85912 | 0.139021 | 8.5323 | 7.14861 | 0.025128 | 29.175 |
| LAB125 | 30581.3 | 6.93451 | 0.120557 | 9.7251 | 6.73122 | 0.352119 | 21.6329 |
| LAB125 | 30583.2 | 6.46111 | 0.61011 | 2.2345 | 7.4188 | 0.117839 | 34.0573 |
| LAB125 | 30584.2 | 6.71419 | 0.077734 | 6.239 | — | | — |
| LAB156 | 30401.4 | 6.39032 | 0.676329 | 1.1144 | 5.611 | 0.889377 | 1.3904 |
| LAB156 | 30402.2 | 6.45748 | 0.457348 | 2.177 | 8.42615 | 0.011888 | 52.2601 |
| LAB156 | 30403.1 | 6.60525 | 0.357725 | 4.5152 | 5.72871 | 0.628953 | 3.5175 |
| LAB228 | 30081.4 | 6.96762 | 0.057551 | 10.249 | 6.33589 | 0.398016 | 14.4893 |
| LAB228 | 30084.3 | 6.86391 | 0.014839 | 8.6081 | — | | — |
| LAB275 | 30361.3 | — | | — | 6.72959 | 0.005713 | 21.6035 |
| LAB275 | 30366.4 | 6.42828 | 0.686155 | 1.715 | 5.98067 | 0.356978 | 8.0704 |
| LAB276_H0 | 30331.1 | 6.57678 | 0.542053 | 4.0648 | 9.08988 | 0.128062 | 64.2537 |
| LAB276_H0 | 30331.4 | — | | — | 6.32693 | 0.213744 | 14.3274 |
| LAB276_H0 | 30333.7 | — | | — | 6.15503 | 0.094971 | 11.2212 |
| LAB277 | 30651.2 | 6.68254 | 0.049263 | 5.7382 | 6.96127 | 0.104891 | 25.7898 |
| LAB277 | 30652.3 | 6.53324 | 0.389745 | 3.3758 | 5.7761 | 0.55497 | 4.3739 |
| LAB277 | 30652.5 | — | | — | 6.4974 | 0.111297 | 17.4077 |
| LAB278 | 30414.2 | 6.44383 | 0.720004 | 1.9611 | 6.87142 | 0.452698 | 24.1662 |
| LAB281 | 30741.1 | 6.46852 | 0.630662 | 2.3517 | 6.38886 | 0.471101 | 15.4465 |
| CONT | — | 6.31989 | — | 0 | 5.53405 | — | 0 |
| LAB110 | 30571.3 | 7.53334 | 0.000288 | 26.946 | 11.3415 | 0.010084 | 117.119 |
| LAB110 | 30572.1 | 6.79593 | 0.018734 | 14.5198 | 7.88633 | 0.060917 | 50.9734 |
| LAB110 | 30572.2 | 7.05554 | 0.002683 | 18.8945 | 8.84927 | 0.000015 | 69.4077 |
| LAB110 | 30573.2 | 7.1804 | 0.000573 | 20.9985 | 8.94205 | 0.000562 | 71.1838 |
| LAB110 | 30574.2 | 6.76745 | 0.129608 | 14.0399 | 9.23801 | 0.044539 | 76.8495 |
| LAB117 | 27291.1 | 6.56635 | 0.270515 | 10.651 | — | | — |
| LAB117 | 27291.2 | 6.88707 | 0.01952 | 16.0556 | 7.77544 | 0.036541 | 48.8506 |
| LAB117 | 27293.1 | 7.37333 | 0.003258 | 24.2496 | 9.53113 | 0.044022 | 82.4609 |
| LAB117 | 27293.2 | 6.32194 | 0.262023 | 6.5325 | — | | — |
| LAB117 | 27296.1 | 6.21082 | 0.433946 | 4.6599 | 6.0519 | 0.337714 | 15.8557 |
| LAB124 | 30431.1 | 6.65157 | 0.080821 | 12.087 | 6.52618 | 0.145299 | 24.9352 |
| LAB124 | 30432.3 | 6.8802 | 0.001975 | 15.9398 | 6.45594 | 0.129976 | 23.5905 |
| LAB124 | 30434.1 | 6.37788 | 0.236047 | 7.4751 | 7.49698 | 0.032019 | 43.5199 |
| LAB124 | 30434.3 | 6.28923 | 0.366268 | 5.9813 | — | | — |
| LAB124 | 30435.2 | 6.88053 | 0.008267 | 15.9453 | 6.44794 | 0.007855 | 23.4374 |
| LAB125 | 30581.3 | 6.5331 | 0.172078 | 10.0908 | 7.53408 | 0.080418 | 44.23 |
| LAB125 | 30582.2 | 7.36389 | 0.000005 | 24.0905 | 8.96124 | 0.016377 | 71.5512 |
| LAB125 | 30583.2 | 6.66618 | 0.037053 | 12.3333 | — | | — |
| LAB125 | 30584.2 | 6.78407 | 0.087585 | 14.3198 | 6.72508 | 0.085936 | 28.7428 |
| LAB156 | 30401.4 | 6.39644 | 0.408611 | 7.7878 | 8.37941 | 0.081784 | 60.4129 |
| LAB156 | 30403.1 | 7.29789 | 0.000029 | 22.9783 | 7.49521 | 0.00103 | 43.4858 |
| LAB156 | 30405.3 | 6.15688 | 0.622947 | 3.7511 | 6.58092 | 0.378165 | 25.9831 |
| LAB228 | 30081.4 | 6.80441 | 0.041597 | 14.6627 | 7.28256 | 0.054012 | 39.415 |
| LAB228 | 30084.3 | 6.53958 | 0.031457 | 10.2 | 5.90802 | 0.222099 | 13.1012 |
| LAB228 | 30084.4 | 6.76767 | 0.037226 | 14.0435 | 7.69967 | 0.027765 | 47.4 |
| LAB228 | 30085.2 | 6.13413 | 0.742537 | 3.3676 | 5.84109 | 0.650141 | 11.82 |
| LAB275 | 30361.2 | 6.49118 | 0.060164 | 9.3843 | 8.17244 | 0.039197 | 56.4506 |
| LAB275 | 30361.3 | 6.57246 | 0.131954 | 10.754 | 6.28364 | 0.04975 | 20.292 |
| LAB275 | 30363.4 | — | | — | 6.30075 | 0.164712 | 20.6196 |
| LAB275 | 30366.4 | 6.2769 | 0.341853 | 5.7735 | 7.09843 | 0.114212 | 35.8901 |

TABLE 70-continued

Genes showing improved root performance at standard growth conditions (T2 generation)

| Gene | | Roots Length [cm] | | | Roots Coverage [cm2] | | |
|---|---|---|---|---|---|---|---|
| Name | Event # | Ave. | p-val. | % Incr. | Ave. | p-val. | % Incr. |
| LAB276_H0 | 30331.1 | — | — | — | 6.07638 | 0.09862 | 16.3244 |
| LAB276_H0 | 30331.4 | 6.05113 | 0.724563 | 1.9689 | 6.83907 | 0.011629 | 30.9251 |
| LAB276_H0 | 30333.7 | 6.54175 | 0.137159 | 10.2364 | 6.37764 | 0.112449 | 22.0915 |
| LAB277 | 30651.2 | 6.69756 | 0.004659 | 12.8621 | 6.65431 | 0.003181 | 27.388 |
| LAB277 | 30652.3 | 6.24532 | 0.319826 | 5.2412 | — | — | — |
| LAB277 | 30652.5 | 6.72732 | 0.103128 | 13.3636 | 8.90805 | 0.009576 | 70.5329 |
| LAB277 | 30652.6 | 6.86419 | 0.000902 | 15.67 | 8.243 | 0.009824 | 57.8013 |
| LAB277 | 30653.1 | 6.68661 | 0.135091 | 12.6775 | 6.3541 | 0.188608 | 21.6409 |
| LAB278 | 30413.3 | 6.41463 | 0.221224 | 8.0945 | 6.87611 | 0.217261 | 31.6341 |
| LAB278 | 30414.1 | 6.43443 | 0.176671 | 8.4281 | 7.4521 | 0.013722 | 42.6606 |
| LAB278 | 30414.2 | 6.18343 | 0.488683 | 4.1984 | 6.05898 | 0.086479 | 15.9912 |
| LAB281 | 30741.1 | 6.13439 | 0.558885 | 3.3719 | — | — | — |
| LAB281 | 30742.4 | 6.46181 | 0.035357 | 8.8895 | 7.37416 | 0.034423 | 41.1686 |
| LAB281 | 30743.4 | 6.89515 | 0.002569 | 16.1918 | 8.03762 | 0.034025 | 53.8697 |
| LAB282 | 30752.2 | 6.09072 | 0.576529 | 2.636 | 5.63082 | 0.551834 | 7.7945 |
| LAB282 | 30753.4 | 6.21587 | 0.412226 | 4.745 | 6.39651 | 0.273126 | 22.4529 |
| CONT | — | 5.93429 | — | 0 | 5.22365 | — | 0 |
| LAB106 | 30032.1 | 6.67433 | 0.094519 | 6.3324 | — | — | — |
| LAB127 | 30811.1 | 6.4084 | 0.784999 | 2.0957 | — | — | — |
| LAB127 | 30811.4 | 6.39442 | 0.811108 | 1.8729 | — | — | — |
| LAB127 | 30814.2 | 7.16115 | 0.000131 | 14.0882 | — | — | — |
| LAB128 | 28074.1 | 6.33181 | 0.835669 | 0.8756 | 6.74033 | 0.695084 | 5.9332 |
| LAB128 | 28074.3 | 6.8755 | 0.024501 | 9.5374 | 6.50255 | 0.831015 | 2.1961 |
| LAB128 | 28075.2 | 6.72363 | 0.119265 | 7.1178 | 6.57785 | 0.852038 | 3.3796 |
| LAB207 | 28842.1 | 6.94267 | 0.007309 | 10.6074 | 8.72984 | 0.155482 | 37.2009 |
| LAB207 | 28842.5 | 6.49277 | 0.406912 | 3.4398 | 6.4622 | 0.89549 | 1.5619 |
| LAB207 | 28845.1 | 6.93886 | 0.064798 | 10.5468 | 7.56708 | 0.190452 | 18.9267 |
| LAB218 | 29431.3 | 6.4919 | 0.546077 | 3.4261 | — | — | — |
| LAB218 | 29433.4 | 6.84169 | 0.144497 | 8.9987 | 7.68217 | 0.189671 | 20.7353 |
| LAB252 | 30292.4 | 6.35543 | 0.860866 | 1.2519 | — | — | — |
| LAB309 | 30052.2 | 6.43127 | 0.461759 | 2.4601 | — | — | — |
| LAB309 | 30052.3 | 6.44795 | 0.350988 | 2.7259 | — | — | — |
| LAB309 | 30055.4 | 7.19523 | 0.030462 | 14.6311 | 7.72001 | 0.28447 | 21.3301 |
| LAB309 | 30056.1 | 7.1656 | 0.084801 | 14.1591 | 8.05469 | 0.301812 | 26.59 |
| LAB80 | 30671.2 | 6.47463 | 0.685825 | 3.1509 | — | — | — |
| LAB80 | 30673.2 | 6.64599 | 0.161718 | 5.8809 | — | — | — |
| LAB80 | 30675.2 | — | — | — | 6.73634 | 0.695025 | 5.8704 |
| LAB82 | 30181.3 | 6.72493 | 0.229136 | 7.1385 | — | — | — |
| LAB82 | 30183.2 | 6.41833 | 0.691772 | 2.2539 | — | — | — |
| LAB84 | 30162.4 | 6.56007 | 0.495 | 4.512 | 6.99557 | 0.414663 | 9.9445 |
| LAB84 | 30163.4 | 6.51292 | 0.562413 | 3.7609 | — | — | — |
| CONT | — | 6.27685 | — | 0 | 6.36282 | — | 0 |
| LAB127 | 30811.4 | 6.99207 | 0.949302 | 0.3383 | — | — | — |
| LAB127 | 30813.2 | 7.06607 | 0.842819 | 1.4002 | — | — | — |
| LAB128 | 28074.1 | — | — | — | 7.83343 | 0.913073 | 1.4949 |
| LAB128 | 28075.2 | 7.39063 | 0.089477 | 6.0577 | 9.48406 | 0.126855 | 22.8815 |
| LAB147 | 31104.1 | 7.22843 | 0.179004 | 3.7301 | 8.1307 | 0.624886 | 5.3466 |
| LAB186 | 31001.4 | — | — | — | 8.52678 | 0.458014 | 10.4785 |
| LAB186 | 31002.1 | — | — | — | 8.04053 | 0.827368 | 4.1782 |
| LAB186 | 31003.1 | — | — | — | 7.80474 | 0.889871 | 1.1232 |
| LAB186 | 31004.2 | 7.10849 | 0.592978 | 2.009 | 8.51472 | 0.406279 | 10.3221 |
| LAB197 | 31084.3 | — | — | — | 7.93526 | 0.80337 | 2.8143 |
| LAB197 | 31085.3 | 7.02598 | 0.811006 | 0.8249 | — | — | — |
| LAB315 | 31065.4 | 6.97164 | 0.992208 | 0.0452 | — | — | — |
| LAB317 | 30951.4 | — | — | — | 8.40295 | 0.594064 | 8.874 |
| LAB317 | 30952.2 | 7.21715 | 0.291968 | 3.5683 | 7.91582 | 0.742641 | 2.5624 |
| LAB317 | 30953.1 | 7.44162 | 0.186499 | 6.7895 | 9.15972 | 0.256031 | 18.6792 |
| LAB325 | 30975.1 | 6.98876 | 0.941147 | 0.2907 | — | — | — |
| LAB325 | 30975.4 | 7.29774 | 0.347929 | 4.7247 | 7.90214 | 0.8559 | 2.3851 |
| CONT | — | 6.9685 | — | 0 | 7.71805 | — | 0 |
| LAB147 | 31103.2 | 6.61887 | 0.064127 | 17.0012 | 5.42624 | 0.168123 | 41.8991 |
| LAB147 | 31104.1 | 5.76443 | 0.865016 | 1.8973 | 4.79936 | 0.418563 | 25.5057 |
| LAB147 | 31104.2 | 6.75612 | 0.054576 | 19.4273 | 6.21271 | 0.089095 | 62.4655 |
| LAB147 | 31105.6 | — | — | — | 4.19656 | 0.721661 | 9.7422 |
| LAB147 | 31105.7 | 5.98797 | 0.461263 | 5.8488 | 4.79655 | 0.385085 | 25.4324 |
| LAB178 | 30632.1 | 5.87212 | 0.731883 | 3.801 | 4.59984 | 0.545174 | 20.2881 |
| LAB178 | 30633.3 | 6.13794 | 0.461678 | 8.4998 | 4.89283 | 0.389305 | 27.9499 |
| LAB178 | 30633.4 | 6.27501 | 0.196673 | 10.9227 | 6.32973 | 0.053877 | 65.5257 |
| LAB178 | 30635.1 | 6.45712 | 0.137235 | 14.1419 | 5.31173 | 0.189499 | 38.9044 |
| LAB186 | 31001.4 | 6.1163 | 0.325517 | 8.1173 | 5.98735 | 0.090559 | 56.5723 |
| LAB186 | 31002.1 | — | — | — | 4.02477 | 0.831344 | 5.2497 |
| LAB186 | 31003.1 | — | — | — | 4.43432 | 0.594681 | 15.9596 |
| LAB186 | 31004.2 | — | — | — | 4.00772 | 0.845449 | 4.804 |
| LAB197 | 31081.3 | — | — | — | 4.14257 | 0.747358 | 8.3302 |

TABLE 70-continued

Genes showing improved root performance at standard growth conditions (T2 generation)

| Gene Name | Event # | Roots Length [cm] | | | Roots Coverage [cm2] | | |
|---|---|---|---|---|---|---|---|
| | | Ave. | p-val. | % Incr. | Ave. | p-val. | % Incr. |
| LAB197 | 31084.3 | 6.12894 | 0.453103 | 8.3408 | 5.22104 | 0.264523 | 36.5329 |
| LAB247 | 28093.2 | — | | — | 4.06354 | 0.815137 | 6.2637 |
| LAB247 | 28094.1 | — | | — | 4.56249 | 0.518748 | 19.3115 |
| LAB247 | 28094.3 | 6.51112 | 0.114345 | 15.0964 | 6.31953 | 0.054337 | 65.2589 |
| LAB314 | 29292.4 | — | | — | 4.54055 | 0.557454 | 18.7378 |
| LAB315 | 31061.1 | 5.84767 | 0.626884 | 3.3687 | — | | |
| LAB315 | 31061.2 | — | | | 5.14613 | 0.28865 | 34.574 |
| LAB315 | 31063.1 | 5.76994 | 0.828833 | 1.9947 | 5.05875 | 0.35601 | 32.289 |
| LAB317 | 30952.2 | 5.87231 | 0.705596 | 3.8042 | 4.51068 | 0.559392 | 17.9566 |
| LAB317 | 30952.3 | 6.18031 | 0.321157 | 9.2487 | 4.4922 | 0.560188 | 17.4734 |
| LAB317 | 30953.1 | 6.51791 | 0.126601 | 15.2165 | 5.62889 | 0.131987 | 47.1984 |
| LAB317 | 30953.4 | 6.28124 | 0.237674 | 11.0329 | 5.00884 | 0.272797 | 30.9837 |
| LAB317 | 30954.4 | 5.72737 | 0.87672 | 1.2421 | 4.95948 | 0.288942 | 29.6928 |
| LAB324 | 30961.1 | 5.9254 | 0.596553 | 4.7427 | 5.24603 | 0.259297 | 37.1863 |
| LAB324 | 30962.2 | 6.39499 | 0.175639 | 13.0436 | 4.25691 | 0.772341 | 11.3205 |
| LAB324 | 30963.1 | 6.15506 | 0.336188 | 8.8024 | 4.91412 | 0.341459 | 28.5067 |
| LAB324 | 30965.2 | 6.62728 | 0.061113 | 17.1499 | 5.80422 | 0.119813 | 51.7833 |
| LAB324 | 30965.3 | 6.41765 | 0.186166 | 13.4441 | 6.25856 | 0.093937 | 63.6644 |
| LAB325 | 30971.4 | 5.78185 | 0.775284 | 2.2053 | 6.21049 | 0.063981 | 62.4075 |
| LAB325 | 30972.2 | 5.80693 | 0.72274 | 2.6486 | 4.67458 | 0.416298 | 22.2426 |
| LAB325 | 30973.1 | 6.00494 | 0.390211 | 6.1488 | 4.91095 | 0.313791 | 28.4238 |
| LAB325 | 30975.2 | 5.83468 | 0.7005 | 3.1391 | 4.55175 | 0.561416 | 19.0306 |
| LAB325 | 30975.4 | 5.90381 | 0.554635 | 4.3612 | 4.78383 | 0.34574 | 25.0997 |
| LAB54 | 28133.4 | 5.76956 | 0.813646 | 1.9879 | 4.9493 | 0.331577 | 29.4268 |
| LAB54 | 28134.1 | — | | — | 4.32068 | 0.655323 | 12.9879 |
| LAB54 | 28136.2 | 5.99153 | 0.535507 | 5.9118 | 5.03591 | 0.267512 | 31.6916 |
| LAB67 | 31023.3 | — | | — | 3.90669 | 0.938647 | 2.1618 |
| LAB68 | 29331.5 | — | | — | 4.50289 | 0.531875 | 17.7528 |
| LAB68 | 29331.6 | — | | — | 4.07413 | 0.797731 | 6.5406 |
| LAB68 | 29335.1 | 6.34573 | 0.162069 | 12.1729 | 5.82342 | 0.097685 | 52.2853 |
| LAB68 | 29335.3 | 6.45076 | 0.11328 | 14.0295 | 5.67057 | 0.146991 | 48.2884 |
| LAB73 | 30152.1 | — | | — | 3.96817 | 0.898006 | 3.7698 |
| LAB73 | 30152.2 | — | | — | 3.93658 | 0.928086 | 2.9436 |
| LAB73 | 30154.3 | 5.76273 | 0.840834 | 1.8672 | 4.73353 | 0.457488 | 23.7843 |
| LAB74 | 28451.3 | 5.76284 | 0.789728 | 1.8692 | 4.62669 | 0.427829 | 20.9903 |
| LAB74 | 28452.1 | 5.67783 | 0.95613 | 0.3665 | 5.01713 | 0.261294 | 31.2004 |
| LAB74 | 28452.2 | — | | — | 4.74009 | 0.393377 | 23.9559 |
| LAB74 | 28453.5 | 5.8763 | 0.698594 | 3.8749 | 4.03186 | 0.845191 | 5.4353 |
| LAB74 | 28454.1 | — | | — | 4.13367 | 0.769632 | 8.0975 |
| CONT | — | 5.6571 | — | 0 | 3.82402 | — | — |
| LAB133 | 28832.1 | 5.80422 | 0.610439 | 4.0734 | 5.3491 | 0.445466 | 12.1269 |
| LAB133 | 28832.5 | 5.86152 | 0.558018 | 5.101 | 5.0871 | 0.692944 | 6.6347 |
| LAB133 | 28833.1 | 6.25927 | 0.101782 | 12.2329 | — | | — |
| LAB133 | 28833.2 | 6.00378 | 0.129715 | 7.6518 | 5.42917 | 0.203553 | 13.8052 |
| LAB133 | 28833.5 | 5.72405 | 0.729384 | 2.636 | — | | — |
| LAB158 | 29411.3 | 6.16809 | 0.146353 | 10.5979 | — | | — |
| LAB158 | 29412.1 | 6.56474 | 0.007256 | 17.7101 | 5.70815 | 0.236573 | 19.6532 |
| LAB158 | 29414.3 | — | | — | 5.20569 | 0.631938 | 9.1206 |
| LAB158 | 29415.1 | 6.25409 | 0.069097 | 12.1399 | 6.03835 | 0.240487 | 26.5747 |
| LAB160 | 29311.2 | 6.53994 | 0.007008 | 17.2654 | 6.10895 | 0.107309 | 28.0546 |
| LAB160 | 29312.1 | 5.57859 | 0.996669 | 0.0278 | 5.42733 | 0.250725 | 13.7665 |
| LAB160 | 29314.2 | 6.47118 | 0.010048 | 16.0326 | 6.08338 | 0.092174 | 27.5185 |
| LAB160 | 29315.2 | 6.2864 | 0.026271 | 12.7193 | 5.92369 | 0.231155 | 24.1713 |
| LAB162 | 29341.2 | 6.06089 | 0.404227 | 8.6758 | 5.53318 | 0.080809 | 15.9855 |
| LAB162 | 29342.6 | 6.27845 | 0.148763 | 12.5768 | 6.8903 | 0.049142 | 44.4331 |
| LAB162 | 29342.7 | 6.03564 | 0.136263 | 8.2231 | 4.786 | 0.973724 | 0.3232 |
| LAB162 | 29344.1 | 5.95787 | 0.326031 | 6.8287 | — | | — |
| LAB177 | 29421.2 | 5.93717 | 0.3504 | 6.4575 | 4.97681 | 0.748937 | 4.3228 |
| LAB177 | 29422.1 | 6.7189 | 0.003115 | 20.4743 | 6.75326 | 0.070778 | 41.5604 |
| LAB177 | 29424.3 | 6.34835 | 0.025715 | 13.8302 | 6.58621 | 0.053661 | 38.0587 |
| LAB177 | 29425.1 | 6.01152 | 0.112592 | 7.7906 | 5.02748 | 0.545078 | 5.3851 |
| LAB179 | 29301.4 | 6.63642 | 0.004038 | 18.9955 | 5.91931 | 0.030013 | 24.0793 |
| LAB179 | 29302.4 | 6.47615 | 0.012392 | 16.1217 | 6.12315 | 0.026383 | 28.3522 |
| LAB179 | 29303.2 | 6.33381 | 0.029445 | 13.5694 | 6.76357 | 0.093179 | 41.7765 |
| LAB179 | 29304.3 | 6.06029 | 0.103971 | 8.6649 | 5.11584 | 0.630807 | 7.2372 |
| LAB185 | 28172.2 | 5.94302 | 0.415543 | 6.5624 | — | | — |
| LAB185 | 28175.3 | 5.94938 | 0.575815 | 6.6764 | 4.80754 | 0.961878 | 0.7747 |
| LAB210 | 28331.2 | 6.60336 | 0.005567 | 18.4026 | 6.10946 | 0.099709 | 28.0653 |
| LAB210 | 28331.3 | 5.77658 | 0.626304 | 3.5779 | — | | — |
| LAB210 | 28333.2 | 6.33668 | 0.046464 | 13.6208 | 5.32985 | 0.243062 | 11.7233 |
| LAB210 | 28333.3 | 6.50488 | 0.007479 | 16.6367 | 7.4608 | 0.003681 | 56.3919 |
| LAB254 | 28811.1 | 5.71138 | 0.609884 | 2.4088 | 5.2835 | 0.431317 | 10.7516 |
| LAB254 | 28814.1 | — | | — | 4.91127 | 0.773698 | 2.9491 |
| LAB254 | 28814.5 | — | | — | 5.84136 | 0.046913 | 22.4453 |

TABLE 70-continued

Genes showing improved root performance at standard growth conditions (T2 generation)

| Gene Name | Event # | Roots Length [cm] Ave. | p-val. | % Incr. | Roots Coverage [cm2] Ave. | p-val. | % Incr. |
|---|---|---|---|---|---|---|---|
| LAB254 | 28815.3 | 6.21195 | 0.040344 | 11.3844 | 6.27497 | 0.2088 | 31.5346 |
| LAB254 | 28815.4 | 6.4119 | 0.012868 | 14.9696 | 7.3127 | 0.002523 | 53.2874 |
| LAB293 | 29232.2 | 6.12234 | 0.204054 | 9.7776 | 6.0277 | 0.251369 | 26.3514 |
| LAB293 | 29233.3 | 5.76625 | 0.539234 | 3.3928 | 5.33282 | 0.222562 | 11.7855 |
| LAB293 | 29235.4 | 5.80665 | 0.688421 | 4.117 | 5.84727 | 0.36689 | 22.5693 |
| LAB297 | 29272.1 | 5.72116 | 0.581364 | 2.5842 | — | | |
| LAB297 | 29272.5 | 6.41932 | 0.013288 | 15.1026 | 6.39628 | 0.022544 | 34.0775 |
| LAB297 | 29273.1 | 5.60442 | 0.956556 | 0.491 | 5.50905 | 0.575879 | 15.4797 |
| LAB297 | 29273.4 | 5.81603 | 0.393471 | 4.2854 | 6.0681 | 0.095267 | 27.1983 |
| LAB297 | 29275.1 | — | | — | 5.39748 | 0.231952 | 13.141 |
| LAB310 | 28181.2 | 6.37961 | 0.014501 | 14.3906 | 5.0129 | 0.595718 | 5.0794 |
| LAB310 | 28181.3 | 6.32074 | 0.027707 | 13.3351 | 5.66699 | 0.163313 | 18.7904 |
| LAB310 | 28182.3 | 5.70463 | 0.864828 | 2.2878 | — | | — |
| LAB310 | 28183.3 | 6.11374 | 0.186476 | 9.6234 | 5.76972 | 0.11541 | 20.9436 |
| LAB318 | 28101.3 | 6.28403 | 0.037305 | 12.6768 | 5.02906 | 0.641867 | 5.4182 |
| LAB318 | 28101.5 | 5.64398 | 0.898379 | 1.2004 | — | | — |
| LAB318 | 28101.7 | 6.13046 | 0.167304 | 9.9232 | 5.67323 | 0.468659 | 18.921 |
| LAB318 | 28103.2 | 5.87229 | 0.51228 | 5.294 | 4.91796 | 0.765211 | 3.0892 |
| LAB318 | 28104.3 | 6.21347 | 0.03784 | 11.4116 | 6.3149 | 0.174093 | 32.3716 |
| LAB327 | 29221.2 | 6.38529 | 0.016825 | 14.4924 | 4.80217 | 0.948991 | 0.6622 |
| LAB327 | 29221.5 | 6.38404 | 0.025738 | 14.4701 | 5.3969 | 0.336048 | 13.1287 |
| LAB327 | 29221.6 | 6.06705 | 0.212352 | 8.7862 | 7.29434 | 0.197655 | 52.9026 |
| LAB327 | 29221.8 | — | | — | 5.54073 | 0.265936 | 16.1437 |
| LAB327 | 29225.4 | 6.20291 | 0.056082 | 11.2223 | 5.54796 | 0.105138 | 16.2952 |
| LAB335 | 27314.2 | — | | — | 5.34718 | 0.488777 | 12.0864 |
| CONT | — | 5.57704 | — | 0 | 4.77058 | — | 0 |
| LAB102 | 30312.2 | 6.19705 | 0.205333 | 10.0026 | 5.82708 | 0.287542 | 30.4255 |
| LAB102 | 30312.4 | 6.38014 | 0.060475 | 13.2526 | 5.36664 | 0.034387 | 20.1196 |
| LAB102 | 30313.2 | 5.70939 | 0.795102 | 1.3463 | 6.37342 | 0.142259 | 42.654 |
| LAB102 | 30313.3 | 6.65847 | 0.000118 | 18.1933 | 8.96725 | 0.01771 | 100.711 |
| LAB102 | 30314.3 | 6.35659 | 0.006659 | 12.8347 | 7.8193 | 0.040467 | 75.0165 |
| LAB126 | 30201.3 | 7.03519 | 0.000847 | 24.8803 | 10.8264 | 0.006182 | 142.323 |
| LAB126 | 30202.3 | 6.99093 | 0.003462 | 24.0947 | 7.34382 | 0.082628 | 64.374 |
| LAB126 | 30203.3 | 7.33133 | 0.000671 | 30.137 | 10.6049 | 0.000578 | 137.365 |
| LAB126 | 30205.1 | 7.09576 | 0.000004 | 25.9554 | 8.91827 | 0.008951 | 99.6145 |
| LAB126 | 30205.3 | 6.98065 | 0.004562 | 23.9121 | 8.2004 | 0.004351 | 83.5465 |
| LAB165 | 30231.1 | 7.26758 | 0.000138 | 29.0055 | 10.304 | 0.00177 | 130.631 |
| LAB165 | 30231.2 | — | | — | 5.15378 | 0.111928 | 15.3552 |
| LAB165 | 30232.1 | 5.8765 | 0.741345 | 4.3126 | 7.0496 | 0.09824 | 57.7886 |
| LAB165 | 30233.1 | 5.83346 | 0.50949 | 3.5486 | 7.43001 | 0.020732 | 66.3032 |
| LAB165 | 30235.1 | — | | — | 5.23405 | 0.119274 | 17.1518 |
| LAB167 | 27321.4 | 7.44884 | 0.00001 | 32.223 | 9.31699 | 0.001375 | 108.539 |
| LAB167 | 27321.6 | 6.27115 | 0.004739 | 11.318 | 6.01431 | 0.00065 | 34.6162 |
| LAB220 | 30321.4 | 6.76444 | 0.003424 | 20.0743 | 10.9381 | 0.019015 | 144.824 |
| LAB220 | 30322.2 | 6.85455 | 0.00009 | 21.6738 | 5.68539 | 0.080244 | 27.2539 |
| LAB220 | 30322.3 | 6.81179 | 0.003784 | 20.9147 | 8.6371 | 0.005247 | 93.3211 |
| LAB220 | 30323.1 | 6.6657 | 0.00075 | 18.3215 | 5.74559 | 0.009635 | 28.6015 |
| LAB220 | 30324.4 | 6.25595 | 0.163769 | 11.0482 | 7.93821 | 0.014607 | 77.6781 |
| LAB241 | 30211.3 | 6.17402 | 0.089647 | 9.5939 | 5.34938 | 0.261386 | 19.7332 |
| LAB241 | 30212.2 | — | | — | 4.54658 | 0.85342 | 1.7645 |
| LAB241 | 30214.4 | 5.66263 | 0.914559 | 0.5162 | — | | — |
| LAB268 | 30391.4 | — | | — | 5.22346 | 0.212544 | 16.9149 |
| LAB268 | 30392.1 | 6.11419 | 0.080625 | 8.5319 | 4.63222 | 0.635127 | 3.6813 |
| LAB268 | 30392.2 | 6.09504 | 0.164305 | 8.1919 | 6.21287 | 0.08952 | 39.0604 |
| LAB268 | 30393.3 | 5.7466 | 0.568624 | 2.0068 | 4.6348 | 0.666343 | 3.739 |
| LAB268 | 30395.1 | 6.38642 | 0.006205 | 13.3641 | 9.09578 | 0.004751 | 103.588 |
| LAB280 | 30041.1 | 6.81493 | 0.001432 | 20.9705 | 7.46804 | 0.040012 | 67.1544 |
| LAB280 | 30044.1 | 6.05212 | 0.105308 | 7.4301 | 5.97359 | 0.144883 | 33.7048 |
| LAB280 | 30045.3 | 6.67626 | 0.094752 | 18.5089 | 8.29606 | 0.053185 | 85.6877 |
| LAB289 | 30371.2 | 5.75101 | 0.613303 | 2.085 | 4.55532 | 0.818857 | 1.9601 |
| LAB289 | 30371.4 | 6.85042 | 0.006644 | 21.6005 | 8.86128 | 0.008067 | 98.3387 |
| LAB289 | 30371.6 | 6.93502 | 0.000051 | 23.1023 | 7.4658 | 0.002415 | 67.1044 |
| LAB289 | 30375.2 | 6.49988 | 0.000421 | 15.3782 | 9.66447 | 0.001861 | 116.316 |
| LAB289 | 30375.3 | 6.44628 | 0.033062 | 14.4266 | 9.71969 | 0.001787 | 117.552 |
| LAB303 | 30424.3 | 5.8333 | 0.476111 | 3.5459 | 8.58181 | 0.000002 | 92.0835 |
| LAB303 | 30425.3 | 5.98222 | 0.372456 | 6.1893 | 8.14858 | 0.040293 | 82.3868 |
| CONT | — | 5.63355 | — | 0 | 4.46775 | — | 0 |
| LAB303 | 30421.2 | — | | — | 7.02896 | 0.810685 | 3.1247 |
| LAB311 | 30223.4 | 7.33751 | 0.158355 | 6.4637 | 9.84886 | 0.124024 | 44.4966 |
| LAB355 | 29281.3 | — | | — | 8.1774 | 0.087061 | 19.9738 |
| LAB355 | 29282.2 | — | | — | 8.45519 | 0.176963 | 24.0494 |
| LAB367 | 30173.3 | — | | — | 7.33898 | 0.710281 | 7.6731 |
| LAB381 | 30352.4 | 7.26644 | 0.283058 | 5.4326 | 8.80456 | 0.107771 | 29.1752 |
| LAB381 | 30354.2 | — | | — | 10.1606 | 0.117183 | 49.0702 |

TABLE 70-continued

Genes showing improved root performance at standard growth conditions (T2 generation)

| Gene Name | Event # | Roots Length [cm] | | | Roots Coverage [cm2] | | |
|---|---|---|---|---|---|---|---|
| | | Ave. | p-val. | % Incr. | Ave. | p-val. | % Incr. |
| LAB383 | 28111.3 | — | | — | 7.33249 | 0.672264 | 7.5779 |
| LAB64 | 30272.1 | — | | — | 6.99529 | 0.832978 | 2.6307 |
| LAB64 | 30273.2 | — | | — | 7.77573 | 0.596997 | 14.0809 |
| LAB64 | 30274.2 | — | | — | 7.47386 | 0.492374 | 9.652 |
| LAB92 | 29322.1 | — | | — | 7.72077 | 0.628135 | 13.2744 |
| LAB92 | 29323.2 | — | | — | 8.07587 | 0.238597 | 18.4842 |
| LAB92 | 29325.1 | 7.17628 | 0.402451 | 4.1243 | — | | — |
| CONT | | 6.89203 | — | 0 | 6.81598 | — | 0 |
| LAB172 | 30854.1 | 6.55703 | 0.525011 | 2.8379 | 6.20829 | 0.3001 | 18.9646 |
| LAB172 | 30854.4 | 6.81657 | 0.281904 | 6.9084 | 6.17642 | 0.065606 | 18.3541 |
| LAB188 | 30722.2 | 7.35723 | 0.000553 | 15.3878 | 8.48065 | 0.000169 | 62.5082 |
| LAB188 | 30724.1 | 6.89466 | 0.069155 | 8.1331 | 5.54721 | 0.484242 | 6.2971 |
| LAB243 | 27101.1 | 6.70946 | 0.182391 | 5.2285 | 6.07671 | 0.377423 | 16.4434 |
| LAB243 | 30872.1 | — | | — | 6.2724 | 0.326111 | 20.1932 |
| LAB243 | 30873.4 | 6.54574 | 0.671719 | 2.6607 | 8.04283 | 0.02301 | 54.1186 |
| LAB270 | 30591.2 | 6.41944 | 0.94381 | 0.6799 | 6.37312 | 0.404632 | 22.1232 |
| LAB270 | 30594.3 | 6.71293 | 0.149306 | 5.2829 | — | | — |
| LAB270 | 30595.2 | — | | — | 6.00722 | 0.366753 | 15.1118 |
| LAB291 | 31851.2 | — | | — | 6.32551 | 0.075328 | 21.211 |
| LAB291 | 31851.3 | — | | — | 6.72968 | 0.1501 | 28.9558 |
| LAB291 | 31852.4 | 6.65836 | 0.53786 | 4.4271 | 6.85046 | 0.064018 | 31.2701 |
| LAB291 | 31853.3 | — | | — | 6.05274 | 0.012332 | 15.984 |
| LAB291 | 31854.4 | 6.86916 | 0.019457 | 7.7332 | 6.3837 | 0.002718 | 22.326 |
| LAB295 | 31861.3 | — | | — | 6.32458 | 0.141135 | 21.1931 |
| LAB295 | 31863.1 | — | | — | 6.01394 | 0.049525 | 15.2405 |
| LAB295 | 31864.3 | 6.88793 | 0.033192 | 8.0276 | 6.50057 | 0.067324 | 24.5654 |
| LAB295 | 31864.4 | 6.73646 | 0.343961 | 5.6519 | 8.92573 | 0.002292 | 71.0369 |
| LAB295 | 31865.1 | — | | — | 5.35137 | 0.872569 | 2.5443 |
| LAB323 | 30381.4 | — | | — | 6.19624 | 0.344372 | 18.7733 |
| LAB323 | 30383.1 | 7.37228 | 0.013439 | 15.6239 | 6.27634 | 0.081365 | 20.2687 |
| LAB323 | 30383.2 | — | | — | 5.87189 | 0.139614 | 12.5185 |
| LAB323 | 30385.1 | 6.38617 | 0.981405 | 0.1582 | 5.67724 | 0.580263 | 8.7887 |
| LAB347_H0 | 30441.1 | 7.16102 | 0.002576 | 12.3106 | 7.29379 | 0.000004 | 39.7653 |
| LAB347_H0 | 30442.4 | 6.70618 | 0.199422 | 5.1771 | 5.39654 | 0.607197 | 3.4099 |
| LAB347_H0 | 30444.1 | — | | — | 6.78346 | 0.012588 | 29.9862 |
| LAB347_H0 | 30444.3 | 6.86861 | 0.056978 | 7.7245 | 6.23363 | 0.06923 | 19.4503 |
| LAB55 | 30022.3 | 6.45594 | 0.872834 | 1.2524 | — | | — |
| LAB55 | 30023.1 | 6.39324 | 0.96162 | 0.269 | 5.7609 | 0.312271 | 10.3917 |
| LAB94 | 30681.4 | 6.67422 | 0.37818 | 4.6759 | 5.28519 | 0.903557 | 1.276 |
| LAB94 | 30681.8 | 6.38898 | 0.968264 | 0.2021 | — | | — |
| LAB94 | 30682.2 | 6.64908 | 0.20728 | 4.2815 | — | | — |
| LAB94 | 30682.3 | 6.39575 | 0.923053 | 0.3083 | — | | — |
| CONT | | 6.37609 | — | 0 | 5.2186 | — | 0 |
| LAB243 | 30873.2 | 7.42215 | 0.954916 | 0.1615 | — | | — |
| CONT | | 7.41018 | — | 0 | — | | — |

Table 70.
"CONT."—Control;
"Ave."—Average;
"% Incr." = % increment;
"p-val."—p-value.

TABLE 71

Genes showing improved root performance at standard growth conditions (T1 generation)

| Gene Name | Event # | Roots Length_[cm] | | | Gene Name | Event # | Roots Coverage [cm2] | | |
|---|---|---|---|---|---|---|---|---|---|
| | | Ave. | p-val. | % | | | Ave. | p-val. | % |
| LAB211 | 32581.00 | 0.41 | 0.09 | 9 | LAB211 | 32581.00 | 3.37 | 0.01 | 22 |
| LAB236 | 33201.00 | — | | — | LAB236 | 33201.00 | 3.82 | 0.00 | 39 |
| LAB291 | 31851.00 | — | | — | LAB291 | 31851.00 | 2.80 | 0.83 | 2 |
| cont | — | 0.38 | — | 0 | cont | — | 2.76 | — | 0 |
| LAB349 | 32391.00 | — | | — | LAB349 | 32391.00 | 2.81 | 0.66 | 5 |
| LAB53 | 32461.00 | 0.38 | 0.26 | 8 | LAB53 | 32461.00 | 3.08 | 0.31 | 16 |

TABLE 71-continued

Genes showing improved root performance at standard growth conditions (T1 generation)

| Gene Name | Event # | Roots Length [cm] Ave. | p-val. | % | Gene Name | Event # | Roots Coverage [cm2] Ave. | p-val. | % |
|---|---|---|---|---|---|---|---|---|---|
| LAB69 | 32451.00 | 0.40 | 0.11 | 13 | LAB69 | 32451.00 | 3.06 | 0.54 | 15 |
| cont | — | 0.35 | — | 0 | cont | — | 2.67 | — | 0 |

Table 71.
"CONT."—Control;
"Ave."—Average;
"% Incr." = % increment;
"p-val."—p-value.

The genes listed in Tables 72-73 improved plant growth rate (leaf area, root length and root coverage growth rate) when grown at standard growth conditions. These produced plants that grew faster than control plants when grown under standard growth conditions. Faster growth was observed when growth rate of leaf area and root length and coverage was measured. The genes were cloned under the regulation of a constitutive promoter (At6669; SEQ ID NO:8741). Evaluation of each gene was performed by testing the performance of different number of events. Some of the genes were evaluated in more than one tissue culture assay resulting in positive results as well. Event with p-value <0.1 was considered statistically significant

TABLE 72

Genes showing improved growth rate at standard growth conditions (T2 generation)

| Gene Name | Event # | RGR Of Leaf Area Ave. | p-val. | % Incr | RGR Of Roots Coverage Ave. | p-val. | % Incr | RGR Of Roots Length Ave. | p-val. | % Incr |
|---|---|---|---|---|---|---|---|---|---|---|
| LAB115 | 27281.2 | 0.05 | 0.34 | 88 | 0.46 | 0.21 | 170 | 0.28 | 0.75 | 22 |
| LAB115 | 27282.3 | 0.03 | 0.65 | 34 | 0.26 | 0.66 | 51 | 0.30 | 0.63 | 31 |
| LAB115 | 27284.3 | 0.03 | 0.73 | 24 | 0.38 | 0.22 | 126 | 0.27 | 0.79 | 18 |
| LAB115 | 27285.2 | — | — | — | 0.37 | 0.25 | 121 | — | — | — |
| LAB115 | 27285.4 | 0.03 | 0.62 | 33 | 0.20 | 0.83 | 18 | — | — | — |
| LAB123 | 28282.3 | 0.05 | 0.19 | 97 | 0.17 | 0.98 | 3 | 0.32 | 0.53 | 40 |
| LAB123 | 28283.1 | 0.03 | 0.91 | 8 | 0.29 | 0.46 | 72 | 0.27 | 0.82 | 16 |
| LAB123 | 28284.2 | — | — | — | 0.26 | 0.58 | 53 | 0.29 | 0.67 | 28 |
| LAB123 | 28284.3 | 0.03 | 0.75 | 19 | 0.30 | 0.42 | 78 | — | — | — |
| LAB123 | 28285.2 | 0.06 | 0.15 | 125 | 0.40 | 0.28 | 139 | 0.30 | 0.63 | 33 |
| LAB183 | 27451.4 | — | — | — | 0.23 | 0.69 | 34 | — | — | — |
| LAB183 | 27452.2 | 0.03 | 0.94 | 6 | 0.34 | 0.30 | 102 | — | — | — |
| LAB183 | 27453.1 | 0.03 | 0.74 | 22 | 0.23 | 0.73 | 36 | 0.28 | 0.73 | 22 |
| LAB183 | 27453.4 | 0.03 | 0.97 | 2 | 0.18 | 0.95 | 5 | — | — | — |
| LAB183 | 27454.2 | 0.03 | 0.65 | 31 | 0.20 | 0.89 | 15 | 0.33 | 0.49 | 45 |
| LAB189 | 28163.2 | 0.03 | 0.57 | 39 | 0.21 | 0.81 | 22 | 0.24 | 0.94 | 5 |
| LAB189 | 28165.2 | — | — | — | 0.19 | 0.91 | 9 | — | — | — |
| LAB189 | 28166.1 | 0.03 | 0.57 | 37 | — | — | — | 0.34 | 0.46 | 47 |
| LAB189 | 28166.2 | — | — | — | 0.17 | 0.97 | 3 | 0.23 | 0.97 | 2 |
| LAB189 | 28166.5 | — | — | — | — | — | — | 0.24 | 0.94 | 5 |
| LAB212 | 28041.1 | — | — | — | 0.21 | 0.81 | 25 | 0.37 | 0.33 | 62 |
| LAB212 | 28042.1 | 0.04 | 0.53 | 53 | 0.43 | 0.22 | 157 | 0.24 | 0.95 | 5 |
| LAB212 | 28043.2 | 0.05 | 0.33 | 85 | 0.58 | 0.05 | 242 | — | — | — |
| LAB212 | 28044.2 | 0.03 | 0.83 | 13 | 0.22 | 0.76 | 28 | 0.29 | 0.65 | 27 |
| LAB212 | 28045.2 | 0.03 | 0.89 | 9 | 0.28 | 0.49 | 63 | — | — | — |
| LAB217 | 28033.2 | — | — | — | 0.33 | 0.31 | 98 | — | — | — |
| LAB217 | 28034.1 | — | — | — | 0.27 | 0.50 | 59 | — | — | — |
| LAB217 | 28035.1 | — | — | — | 0.27 | 0.55 | 59 | 0.29 | 0.70 | 26 |
| LAB217 | 28035.3 | 0.04 | 0.53 | 42 | 0.25 | 0.60 | 50 | 0.24 | 0.97 | 2 |
| LAB217 | 28036.4 | 0.03 | 0.90 | 9 | 0.25 | 0.63 | 46 | 0.26 | 0.83 | 14 |
| LAB326 | 28052.4 | — | — | — | 0.24 | 0.62 | 44 | — | — | — |
| LAB326 | 28053.2 | 0.03 | 0.94 | 6 | 0.28 | 0.48 | 63 | — | — | — |
| LAB326 | 28054.1 | 0.03 | 0.85 | 13 | 0.26 | 0.54 | 53 | — | — | — |
| LAB326 | 28056.2 | 0.04 | 0.44 | 60 | 0.33 | 0.39 | 94 | — | — | — |
| LAB326 | 28056.3 | 0.03 | 0.71 | 27 | 0.25 | 0.62 | 48 | — | — | — |
| LAB93 | 28271.3 | 0.03 | 0.90 | 7 | — | — | — | 0.27 | 0.78 | 18 |
| LAB93 | 28271.4 | — | — | — | 0.23 | 0.64 | 37 | — | — | — |
| LAB93 | 28272.3 | 0.03 | 0.75 | 19 | — | — | — | — | — | — |
| LAB93 | 28274.2 | 0.03 | 0.81 | 14 | — | — | — | 0.31 | 0.60 | 33 |
| LAB93 | 28275.2 | — | — | — | 0.24 | 0.67 | 43 | 0.28 | 0.73 | 23 |
| cont | — | 0.03 | — | 0 | 0.17 | — | 0 | 0.23 | — | 0 |
| LAB115 | 27281.3 | — | — | — | — | — | — | 0.52 | 0.82 | 3 |
| LAB115 | 27284.3 | 0.05 | 0.82 | 4 | — | — | — | 0.52 | 0.78 | 3 |

TABLE 72-continued

Genes showing improved growth rate at standard growth conditions (T2 generation)

| Gene Name | Event # | RGR Of Leaf Area | | | RGR Of Roots Coverage | | | RGR Of Roots Length | | |
|---|---|---|---|---|---|---|---|---|---|---|
| | | Ave. | p-val. | % Incr | Ave. | p-val. | % Incr | Ave. | p-val. | % Incr |
| LAB115 | 27285.1 | 0.07 | 0.02 | 52 | 0.58 | 0.31 | 19 | — | | — |
| LAB123 | 28281.1 | 0.08 | 0.00 | 76 | 0.81 | 0.00 | 65 | 0.52 | 0.74 | 4 |
| LAB123 | 28282.3 | 0.07 | 0.01 | 51 | 0.68 | 0.01 | 39 | 0.54 | 0.53 | 7 |
| LAB123 | 28283.1 | 0.07 | 0.00 | 64 | 0.67 | 0.02 | 37 | 0.55 | 0.39 | 8 |
| LAB123 | 28284.1 | 0.06 | 0.07 | 31 | 0.71 | 0.01 | 43 | 0.59 | 0.09 | 17 |
| LAB123 | 28285.2 | 0.08 | 0.00 | 74 | 0.81 | 0.00 | 65 | 0.56 | 0.32 | 10 |
| LAB183 | 27453.4 | 0.06 | 0.15 | 24 | 0.58 | 0.25 | 18 | — | | — |
| LAB183 | 27454.1 | — | | — | — | | — | 0.51 | 0.93 | 1 |
| LAB189 | 28163.2 | — | | — | 0.57 | 0.34 | 16 | 0.57 | 0.20 | 14 |
| LAB189 | 28166.2 | 0.06 | 0.04 | 36 | 0.65 | 0.06 | 32 | 0.56 | 0.27 | 12 |
| LAB189 | 28166.5 | 0.07 | 0.03 | 46 | 0.75 | 0.02 | 52 | 0.52 | 0.71 | 4 |
| LAB206 | 30011.2 | 0.07 | 0.00 | 66 | 0.59 | 0.19 | 20 | 0.53 | 0.60 | 5 |
| LAB206 | 30012.4 | 0.05 | 0.24 | 22 | 0.70 | 0.02 | 42 | 0.61 | 0.04 | 21 |
| LAB206 | 30012.8 | 0.07 | 0.00 | 49 | 0.68 | 0.04 | 38 | 0.56 | 0.29 | 11 |
| LAB212 | 28041.1 | — | | — | 0.54 | 0.53 | 10 | 0.58 | 0.14 | 14 |
| LAB212 | 28042.1 | — | | — | 0.51 | 0.83 | 3 | — | | — |
| LAB212 | 28044.2 | 0.05 | 0.94 | 1 | — | | — | — | | — |
| LAB212 | 28045.1 | 0.06 | 0.12 | 26 | 0.56 | 0.41 | 14 | — | | — |
| LAB217 | 28033.2 | 0.06 | 0.02 | 43 | 0.77 | 0.00 | 57 | 0.62 | 0.06 | 22 |
| LAB217 | 28034.1 | 0.07 | 0.02 | 58 | 0.62 | 0.18 | 27 | — | | — |
| LAB217 | 28034.3 | 0.07 | 0.00 | 58 | 0.71 | 0.01 | 43 | 0.57 | 0.24 | 12 |
| LAB217 | 28035.1 | 0.06 | 0.02 | 45 | 0.70 | 0.01 | 42 | 0.53 | 0.64 | 4 |
| LAB217 | 28036.1 | 0.06 | 0.02 | 40 | 0.70 | 0.01 | 41 | 0.56 | 0.23 | 12 |
| LAB250 | 30251.2 | 0.05 | 0.68 | 8 | 0.52 | 0.77 | 5 | — | | — |
| LAB250 | 30253.1 | — | | — | 0.50 | 0.95 | 1 | — | | — |
| LAB250 | 30254.1 | — | | — | 0.56 | 0.37 | 14 | 0.60 | 0.09 | 18 |
| LAB250 | 30254.3 | 0.05 | 0.42 | 14 | 0.51 | 0.84 | 3 | 0.54 | 0.51 | 7 |
| LAB314 | 29292.4 | 0.05 | 0.59 | 10 | — | | — | 0.55 | 0.37 | 10 |
| LAB314 | 29292.6 | 0.06 | 0.01 | 43 | 0.53 | 0.64 | 7 | — | | — |
| LAB314 | 29294.1 | 0.05 | 0.57 | 13 | 0.50 | 0.98 | 1 | — | | — |
| LAB314 | 29295.2 | 0.06 | 0.08 | 32 | 0.56 | 0.38 | 13 | 0.56 | 0.21 | 12 |
| LAB326 | 28052.4 | 0.05 | 0.34 | 16 | 0.67 | 0.03 | 37 | 0.59 | 0.10 | 17 |
| LAB326 | 28053.2 | — | | — | 0.52 | 0.75 | 5 | 0.58 | 0.15 | 15 |
| LAB326 | 28056.3 | 0.05 | 0.44 | 13 | 0.69 | 0.01 | 40 | 0.59 | 0.08 | 17 |
| LAB351 | 30112.1 | 0.05 | 0.89 | 2 | — | | — | 0.53 | 0.63 | 5 |
| LAB351 | 30114.2 | 0.05 | 0.23 | 20 | 0.61 | 0.13 | 25 | 0.61 | 0.07 | 20 |
| LAB351 | 30115.3 | — | | — | — | | — | 0.54 | 0.52 | 7 |
| LAB93 | 28271.3 | 0.05 | 0.27 | 18 | 0.54 | 0.52 | 10 | 0.51 | 0.91 | 1 |
| LAB93 | 28271.4 | 0.06 | 0.20 | 28 | — | | — | — | | — |
| LAB93 | 28272.3 | 0.08 | 0.00 | 80 | 0.57 | 0.35 | 16 | 0.51 | 0.95 | 1 |
| LAB93 | 28274.2 | 0.06 | 0.13 | 27 | 0.54 | 0.60 | 10 | — | | — |
| LAB93 | 28274.3 | 0.05 | 0.84 | 4 | — | | — | 0.54 | 0.48 | 7 |
| cont | — | 0.04 | — | 0 | 0.49 | — | 0 | 0.50 | — | 0 |
| LAB106 | 30031.4 | — | | — | — | | — | 0.53 | 0.23 | 15 |
| LAB106 | 30032.1 | 0.07 | 0.08 | 20 | 0.71 | 0.12 | 16 | 0.49 | 0.59 | 6 |
| LAB106 | 30032.2 | 0.07 | 0.01 | 31 | 0.66 | 0.48 | 7 | 0.48 | 0.62 | 6 |
| LAB106 | 30035.1 | — | | — | — | | — | 0.52 | 0.30 | 13 |
| LAB106 | 30035.2 | — | | — | — | | — | 0.47 | 0.80 | 4 |
| LAB206 | 30011.4 | — | | — | — | | — | 0.46 | 0.94 | 1 |
| LAB206 | 30011.7 | 0.07 | 0.01 | 30 | 0.73 | 0.07 | 19 | — | | — |
| LAB206 | 30012.4 | 0.06 | 0.40 | 15 | 0.84 | 0.05 | 36 | 0.55 | 0.18 | 20 |
| LAB206 | 30012.8 | — | | — | 0.70 | 0.19 | 13 | 0.54 | 0.15 | 18 |
| LAB207 | 28842.1 | 0.06 | 0.33 | 12 | 0.78 | 0.01 | 26 | 0.50 | 0.50 | 9 |
| LAB207 | 28842.5 | — | | — | 0.81 | 0.01 | 31 | 0.56 | 0.15 | 23 |
| LAB207 | 28843.3 | 0.08 | 0.00 | 44 | 0.66 | 0.42 | 8 | 0.47 | 0.77 | 4 |
| LAB207 | 28843.5 | — | | — | 0.80 | 0.00 | 31 | 0.59 | 0.02 | 28 |
| LAB207 | 28845.1 | — | | — | 0.76 | 0.01 | 23 | 0.53 | 0.20 | 16 |
| LAB218 | 29431.1 | — | | — | 0.71 | 0.18 | 15 | 0.53 | 0.18 | 16 |
| LAB218 | 29431.3 | — | | — | — | | — | 0.51 | 0.34 | 12 |
| LAB218 | 29432.2 | 0.08 | 0.02 | 34 | 0.80 | 0.02 | 30 | 0.61 | 0.02 | 33 |
| LAB218 | 29433.4 | — | | — | — | | — | 0.60 | 0.02 | 31 |
| LAB218 | 29434.3 | 0.06 | 0.54 | 7 | — | | — | 0.50 | 0.44 | 10 |
| LAB250 | 30251.2 | — | | — | — | | — | 0.48 | 0.75 | 4 |
| LAB250 | 30252.1 | — | | — | 0.73 | 0.07 | 19 | 0.60 | 0.02 | 31 |
| LAB250 | 30253.1 | 0.07 | 0.15 | 22 | 0.83 | 0.01 | 35 | 0.50 | 0.45 | 10 |
| LAB250 | 30254.1 | — | | — | 0.68 | 0.27 | 11 | 0.55 | 0.13 | 20 |
| LAB250 | 30254.3 | — | | — | 0.73 | 0.07 | 18 | 0.59 | 0.05 | 30 |
| LAB252 | 30291.2 | — | | — | — | | — | 0.49 | 0.59 | 7 |
| LAB252 | 30291.4 | 0.06 | 0.83 | 2 | — | | — | — | | — |
| LAB252 | 30292.3 | 0.09 | 0.00 | 68 | 0.91 | 0.00 | 49 | 0.60 | 0.02 | 30 |
| LAB309 | 30052.2 | 0.09 | 0.00 | 67 | 0.84 | 0.01 | 36 | 0.53 | 0.29 | 15 |
| LAB309 | 30052.3 | 0.07 | 0.16 | 16 | 0.69 | 0.33 | 12 | — | | — |

TABLE 72-continued

Genes showing improved growth rate at standard growth conditions (T2 generation)

| Gene Name | Event # | RGR Of Leaf Area | | | RGR Of Roots Coverage | | | RGR Of Roots Length | | |
|---|---|---|---|---|---|---|---|---|---|---|
| | | Ave. | p-val. | % Incr | Ave. | p-val. | % Incr | Ave. | p-val. | % Incr |
| LAB309 | 30054.2 | — | — | — | — | — | — | 0.47 | 0.89 | 2 |
| LAB309 | 30055.4 | — | — | — | — | — | — | 0.53 | 0.18 | 16 |
| LAB309 | 30056.1 | — | — | — | — | — | — | 0.52 | 0.34 | 13 |
| LAB314 | 29292.4 | 0.08 | 0.04 | 46 | 0.91 | 0.00 | 48 | 0.56 | 0.09 | 21 |
| LAB314 | 29292.6 | 0.07 | 0.01 | 33 | 0.82 | 0.02 | 33 | 0.54 | 0.19 | 18 |
| LAB314 | 29294.1 | 0.06 | 0.34 | 11 | 0.72 | 0.09 | 17 | 0.52 | 0.26 | 15 |
| LAB314 | 29295.2 | 0.07 | 0.06 | 21 | 0.74 | 0.19 | 21 | 0.46 | 0.92 | 1 |
| LAB346 | 29442.2 | — | — | — | — | — | — | 0.52 | 0.33 | 13 |
| LAB346 | 29442.4 | 0.06 | 0.99 | 0 | 0.71 | 0.24 | 15 | 0.63 | 0.01 | 37 |
| LAB346 | 29443.2 | 0.06 | 0.25 | 13 | 0.88 | 0.00 | 44 | 0.54 | 0.26 | 17 |
| LAB346 | 29445.2 | 0.06 | 0.50 | 7 | — | — | — | — | — | — |
| LAB346 | 29445.3 | 0.06 | 0.41 | 8 | 0.62 | 0.90 | 1 | 0.47 | 0.76 | 4 |
| LAB351 | 30111.2 | 0.07 | 0.06 | 24 | 0.95 | 0.00 | 54 | 0.55 | 0.15 | 19 |
| LAB351 | 30112.1 | 0.06 | 0.45 | 9 | — | — | — | — | — | — |
| LAB351 | 30114.2 | 0.07 | 0.16 | 16 | 0.72 | 0.30 | 16 | 0.53 | 0.26 | 16 |
| LAB351 | 30115.1 | — | — | — | — | — | — | 0.54 | 0.15 | 17 |
| LAB351 | 30115.3 | — | — | — | 0.72 | 0.06 | 17 | 0.56 | 0.09 | 22 |
| LAB82 | 30181.3 | — | — | — | 0.79 | 0.05 | 29 | 0.62 | 0.01 | 35 |
| LAB82 | 30182.2 | — | — | — | 0.76 | 0.09 | 24 | 0.62 | 0.02 | 35 |
| LAB82 | 30183.2 | — | — | — | 0.63 | 0.73 | 3 | 0.54 | 0.19 | 17 |
| LAB82 | 30184.2 | — | — | — | — | — | — | 0.47 | 0.78 | 4 |
| LAB84 | 30161.4 | — | — | — | — | — | — | 0.52 | 0.23 | 14 |
| LAB84 | 30162.2 | 0.08 | 0.00 | 42 | 1.11 | 0.00 | 81 | 0.56 | 0.06 | 23 |
| LAB84 | 30162.4 | 0.07 | 0.10 | 23 | 0.77 | 0.03 | 26 | 0.53 | 0.21 | 17 |
| LAB84 | 30163.4 | 0.08 | 0.00 | 47 | 0.82 | 0.00 | 33 | 0.56 | 0.08 | 22 |
| LAB84 | 30164.2 | 0.07 | 0.01 | 32 | 0.74 | 0.09 | 21 | 0.57 | 0.05 | 25 |
| cont | — | 0.06 | — | 0 | 0.61 | — | 0 | 0.46 | — | 0 |
| LAB110 | 30571.3 | 0.08 | 0.03 | 30 | 1.00 | 0.00 | 51 | 0.60 | 0.58 | 4 |
| LAB110 | 30572.1 | 0.06 | 0.47 | 9 | 0.75 | 0.20 | 14 | 0.60 | 0.54 | 5 |
| LAB110 | 30573.2 | 0.06 | 0.97 | 1 | — | — | — | — | — | — |
| LAB110 | 30574.2 | 0.08 | 0.02 | 31 | 0.81 | 0.05 | 22 | — | — | — |
| LAB117 | 27291.1 | 0.07 | 0.19 | 19 | 0.98 | 0.00 | 49 | 0.60 | 0.61 | 4 |
| LAB117 | 27291.5 | 0.07 | 0.11 | 21 | 0.73 | 0.44 | 10 | — | — | — |
| LAB117 | 27293.1 | 0.08 | 0.00 | 37 | 1.01 | 0.00 | 52 | 0.63 | 0.20 | 10 |
| LAB117 | 27293.2 | — | — | — | — | — | — | 0.60 | 0.60 | 4 |
| LAB124 | 30431.1 | 0.07 | 0.11 | 20 | 0.75 | 0.26 | 14 | — | — | — |
| LAB124 | 30432.3 | 0.06 | 0.98 | 0 | 0.70 | 0.61 | 6 | 0.62 | 0.30 | 8 |
| LAB124 | 30434.1 | — | — | — | — | — | — | 0.58 | 0.87 | 1 |
| LAB124 | 30434.3 | 0.08 | 0.01 | 31 | 0.77 | 0.15 | 17 | — | — | — |
| LAB124 | 30435.2 | 0.08 | 0.01 | 34 | 0.86 | 0.01 | 30 | 0.58 | 0.87 | 1 |
| LAB125 | 30581.3 | — | — | — | 0.80 | 0.13 | 21 | 0.58 | 0.99 | 0 |
| LAB125 | 30583.2 | 0.08 | 0.03 | 31 | 0.88 | 0.01 | 33 | — | — | — |
| LAB125 | 30584.2 | — | — | — | — | — | — | 0.59 | 0.81 | 2 |
| LAB156 | 30401.4 | 0.08 | 0.02 | 32 | — | — | — | — | — | — |
| LAB156 | 30402.2 | 0.09 | 0.00 | 49 | 1.01 | 0.00 | 53 | — | — | — |
| LAB156 | 30403.1 | 0.07 | 0.26 | 14 | 0.66 | 0.98 | 0 | — | — | — |
| LAB228 | 30081.4 | 0.07 | 0.32 | 13 | 0.74 | 0.33 | 12 | 0.59 | 0.74 | 3 |
| LAB228 | 30084.3 | — | — | — | — | — | — | 0.60 | 0.54 | 5 |
| LAB275 | 30361.3 | 0.09 | 0.00 | 54 | 0.79 | 0.06 | 20 | — | — | — |
| LAB275 | 30363.4 | 0.06 | 0.81 | 3 | — | — | — | — | — | — |
| LAB275 | 30366.4 | 0.06 | 0.76 | 4 | 0.70 | 0.58 | 6 | — | — | — |
| LAB276_H0 | 30331.1 | 0.10 | 0.00 | 67 | 1.07 | 0.00 | 63 | — | — | — |
| LAB276_H0 | 30331.4 | 0.07 | 0.29 | 13 | 0.75 | 0.21 | 14 | — | — | — |
| LAB276_H0 | 30333.7 | 0.07 | 0.07 | 22 | 0.74 | 0.26 | 12 | — | — | — |
| LAB277 | 30651.2 | 0.07 | 0.18 | 16 | 0.82 | 0.04 | 24 | 0.58 | 0.89 | 1 |
| LAB277 | 30652.3 | 0.08 | 0.00 | 37 | 0.68 | 0.79 | 3 | — | — | — |
| LAB277 | 30652.5 | 0.06 | 0.50 | 8 | 0.77 | 0.16 | 17 | — | — | — |
| LAB278 | 30411.4 | 0.06 | 0.73 | 4 | — | — | — | — | — | — |
| LAB278 | 30412.1 | 0.07 | 0.35 | 13 | — | — | — | — | — | — |
| LAB278 | 30413.3 | 0.08 | 0.02 | 34 | — | — | — | — | — | — |
| LAB278 | 30414.2 | 0.06 | 0.55 | 9 | 0.80 | 0.16 | 22 | — | — | — |
| LAB281 | 30741.1 | 0.06 | 0.67 | 5 | 0.77 | 0.20 | 17 | 0.59 | 0.73 | 3 |
| LAB282 | 30751.3 | 0.06 | 0.46 | 9 | — | — | — | — | — | — |
| cont | — | 0.06 | — | 0 | 0.66 | — | 0 | 0.58 | — | 0 |
| LAB110 | 30571.3 | 0.05 | 0.52 | 8 | 1.33 | 0.00 | 130 | 0.64 | 0.01 | 35 |
| LAB110 | 30572.1 | 0.05 | 0.52 | 10 | 0.93 | 0.00 | 61 | 0.60 | 0.05 | 26 |
| LAB110 | 30572.2 | 0.07 | 0.00 | 50 | 1.03 | 0.00 | 78 | 0.62 | 0.01 | 31 |
| LAB110 | 30573.2 | 0.07 | 0.02 | 31 | 0.99 | 0.00 | 72 | 0.59 | 0.06 | 24 |
| LAB110 | 30574.2 | 0.07 | 0.01 | 38 | 1.04 | 0.00 | 80 | 0.54 | 0.27 | 14 |
| LAB117 | 27291.1 | — | — | — | — | — | — | 0.55 | 0.23 | 16 |
| LAB117 | 27291.2 | 0.07 | 0.01 | 35 | 0.87 | 0.00 | 50 | 0.56 | 0.18 | 17 |
| LAB117 | 27293.1 | 0.09 | 0.00 | 77 | 1.09 | 0.00 | 89 | 0.64 | 0.01 | 34 |

TABLE 72-continued

Genes showing improved growth rate at standard growth conditions (T2 generation)

| Gene Name | Event # | RGR Of Leaf Area | | | RGR Of Roots Coverage | | | RGR Of Roots Length | | |
|---|---|---|---|---|---|---|---|---|---|---|
| | | Ave. | p-val. | % Incr | Ave. | p-val. | % Incr | Ave. | p-val. | % Incr |
| LAB117 | 27293.2 | — | | — | — | | — | 0.57 | 0.09 | 21 |
| LAB117 | 27296.1 | 0.06 | 0.42 | 10 | 0.68 | 0.22 | 17 | 0.53 | 0.40 | 11 |
| LAB124 | 30431.1 | 0.05 | 0.67 | 6 | 0.76 | 0.02 | 32 | 0.59 | 0.06 | 24 |
| LAB124 | 30432.3 | 0.06 | 0.36 | 13 | 0.68 | 0.16 | 18 | 0.58 | 0.09 | 21 |
| LAB124 | 30434.1 | 0.07 | 0.01 | 37 | 0.83 | 0.00 | 44 | 0.52 | 0.50 | 8 |
| LAB124 | 30434.3 | — | | — | — | | — | 0.55 | 0.20 | 16 |
| LAB124 | 30435.2 | — | | — | 0.72 | 0.04 | 25 | 0.59 | 0.05 | 25 |
| LAB125 | 30581.3 | 0.06 | 0.10 | 20 | 0.84 | 0.00 | 45 | 0.52 | 0.49 | 9 |
| LAB125 | 30582.2 | 0.07 | 0.00 | 42 | 0.93 | 0.00 | 61 | 0.51 | 0.55 | 7 |
| LAB125 | 30583.2 | — | | — | — | | — | 0.57 | 0.14 | 19 |
| LAB125 | 30584.2 | 0.07 | 0.00 | 48 | 0.71 | 0.08 | 23 | 0.53 | 0.37 | 12 |
| LAB156 | 30401.4 | 0.07 | 0.01 | 41 | 0.90 | 0.00 | 56 | 0.49 | 0.87 | 2 |
| LAB156 | 30402.2 | 0.06 | 0.33 | 11 | — | | — | — | | — |
| LAB156 | 30403.1 | 0.05 | 0.70 | 5 | 0.81 | 0.00 | 41 | 0.59 | 0.04 | 25 |
| LAB156 | 30403.4 | — | | — | — | | — | 0.51 | 0.53 | 8 |
| LAB156 | 30405.3 | 0.06 | 0.08 | 26 | 0.73 | 0.11 | 26 | 0.49 | 0.83 | 3 |
| LAB228 | 30081.4 | — | | — | 0.82 | 0.00 | 42 | 0.56 | 0.14 | 18 |
| LAB228 | 30082.3 | 0.06 | 0.22 | 15 | — | | — | 0.48 | 0.88 | 2 |
| LAB228 | 30084.3 | 0.05 | 0.66 | 6 | 0.63 | 0.43 | 10 | 0.55 | 0.20 | 16 |
| LAB228 | 30084.4 | 0.06 | 0.05 | 26 | 0.88 | 0.00 | 52 | 0.59 | 0.05 | 25 |
| LAB228 | 30085.2 | — | | — | — | | — | 0.49 | 0.87 | 2 |
| LAB275 | 30361.2 | 0.07 | 0.01 | 44 | 0.95 | 0.00 | 65 | 0.55 | 0.21 | 15 |
| LAB275 | 30361.3 | 0.05 | 0.82 | 3 | 0.71 | 0.06 | 24 | 0.56 | 0.18 | 17 |
| LAB275 | 30363.1 | 0.07 | 0.00 | 50 | 0.59 | 0.89 | 2 | — | | — |
| LAB275 | 30363.4 | 0.07 | 0.02 | 35 | 0.70 | 0.09 | 22 | — | | — |
| LAB275 | 30366.4 | 0.06 | 0.04 | 27 | 0.77 | 0.01 | 34 | 0.48 | 0.96 | 1 |
| LAB276_H0 | 30331.1 | 0.06 | 0.04 | 25 | 0.70 | 0.08 | 21 | 0.51 | 0.61 | 6 |
| LAB276_H0 | 30331.4 | 0.08 | 0.00 | 65 | 0.77 | 0.01 | 33 | 0.55 | 0.20 | 15 |
| LAB276_H0 | 30333.7 | 0.06 | 0.44 | 11 | 0.73 | 0.05 | 26 | 0.55 | 0.23 | 15 |
| LAB277 | 30651.2 | 0.06 | 0.15 | 20 | 0.76 | 0.01 | 32 | 0.56 | 0.15 | 17 |
| LAB277 | 30652.3 | — | | — | 0.59 | 0.88 | 2 | 0.51 | 0.56 | 7 |
| LAB277 | 30652.5 | 0.06 | 0.20 | 17 | 1.03 | 0.00 | 79 | 0.58 | 0.10 | 21 |
| LAB277 | 30652.6 | 0.06 | 0.03 | 29 | 0.90 | 0.00 | 56 | 0.51 | 0.55 | 7 |
| LAB277 | 30653.1 | 0.06 | 0.10 | 21 | 0.72 | 0.05 | 25 | 0.59 | 0.07 | 23 |
| LAB278 | 30411.4 | 0.08 | 0.00 | 55 | — | | — | — | | — |
| LAB278 | 30413.3 | 0.08 | 0.00 | 58 | 0.74 | 0.06 | 28 | 0.52 | 0.49 | 9 |
| LAB278 | 30414.1 | 0.08 | 0.00 | 64 | 0.85 | 0.00 | 46 | 0.52 | 0.49 | 9 |
| LAB278 | 30414.2 | 0.05 | 0.59 | 7 | 0.64 | 0.35 | 11 | 0.48 | 0.89 | 2 |
| LAB281 | 30741.1 | — | | — | — | | — | 0.52 | 0.45 | 9 |
| LAB281 | 30742.1 | — | | — | — | | — | 0.50 | 0.70 | 5 |
| LAB281 | 30742.4 | 0.06 | 0.02 | 28 | 0.82 | 0.00 | 42 | 0.51 | 0.52 | 8 |
| LAB281 | 30743.4 | 0.06 | 0.07 | 25 | 0.93 | 0.00 | 61 | 0.58 | 0.07 | 23 |
| LAB282 | 30752.2 | — | | — | 0.66 | 0.29 | 13 | 0.57 | 0.13 | 19 |
| LAB282 | 30753.4 | 0.06 | 0.04 | 29 | 0.74 | 0.04 | 29 | 0.57 | 0.13 | 19 |
| cont | — | 0.05 | — | 0 | 0.58 | — | 0 | 0.48 | — | 0 |
| LAB106 | 30032.1 | — | | — | — | | — | 0.60 | 0.24 | 12 |
| LAB106 | 30035.2 | 0.06 | 0.32 | 19 | — | | — | — | | — |
| LAB127 | 30814.2 | — | | — | — | | — | 0.60 | 0.18 | 13 |
| LAB128 | 28074.1 | 0.06 | 0.44 | 14 | 0.80 | 0.67 | 6 | 0.56 | 0.65 | 5 |
| LAB128 | 28074.3 | — | | — | 0.77 | 0.88 | 2 | 0.58 | 0.37 | 9 |
| LAB128 | 28075.2 | — | | — | 0.77 | 0.85 | 3 | 0.55 | 0.71 | 4 |
| LAB207 | 28842.1 | 0.06 | 0.39 | 17 | 1.06 | 0.02 | 42 | 0.63 | 0.07 | 19 |
| LAB207 | 28842.5 | — | | — | 0.76 | 0.93 | 1 | 0.53 | 0.97 | 0 |
| LAB207 | 28845.1 | — | | — | 0.90 | 0.16 | 20 | 0.60 | 0.21 | 13 |
| LAB218 | 29431.1 | — | | — | — | | — | 0.55 | 0.65 | 4 |
| LAB218 | 29432.2 | 0.05 | 0.79 | 5 | — | | — | — | | — |
| LAB218 | 29433.4 | 0.05 | 0.86 | 3 | 0.91 | 0.15 | 21 | 0.57 | 0.46 | 8 |
| LAB252 | 30292.3 | 0.06 | 0.33 | 17 | — | | — | — | | — |
| LAB252 | 30292.4 | — | | — | — | | — | 0.55 | 0.74 | 4 |
| LAB309 | 30052.2 | 0.05 | 0.61 | 9 | — | | — | 0.53 | 0.94 | 1 |
| LAB309 | 30052.3 | 0.06 | 0.19 | 23 | — | | — | 0.59 | 0.24 | 11 |
| LAB309 | 30055.4 | — | | — | 0.93 | 0.13 | 24 | 0.62 | 0.11 | 17 |
| LAB309 | 30056.1 | 0.07 | 0.10 | 30 | 0.97 | 0.08 | 30 | 0.63 | 0.10 | 19 |
| LAB337 | 27265.2 | 0.06 | 0.16 | 24 | — | | — | — | | — |
| LAB346 | 29443.2 | — | | — | — | | — | 0.55 | 0.77 | 3 |
| LAB346 | 29445.6 | 0.06 | 0.50 | 12 | — | | — | — | | — |
| LAB80 | 30673.2 | — | | — | — | | — | 0.56 | 0.59 | 5 |
| LAB80 | 30675.2 | — | | — | 0.82 | 0.52 | 10 | — | | — |
| LAB82 | 30181.3 | — | | — | — | | — | 0.59 | 0.33 | 10 |
| LAB82 | 30183.2 | — | | — | — | | — | 0.56 | 0.65 | 5 |
| LAB82 | 30184.2 | — | | — | — | | — | 0.53 | 0.97 | 0 |
| LAB84 | 30162.4 | 0.06 | 0.13 | 26 | 0.83 | 0.42 | 11 | 0.55 | 0.73 | 4 |

TABLE 72-continued

Genes showing improved growth rate at standard growth conditions (T2 generation)

| Gene Name | Event # | RGR Of Leaf Area | | | RGR Of Roots Coverage | | | RGR Of Roots Length | | |
|---|---|---|---|---|---|---|---|---|---|---|
| | | Ave. | p-val. | % Incr | Ave. | p-val. | % Incr | Ave. | p-val. | % Incr |
| LAB84 | 30163.4 | — | — | — | — | — | — | 0.56 | 0.67 | 5 |
| cont | — | 0.05 | — | 0 | 0.75 | — | 0 | 0.53 | — | 0 |
| LAB127 | 30811.1 | 0.04 | 0.69 | 23 | — | — | — | 0.33 | 0.67 | 30 |
| LAB127 | 30811.4 | 0.04 | 0.73 | 20 | — | — | — | 0.31 | 0.76 | 21 |
| LAB127 | 30812.1 | 0.03 | 0.86 | 9 | — | — | — | 0.30 | 0.78 | 19 |
| LAB127 | 30813.2 | — | — | — | — | — | — | 0.25 | 1.00 | 0 |
| LAB128 | 28071.8 | 0.03 | 0.87 | 9 | — | — | — | 0.27 | 0.90 | 8 |
| LAB128 | 28074.1 | — | — | — | — | — | — | 0.29 | 0.81 | 17 |
| LAB128 | 28075.1 | — | — | — | — | — | — | 0.29 | 0.85 | 13 |
| LAB128 | 28075.2 | 0.04 | 0.63 | 32 | 0.59 | 0.71 | 22 | 0.30 | 0.81 | 17 |
| LAB147 | 31103.2 | — | — | — | — | — | — | 0.29 | 0.84 | 14 |
| LAB147 | 31104.1 | 0.03 | 0.96 | 3 | 0.52 | 0.90 | 6 | — | — | — |
| LAB147 | 31104.2 | — | — | — | — | — | — | 0.25 | 0.99 | 1 |
| LAB147 | 31105.6 | 0.03 | 0.97 | 2 | — | — | — | — | — | — |
| LAB186 | 31001.4 | — | — | — | 0.50 | 0.97 | 2 | 0.28 | 0.88 | 11 |
| LAB186 | 31002.1 | 0.03 | 0.87 | 10 | — | — | — | — | — | — |
| LAB186 | 31003.1 | 0.03 | 0.94 | 5 | — | — | — | 0.29 | 0.84 | 14 |
| LAB186 | 31004.2 | — | — | — | 0.62 | 0.62 | 27 | — | — | — |
| LAB197 | 31081.3 | 0.04 | 0.58 | 33 | — | — | — | — | — | — |
| LAB197 | 31083.1 | — | — | — | — | — | — | 0.26 | 0.95 | 4 |
| LAB197 | 31084.3 | — | — | — | 0.55 | 0.82 | 12 | — | — | — |
| LAB197 | 31085.3 | — | — | — | — | — | — | 0.26 | 0.96 | 3 |
| LAB315 | 31061.1 | — | — | — | — | — | — | 0.28 | 0.88 | 11 |
| LAB315 | 31063.1 | 0.03 | 0.98 | 2 | — | — | — | — | — | — |
| LAB315 | 31064.3 | — | — | — | — | — | — | 0.29 | 0.84 | 14 |
| LAB315 | 31065.4 | — | — | — | — | — | — | 0.33 | 0.67 | 29 |
| LAB317 | 30951.4 | — | — | — | — | — | — | 0.44 | 0.29 | 73 |
| LAB317 | 30952.2 | — | — | — | — | — | — | 0.29 | 0.84 | 14 |
| LAB317 | 30953.1 | — | — | — | 0.69 | 0.46 | 42 | 0.32 | 0.71 | 27 |
| LAB324 | 30961.1 | 0.04 | 0.69 | 24 | — | — | — | 0.29 | 0.82 | 16 |
| LAB324 | 30965.2 | — | — | — | — | — | — | 0.26 | 0.98 | 2 |
| LAB325 | 30971.4 | — | — | — | 0.51 | 0.94 | 4 | 0.27 | 0.92 | 7 |
| LAB325 | 30973.1 | — | — | — | — | — | — | 0.27 | 0.92 | 7 |
| LAB325 | 30975.1 | — | — | — | — | — | — | 0.26 | 0.97 | 3 |
| LAB325 | 30975.4 | 0.04 | 0.54 | 37 | — | — | — | 0.33 | 0.67 | 30 |
| LAB67 | 31022.1 | 0.04 | 0.66 | 33 | — | — | — | — | — | — |
| LAB67 | 31022.6 | 0.04 | 0.56 | 34 | — | — | — | — | — | — |
| LAB80 | 30673.1 | — | — | — | — | — | — | 0.29 | 0.83 | 15 |
| LAB80 | 30673.2 | — | — | — | — | — | — | 0.31 | 0.75 | 21 |
| LAB80 | 30675.2 | — | — | — | — | — | — | 0.26 | 0.95 | 4 |
| cont | — | 0.03 | — | 0 | 0.49 | — | 0 | 0.25 | — | 0 |
| LAB147 | 31103.2 | 0.05 | 0.02 | 52 | 0.63 | 0.07 | 46 | 0.55 | 0.14 | 15 |
| LAB147 | 31104.1 | 0.04 | 0.64 | 12 | 0.57 | 0.25 | 31 | 0.51 | 0.66 | 7 |
| LAB147 | 31104.2 | 0.05 | 0.21 | 30 | 0.75 | 0.02 | 72 | 0.64 | 0.01 | 34 |
| LAB147 | 31105.6 | 0.05 | 0.03 | 50 | 0.49 | 0.58 | 13 | — | — | — |
| LAB147 | 31105.7 | 0.05 | 0.11 | 35 | 0.56 | 0.25 | 30 | 0.52 | 0.47 | 8 |
| LAB178 | 30632.1 | 0.04 | 0.82 | 5 | 0.54 | 0.40 | 25 | 0.50 | 0.71 | 6 |
| LAB178 | 30633.3 | 0.04 | 0.56 | 15 | 0.57 | 0.29 | 30 | 0.50 | 0.80 | 4 |
| LAB178 | 30633.4 | 0.06 | 0.11 | 64 | 0.73 | 0.01 | 68 | 0.49 | 0.86 | 2 |
| LAB178 | 30635.1 | 0.04 | 0.98 | 1 | 0.63 | 0.06 | 45 | 0.59 | 0.05 | 23 |
| LAB186 | 31001.4 | 0.05 | 0.09 | 55 | 0.69 | 0.03 | 60 | 0.49 | 0.74 | 4 |
| LAB186 | 31002.1 | 0.04 | 0.59 | 12 | 0.46 | 0.76 | 7 | — | — | — |
| LAB186 | 31003.1 | 0.04 | 0.54 | 16 | 0.53 | 0.42 | 22 | 0.50 | 0.63 | 6 |
| LAB186 | 31004.1 | 0.04 | 0.44 | 17 | — | — | — | — | — | — |
| LAB186 | 31004.2 | 0.04 | 0.90 | 3 | 0.45 | 0.86 | 4 | — | — | — |
| LAB197 | 31081.3 | 0.04 | 0.43 | 20 | 0.49 | 0.60 | 13 | — | — | — |
| LAB197 | 31084.3 | — | — | — | 0.62 | 0.12 | 43 | 0.52 | 0.51 | 9 |
| LAB197 | 31084.4 | 0.04 | 0.27 | 23 | — | — | — | — | — | — |
| LAB197 | 31085.3 | — | — | — | 0.44 | 0.96 | 2 | 0.48 | 0.90 | 1 |
| LAB247 | 28093.2 | — | — | — | 0.48 | 0.64 | 11 | 0.48 | 0.92 | 1 |
| LAB247 | 28094.1 | 0.05 | 0.22 | 33 | 0.55 | 0.33 | 26 | 0.51 | 0.56 | 8 |
| LAB247 | 28094.3 | 0.05 | 0.13 | 40 | 0.75 | 0.01 | 72 | 0.55 | 0.21 | 16 |
| LAB314 | 29292.4 | — | — | — | 0.53 | 0.44 | 23 | — | — | — |
| LAB315 | 31061.1 | — | — | — | — | — | — | 0.49 | 0.80 | 3 |
| LAB315 | 31061.2 | 0.05 | 0.21 | 27 | 0.58 | 0.25 | 34 | — | — | — |
| LAB315 | 31063.1 | 0.04 | 0.60 | 13 | 0.59 | 0.24 | 36 | 0.50 | 0.69 | 5 |
| LAB315 | 31064.3 | 0.04 | 0.43 | 17 | — | — | — | — | — | — |
| LAB317 | 30952.2 | 0.05 | 0.24 | 33 | 0.53 | 0.42 | 22 | 0.50 | 0.77 | 4 |
| LAB317 | 30952.3 | 0.04 | 0.71 | 10 | 0.52 | 0.47 | 20 | 0.52 | 0.45 | 10 |
| LAB317 | 30953.1 | 0.04 | 0.77 | 7 | 0.65 | 0.07 | 49 | 0.51 | 0.62 | 6 |
| LAB317 | 30953.4 | — | — | — | 0.59 | 0.15 | 35 | 0.55 | 0.26 | 16 |
| LAB317 | 30954.4 | 0.05 | 0.01 | 53 | 0.58 | 0.15 | 33 | 0.53 | 0.38 | 11 |

TABLE 72-continued

Genes showing improved growth rate at standard growth conditions (T2 generation)

| Gene Name | Event # | RGR Of Leaf Area | | | RGR Of Roots Coverage | | | RGR Of Roots Length | | |
|---|---|---|---|---|---|---|---|---|---|---|
| | | Ave. | p-val. | % Incr | Ave. | p-val. | % Incr | Ave. | p-val. | % Incr |
| LAB324 | 30961.1 | 0.05 | 0.03 | 54 | 0.61 | 0.15 | 40 | 0.51 | 0.59 | 7 |
| LAB324 | 30962.2 | — | — | — | 0.49 | 0.69 | 13 | 0.55 | 0.22 | 15 |
| LAB324 | 30963.1 | 0.04 | 0.45 | 18 | 0.58 | 0.20 | 33 | 0.54 | 0.27 | 13 |
| LAB324 | 30965.2 | 0.05 | 0.24 | 35 | 0.67 | 0.06 | 54 | 0.54 | 0.21 | 14 |
| LAB324 | 30965.3 | 0.05 | 0.09 | 45 | 0.74 | 0.03 | 71 | 0.59 | 0.11 | 24 |
| LAB325 | 30971.4 | 0.05 | 0.12 | 38 | 0.73 | 0.01 | 68 | — | — | — |
| LAB325 | 30972.2 | 0.05 | 0.30 | 32 | 0.55 | 0.28 | 26 | 0.48 | 0.90 | 1 |
| LAB325 | 30973.1 | 0.05 | 0.19 | 31 | 0.59 | 0.16 | 36 | 0.57 | 0.04 | 20 |
| LAB325 | 30975.2 | 0.05 | 0.13 | 45 | 0.54 | 0.42 | 24 | 0.53 | 0.39 | 11 |
| LAB325 | 30975.4 | 0.05 | 0.20 | 29 | 0.57 | 0.17 | 31 | 0.53 | 0.32 | 10 |
| LAB54 | 28133.1 | 0.04 | 0.89 | 3 | — | — | — | — | — | — |
| LAB54 | 28133.4 | 0.05 | 0.02 | 49 | 0.58 | 0.22 | 34 | 0.50 | 0.69 | 5 |
| LAB54 | 28134.1 | 0.04 | 0.71 | 9 | 0.50 | 0.56 | 15 | — | — | — |
| LAB54 | 28136.2 | 0.05 | 0.02 | 54 | 0.59 | 0.13 | 36 | 0.51 | 0.60 | 7 |
| LAB67 | 31021.4 | 0.04 | 0.99 | 0 | — | — | — | — | — | — |
| LAB67 | 31022.1 | 0.04 | 0.47 | 26 | — | — | — | — | — | — |
| LAB67 | 31022.6 | 0.05 | 0.05 | 50 | — | — | — | — | — | — |
| LAB67 | 31023.3 | 0.05 | 0.20 | 44 | 0.45 | 0.86 | 4 | — | — | — |
| LAB67 | 31023.4 | 0.04 | 0.45 | 21 | — | — | — | — | — | — |
| LAB68 | 29331.5 | — | — | — | 0.53 | 0.37 | 23 | — | — | — |
| LAB68 | 29331.6 | — | — | — | 0.48 | 0.66 | 10 | 0.49 | 0.84 | 2 |
| LAB68 | 29335.1 | — | — | — | 0.68 | 0.03 | 57 | 0.51 | 0.46 | 8 |
| LAB68 | 29335.3 | — | — | — | 0.66 | 0.07 | 53 | 0.56 | 0.17 | 17 |
| LAB73 | 30152.1 | 0.04 | 0.52 | 15 | 0.45 | 0.87 | 4 | 0.48 | 0.96 | 1 |
| LAB73 | 30152.2 | — | — | — | 0.46 | 0.81 | 7 | — | — | — |
| LAB73 | 30154.3 | 0.04 | 0.78 | 7 | 0.55 | 0.34 | 28 | 0.50 | 0.72 | 5 |
| LAB74 | 28451.3 | 0.05 | 0.18 | 32 | 0.54 | 0.27 | 25 | 0.49 | 0.78 | 3 |
| LAB74 | 28452.1 | — | — | — | 0.58 | 0.20 | 33 | 0.49 | 0.82 | 2 |
| LAB74 | 28452.2 | 0.06 | 0.09 | 56 | 0.55 | 0.27 | 27 | — | — | — |
| LAB74 | 28453.5 | — | — | — | 0.48 | 0.69 | 10 | 0.55 | 0.21 | 16 |
| LAB74 | 28454.1 | 0.05 | 0.20 | 34 | 0.48 | 0.69 | 9 | — | — | — |
| cont | — | 0.04 | — | 0 | 0.43 | — | 0 | 0.48 | — | 0 |
| LAB133 | 28832.1 | — | — | — | 0.64 | 0.36 | 12 | 0.52 | 0.89 | 2 |
| LAB133 | 28832.5 | — | — | — | 0.57 | 0.97 | 0 | — | — | — |
| LAB133 | 28833.1 | — | — | — | — | — | — | 0.53 | 0.72 | 4 |
| LAB133 | 28833.2 | 0.04 | 0.41 | 10 | 0.63 | 0.33 | 11 | 0.51 | 0.99 | 0 |
| LAB158 | 29411.4 | 0.04 | 0.17 | 14 | 0.57 | 0.97 | 1 | 0.52 | 0.85 | 2 |
| LAB158 | 29412.1 | — | — | — | 0.66 | 0.17 | 17 | 0.56 | 0.47 | 10 |
| LAB158 | 29414.3 | 0.04 | 0.87 | 2 | 0.62 | 0.55 | 9 | 0.52 | 0.91 | 2 |
| LAB158 | 29415.1 | — | — | — | 0.70 | 0.14 | 24 | — | — | — |
| LAB160 | 29311.2 | — | — | — | 0.72 | 0.07 | 28 | 0.57 | 0.34 | 12 |
| LAB160 | 29312.1 | 0.04 | 0.08 | 19 | 0.61 | 0.48 | 8 | — | — | — |
| LAB160 | 29314.2 | 0.05 | 0.13 | 24 | 0.71 | 0.06 | 25 | 0.57 | 0.37 | 12 |
| LAB160 | 29315.2 | — | — | — | 0.70 | 0.13 | 23 | 0.53 | 0.66 | 5 |
| LAB162 | 29341.2 | 0.04 | 0.25 | 14 | 0.65 | 0.24 | 14 | 0.56 | 0.47 | 11 |
| LAB162 | 29342.6 | 0.04 | 0.65 | 5 | 0.82 | 0.01 | 44 | 0.56 | 0.52 | 10 |
| LAB177 | 29421.2 | — | — | — | 0.59 | 0.78 | 3 | 0.52 | 0.81 | 3 |
| LAB177 | 29422.1 | 0.04 | 0.51 | 7 | 0.80 | 0.01 | 41 | 0.55 | 0.48 | 9 |
| LAB177 | 29424.3 | 0.05 | 0.00 | 38 | 0.77 | 0.02 | 36 | — | — | — |
| LAB177 | 29424.4 | 0.04 | 0.52 | 7 | — | — | — | — | — | — |
| LAB177 | 29425.1 | — | — | — | 0.58 | 0.80 | 3 | — | — | — |
| LAB179 | 29301.4 | — | — | — | 0.70 | 0.04 | 23 | 0.58 | 0.31 | 13 |
| LAB179 | 29302.4 | — | — | — | 0.72 | 0.02 | 27 | 0.53 | 0.70 | 5 |
| LAB179 | 29303.2 | 0.05 | 0.09 | 22 | 0.78 | 0.03 | 37 | — | — | — |
| LAB179 | 29304.3 | — | — | — | 0.58 | 0.80 | 3 | — | — | — |
| LAB210 | 28331.2 | — | — | — | 0.73 | 0.05 | 29 | 0.58 | 0.22 | 15 |
| LAB210 | 28333.2 | — | — | — | 0.61 | 0.52 | 7 | 0.51 | 0.96 | 1 |
| LAB210 | 28333.3 | — | — | — | 0.85 | 0.00 | 51 | 0.52 | 0.78 | 3 |
| LAB210 | 28335.3 | 0.04 | 0.62 | 5 | — | — | — | — | — | — |
| LAB254 | 28811.1 | — | — | — | 0.60 | 0.71 | 5 | — | — | — |
| LAB254 | 28814.1 | 0.04 | 0.32 | 11 | — | — | — | — | — | — |
| LAB254 | 28814.5 | 0.05 | 0.00 | 44 | 0.67 | 0.12 | 18 | — | — | — |
| LAB254 | 28815.3 | 0.04 | 0.21 | 18 | 0.73 | 0.11 | 28 | 0.54 | 0.70 | 6 |
| LAB254 | 28815.4 | 0.05 | 0.03 | 23 | 0.87 | 0.00 | 53 | 0.55 | 0.51 | 9 |
| LAB293 | 29232.2 | 0.05 | 0.05 | 37 | 0.68 | 0.27 | 20 | — | — | — |
| LAB293 | 29233.2 | 0.04 | 0.29 | 15 | — | — | — | — | — | — |
| LAB293 | 29233.3 | 0.04 | 0.19 | 14 | 0.63 | 0.35 | 10 | 0.54 | 0.60 | 6 |
| LAB293 | 29233.4 | 0.04 | 0.08 | 17 | — | — | — | — | — | — |
| LAB293 | 29235.4 | 0.04 | 0.07 | 20 | 0.67 | 0.31 | 18 | 0.51 | 0.94 | 1 |
| LAB297 | 29272.1 | 0.04 | 0.42 | 12 | — | — | — | — | — | — |
| LAB297 | 29272.5 | — | — | — | 0.74 | 0.01 | 30 | — | — | — |
| LAB297 | 29273.1 | 0.04 | 0.10 | 20 | 0.64 | 0.57 | 12 | — | — | — |

TABLE 72-continued

Genes showing improved growth rate at standard growth conditions (T2 generation)

| Gene Name | Event # | RGR Of Leaf Area | | | RGR Of Roots Coverage | | | RGR Of Roots Length | | |
|---|---|---|---|---|---|---|---|---|---|---|
| | | Ave. | p-val. | % Incr | Ave. | p-val. | % Incr | Ave. | p-val. | % Incr |
| LAB297 | 29273.4 | 0.04 | 0.38 | 9 | 0.70 | 0.08 | 24 | — | | — |
| LAB297 | 29275.1 | 0.05 | 0.02 | 46 | 0.62 | 0.39 | 9 | — | | — |
| LAB310 | 28181.2 | — | | — | 0.58 | 0.85 | 2 | — | | — |
| LAB310 | 28181.3 | — | | — | 0.65 | 0.23 | 15 | 0.52 | 0.80 | 3 |
| LAB310 | 28183.3 | 0.04 | 0.46 | 10 | 0.68 | 0.12 | 20 | 0.54 | 0.66 | 6 |
| LAB318 | 28101.3 | — | | — | 0.60 | 0.65 | 5 | 0.57 | 0.28 | 13 |
| LAB318 | 28101.5 | 0.04 | 0.46 | 9 | — | | — | — | | — |
| LAB318 | 28101.7 | 0.05 | 0.10 | 35 | 0.67 | 0.38 | 19 | 0.54 | 0.65 | 6 |
| LAB318 | 28104.3 | 0.04 | 0.71 | 5 | 0.74 | 0.07 | 31 | 0.54 | 0.66 | 6 |
| LAB327 | 29221.2 | — | | — | — | | — | 0.51 | 0.99 | 0 |
| LAB327 | 29221.5 | — | | — | 0.64 | 0.28 | 13 | 0.55 | 0.50 | 8 |
| LAB327 | 29221.6 | — | | — | 0.86 | 0.05 | 52 | — | | — |
| LAB327 | 29221.8 | 0.05 | 0.06 | 20 | 0.66 | 0.21 | 17 | 0.51 | 0.93 | 1 |
| LAB327 | 29225.4 | 0.04 | 0.68 | 4 | 0.64 | 0.24 | 13 | 0.52 | 0.83 | 3 |
| LAB335 | 27314.2 | 0.06 | 0.00 | 66 | 0.65 | 0.33 | 14 | 0.54 | 0.56 | 7 |
| LAB335 | 27315.4 | 0.04 | 0.42 | 9 | — | | — | — | | — |
| cont | — | 0.04 | — | 0 | 0.57 | — | 0 | 0.51 | — | 0 |
| LAB102 | 30312.2 | 0.05 | 0.59 | 8 | 0.68 | 0.08 | 29 | 0.52 | 0.36 | 9 |
| LAB102 | 30312.4 | 0.06 | 0.43 | 9 | 0.64 | 0.05 | 21 | 0.59 | 0.01 | 24 |
| LAB102 | 30313.2 | 0.06 | 0.13 | 20 | 0.75 | 0.01 | 42 | 0.49 | 0.70 | 4 |
| LAB102 | 30313.3 | 0.08 | 0.00 | 56 | 1.08 | 0.00 | 105 | 0.60 | 0.00 | 27 |
| LAB102 | 30314.3 | 0.08 | 0.01 | 50 | 0.94 | 0.00 | 78 | 0.55 | 0.08 | 15 |
| LAB126 | 30201.3 | 0.09 | 0.00 | 70 | 1.31 | 0.00 | 148 | 0.62 | 0.00 | 30 |
| LAB126 | 30202.3 | 0.07 | 0.01 | 36 | 0.87 | 0.00 | 65 | 0.55 | 0.12 | 15 |
| LAB126 | 30203.3 | 0.08 | 0.00 | 56 | 1.28 | 0.00 | 143 | 0.63 | 0.00 | 33 |
| LAB126 | 30205.1 | 0.08 | 0.00 | 68 | 1.07 | 0.00 | 103 | 0.58 | 0.02 | 21 |
| LAB126 | 30205.3 | 0.07 | 0.01 | 39 | 0.99 | 0.00 | 88 | 0.60 | 0.01 | 26 |
| LAB165 | 30231.1 | 0.10 | 0.00 | 90 | 1.22 | 0.00 | 130 | 0.60 | 0.01 | 27 |
| LAB165 | 30231.2 | 0.05 | 0.81 | 4 | 0.56 | 0.65 | 7 | — | | — |
| LAB165 | 30232.1 | 0.08 | 0.00 | 61 | 0.85 | 0.00 | 61 | 0.54 | 0.40 | 13 |
| LAB165 | 30233.1 | 0.08 | 0.00 | 59 | 0.90 | 0.00 | 70 | 0.52 | 0.31 | 9 |
| LAB165 | 30235.1 | 0.06 | 0.25 | 16 | 0.63 | 0.11 | 18 | — | | — |
| LAB167 | 27321.3 | — | | — | — | | — | 0.49 | 0.84 | 2 |
| LAB167 | 27321.4 | 0.09 | 0.00 | 72 | 1.13 | 0.00 | 114 | 0.67 | 0.00 | 40 |
| LAB167 | 27321.6 | 0.06 | 0.04 | 25 | 0.72 | 0.00 | 35 | 0.58 | 0.02 | 21 |
| LAB220 | 30321.4 | 0.08 | 0.00 | 52 | 1.33 | 0.00 | 151 | 0.58 | 0.02 | 22 |
| LAB220 | 30322.2 | 0.05 | 0.98 | 0 | 0.68 | 0.01 | 29 | 0.65 | 0.00 | 35 |
| LAB220 | 30322.3 | 0.07 | 0.03 | 31 | 1.05 | 0.00 | 99 | 0.63 | 0.00 | 32 |
| LAB220 | 30323.1 | — | | — | 0.68 | 0.01 | 29 | 0.56 | 0.06 | 17 |
| LAB220 | 30324.4 | 0.08 | 0.00 | 53 | 0.96 | 0.00 | 82 | 0.54 | 0.15 | 14 |
| LAB241 | 30211.3 | 0.06 | 0.25 | 14 | 0.62 | 0.14 | 18 | 0.51 | 0.56 | 6 |
| LAB241 | 30212.1 | 0.06 | 0.17 | 18 | 0.54 | 0.89 | 2 | — | | — |
| LAB241 | 30212.2 | 0.06 | 0.33 | 12 | 0.54 | 0.85 | 2 | — | | — |
| LAB241 | 30213.1 | 0.07 | 0.02 | 32 | — | | — | — | | — |
| LAB241 | 30214.4 | — | | — | — | | — | 0.49 | 0.83 | 2 |
| LAB268 | 30391.4 | — | | — | 0.62 | 0.13 | 18 | 0.52 | 0.30 | 10 |
| LAB268 | 30392.1 | — | | — | 0.53 | 0.92 | 1 | 0.53 | 0.25 | 10 |
| LAB268 | 30392.2 | 0.07 | 0.00 | 41 | 0.74 | 0.00 | 40 | 0.51 | 0.38 | 8 |
| LAB268 | 30393.3 | 0.06 | 0.39 | 10 | 0.55 | 0.70 | 4 | 0.51 | 0.42 | 7 |
| LAB268 | 30395.1 | 0.08 | 0.00 | 58 | 1.11 | 0.00 | 109 | 0.55 | 0.06 | 16 |
| LAB280 | 30041.1 | 0.09 | 0.00 | 76 | 0.89 | 0.00 | 67 | 0.58 | 0.02 | 23 |
| LAB280 | 30042.1 | 0.05 | 0.99 | 0 | — | | — | — | | — |
| LAB280 | 30044.1 | 0.07 | 0.00 | 36 | 0.72 | 0.01 | 35 | 0.53 | 0.22 | 11 |
| LAB280 | 30045.1 | 0.05 | 0.62 | 6 | — | | — | — | | — |
| LAB280 | 30045.3 | 0.08 | 0.00 | 52 | 1.00 | 0.00 | 90 | 0.60 | 0.03 | 25 |
| LAB289 | 30371.2 | 0.06 | 0.22 | 15 | 0.54 | 0.78 | 3 | 0.52 | 0.31 | 9 |
| LAB289 | 30371.4 | 0.09 | 0.00 | 76 | 1.05 | 0.00 | 99 | 0.55 | 0.09 | 16 |
| LAB289 | 30371.6 | 0.08 | 0.00 | 50 | 0.89 | 0.00 | 68 | 0.58 | 0.02 | 21 |
| LAB289 | 30375.2 | 0.11 | 0.00 | 113 | 1.18 | 0.00 | 123 | 0.61 | 0.00 | 28 |
| LAB289 | 30375.3 | 0.09 | 0.00 | 72 | 1.18 | 0.00 | 123 | 0.54 | 0.14 | 13 |
| LAB303 | 30421.3 | 0.05 | 0.91 | 1 | — | | — | — | | — |
| LAB303 | 30423.4 | 0.05 | 0.67 | 5 | — | | — | — | | — |
| LAB303 | 30424.3 | — | | — | 1.03 | 0.00 | 94 | 0.50 | 0.54 | 5 |
| LAB303 | 30425.3 | — | | — | 0.98 | 0.00 | 86 | 0.51 | 0.49 | 7 |
| cont | — | 0.05 | — | 0 | 0.53 | — | 0 | 0.48 | — | 0 |
| LAB303 | 30421.2 | — | | — | 0.83 | 0.73 | 5 | — | | — |
| LAB311 | 30222.2 | 0.05 | 0.51 | 10 | — | | — | — | | — |
| LAB311 | 30223.2 | — | | — | — | | — | 0.58 | 0.92 | 1 |
| LAB311 | 30223.4 | 0.08 | 0.00 | 50 | 1.15 | 0.01 | 44 | — | | — |
| LAB344 | 30092.3 | 0.05 | 0.56 | 6 | — | | — | — | | — |
| LAB344 | 30096.1 | 0.06 | 0.03 | 25 | — | | — | — | | — |
| LAB344 | 30096.3 | 0.06 | 0.06 | 21 | — | | — | — | | — |

TABLE 72-continued

Genes showing improved growth rate at standard growth conditions (T2 generation)

| Gene Name | Event # | RGR Of Leaf Area | | | RGR Of Roots Coverage | | | RGR Of Roots Length | | |
|---|---|---|---|---|---|---|---|---|---|---|
| | | Ave. | p-val. | % Incr | Ave. | p-val. | % Incr | Ave. | p-val. | % Incr |
| LAB355 | 29281.3 | 0.08 | 0.00 | 52 | 0.97 | 0.12 | 22 | — | — | — |
| LAB355 | 29282.2 | 0.08 | 0.00 | 64 | 0.98 | 0.11 | 24 | — | — | — |
| LAB355 | 29282.3 | 0.06 | 0.26 | 14 | — | — | — | — | — | — |
| LAB367 | 30171.3 | 0.06 | 0.07 | 20 | — | — | — | — | — | — |
| LAB367 | 30173.1 | 0.05 | 0.93 | 1 | — | — | — | — | — | — |
| LAB367 | 30173.3 | 0.07 | 0.02 | 34 | 0.85 | 0.66 | 7 | — | — | — |
| LAB381 | 30351.4 | 0.05 | 0.36 | 10 | — | — | — | — | — | — |
| LAB381 | 30352.2 | 0.07 | 0.00 | 40 | — | — | — | — | — | — |
| LAB381 | 30352.4 | 0.06 | 0.06 | 28 | 1.02 | 0.07 | 28 | 0.58 | 0.92 | 1 |
| LAB381 | 30354.2 | 0.07 | 0.00 | 44 | 1.22 | 0.01 | 53 | — | — | — |
| LAB381 | 30356.1 | 0.07 | 0.01 | 30 | — | — | — | — | — | — |
| LAB383 | 28111.1 | 0.05 | 0.43 | 10 | — | — | — | — | — | — |
| LAB383 | 28111.3 | 0.06 | 0.10 | 23 | 0.87 | 0.54 | 9 | — | — | — |
| LAB383 | 28115.2 | 0.06 | 0.04 | 26 | — | — | — | — | — | — |
| LAB64 | 30271.2 | 0.07 | 0.01 | 49 | — | — | — | — | — | — |
| LAB64 | 30272.1 | 0.06 | 0.05 | 29 | 0.82 | 0.83 | 3 | — | — | — |
| LAB64 | 30273.2 | 0.07 | 0.05 | 44 | 0.90 | 0.48 | 13 | — | — | — |
| LAB64 | 30274.2 | 0.06 | 0.13 | 19 | 0.88 | 0.47 | 10 | — | — | — |
| LAB65 | 30303.4 | 0.05 | 0.49 | 8 | — | — | — | — | — | — |
| LAB65 | 30304.3 | 0.05 | 0.78 | 4 | — | — | — | — | — | — |
| LAB92 | 29321.2 | 0.06 | 0.11 | 17 | — | — | — | — | — | — |
| LAB92 | 29322.1 | 0.05 | 0.80 | 3 | 0.90 | 0.46 | 14 | — | — | — |
| LAB92 | 29323.2 | 0.06 | 0.17 | 15 | 0.96 | 0.15 | 21 | — | — | — |
| LAB92 | 29324.2 | 0.06 | 0.26 | 14 | — | — | — | — | — | — |
| LAB92 | 29325.1 | — | — | — | 0.81 | 0.90 | 2 | 0.67 | 0.13 | 16 |
| cont | — | 0.05 | — | 0 | 0.80 | — | 0 | 0.57 | — | 0 |
| LAB172 | 30853.4 | 0.05 | 0.98 | 0 | — | — | — | — | — | — |
| LAB172 | 30854.1 | 0.06 | 0.16 | 16 | 0.74 | 0.17 | 19 | 0.58 | 0.65 | 4 |
| LAB172 | 30854.4 | 0.06 | 0.10 | 20 | 0.74 | 0.14 | 19 | 0.62 | 0.26 | 11 |
| LAB188 | 30722.2 | 0.05 | 0.52 | 7 | 0.99 | 0.00 | 60 | 0.57 | 0.89 | 1 |
| LAB188 | 30724.1 | — | — | — | 0.67 | 0.55 | 8 | 0.66 | 0.06 | 17 |
| LAB188 | 30724.2 | — | — | — | — | — | — | 0.58 | 0.72 | 3 |
| LAB243 | 27101.1 | 0.05 | 0.70 | 5 | 0.73 | 0.20 | 18 | 0.63 | 0.20 | 12 |
| LAB243 | 30872.1 | 0.06 | 0.17 | 19 | 0.76 | 0.12 | 23 | 0.58 | 0.69 | 4 |
| LAB243 | 30873.2 | 0.05 | 0.84 | 2 | — | — | — | — | — | — |
| LAB243 | 30873.4 | 0.06 | 0.03 | 27 | 0.97 | 0.00 | 57 | 0.59 | 0.54 | 6 |
| LAB270 | 30591.2 | 0.05 | 0.84 | 2 | 0.76 | 0.14 | 23 | — | — | — |
| LAB270 | 30594.3 | — | — | — | — | — | — | 0.62 | 0.27 | 10 |
| LAB270 | 30595.1 | 0.06 | 0.25 | 14 | — | — | — | — | — | — |
| LAB270 | 30595.2 | — | — | — | 0.72 | 0.23 | 16 | 0.58 | 0.78 | 3 |
| LAB291 | 31851.2 | 0.06 | 0.17 | 17 | 0.76 | 0.08 | 23 | 0.62 | 0.28 | 10 |
| LAB291 | 31851.3 | 0.07 | 0.00 | 48 | 0.81 | 0.03 | 31 | — | — | — |
| LAB291 | 31852.4 | 0.06 | 0.16 | 16 | 0.83 | 0.02 | 34 | 0.64 | 0.16 | 14 |
| LAB291 | 31853.3 | 0.07 | 0.00 | 42 | 0.74 | 0.14 | 19 | — | — | — |
| LAB291 | 31854.4 | — | — | — | 0.77 | 0.05 | 25 | 0.69 | 0.01 | 24 |
| LAB295 | 31861.3 | 0.08 | 0.00 | 53 | 0.76 | 0.09 | 23 | — | — | — |
| LAB295 | 31863.1 | 0.08 | 0.00 | 53 | 0.72 | 0.19 | 17 | 0.59 | 0.57 | 5 |
| LAB295 | 31864.3 | 0.06 | 0.40 | 11 | 0.77 | 0.07 | 24 | 0.57 | 0.85 | 2 |
| LAB295 | 31864.4 | 0.08 | 0.00 | 69 | 1.08 | 0.00 | 75 | 0.64 | 0.11 | 15 |
| LAB295 | 31865.1 | 0.05 | 0.49 | 8 | 0.64 | 0.76 | 4 | 0.59 | 0.54 | 6 |
| LAB323 | 30381.1 | — | — | — | — | — | — | 0.58 | 0.74 | 3 |
| LAB323 | 30381.4 | 0.08 | 0.00 | 65 | 0.74 | 0.16 | 20 | — | — | — |
| LAB323 | 30383.1 | — | — | — | 0.74 | 0.14 | 20 | 0.67 | 0.03 | 20 |
| LAB323 | 30383.2 | 0.06 | 0.24 | 13 | 0.70 | 0.30 | 13 | 0.58 | 0.75 | 3 |
| LAB323 | 30385.1 | — | — | — | 0.69 | 0.43 | 11 | 0.60 | 0.46 | 7 |
| LAB347_H0 | 30441.1 | — | — | — | 0.88 | 0.00 | 43 | 0.69 | 0.01 | 24 |
| LAB347_H0 | 30442.4 | — | — | — | 0.64 | 0.77 | 4 | 0.64 | 0.11 | 15 |
| LAB347_H0 | 30444.1 | — | — | — | 0.82 | 0.02 | 32 | 0.60 | 0.51 | 6 |
| LAB347_H0 | 30444.3 | 0.06 | 0.27 | 13 | 0.74 | 0.13 | 20 | 0.59 | 0.55 | 5 |
| LAB55 | 30022.3 | — | — | — | — | — | — | 0.60 | 0.52 | 6 |
| LAB55 | 30023.1 | 0.05 | 0.52 | 9 | 0.69 | 0.41 | 11 | 0.58 | 0.66 | 4 |
| LAB55 | 30023.3 | — | — | — | 0.63 | 0.93 | 1 | — | — | — |
| LAB94 | 30681.4 | — | — | — | 0.63 | 0.91 | 2 | 0.62 | 0.26 | 11 |
| LAB94 | 30681.8 | — | — | — | — | — | — | 0.62 | 0.29 | 10 |
| LAB94 | 30682.2 | — | — | — | — | — | — | 0.64 | 0.14 | 13 |
| LAB94 | 30682.3 | — | — | — | — | — | — | 0.57 | 0.81 | 2 |
| cont | — | 0.05 | — | 0 | 0.62 | — | 0 | 0.56 | — | 0 |
| LAB243 | 27101.1 | — | — | — | — | — | — | 0.69 | 0.93 | 1 |
| LAB243 | 30872.1 | — | — | — | — | — | — | 0.70 | 0.83 | 2 |
| LAB291 | 31851.2 | 0.07 | 0.20 | 15 | — | — | — | 0.74 | 0.37 | 8 |
| LAB291 | 31851.3 | — | — | — | — | — | — | 0.69 | 0.95 | 0 |
| LAB291 | 31853.3 | 0.07 | 0.94 | 1 | — | — | — | — | — | — |

TABLE 72-continued

Genes showing improved growth rate at standard growth conditions (T2 generation)

| Gene Name | Event # | RGR Of Leaf Area | | | RGR Of Roots Coverage | | | RGR Of Roots Length | | |
|---|---|---|---|---|---|---|---|---|---|---|
| | | Ave. | p-val. | % Incr | Ave. | p-val. | % Incr | Ave. | p-val. | % Incr |
| LAB291 | 31854.4 | 0.07 | 0.79 | 2 | — | — | — | 0.70 | 0.74 | 3 |
| cont | — | 0.06 | — | 0 | — | — | — | 0.68 | — | 0 |

Table 72.
"CONT."—Control;
"Ave."—Average;
"% Incr." = % increment;
"p-val"—p-value.

TABLE 73

Genes showing improved growth rate at standard growth conditions (T1 generation)

| Gene Name | Event # | RGR Of Leaf Area | | | RGR Of Roots Coverage | | | RGR Of Roots Length | | |
|---|---|---|---|---|---|---|---|---|---|---|
| | | Ave. | p-val. | % Incr. | Ave. | p-val. | % Incr. | Ave. | p-val. | % Incr. |
| LAB109 | 32411 | 0.07 | 0.16 | 15 | | | | | | |
| LAB211 | 32581 | 0.08 | 0.00 | 43 | 0.41 | 0.03 | 25 | 0.41 | 0.09 | 9 |
| LAB274 | 32471 | 0.06 | 0.30 | 11 | | | | | | |
| LAB291 | 31851 | 0.06 | 0.44 | 7 | | | | | | |
| LAB296 | 32441 | 0.06 | 0.00 | 28 | | | | | | |
| LAB349 | 32391 | 0.07 | 0.00 | 33 | 0.34 | 0.25 | 12 | | | |
| LAB53 | 32461 | 0.06 | 0.01 | 33 | 0.38 | 0.05 | 24 | 0.38 | 0.26 | 8 |
| LAB69 | 32451 | 0.06 | 0.03 | 23 | 0.37 | 0.17 | 21 | 0.40 | 0.11 | 13 |
| LAB89 | 32432 | 0.06 | 0.02 | 20 | | | | | | |
| LAB295 | 31861 | 0.05 | 0.77 | 2 | | | | | | |
| LAB236 | 33201 | | | | 0.47 | 0.00 | 41 | | | |

Table 73.
"CONT."—Control;
"Ave."—Average;
"% Incr." = % increment;
"p-val."—p-value.

Example 15

Evaluation of Transgenic Arabidopsis Plant Growth Under Abiotic Stress as Well as Under Favorable Conditions in Greenhouse Assay ABS tolerance: Yield and plant growth rate at high salinity concentration under greenhouse conditions (until bolting)—This assay follows the plant biomass formation and the rosette area growth of plants grown in the greenhouse at high salinity irrigation and normal irrigation. Transgenic *Arabidopsis* seeds were sown in phytogel media supplemented with ½ MS medium and a selection agent (Kanamycin). The $T_2$ transgenic seedlings were then transplanted to 1.7 trays filled with peat and perlite in a 1:1 ratio. Half of the plants are irrigated with a salt solution (150 mM NaCl) so as to induce salinity stress (stress conditions). The other half of the plants is irrigated with tap water (normal conditions). All plants are grown in the greenhouse until bolting stage, then harvested (the above ground tissue) and weighted (immediately or following drying in oven at 50° C. for 24 hours). High salinity conditions are achieved by irrigating with a solution containing 150 mM NaCl ("ABS" growth conditions) and compared to regular growth conditions.

Each construct was validated at its $T_2$ generation. Transgenic plants transformed with a construct conformed by an empty vector carrying the AT6669 (SEQ ID NO:8741) promoter and the selectable marker was used as control.

The plants were analyzed for their overall size, growth rate, fresh weight and dry matter. Transgenic plants performance was compared to control plants grown in parallel under the same conditions. Mock-transgenic plants with no gene at all, under the same promoter were used as control.

The experiment is planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) is used for capturing images of plant samples.

The image capturing process was repeated every 2 days starting from day 1 after transplanting till day 16. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 (Java based image processing program which was developed at the U.S National Institutes of Health and freely available on the internet at Hypertext Transfer Protocol://rsbweb (dot) nih (dot) gov/). Images are captured in resolution of 10 Mega Pixels (3888× 2592 pixels) and stored in a low compression JPEG (Joint Photographic Experts Group standard) format. Next, analyzed data is saved to text files and processed using the JMP statistical analysis software (SAS institute).

Leaf analysis—Using the digital analysis leaves data was calculated, including leaf number, rosette area, rosette diameter, leaf blade area, Petiole Relative Area and leaf petiole length.

Vegetative growth rate: the relative growth rate (RGR) of leaf blade area (Formula VIII), leaf number (Formula IX), rosette area (Formula X), rosette diameter (Formula XI), plot coverage (Formula XII) and Petiole Relative Area (XIII) as described above.

Plant Fresh and Dry weight—On about day 80 from sowing, the plants were harvested and directly weight for the determination of the plant fresh weight (FW) and left to dry at 50° C. in a drying chamber for about 48 hours before weighting to determine plant dry weight (DW).

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results are considered significant if the p value was less than 0.1. The JMP statistics software package was used (Version 5.2.1, SAS Institute Inc., Cary, N.C., USA).

Experimental Results:

The genes listed in Tables 74-83 improved plant ABST when grown at high salinity concentration. These genes produced larger plants with a larger photosynthetic area, biomass (fresh weight, dry weight, rosette diameter, rosette area and plot coverage) when grown under high salinity concentration. The genes were cloned under the regulation of a constitutive (At6669; SEQ ID NO:8741). The evaluation of each gene was performed by testing the performance of different number of events. Event with p-value <0.1 was considered statistically significant

TABLE 74

Genes showing improved plant biomass production under high salinity conditions

| Gene Name | Event # | Dry Weight [g] | | | Fresh Weight [g] | | |
|---|---|---|---|---|---|---|---|
| | | Ave. | P-Val/ | % Incr. | Ave. | P-Val. | % Incr. |
| LAB258 | 27441.4 | 0.135 | 0.220034 | 28.1022 | 1.0375 | 0.074011 | 14.5435 |
| LAB258 | 27441.6 | 0.134554 | 0.343669 | 27.6786 | 1.06964 | 0.064851 | 18.0922 |
| LAB258 | 27442.2 | 0.13125 | 0.255047 | 24.5438 | 1.1375 | 0.010312 | 25.5839 |
| LAB258 | 27442.5 | 0.116875 | 0.413659 | 10.9033 | 0.9625 | 0.379111 | 6.2633 |
| LAB258 | 27444.4 | — | — | — | 0.925 | 0.793808 | 2.1231 |
| LAB247 | 28091.4 | 0.135 | 0.119436 | 28.1022 | 1.0375 | 0.390321 | 14.5435 |
| LAB247 | 28093.2 | 0.11 | 0.607342 | 4.3796 | 0.95625 | 0.391025 | 5.5732 |
| LAB247 | 28094.3 | 0.123125 | 0.449561 | 16.8339 | 1.1125 | 0.100581 | 22.8238 |
| LAB247 | 28095.4 | 0.11375 | 0.220966 | 7.938 | 1.01875 | 0.14898 | 12.4735 |
| LAB88 | 28193.6 | 0.10625 | 0.9075 | 0.8212 | — | — | — |
| LAB131 | 28291.1 | 0.11375 | 0.220966 | 7.938 | 1.04375 | 0.095012 | 15.2335 |
| LAB131 | 28292.3 | 0.1125 | 0.174315 | 6.7518 | 1.01875 | 0.040445 | 12.4735 |
| LAB131 | 28294.2 | 0.110625 | 0.591275 | 4.9726 | 0.9625 | 0.301506 | 6.2633 |
| LAB131 | 28295.3 | 0.115536 | 0.574688 | 9.6324 | 1.00268 | 0.176722 | 10.6991 |
| LAB153 | 28301.2 | 0.113125 | 0.772043 | 7.3449 | — | — | — |
| LAB153 | 28302.2 | 0.124375 | 0.039102 | 18.0201 | 1.1125 | 0.051333 | 22.8238 |
| LAB153 | 28303.1 | 0.138125 | 0.327593 | 31.0675 | 1.04375 | 0.010746 | 15.2335 |
| LAB153 | 28304.1 | 0.131875 | 0.040321 | 25.1369 | 1.1875 | 0.000322 | 31.104 |
| LAB153 | 28305.3 | 0.13875 | 0.132511 | 31.6606 | 1.1875 | 0.132489 | 31.104 |
| LAB169 | 28391.1 | 0.10875 | 0.798146 | 3.1934 | 0.9875 | 0.389191 | 9.0234 |
| LAB169 | 28391.4 | 0.12875 | 0.076133 | 22.1715 | 0.99375 | 0.09915 | 9.7134 |
| LAB169 | 28392.1 | 0.11625 | 0.40792 | 10.3102 | 0.9625 | 0.379111 | 6.2633 |
| LAB169 | 28394.3 | 0.128125 | 0.000765 | 21.5785 | 1.13125 | 0.000333 | 24.8938 |
| LAB294 | 28401.3 | 0.12125 | 0.006922 | 15.0547 | 1.09375 | 0.001415 | 20.7537 |
| LAB294 | 28402.5 | 0.115625 | 0.401711 | 9.7172 | 0.98125 | 0.126051 | 8.3333 |
| LAB294 | 28404.1 | 0.115 | 0.067772 | 9.1241 | 0.9875 | 0.107505 | 9.0234 |
| LAB294 | 28404.3 | — | — | — | 0.93125 | 0.658581 | 2.8132 |
| LAB187 | 28431.5 | 0.123125 | 0.214767 | 16.8339 | 1.05625 | 0.029237 | 16.6136 |
| LAB187 | 28434.1 | 0.156875 | 0.285322 | 48.8595 | 1.26875 | 0.189984 | 40.0743 |
| LAB74 | 28451.3 | 0.11375 | 0.220966 | 7.938 | — | — | — |
| LAB74 | 28454.1 | 0.11 | 0.77733 | 4.3796 | 0.90625 | 0.992376 | 0.0531 |
| LAB152 | 28471.1 | 0.113125 | 0.214394 | 7.3449 | 1.01875 | 0.079637 | 12.4735 |
| LAB152 | 28472.3 | 0.125 | 0.00441 | 18.6131 | 1.09375 | 0.011172 | 20.7537 |
| LAB152 | 28473.2 | 0.1325 | 0.434836 | 25.7299 | 1.025 | 0.316015 | 13.1635 |
| LAB152 | 28473.3 | 0.121875 | 0.021293 | 15.6478 | 0.98125 | 0.298838 | 8.3333 |
| LAB152 | 28474.4 | 0.126875 | 0.005986 | 20.3923 | 1.0625 | 0.004915 | 17.3036 |
| LAB181 | 28481.1 | 0.125 | 0.370923 | 18.6131 | 1.08125 | 0.105183 | 19.3737 |
| LAB181 | 28482.2 | 0.124375 | 0.086795 | 18.0201 | 1.05 | 0.009289 | 15.9236 |
| LAB181 | 28483.2 | 0.113125 | 0.157324 | 7.3449 | 0.925 | 0.69078 | 2.1231 |
| LAB181 | 28484.3 | 0.133125 | 0.529519 | 26.323 | 1.01875 | 0.507016 | 12.4735 |
| LAB113 | 28543.5 | 0.109375 | 0.452382 | 3.7865 | 0.95 | 0.351115 | 4.8832 |
| LAB113 | 28545.2 | 0.12625 | 0.501337 | 19.7993 | 1.00625 | 0.111286 | 11.0934 |
| LAB113 | 28545.3 | 0.11 | 0.412464 | 4.3796 | 0.98125 | 0.151216 | 8.3333 |
| LAB145 | 28551.1 | 0.109375 | 0.717413 | 3.7865 | 0.925 | 0.719409 | 2.1231 |
| LAB145 | 28551.3 | 0.1275 | 0.040988 | 20.9854 | — | — | — |
| LAB145 | 28553.2 | 0.1125 | 0.216484 | 6.7518 | 1.01875 | 0.14898 | 12.4735 |
| LAB145 | 28553.3 | 0.13 | 0.000245 | 23.3577 | 1.1625 | 0.006746 | 28.3439 |

TABLE 74-continued

Genes showing improved plant biomass production under high salinity conditions

| Gene | | Dry Weight [g] | | | Fresh Weight [g] | | |
|---|---|---|---|---|---|---|---|
| Name | Event # | Ave. | P-Val/ | % Incr. | Ave. | P-Val. | % Incr. |
| LAB213 | 28561.2 | 0.113125 | 0.134294 | 7.3449 | 1.05 | 0.009289 | 15.9236 |
| LAB213 | 28562.6 | 0.11375 | 0.220966 | 7.938 | 0.975 | 0.213364 | 7.6433 |
| LAB230 | 28572.3 | 0.125 | 0.001631 | 18.6131 | 1.0875 | 0.002032 | 20.0637 |
| LAB230 | 28574.2 | 0.11125 | 0.807913 | 5.5657 | — | | |
| LAB249 | 28602.1 | 0.116875 | 0.617635 | 10.9033 | 1.00625 | 0.462872 | 11.0934 |
| LAB249 | 28603.3 | — | | — | 0.94375 | 0.424762 | 4.1932 |
| LAB249 | 28604.4 | 0.108125 | 0.692913 | 2.6004 | 0.96875 | 0.52359 | 6.9533 |
| CONT | — | 0.105385 | — | 0 | 0.905769 | — | 0 |
| LAB258 | 27441.4 | 0.095625 | 0.844984 | 1.3761 | 0.95625 | 0.808839 | 5.3496 |
| LAB258 | 27441.6 | — | | — | 0.9625 | 0.737615 | 6.0381 |
| LAB258 | 27442.5 | 0.139286 | 0.360339 | 47.6627 | 1.11607 | 0.034028 | 22.957 |
| LAB258 | 27444.4 | — | | — | 0.95625 | 0.351786 | 5.3496 |
| LAB247 | 28091.4 | 0.119375 | 0.117814 | 26.5545 | 1.125 | 0.246841 | 23.9407 |
| LAB247 | 28093.2 | 0.110625 | 0.174366 | 17.2783 | 1.1125 | 0.002401 | 22.5636 |
| LAB247 | 28094.1 | — | | — | 1 | 0.260008 | 10.1695 |
| LAB247 | 28094.3 | 0.1 | | 6.0143 | 1.0375 | | 14.3008 |
| LAB247 | 28095.4 | 0.105 | 0.628532 | 11.315 | 1.06875 | 0.076217 | 17.7436 |
| LAB88 | 28191.3 | 0.095 | 0.975864 | 0.7136 | 0.975 | 0.710377 | 7.4153 |
| LAB131 | 28291.1 | 0.100625 | 0.535299 | 6.6769 | 1.11875 | 0.042304 | 23.2521 |
| LAB131 | 28292.3 | 0.108125 | 0.031657 | 14.6279 | 1.15 | 0.00002 | 26.6949 |
| LAB131 | 28294.2 | 0.095 | 0.923605 | 0.7136 | 0.9875 | 0.209337 | 8.7924 |
| LAB131 | 28295.3 | 0.10375 | 0.665265 | 9.9898 | 1.0625 | 0.455086 | 17.0551 |
| LAB153 | 28301.1 | 0.110625 | 0.031056 | 17.2783 | 1.05 | 0.002041 | 15.678 |
| LAB153 | 28302.2 | 0.099375 | 0.693475 | 5.3517 | 0.95 | 0.272249 | 4.661 |
| LAB153 | 28303.1 | 0.113125 | 0.188391 | 19.9286 | 1.025 | 0.007379 | 12.9237 |
| LAB153 | 28304.1 | 0.106875 | 0.632758 | 13.3028 | 1.13125 | 0.000029 | 24.6292 |
| LAB153 | 28305.3 | 0.101875 | 0.227706 | 8.002 | 0.96875 | 0.254778 | 6.7267 |
| LAB169 | 28391.1 | 0.12125 | 0.266883 | 28.5423 | 1.3 | 0.073068 | 43.2203 |
| LAB169 | 28391.4 | 0.101875 | 0.227706 | 8.002 | 0.95625 | 0.543061 | 5.3496 |
| LAB169 | 28392.1 | 0.1275 | 0.008673 | 35.1682 | 1.30625 | 0.224333 | 43.9089 |
| LAB169 | 28393.2 | 0.135625 | 0.072328 | 43.7819 | 1.275 | 0 | 40.4661 |
| LAB169 | 28394.3 | 0.11875 | 0.380051 | 25.8919 | 1.13125 | 0.000215 | 24.6292 |
| LAB294 | 28404.3 | 0.094375 | 0.996064 | 0.051 | — | | |
| LAB294 | 28405.1 | — | | — | 1.025 | 0.007379 | 12.9237 |
| LAB187 | 28433.3 | — | | — | 0.98125 | 0.183467 | 8.1038 |
| LAB187 | 28434.1 | 0.128125 | 0.000079 | 35.8308 | 1.25625 | 0 | 38.4004 |
| LAB187 | 28434.2 | 0.106875 | 0.055404 | 13.3028 | 0.99375 | 0.519592 | 9.4809 |
| LAB187 | 28435.3 | 0.09875 | 0.488478 | 4.6891 | — | | |
| LAB187 | 28435.4 | 0.09625 | 0.833629 | 2.0387 | 1.04375 | 0.10714 | 14.9894 |
| LAB74 | 28451.3 | 0.09875 | 0.894252 | 4.6891 | 1.11875 | 0.39781 | 23.2521 |
| LAB74 | 28453.5 | 0.095 | 0.958202 | 0.7136 | 0.954167 | 0.667873 | 5.1201 |
| LAB70 | 28462.2 | 0.099375 | 0.693475 | 5.3517 | — | | — |
| LAB152 | 28471.1 | 0.136875 | 0.000073 | 45.107 | 1.25625 | 0.012927 | 38.4004 |
| LAB152 | 28472.3 | 0.10875 | 0.352681 | 15.2905 | 1.1625 | 0.00073 | 28.072 |
| LAB152 | 28473.2 | 0.1025 | 0.73923 | 8.6646 | 1.1125 | 0.299877 | 22.5636 |
| LAB152 | 28473.3 | — | | — | 0.9125 | 0.953437 | 0.5297 |
| LAB152 | 28474.4 | — | | — | 0.9625 | | 6.0381 |
| LAB181 | 28481.1 | 0.134375 | 0.000015 | 42.4567 | 1.16875 | 0.025889 | 28.7606 |
| LAB181 | 28482.2 | — | | — | 1.0875 | | 19.8093 |
| LAB181 | 28482.3 | 0.11625 | 0.002325 | 23.2416 | 1.0125 | 0.014083 | 11.5466 |
| LAB181 | 28483.2 | 0.1125 | 0.564365 | 19.2661 | 0.98125 | 0.698883 | 8.1038 |
| LAB181 | 28484.3 | 0.115 | 0.0035 | 21.9164 | 1.175 | 0.011128 | 29.4492 |
| LAB113 | 28545.3 | 0.10875 | 0.181687 | 15.2905 | 1.25625 | 0.000005 | 38.4004 |
| LAB145 | 28551.1 | — | | — | 1.0125 | 0.610148 | 11.5466 |
| LAB145 | 28551.3 | 0.11 | 0.407843 | 16.6157 | 1 | 0.344679 | 10.1695 |
| LAB145 | 28553.2 | 0.1075 | 0.055019 | 13.9653 | 1.08125 | 0.017152 | 19.1208 |
| LAB145 | 28553.3 | 0.11875 | 0.326059 | 25.8919 | 1.2625 | 0.194616 | 39.089 |
| LAB145 | 28555.1 | 0.121875 | 0.531091 | 29.2049 | 1.225 | 0.09811 | 34.9576 |
| LAB213 | 28561.2 | 0.115 | 0.044958 | 21.9164 | 1.1625 | 0.171704 | 28.072 |
| LAB213 | 28561.4 | 0.10125 | 0.469329 | 7.3394 | — | | |
| LAB213 | 28562.6 | 0.110625 | 0.475975 | 17.2783 | 1.04375 | 0.363555 | 14.9894 |
| LAB213 | 28565.2 | 0.095 | 0.959339 | 0.7136 | 1.0625 | 0.38577 | 17.0551 |
| LAB230 | 28572.2 | 0.115625 | 0.321917 | 22.579 | 1.05625 | 0.001074 | 16.3665 |
| LAB230 | 28572.3 | 0.101875 | 0.270878 | 8.002 | 1.08125 | 0.127133 | 19.1208 |
| LAB230 | 28574.2 | 0.09875 | 0.787586 | 4.6891 | 1 | 0.558254 | 10.1695 |
| LAB249 | 28602.1 | — | | — | 0.9875 | 0.209337 | 8.7924 |
| LAB249 | 28603.3 | 0.104375 | 0.152151 | 10.6524 | 1.00625 | 0.031689 | 10.8581 |
| LAB249 | 28604.2 | 0.10875 | 0.30155 | 15.2905 | 1.1125 | 0.070504 | 22.5636 |
| LAB249 | 28604.4 | — | | — | 0.9125 | 0.973147 | 0.5297 |
| LAB249 | 28605.2 | 0.10875 | 0.068601 | 15.2905 | 1.13125 | 0.037116 | 24.6292 |
| CONT | — | 0.094327 | — | 0 | 0.907692 | — | 0 |
| LAB339 | 27272.7 | — | | — | 1.11875 | 0.270824 | 8.3535 |
| LAB299 | 28063.1 | 0.119643 | 0.275587 | 9.5129 | 1.13125 | 0.377788 | 9.5642 |
| LAB299 | 28064.1 | 0.131875 | 0.329678 | 20.7094 | 1.13125 | 0.377788 | 9.5642 |

TABLE 74-continued

Genes showing improved plant biomass production under high salinity conditions

| Gene Name | Event # | Dry Weight [g] | | | Fresh Weight [g] | | |
|---|---|---|---|---|---|---|---|
| | | Ave. | P-Val/ | % Incr. | Ave. | P-Val. | % Incr. |
| LAB299 | 28066.1 | 0.11375 | 0.52632 | 4.119 | 1.21875 | 0.164137 | 18.0387 |
| LAB242 | 28081.2 | 0.144375 | 0.000022 | 32.151 | 1.30625 | 0.030454 | 26.5133 |
| LAB242 | 28081.3 | 0.118125 | 0.647491 | 8.1236 | 1.0875 | 0.679647 | 5.3269 |
| LAB242 | 28083.1 | 0.116875 | 0.015786 | 6.9794 | 1.11875 | 0.270824 | 8.3535 |
| LAB242 | 28085.1 | 0.115 | 0.821892 | 5.2632 | 1.06875 | 0.733045 | 3.5109 |
| LAB242 | 28085.5 | 0.12375 | 0.031893 | 13.2723 | 1.1875 | 0.001331 | 15.0121 |
| LAB157 | 28142.3 | 0.124821 | 0.020162 | 14.253 | 1.14196 | 0.10599 | 10.6019 |
| LAB157 | 28144.2 | 0.11125 | 0.857626 | 1.8307 | — | — | — |
| LAB157 | 28145.2 | 0.11875 | 0.416026 | 8.6957 | 1.15625 | 0.362404 | 11.9855 |
| LAB157 | 28146.1 | 0.124375 | 0.008272 | 13.8444 | 1.19375 | 0.010504 | 15.6174 |
| LAB269 | 28342.3 | — | — | — | 1.05625 | 0.788962 | 2.3002 |
| LAB269 | 28343.4 | 0.135625 | 0.102888 | 24.1419 | 1.19375 | 0.242228 | 15.6174 |
| LAB269 | 28345.2 | 0.11375 | 0.697551 | 4.119 | 1.0625 | 0.423056 | 2.9056 |
| LAB269 | 28345.3 | 0.118125 | 0.253314 | 8.1236 | 1.1 | 0.027647 | 6.5375 |
| LAB279 | 28351.1 | 0.11875 | 0.278517 | 8.6957 | 1.0625 | 0.655422 | 2.9056 |
| LAB279 | 28351.4 | 0.119375 | 0.633541 | 9.2677 | 1.06875 | 0.854999 | 3.5109 |
| LAB279 | 28353.2 | 0.120625 | 0.266158 | 10.4119 | 1.1625 | 0.134631 | 12.5908 |
| LAB279 | 28355.4 | 0.116875 | 0.786553 | 6.9794 | 1.0375 | 0.976897 | 0.4843 |
| LAB283 | 28361.1 | 0.109375 | 0.994476 | 0.1144 | 1.0875 | 0.679647 | 5.3269 |
| LAB283 | 28363.3 | 0.134375 | 0.18265 | 22.9977 | 1.25 | 0.000174 | 21.0654 |
| LAB283 | 28364.3 | 0.115 | 0.334987 | 5.2632 | 1.08125 | 0.605642 | 4.7215 |
| LAB283 | 28365.1 | 0.116875 | 0.56296 | 6.9794 | 1.04375 | 0.957665 | 1.0896 |
| LAB336 | 28375.3 | 0.11 | 0.760699 | 0.6865 | — | — | — |
| LAB267 | 28383.2 | 0.1175 | 0.679705 | 7.5515 | 1.15 | 0.152916 | 11.3801 |
| LAB267 | 28384.2 | 0.11625 | 0.674751 | 6.4073 | 1.09375 | 0.464717 | 5.9322 |
| LAB267 | 28384.5 | 0.125625 | 0.000696 | 14.9886 | 1.13125 | 0.312881 | 9.5642 |
| LAB267 | 28385.2 | 0.1125 | 0.223777 | 2.9748 | — | — | — |
| LAB119 | 28411.1 | 0.122411 | 0.255302 | 12.0464 | 1.10089 | 0.031749 | 6.624 |
| LAB119 | 28412.1 | 0.1275 | 0.019106 | 16.7048 | 1.15625 | 0.020352 | 11.9855 |
| LAB119 | 28413.1 | 0.1225 | 0.117484 | 12.1281 | 1.15625 | 0.100708 | 11.9855 |
| LAB238 | 28422.4 | 0.116875 | 0.388035 | 6.9794 | 1.10625 | 0.316711 | 7.1429 |
| LAB238 | 28422.5 | 0.11 | 0.907146 | 0.6865 | — | — | — |
| LAB238 | 28424.3 | 0.119375 | 0.422514 | 9.2677 | 1.11875 | 0.56457 | 8.3535 |
| LAB238 | 28424.4 | 0.12 | 0.316118 | 9.8398 | 1.1 | 0.027647 | 6.5375 |
| LAB238 | 28425.5 | 0.1225 | 0.478731 | 12.1281 | 1.1125 | 0.337148 | 7.7482 |
| LAB58 | 28441.2 | 0.110625 | 0.893959 | 1.2586 | 1.0375 | 0.882514 | 0.4843 |
| LAB58 | 28442.1 | 0.119375 | 0.470741 | 9.2677 | 1.1125 | 0.605698 | 7.7482 |
| LAB58 | 28443.2 | 0.11625 | 0.374258 | 6.4073 | 1.15 | 0.152916 | 11.3801 |
| LAB58 | 28443.4 | 0.12 | 0.060364 | 9.8398 | 1.075 | 0.6714 | 4.1162 |
| LAB58 | 28445.2 | 0.12 | 0.316118 | 9.8398 | 1.1875 | 0.03802 | 15.0121 |
| LAB345 | 28495.1 | 0.12125 | 0.437094 | 10.984 | 1.15 | 0.001876 | 11.3801 |
| LAB108 | 28502.2 | 0.131875 | 0.23831 | 20.7094 | 1.2 | 0.000978 | 16.2228 |
| LAB231 | 28581.3 | 0.120625 | 0.003302 | 10.4119 | 1.1 | 0.027647 | 6.5375 |
| LAB231 | 28582.1 | — | — | — | 1.05625 | 0.788962 | 2.3002 |
| LAB231 | 28583.1 | 0.12 | 0.428072 | 9.8398 | 1.21875 | 0.112554 | 18.0387 |
| LAB231 | 28585.1 | 0.140625 | 0.016533 | 28.7185 | 1.25625 | 0.089872 | 21.6707 |
| LAB240 | 28592.2 | 0.13 | 0.000376 | 18.9931 | 1.2 | 0.000483 | 16.2228 |
| LAB240 | 28592.6 | 0.1225 | 0.478731 | 12.1281 | 1.15625 | 0.362404 | 11.9855 |
| LAB240 | 28595.1 | 0.135 | 0.000194 | 23.5698 | 1.2625 | 0.00014 | 22.276 |
| LAB240 | 28595.3 | 0.12625 | 0.530244 | 15.5606 | 1.1875 | 0.171148 | 15.0121 |
| LAB302 | 28822.6 | 0.11 | 0.760699 | 0.6865 | 1.0625 | 0.566106 | 2.9056 |
| LAB302 | 28822.7 | 0.12375 | 0.10317 | 13.2723 | 1.18125 | 0.147423 | 14.4068 |
| LAB298 | 29242.1 | — | — | — | 1.0625 | 0.211987 | 2.9056 |
| LAB298 | 29244.1 | 0.115 | 0.628761 | 5.2632 | 1.1 | 0.29049 | 6.5375 |
| LAB298 | 29245.2 | 0.113125 | 0.672989 | 3.5469 | 1.125 | 0.094404 | 8.9588 |
| LAB298 | 29245.3 | — | — | — | 1.08125 | 0.329513 | 4.7215 |
| LAB298 | 29245.4 | 0.13875 | 0.139273 | 27.0023 | 1.21875 | 0.164137 | 18.0387 |
| CONT | — | 0.10925 | — | 0 | 1.0325 | — | 0 |
| LAB335 | 27314.2 | — | — | — | 1.475 | 0.648428 | 5.4917 |
| LAB335 | 27315.4 | 0.14375 | 0.768385 | 5.2288 | — | — | — |
| LAB318 | 28103.2 | — | — | — | 1.51875 | 0.552509 | 8.6207 |
| LAB54 | 28134.1 | 0.15 | 0.474804 | 9.8039 | 1.54375 | 0.167868 | 10.4087 |
| LAB54 | 28136.1 | 0.145 | 0.455648 | 6.1438 | 1.46875 | 0.119662 | 5.0447 |
| LAB54 | 28136.2 | 0.148125 | 0.014598 | 8.4314 | 1.45 | 0.186902 | 3.7037 |
| LAB185 | 28172.4 | — | — | — | 1.4 | 0.995226 | 0.1277 |
| LAB310 | 28181.2 | 0.1525 | 0.479345 | 11.634 | 1.525 | 0.240903 | 9.0677 |
| LAB310 | 28182.3 | 0.149375 | 0.586881 | 9.3464 | 1.56875 | 0.132058 | 12.1967 |
| LAB133 | 28832.1 | 0.139375 | 0.791926 | 2.0261 | 1.45 | 0.614414 | 3.7037 |
| LAB133 | 28832.5 | 0.14625 | 0.609795 | 7.0588 | 1.43125 | 0.78671 | 2.3627 |
| LAB133 | 28833.1 | 0.1425 | 0.692673 | 4.3137 | 1.425 | 0.896508 | 1.9157 |
| LAB133 | 28833.2 | 0.148125 | 0.61819 | 8.4314 | — | — | — |
| LAB327 | 29224.2 | 0.1425 | 0.431242 | 4.3137 | — | — | — |
| LAB327 | 29225.2 | 0.13875 | 0.416566 | 1.5686 | 1.46875 | 0.206014 | 5.0447 |
| LAB179 | 29303.2 | 0.140625 | 0.396084 | 2.9412 | 1.4625 | 0.113917 | 4.5977 |

TABLE 74-continued

Genes showing improved plant biomass production under high salinity conditions

| Gene Name | Event # | Dry Weight [g] Ave. | P-Val/ | % Incr. | Fresh Weight [g] Ave. | P-Val. | % Incr. |
|---|---|---|---|---|---|---|---|
| LAB179 | 29304.2 | 0.14125 | 0.646174 | 3.3987 | 1.4 | 0.987301 | 0.1277 |
| LAB179 | 29304.3 | — | — | — | 1.40625 | 0.977946 | 0.5747 |
| LAB160 | 29314.2 | 0.138125 | 0.792563 | 1.1111 | — | — | — |
| LAB160 | 29315.3 | 0.1425 | 0.660442 | 4.3137 | — | — | — |
| LAB177 | 29422.1 | 0.14125 | 0.845626 | 3.3987 | 1.4125 | 0.934602 | 1.0217 |
| LAB177 | 29424.3 | 0.14375 | 0.639105 | 5.2288 | — | — | — |
| CONT | | 0.136607 | — | 0 | 1.39821 | — | 0 |
| LAB167 | 27321.2 | — | — | — | 1.025 | 0.171755 | 6.2812 |
| LAB167 | 27321.3 | 0.105 | 0.586487 | 4.698 | 1.06875 | 0.087891 | 10.8175 |
| LAB167 | 27321.4 | 0.10375 | 0.534731 | 3.4516 | 1.0625 | 0.398727 | 10.1695 |
| LAB167 | 27321.6 | 0.10625 | 0.617316 | 5.9444 | 1.0875 | 0.188063 | 12.7617 |
| LAB383 | 28111.4 | 0.115625 | 0.591907 | 15.2924 | 0.9875 | 0.837334 | 2.3928 |
| LAB383 | 28114.2 | 0.108036 | 0.558614 | 7.725 | 1.07679 | 0.585528 | 11.6508 |
| LAB383 | 28115.2 | — | — | — | 1.025 | 0.045482 | 6.2812 |
| LAB355 | 29281.3 | 0.10375 | 0.811156 | 3.4516 | — | — | — |
| LAB355 | 29282.1 | 0.10125 | 0.955841 | 0.9588 | — | — | — |
| LAB355 | 29282.2 | — | — | — | 1.04375 | 0.678687 | 8.2253 |
| LAB355 | 29283.1 | 0.1125 | 0.534068 | 12.1764 | 1.09375 | 0.467131 | 13.4098 |
| LAB92 | 29322.1 | — | — | — | 0.96875 | 0.982439 | 0.4487 |
| LAB92 | 29323.2 | 0.12 | 0.433621 | 19.6548 | 1.0875 | 0.026381 | 12.7617 |
| LAB280 | 30041.2 | 0.108125 | 0.72332 | 7.814 | — | — | — |
| LAB280 | 30042.1 | 0.1125 | 0.003597 | 12.1764 | — | — | — |
| LAB280 | 30044.1 | 0.12 | 0.138405 | 19.6548 | 1.225 | 0.104533 | 27.0189 |
| LAB280 | 30044.2 | 0.107857 | 0.502287 | 7.5469 | 0.967857 | 0.91857 | 0.3561 |
| LAB280 | 30045.1 | 0.11125 | 0.356923 | 10.93 | 1.09375 | 0.135462 | 13.4098 |
| LAB344 | 30096.3 | 0.105625 | 0.416526 | 5.3212 | — | — | — |
| LAB367 | 30172.3 | 0.114911 | 0.058567 | 14.5802 | 1.12321 | 0.141419 | 16.4649 |
| LAB367 | 30173.1 | — | — | — | 1 | 0.514084 | 3.6889 |
| LAB126 | 30205.1 | 0.11375 | 0.001822 | 13.4228 | 1.0875 | 0.000685 | 12.7617 |
| LAB241 | 30211.3 | 0.119375 | 0.30474 | 19.0316 | 1.13125 | 0.308441 | 17.2981 |
| LAB241 | 30212.1 | 0.101875 | 0.894733 | 1.582 | 1 | 0.386552 | 3.6889 |
| LAB241 | 30212.2 | 0.130625 | 0.160329 | 30.2493 | 1.16875 | 0.000006 | 21.1864 |
| LAB241 | 30213.1 | 0.100625 | 0.983799 | 0.3356 | 1.05625 | 0.223372 | 9.5214 |
| LAB311 | 30222.2 | 0.1125 | 0.003597 | 12.1764 | 1.075 | 0.124446 | 11.4656 |
| LAB311 | 30223.2 | 0.105625 | 0.416526 | 5.3212 | 1.03125 | 0.329886 | 6.9292 |
| LAB311 | 30224.2 | 0.1025 | 0.82083 | 2.2052 | — | — | — |
| LAB165 | 30231.2 | 0.110625 | 0.572615 | 10.3068 | 1.0875 | 0.560656 | 12.7617 |
| LAB165 | 30233.1 | 0.10375 | 0.426725 | 3.4516 | 0.9875 | 0.563735 | 2.3928 |
| LAB165 | 30235.1 | 0.11125 | 0.501942 | 10.93 | 1.06875 | 0.5003 | 10.8175 |
| LAB64 | 30271.2 | 0.106875 | 0.334141 | 6.5676 | 1.0875 | 0.262446 | 12.7617 |
| LAB64 | 30272.1 | 0.115625 | 0.090588 | 15.2924 | 1.0875 | 0.001569 | 12.7617 |
| LAB64 | 30274.2 | 0.1075 | 0.435692 | 7.1908 | 1.01875 | 0.727108 | 5.6331 |
| LAB65 | 30301.4 | 0.106875 | 0.7267 | 6.5676 | 1.09375 | 0.280452 | 13.4098 |
| LAB65 | 30302.1 | 0.12 | 0.138405 | 19.6548 | 1.0375 | 0.349001 | 7.5773 |
| LAB65 | 30303.4 | — | — | — | 0.99375 | 0.745703 | 3.0409 |
| LAB65 | 30304.3 | 0.11125 | 0.501942 | 10.93 | 0.99375 | 0.745703 | 3.0409 |
| LAB102 | 30312.2 | — | — | — | 0.98125 | 0.625672 | 1.7448 |
| LAB220 | 30322.2 | 0.103125 | 0.89437 | 2.8284 | — | — | — |
| LAB220 | 30322.3 | 0.110625 | 0.007216 | 10.3068 | 0.9875 | 0.563735 | 2.3928 |
| LAB220 | 30324.4 | 0.10375 | 0.329683 | 3.4516 | — | — | — |
| LAB381 | 30351.4 | 0.10875 | 0.619609 | 8.4372 | — | — | — |
| LAB381 | 30352.2 | 0.1125 | 0.094053 | 12.1764 | 1.025 | 0.41709 | 6.2812 |
| LAB381 | 30352.4 | 0.10375 | 0.681584 | 3.4516 | 1.05 | 0.008335 | 8.8734 |
| LAB381 | 30354.2 | 0.1075 | 0.599632 | 7.1908 | 1.025 | 0.562718 | 6.2812 |
| LAB289 | 30371.6 | 0.116875 | 0.672607 | 16.5388 | 0.99375 | 0.872317 | 3.0409 |
| LAB289 | 30375.2 | 0.111875 | 0.012087 | 11.5532 | 1.00625 | 0.157338 | 4.337 |
| LAB268 | 30391.4 | 0.110625 | 0.0847 | 10.3068 | 1 | 0.257963 | 3.6889 |
| LAB268 | 30392.1 | 0.105 | 0.642705 | 4.698 | 0.98125 | 0.900738 | 1.7448 |
| LAB268 | 30393.1 | 0.110625 | 0.53973 | 10.3068 | — | — | — |
| LAB268 | 30395.1 | 0.134375 | 0.341339 | 33.9885 | 1.1875 | 0.213179 | 23.1306 |
| CONT | | 0.100288 | — | 0 | 0.964423 | — | 0 |
| LAB259 | 27112.12 | 0.118125 | 0.401292 | 8 | 1.2125 | 0.522954 | 3.0818 |
| LAB259 | 27112.14 | 0.11625 | 0.264126 | 6.2857 | 1.25 | 0.427155 | 6.2699 |
| LAB259 | 27112.3 | 0.125 | 0.010417 | 14.2857 | 1.325 | 0.001993 | 12.6461 |
| LAB259 | 27112.7 | 0.113125 | 0.86129 | 3.4286 | — | — | — |
| LAB259 | 27112.9 | 0.115 | 0.446264 | 5.1429 | — | — | — |
| LAB55 | 30022.3 | 0.1175 | 0.306687 | 7.4286 | 1.34375 | 0.073315 | 14.2402 |
| LAB55 | 30023.1 | 0.123125 | 0.184276 | 12.5714 | 1.225 | 0.764119 | 4.1445 |
| LAB55 | 30023.3 | 0.111875 | 0.687043 | 2.2857 | — | — | — |
| LAB55 | 30025.3 | 0.12 | 0.630358 | 9.7143 | 1.3125 | 0.148458 | 11.5834 |
| LAB300 | 30061.2 | 0.113125 | 0.294741 | 3.4286 | — | — | — |
| LAB300 | 30062.2 | 0.1175 | 0.306687 | 7.4286 | 1.29375 | 0.458014 | 9.9894 |
| LAB300 | 30063.1 | 0.119375 | 0.030064 | 9.1429 | 1.26875 | 0.305103 | 7.864 |
| LAB300 | 30064.1 | 0.12125 | 0.474626 | 10.8571 | 1.28125 | 0.534215 | 8.9267 |

TABLE 74-continued

Genes showing improved plant biomass production under high salinity conditions

| Gene | | Dry Weight [g] | | | Fresh Weight [g] | | |
|---|---|---|---|---|---|---|---|
| Name | Event # | Ave. | P-Val/ | % Incr. | Ave. | P-Val. | % Incr. |
| LAB300 | 30064.3 | 0.118125 | 0.231489 | 8 | 1.36875 | 0.013435 | 16.3656 |
| LAB176 | 30142.1 | 0.1275 | 0.036641 | 16.5714 | 1.275 | 0.239251 | 8.3953 |
| LAB176 | 30143.2 | 0.11 | 0.908672 | 0.5714 | 1.1875 | 0.868611 | 0.9564 |
| LAB83 | 30191.1 | 0.11375 | 0.54084 | 4 | 1.25625 | 0.042293 | 6.8013 |
| LAB83 | 30194.1 | 0.11375 | 0.66503 | 4 | — | — | — |
| LAB83 | 30194.3 | 0.12 | 0.216638 | 9.7143 | 1.21875 | 0.24293 | 3.6132 |
| LAB166 | 30243.1 | 0.119375 | 0.58296 | 9.1429 | 1.30625 | 0.009187 | 11.0521 |
| LAB166 | 30244.3 | 0.119375 | 0.015094 | 9.1429 | 1.19375 | 0.72198 | 1.4878 |
| LAB166 | 30245.3 | 0.12625 | 0.007464 | 15.4286 | 1.33125 | 0.274328 | 13.1775 |
| LAB166 | 30245.4 | — | — | — | 1.18125 | 0.970456 | 0.4251 |
| LAB237 | 30282.1 | 0.110625 | 0.719785 | 1.1429 | — | — | — |
| LAB237 | 30283.2 | 0.11875 | 0.158614 | 8.5714 | 1.225 | 0.501139 | 4.1445 |
| LAB347_H0 | 30441.1 | 0.12125 | 0.09899 | 10.8571 | 1.275 | 0.447959 | 8.3953 |
| LAB347_H0 | 30443.4 | 0.11625 | 0.068568 | 6.2857 | 1.26875 | 0.21293 | 7.864 |
| LAB347_H0 | 30444.1 | — | — | — | 1.2375 | 0.495315 | 5.2072 |
| LAB347_H0 | 30444.3 | 0.114375 | 0.648707 | 4.5714 | 1.24375 | 0.214337 | 5.7386 |
| LAB161 | 30482.1 | 0.12375 | 0.001921 | 13.1429 | 1.225 | 0.575905 | 4.1445 |
| LAB161 | 30482.2 | 0.12375 | 0.410904 | 13.1429 | 1.28125 | 0.08323 | 8.9267 |
| LAB161 | 30483.1 | 0.12875 | 0.000285 | 17.7143 | 1.3875 | 0.170849 | 17.9596 |
| LAB161 | 30485.1 | 0.123125 | 0.002499 | 12.5714 | 1.19375 | 0.660711 | 1.4878 |
| LAB161 | 30486.1 | 0.1275 | 0.000404 | 16.5714 | 1.41875 | 0.005967 | 20.6164 |
| LAB306 | 30561.2 | 0.116875 | 0.175952 | 6.8571 | 1.2625 | 0.541319 | 7.3326 |
| LAB306 | 30563.2 | 0.125625 | 0.023772 | 14.8571 | 1.23125 | 0.139764 | 4.6759 |
| LAB306 | 30564.2 | 0.11 | 0.926447 | 0.5714 | — | — | — |
| LAB306 | 30564.3 | 0.118125 | 0.231489 | 8 | — | — | — |
| LAB270 | 30591.2 | 0.115 | 0.525914 | 5.1429 | — | — | — |
| LAB270 | 30594.1 | 0.115 | 0.124873 | 5.1429 | — | — | — |
| LAB270 | 30594.3 | 0.118125 | 0.050348 | 8 | 1.225 | 0.28997 | 4.1445 |
| LAB270 | 30595.1 | 0.11 | 0.855036 | 0.5714 | 1.2 | 0.591761 | 2.0191 |
| LAB270 | 30595.2 | 0.129375 | 0.051305 | 18.2857 | 1.4 | 0.0626 | 19.0223 |
| LAB262 | 30611.4 | 0.11875 | 0.158614 | 8.5714 | 1.33125 | 0.001214 | 13.1775 |
| LAB262 | 30612.1 | 0.11375 | 0.66503 | 4 | — | — | — |
| LAB262 | 30612.4 | 0.12375 | 0.136822 | 13.1429 | 1.18125 | 0.886617 | 0.4251 |
| LAB262 | 30614.1 | 0.12 | 0.366123 | 9.7143 | 1.2125 | 0.669557 | 3.0818 |
| LAB262 | 30614.2 | 0.12125 | 0.184351 | 10.8571 | 1.26875 | 0.575504 | 7.864 |
| LAB94 | 30681.4 | 0.116071 | 0.084193 | 6.1224 | 1.29375 | 0.413361 | 9.9894 |
| LAB94 | 30681.8 | 0.116875 | 0.456706 | 6.8571 | 1.275 | 0.057991 | 8.3953 |
| LAB94 | 30682.2 | 0.12125 | 0.09899 | 10.8571 | 1.275 | 0.020323 | 8.3953 |
| LAB159 | 30701.6 | 0.116875 | 0.669037 | 6.8571 | 1.2 | 0.881392 | 2.0191 |
| LAB159 | 30702.3 | 0.12375 | 0.064528 | 13.1429 | 1.25625 | 0.155306 | 6.8013 |
| LAB159 | 30702.4 | 0.135893 | 0.000047 | 24.2449 | 1.45357 | 0.000016 | 23.5767 |
| LAB159 | 30704.3 | 0.12125 | 0.09899 | 10.8571 | 1.34375 | 0.000711 | 14.2402 |
| LAB159 | 30704.4 | 0.116875 | 0.286151 | 6.8571 | — | — | — |
| LAB170 | 30712.1 | 0.110625 | 0.867692 | 1.1429 | 1.19375 | 0.776218 | 1.4878 |
| LAB170 | 30712.2 | 0.114286 | 0.543603 | 4.4898 | 1.25179 | 0.11037 | 6.4217 |
| LAB170 | 30713.2 | 0.11625 | 0.264126 | 6.2857 | 1.24375 | 0.494549 | 5.7386 |
| LAB170 | 30715.1 | 0.1225 | 0.477631 | 12 | 1.1875 | 0.943365 | 0.9564 |
| LAB170 | 30715.2 | 0.11625 | 0.519085 | 6.2857 | 1.225 | 0.28997 | 4.1445 |
| LAB188 | 30722.2 | 0.11875 | 0.158614 | 8.5714 | 1.25 | 0.49439 | 6.2699 |
| LAB188 | 30723.7 | 0.11 | 0.863841 | 0.5714 | — | — | — |
| LAB188 | 30724.1 | 0.11 | 0.965065 | 0.5714 | — | — | — |
| CONT | | 0.109375 | — | 0 | 1.17625 | — | 0 |
| LAB259 | 27112.12 | 0.154375 | 0.178378 | 40.3694 | 1.3125 | 0.003606 | 31.4554 |
| LAB259 | 27112.14 | 0.138125 | 0.002237 | 25.5937 | 1.2 | 0.006299 | 20.1878 |
| LAB259 | 27112.3 | 0.153125 | 0.245216 | 39.2328 | 1.325 | 0.071257 | 32.7074 |
| LAB259 | 27112.7 | 0.13125 | 0.176485 | 19.3424 | 1.1625 | 0.091343 | 16.4319 |
| LAB259 | 27112.9 | 0.170625 | 0.018694 | 55.1451 | 1.41875 | 0.00004 | 42.097 |
| LAB55 | 30022.3 | 0.110625 | 0.948255 | 0.5886 | — | — | — |
| LAB300 | 30061.2 | 0.13125 | 0.630179 | 19.3424 | 1.06875 | 0.791509 | 7.0423 |
| LAB300 | 30064.1 | 0.12375 | 0.413898 | 12.5228 | 1.05625 | 0.713479 | 5.7903 |
| LAB300 | 30064.3 | 0.120625 | 0.132041 | 9.6813 | 1.1875 | 0.005065 | 18.9358 |
| LAB176 | 30141.4 | 0.14875 | 0.005258 | 35.2547 | 1.26875 | 0.000718 | 27.0736 |
| LAB176 | 30142.1 | 0.151875 | 0.092436 | 38.0962 | 1.3125 | 0.000499 | 31.4554 |
| LAB176 | 30143.1 | 0.11375 | 0.553071 | 3.4301 | — | — | — |
| LAB176 | 30143.2 | 0.1575 | 0.064157 | 43.2109 | 1.35 | 0.207896 | 35.2113 |
| LAB176 | 30144.2 | 0.1475 | 0.005994 | 34.1181 | 1.29375 | 0.000394 | 29.5775 |
| LAB83 | 30194.3 | 0.11625 | 0.863829 | 5.7033 | — | — | — |
| LAB166 | 30242.1 | 0.13 | 0.027748 | 18.2058 | 1.08125 | 0.269036 | 8.2942 |
| LAB166 | 30243.1 | 0.144375 | 0.000721 | 31.2766 | 1.225 | 0.001828 | 22.6917 |
| LAB166 | 30244.3 | 0.155625 | 0.034672 | 41.506 | 1.36875 | 0.000093 | 37.0892 |
| LAB166 | 30245.3 | 0.155625 | 0.001148 | 41.506 | 1.2375 | 0.036016 | 23.9437 |
| LAB166 | 30245.4 | 0.1375 | 0.077689 | 25.0254 | 1.2 | 0.003572 | 20.1878 |
| LAB237 | 30281.4 | 0.12375 | 0.144181 | 12.5228 | 1.09375 | 0.293709 | 9.5462 |
| LAB237 | 30282.1 | 0.145 | 0.000675 | 31.8449 | 1.2625 | 0.000719 | 26.4476 |

TABLE 74-continued

Genes showing improved plant biomass production under high salinity conditions

| Gene | | Dry Weight [g] | | | Fresh Weight [g] | | |
|---|---|---|---|---|---|---|---|
| Name | Event # | Ave. | P-Val/ | % Incr. | Ave. | P-Val. | % Incr. |
| LAB237 | 30283.2 | 0.141875 | 0.006213 | 29.0035 | 1.19375 | 0.039561 | 19.5618 |
| LAB237 | 30283.4 | 0.13375 | 0.147971 | 21.6156 | 1.13125 | 0.177868 | 13.302 |
| LAB237 | 30284.1 | 0.120625 | 0.12292 | 9.6813 | 1.0375 | 0.607437 | 3.9124 |
| LAB323 | 30381.4 | 0.116875 | 0.557772 | 6.2716 | — | — | — |
| LAB323 | 30383.1 | 0.129375 | 0.313391 | 17.6375 | 1.15 | 0.291647 | 15.18 |
| LAB161 | 30482.1 | 0.134375 | 0.241741 | 22.1839 | 1.1125 | 0.630942 | 11.4241 |
| LAB161 | 30482.2 | 0.14875 | 0.062127 | 35.2547 | 1.19375 | 0.084901 | 19.5618 |
| LAB161 | 30483.1 | 0.131875 | 0.058365 | 19.9107 | 1.16875 | 0.228363 | 17.0579 |
| LAB161 | 30485.1 | 0.13375 | 0.301223 | 21.6156 | 1.1375 | 0.070151 | 13.928 |
| LAB161 | 30486.1 | 0.150625 | 0.197578 | 36.9596 | 1.25 | 0.153041 | 25.1956 |
| LAB306 | 30561.2 | 0.13625 | 0.478342 | 23.8888 | 1.14375 | 0.331467 | 14.554 |
| LAB306 | 30562.2 | 0.113125 | 0.689294 | 2.8618 | 1.00625 | 0.894725 | 0.7825 |
| LAB306 | 30563.2 | 0.12125 | 0.673028 | 10.2496 | 1.08125 | 0.610305 | 8.2942 |
| LAB306 | 30564.2 | 0.13 | 0.357156 | 18.2058 | 1.15 | 0.341297 | 15.18 |
| LAB306 | 30564.3 | 0.1275 | 0.181759 | 15.9326 | 1.11875 | 0.343336 | 12.0501 |
| LAB270 | 30591.2 | 0.141875 | 0.10614 | 29.0035 | 1.25 | 0.031407 | 25.1956 |
| LAB270 | 30594.1 | 0.13125 | 0.009823 | 19.3424 | 1.175 | 0.133386 | 17.6839 |
| LAB270 | 30594.3 | 0.1175 | 0.38519 | 6.8399 | — | — | — |
| LAB270 | 30595.2 | 0.123125 | 0.487781 | 11.9545 | 1.05625 | 0.345859 | 5.7903 |
| LAB262 | 30611.4 | 0.11375 | 0.846022 | 3.4301 | — | — | — |
| LAB262 | 30612.1 | 0.1225 | 0.17599 | 11.3862 | 1.075 | 0.19303 | 7.6682 |
| LAB262 | 30612.4 | 0.11625 | 0.707848 | 5.7033 | — | — | — |
| LAB262 | 30614.1 | 0.121875 | 0.090755 | 10.8179 | 1.0125 | 0.902888 | 1.4085 |
| LAB262 | 30614.2 | 0.159375 | 0.195206 | 44.9158 | 1.25 | 0.440149 | 25.1956 |
| LAB94 | 30681.8 | 0.117411 | 0.762188 | 6.7587 | 1.05714 | 0.753249 | 5.8797 |
| LAB94 | 30682.2 | 0.1125 | 0.833601 | 2.2935 | — | — | — |
| LAB94 | 30682.3 | 0.110625 | 0.948255 | 0.5886 | — | — | — |
| LAB159 | 30701.6 | 0.11875 | 0.537416 | 7.9765 | 1.05 | 0.622081 | 5.1643 |
| LAB159 | 30702.3 | 0.135625 | 0.006203 | 23.3205 | 1.20625 | 0.003511 | 20.8138 |
| LAB159 | 30702.4 | 0.146875 | 0.0032 | 33.5498 | 1.2375 | 0.243276 | 23.9437 |
| LAB159 | 30704.3 | 0.136875 | 0.004836 | 24.4571 | 1.1875 | 0.026388 | 18.9358 |
| LAB159 | 30704.4 | 0.149375 | 0.000269 | 35.823 | 1.175 | 0.371988 | 17.6839 |
| LAB170 | 30712.1 | 0.15625 | 0.009849 | 42.0743 | 1.2875 | 0.000404 | 28.9515 |
| LAB170 | 30712.2 | 0.140625 | 0.021531 | 27.8669 | 1.26875 | 0.194269 | 27.0736 |
| LAB170 | 30713.2 | 0.115 | 0.681132 | 4.5667 | 1.00625 | 0.959103 | 0.7825 |
| LAB170 | 30715.1 | 0.1175 | 0.284186 | 6.8399 | — | — | — |
| LAB170 | 30715.2 | 0.13375 | 0.147971 | 21.6156 | 1.1875 | 0.270406 | 18.9358 |
| LAB188 | 30724.1 | 0.124375 | 0.544623 | 13.0911 | 1.04375 | 0.770738 | 4.5383 |
| LAB188 | 30724.2 | 0.11875 | 0.318291 | 7.9765 | — | — | — |
| LAB138 | 30781.1 | 0.125625 | 0.245702 | 14.2277 | 1.06875 | 0.204185 | 7.0423 |
| LAB138 | 30781.2 | 0.12375 | 0.058647 | 12.5228 | 1.075 | 0.19303 | 7.6682 |
| LAB138 | 30781.6 | 0.110625 | 0.976021 | 0.5886 | — | — | — |
| LAB138 | 30783.2 | 0.11875 | 0.705073 | 7.9765 | 1.04375 | 0.845025 | 4.5383 |
| CONT | — | 0.109978 | — | 0 | 0.998438 | — | 0 |
| LAB191 | 28152.1 | 0.11375 | 0.643498 | 22.8346 | — | — | — |
| LAB191 | 28153.2 | 0.109375 | 0.083803 | 18.1102 | 0.94375 | 0.005461 | 10.219 |
| LAB191 | 28156.2 | 0.10875 | 0.244129 | 17.4353 | 0.98125 | 0.000416 | 14.5985 |
| LAB191 | 28156.4 | 0.10625 | 0.158641 | 14.7357 | 0.94375 | 0.130477 | 10.219 |
| LAB260 | 30071.4 | 0.11875 | 0.139848 | 28.234 | 1.1 | 0.119457 | 28.4672 |
| LAB260 | 30072.2 | 0.104375 | 0.235437 | 12.7109 | 0.99375 | 0.266767 | 16.0584 |
| LAB260 | 30073.2 | 0.10625 | 0.618146 | 14.7357 | 1.0625 | 0.338504 | 24.0876 |
| LAB260 | 30073.4 | 0.10875 | 0.411461 | 17.4353 | 0.99375 | 0.481342 | 16.0584 |
| LAB260 | 30074.3 | 0.095 | 0.425147 | 2.5872 | 0.90625 | 0.161175 | 5.8394 |
| LAB221 | 30122.2 | 0.125625 | 0.177519 | 35.658 | 1.24375 | 0.079758 | 45.2555 |
| LAB221 | 30123.2 | 0.105625 | 0.333108 | 14.0607 | 0.925 | 0.372835 | 8.0292 |
| LAB221 | 30124.4 | 0.125625 | 0 | 35.658 | 1.1375 | 0.001904 | 32.8467 |
| LAB221 | 30125.2 | 0.1175 | 0.283408 | 26.8841 | 1.1125 | 0.187066 | 29.927 |
| LAB264 | 30131.1 | 0.11125 | 0.156403 | 20.135 | 1.03125 | 0.297238 | 20.438 |
| LAB264 | 30131.2 | 0.09625 | 0.508379 | 3.937 | — | — | — |
| LAB264 | 30133.2 | 0.11375 | 0.22273 | 22.8346 | 1.01875 | 0.273667 | 18.9781 |
| LAB264 | 30134.4 | 0.1175 | 0.000003 | 26.8841 | 1.125 | 0.025314 | 31.3869 |
| LAB264 | 30135.2 | 0.098125 | 0.087227 | 5.9618 | 0.8875 | 0.431256 | 3.6496 |
| LAB303 | 30421.3 | 0.11125 | 0.295198 | 20.135 | 1.0375 | 0.008572 | 21.1679 |
| LAB182 | 30451.3 | 0.095 | 0.771264 | 2.5872 | — | — | — |
| LAB182 | 30453.1 | 0.095625 | 0.407909 | 3.2621 | — | — | — |
| LAB182 | 30453.4 | 0.1025 | 0.536542 | 10.6862 | 0.96875 | 0.43326 | 13.1387 |
| LAB182 | 30454.2 | 0.109375 | 0.345637 | 18.1102 | 1 | 0.376248 | 16.7883 |
| LAB182 | 30455.2 | 0.095625 | 0.622055 | 3.2621 | 0.95 | 0.062191 | 10.9489 |
| LAB232 | 30461.5 | 0.093036 | 0.952509 | 0.466 | — | — | — |
| LAB232 | 30462.4 | 0.106875 | 0.184588 | 15.4106 | 1.05625 | 0.000682 | 23.3577 |
| LAB232 | 30462.5 | 0.11875 | 0.210453 | 28.234 | 1.025 | 0.365198 | 19.708 |
| LAB232 | 30463.2 | — | — | — | 0.93125 | 0.386733 | 8.7591 |
| LAB222 | 30472.2 | 0.10125 | 0.666692 | 9.3363 | 0.9125 | 0.730986 | 6.5693 |
| LAB222 | 30473.1 | 0.11375 | 0.000015 | 22.8346 | 0.99375 | 0.368675 | 16.0584 |

TABLE 74-continued

Genes showing improved plant biomass production under high salinity conditions

| Gene Name | Event # | Dry Weight [g] | | | Fresh Weight [g] | | |
|---|---|---|---|---|---|---|---|
| | | Ave. | P-Val/ | % Incr. | Ave. | P-Val. | % Incr. |
| LAB222 | 30474.1 | 0.119375 | 0.11656 | 28.9089 | 1.05 | 0.104546 | 22.6277 |
| LAB222 | 30476.1 | 0.096875 | 0.252547 | 4.6119 | 0.975 | 0.115725 | 13.8686 |
| LAB222 | 30476.2 | 0.105625 | 0.207719 | 14.0607 | 1 | 0.000415 | 16.7883 |
| LAB225 | 30491.4 | 0.116875 | 0.087631 | 26.2092 | 1.0375 | 0.000065 | 21.1679 |
| LAB225 | 30492.1 | — | — | — | 0.89375 | 0.275994 | 4.3796 |
| LAB225 | 30492.2 | 0.115 | 0.16835 | 24.1845 | 1.075 | 0.000013 | 25.5474 |
| LAB225 | 30493.1 | 0.1125 | 0.004124 | 21.4848 | 1.00625 | 0.002997 | 17.5182 |
| LAB348 | 30504.2 | 0.096875 | 0.584283 | 4.6119 | — | | — |
| LAB348 | 30504.3 | 0.099375 | 0.552434 | 7.3116 | 0.875 | 0.845812 | 2.1898 |
| LAB353 | 30553.1 | 0.09875 | 0.411284 | 6.6367 | 0.93125 | 0.171784 | 8.7591 |
| LAB353 | 30554.2 | 0.105 | 0.00226 | 13.3858 | 0.94375 | 0.516731 | 10.219 |
| LAB353 | 30554.3 | 0.105625 | 0.129245 | 14.0607 | 1.03125 | 0.150834 | 20.438 |
| LAB320 | 30601.2 | 0.096875 | 0.175075 | 4.6119 | 0.875 | 0.518153 | 2.1898 |
| LAB320 | 30601.3 | 0.100893 | 0.164958 | 8.9507 | 0.99375 | 0.000187 | 16.0584 |
| LAB320 | 30603.1 | 0.129375 | 0.500265 | 39.7075 | — | | — |
| LAB320 | 30605.1 | 0.095 | 0.654642 | 2.5872 | — | | — |
| LAB343 | 30622.2 | 0.095 | 0.805822 | 2.5872 | — | | — |
| LAB343 | 30622.4 | — | | — | 0.8625 | 0.947841 | 0.7299 |
| LAB343 | 30623.4 | 0.104375 | 0.152077 | 12.7109 | 0.98125 | 0.512406 | 14.5985 |
| LAB343 | 30623.5 | 0.093125 | 0.953058 | 0.5624 | — | | — |
| LAB290_H0 | 30661.2 | 0.105 | 0.529726 | 13.3858 | 0.99375 | 0.266767 | 16.0584 |
| LAB290_H0 | 30662.3 | 0.1075 | 0.401861 | 16.0855 | 1.01875 | 0.394419 | 18.9781 |
| LAB290_H0 | 30663.3 | 0.0975 | 0.814104 | 5.2868 | 0.90625 | 0.746627 | 5.8394 |
| LAB290_H0 | 30663.7 | 0.10125 | 0.076576 | 9.3363 | 0.95 | 0.062191 | 10.9489 |
| LAB265 | 30731.3 | 0.104375 | 0.001904 | 12.7109 | 1.01875 | 0.000042 | 18.9781 |
| LAB265 | 30732.2 | 0.098125 | 0.279615 | 5.9618 | 0.8875 | 0.558367 | 3.6496 |
| LAB265 | 30733.4 | 0.1075 | 0.000593 | 16.0855 | 0.96875 | 0.011384 | 13.1387 |
| LAB265 | 30734.1 | 0.101875 | 0.384396 | 10.0112 | 0.90625 | 0.161175 | 5.8394 |
| LAB265 | 30734.4 | 0.101875 | 0.768736 | 10.0112 | 0.95 | 0.720948 | 10.9489 |
| LAB307 | 30761.1 | 0.09875 | 0.60785 | 6.6367 | 0.93125 | 0.640513 | 8.7591 |
| LAB307 | 30761.5 | 0.114196 | 0.159616 | 23.3167 | 1.08214 | 0.150441 | 26.3816 |
| LAB307 | 30763.3 | 0.109375 | 0.083803 | 18.1102 | 1.04375 | 0.079991 | 21.8978 |
| LAB307 | 30764.1 | 0.125 | 0.107402 | 34.9831 | 1.11875 | 0.046083 | 30.6569 |
| LAB307 | 30764.4 | 0.096875 | 0.384953 | 4.6119 | 0.925 | 0.130192 | 8.0292 |
| LAB319 | 30771.5 | 0.0975 | 0.675206 | 5.2868 | 0.925 | 0.130192 | 8.0292 |
| LAB319 | 30774.1 | 0.0975 | 0.572928 | 5.2868 | 0.9 | 0.609038 | 5.1095 |
| LAB319 | 30774.3 | 0.105 | 0.025003 | 13.3858 | 0.975 | 0.032259 | 13.8686 |
| LAB319 | 30775.2 | 0.111875 | 0.017169 | 20.8099 | 0.98125 | 0.227626 | 14.5985 |
| LAB319 | 30775.4 | 0.098125 | 0.564376 | 5.9618 | 0.925 | 0.263666 | 8.0292 |
| LAB308 | 30932.3 | 0.119375 | 0.035192 | 28.9089 | 1.1125 | 0.002637 | 29.927 |
| LAB308 | 30933.3 | 0.099375 | 0.324178 | 7.3116 | 0.91875 | 0.230061 | 7.2993 |
| LAB308 | 30934.4 | 0.09875 | 0.648251 | 6.6367 | 0.9625 | 0.310222 | 12.4088 |
| CONT | — | 0.092604 | — | 0 | 0.85625 | — | 0 |
| LAB191 | 28153.1 | 0.109375 | 0.442576 | 7.9057 | 0.9625 | 0.119585 | 8.1515 |
| LAB191 | 28156.4 | 0.106875 | 0.661041 | 5.4393 | 0.93125 | 0.593992 | 4.6401 |
| LAB260 | 30071.4 | 0.105625 | 0.497956 | 4.2061 | 0.902679 | 0.812749 | 1.4296 |
| LAB260 | 30072.2 | 0.124375 | 0.235275 | 22.7043 | — | | — |
| LAB260 | 30073.4 | 0.11 | 0.211176 | 8.5224 | 0.96875 | 0.163186 | 8.8538 |
| LAB221 | 30124.3 | 0.104018 | 0.20318 | 2.6206 | — | | — |
| LAB221 | 30124.4 | 0.10875 | 0.25496 | 7.2891 | 0.9125 | 0.362003 | 2.5332 |
| LAB264 | 30131.1 | 0.1125 | 0.565455 | 10.9888 | 0.94375 | 0.573437 | 6.0446 |
| LAB264 | 30133.2 | 0.101518 | 0.986366 | 0.1542 | 0.897321 | 0.890198 | 0.8277 |
| LAB264 | 30135.2 | 0.111339 | 0.001107 | 9.8436 | 0.929464 | 0.510287 | 4.4394 |
| LAB182 | 30451.3 | 0.113125 | 0.500586 | 11.6054 | 0.94375 | 0.626179 | 6.0446 |
| LAB182 | 30453.4 | 0.101875 | 0.960091 | 0.5065 | 0.91875 | 0.784316 | 3.2355 |
| LAB232 | 30462.4 | 0.109375 | 0.547194 | 7.9057 | 0.89375 | 0.878153 | 0.4264 |
| LAB222 | 30472.1 | 0.104375 | 0.737681 | 2.9729 | 0.95 | 0.56632 | 6.7469 |
| LAB222 | 30473.1 | 0.10625 | 0.497961 | 4.8227 | 0.95625 | 0.60634 | 7.4492 |
| LAB222 | 30474.1 | 0.113125 | 0.375477 | 11.6054 | 0.9 | 0.677044 | 1.1287 |
| LAB222 | 30476.1 | — | | — | 0.89375 | 0.965427 | 0.4264 |
| LAB222 | 30476.2 | 0.1175 | 0.090325 | 15.9216 | 1.0875 | 0.052526 | 22.1971 |
| LAB225 | 30492.2 | 0.11125 | 0.177775 | 9.7556 | 1.0375 | 0.27827 | 16.5789 |
| LAB225 | 30493.2 | — | | — | 0.925 | 0.376561 | 3.9378 |
| LAB348 | 30501.1 | 0.105982 | 0.730937 | 4.5585 | — | | — |
| LAB348 | 30506.2 | 0.104375 | 0.502806 | 2.9729 | 0.9 | 0.713199 | 1.1287 |
| LAB353 | 30554.3 | 0.109375 | 0.372617 | 7.9057 | 0.9 | 0.713199 | 1.1287 |
| LAB320 | 30601.2 | — | | — | 0.9 | 0.900297 | 1.1287 |
| LAB320 | 30601.3 | — | | — | 0.89375 | 0.95814 | 0.4264 |
| LAB320 | 30602.2 | 0.1075 | 0.313349 | 6.0559 | 0.93125 | 0.124083 | 4.6401 |
| LAB320 | 30603.1 | — | | — | 0.89375 | 0.930105 | 0.4264 |
| LAB343 | 30622.4 | 0.10375 | 0.76885 | 2.3563 | 0.95 | 0.56632 | 6.7469 |
| LAB343 | 30623.3 | 0.11375 | 0.466039 | 12.222 | 0.89375 | 0.903757 | 0.4264 |
| LAB290_H0 | 30661.2 | 0.11875 | 0.081051 | 17.1548 | 1.0125 | 0.200721 | 13.7698 |
| LAB290_H0 | 30662.3 | 0.113125 | 0.095041 | 11.6054 | 0.975 | 0.013496 | 9.5561 |

TABLE 74-continued

Genes showing improved plant biomass production under high salinity conditions

| Gene Name | Event # | Dry Weight [g] | | | Fresh Weight [g] | | |
|---|---|---|---|---|---|---|---|
| | | Ave. | P-Val/ | % Incr. | Ave. | P-Val. | % Incr. |
| LAB290_H0 | 30663.1 | 0.12 | 0.073215 | 18.388 | 1.03125 | 0.000405 | 15.8766 |
| LAB290_H0 | 30663.7 | — | — | — | 0.9 | 0.786578 | 1.1287 |
| LAB265 | 30731.3 | 0.1025 | 0.928127 | 1.1231 | 0.89375 | 0.98325 | 0.4264 |
| LAB265 | 30732.3 | 0.113125 | 0.533209 | 11.6054 | 0.89375 | 0.878153 | 0.4264 |
| LAB265 | 30733.4 | 0.11125 | 0.602337 | 9.7556 | 0.90625 | 0.77954 | 1.831 |
| LAB307 | 30761.5 | — | — | — | 0.89375 | 0.878153 | 0.4264 |
| LAB307 | 30764.4 | 0.113125 | 0.000355 | 11.6054 | 0.99375 | 0.200047 | 11.6629 |
| LAB319 | 30771.5 | 0.110625 | 0.243014 | 9.139 | 1.00625 | 0.001372 | 13.0675 |
| LAB319 | 30774.1 | 0.114375 | 0.344789 | 12.8386 | 0.96875 | 0.047729 | 8.8538 |
| LAB319 | 30774.3 | — | — | — | 0.9125 | 0.815611 | 2.5332 |
| LAB319 | 30775.1 | 0.10875 | 0.123384 | 7.2891 | 0.96875 | 0.279989 | 8.8538 |
| LAB319 | 30775.4 | 0.11375 | 0.131323 | 12.222 | 0.925 | 0.173368 | 3.9378 |
| LAB308 | 30932.3 | 0.12625 | 0.000003 | 24.5541 | 1.04375 | 0.046321 | 17.2812 |
| LAB308 | 30933.2 | — | — | — | 0.91875 | 0.700637 | 3.2355 |
| LAB308 | 30933.3 | 0.12875 | 0.007668 | 27.0205 | 1.075 | 0.172677 | 20.7926 |
| LAB308 | 30934.4 | 0.115625 | 0.069171 | 14.0718 | 1.0375 | 0.086521 | 16.5789 |
| CONT | — | 0.101362 | — | 0 | 0.889955 | — | 0 |
| LAB339 | 27272.4 | — | — | — | 1.15446 | 0.813638 | 12.2201 |
| LAB339 | 27272.8 | 0.1 | 0.583286 | 8.2544 | 1.04554 | 0.643934 | 1.6317 |
| LAB299 | 28061.1 | 0.0925 | 0.994229 | 0.1353 | — | — | — |
| LAB299 | 28063.1 | — | — | — | 1.08125 | 0.305323 | 5.1033 |
| LAB299 | 28064.1 | 0.093125 | 0.743165 | 0.8119 | — | — | — |
| LAB299 | 28066.1 | 0.098125 | 0.027369 | 6.2246 | 1.0375 | 0.833577 | 0.8505 |
| LAB157 | 28142.3 | — | — | — | 1.05 | 0.796533 | 2.0656 |
| LAB157 | 28144.2 | 0.09625 | 0.645826 | 4.1949 | 1.13125 | 0.088805 | 9.9635 |
| LAB157 | 28145.2 | 0.09625 | 0.765108 | 4.1949 | 1.03125 | 0.985184 | 0.243 |
| LAB157 | 28146.2 | 0.099732 | 0.419824 | 7.9644 | 1.12054 | 0.016073 | 8.9221 |
| LAB269 | 28342.3 | 0.093125 | 0.895466 | 0.8119 | 1.0375 | 0.955837 | 0.8505 |
| LAB269 | 28343.4 | 0.094375 | 0.516773 | 2.1651 | — | — | — |
| LAB269 | 28345.3 | 0.0975 | 0.222462 | 5.548 | — | — | — |
| LAB279 | 28351.4 | 0.100625 | 0.53714 | 8.931 | 1.0375 | 0.951041 | 0.8505 |
| LAB279 | 28353.2 | 0.098393 | 0.743426 | 6.5146 | 1.07857 | 0.752762 | 4.8429 |
| LAB279 | 28354.1 | 0.095 | 0.854534 | 2.8417 | — | — | — |
| LAB279 | 28355.4 | 0.093125 | 0.931661 | 0.8119 | — | — | — |
| LAB283 | 28361.1 | 0.1025 | 0.393712 | 10.9608 | 1.14375 | 0.154511 | 11.1786 |
| LAB283 | 28363.3 | 0.093125 | 0.931661 | 0.8119 | 1.08125 | 0.125127 | 5.1033 |
| LAB283 | 28364.3 | 0.09375 | 0.78424 | 1.4885 | 1.0625 | 0.733293 | 3.2807 |
| LAB283 | 28364.4 | 0.101875 | 0.532642 | 10.2842 | — | — | — |
| LAB283 | 28365.1 | 0.0975 | 0.072646 | 5.548 | — | — | — |
| LAB336 | 28375.1 | 0.094375 | 0.847342 | 2.1651 | 1.1 | 0.440673 | 6.9259 |
| LAB267 | 28384.2 | — | — | — | 1.0375 | 0.869509 | 0.8505 |
| LAB119 | 28411.1 | 0.1 | 0.700518 | 8.2544 | 1.05 | 0.917544 | 2.0656 |
| LAB119 | 28412.1 | 0.103125 | 0.345067 | 11.6373 | 1.13125 | 0.274499 | 9.9635 |
| LAB119 | 28414.1 | 0.09375 | 0.936721 | 1.4885 | 1.0375 | 0.895948 | 0.8505 |
| LAB238 | 28422.4 | 0.0925 | 0.990974 | 0.1353 | — | — | — |
| LAB238 | 28424.3 | 0.096875 | 0.745237 | 4.8714 | 1.075 | 0.648076 | 4.4957 |
| LAB238 | 28424.4 | 0.09875 | 0.033209 | 6.9012 | 1.03125 | 0.946309 | 0.243 |
| LAB238 | 28425.5 | 0.098125 | 0.027369 | 6.2246 | 1.075 | 0.518128 | 4.4957 |
| LAB58 | 28442.4 | 0.095625 | 0.591052 | 3.5183 | — | — | — |
| LAB240 | 28592.5 | 0.105 | 0.034611 | 13.6671 | 1.08125 | 0.125127 | 5.1033 |
| LAB240 | 28595.1 | 0.1 | 0.006033 | 8.2544 | — | — | — |
| LAB240 | 28595.3 | 0.096429 | 0.738335 | 4.3882 | 1.03571 | 0.959107 | 0.677 |
| LAB298 | 29244.1 | 0.10625 | 0.297907 | 15.0203 | 1.14375 | 0.371319 | 11.1786 |
| CONT | — | 0.092375 | — | 0 | 1.02875 | — | 0 |
| LAB329 | 30103.1 | 0.111875 | 0.011305 | 13.1207 | 1.05 | 0.125238 | 11.6809 |
| LAB329 | 30103.2 | 0.104375 | 0.568108 | 5.5372 | — | — | — |
| LAB329 | 30104.1 | 0.110625 | 0.3014 | 11.8568 | 1.0375 | 0.021299 | 10.3514 |
| LAB329 | 30104.2 | 0.11125 | 0.175251 | 12.4887 | 1 | 0.566904 | 6.3628 |
| LAB175 | 30513.4 | 0.10125 | 0.777943 | 2.3774 | — | — | — |
| LAB175 | 30514.3 | 0.099167 | 0.972356 | 0.2708 | — | — | — |
| LAB164 | 30524.1 | 0.1 | 0.931201 | 1.1135 | 1.0375 | 0.021299 | 10.3514 |
| LAB164 | 30525.2 | 0.11375 | 0.01784 | 15.0166 | 1.05 | 0.04519 | 11.6809 |
| LAB164 | 30525.3 | 0.114375 | 0.498862 | 15.6485 | 1.1625 | 0.123628 | 23.6467 |
| LAB107 | 30532.3 | 0.100625 | 0.727571 | 1.7454 | 0.98125 | 0.823395 | 4.3685 |
| LAB107 | 30533.4 | 0.107857 | 0.070454 | 9.0581 | 1.03839 | 0.057098 | 10.4463 |
| LAB107 | 30534.3 | 0.099375 | 0.984413 | 0.4815 | 1.03125 | 0.748955 | 9.6866 |
| LAB107 | 30535.2 | 0.1075 | 0.542344 | 8.697 | 1.025 | 0.091139 | 9.0218 |
| LAB130 | 30542.1 | 0.12 | 0.001126 | 21.3361 | 1.10625 | 0.002084 | 17.6638 |
| LAB130 | 30544.2 | 0.1125 | 0.599238 | 13.7526 | 1.03125 | 0.703512 | 9.6866 |
| LAB130 | 30545.1 | 0.105 | 0.140563 | 6.1691 | 0.95 | 0.852788 | 1.0446 |
| LAB130 | 30545.2 | — | — | — | 0.94375 | 0.909778 | 0.3799 |
| LAB101 | 30641.5 | 0.10875 | 0.033948 | 9.9609 | 0.975 | 0.31792 | 3.7037 |
| LAB101 | 30644.2 | — | — | — | 0.9625 | 0.741661 | 2.3742 |
| LAB101 | 30644.4 | 0.10875 | 0.149191 | 9.9609 | 0.9625 | 0.888171 | 2.3742 |

TABLE 74-continued

Genes showing improved plant biomass production under high salinity conditions

| Gene | | Dry Weight [g] | | | Fresh Weight [g] | | |
|---|---|---|---|---|---|---|---|
| Name | Event # | Ave. | P-Val/ | % Incr. | Ave. | P-Val. | % Incr. |
| LAB101 | 30645.1 | 0.099375 | 0.93799 | 0.4815 | — | — | — |
| LAB121 | 30802.1 | 0.104375 | 0.568108 | 5.5372 | 0.975 | 0.787961 | 3.7037 |
| LAB129 | 30825.1 | 0.103125 | 0.760365 | 4.2732 | 1.03125 | 0.315961 | 9.6866 |
| LAB129 | 30825.5 | 0.1 | 0.893669 | 1.1135 | 0.95 | 0.811428 | 1.0446 |
| LAB163 | 30831.3 | 0.11375 | 0.43654 | 15.0166 | 1.15625 | 0.236627 | 22.982 |
| LAB163 | 30832.2 | 0.101875 | 0.806559 | 3.0093 | 0.95625 | 0.614391 | 1.7094 |
| LAB163 | 30833.1 | 0.105625 | 0.639631 | 6.8011 | 0.95625 | 0.662973 | 1.7094 |
| LAB163 | 30833.2 | 0.104375 | 0.206396 | 5.5372 | 0.96875 | 0.752619 | 3.0389 |
| LAB163 | 30834.2 | 0.106875 | 0.06389 | 8.065 | 1.09375 | 0.372606 | 16.3343 |
| LAB171 | 30841.3 | 0.1 | 0.921873 | 1.1135 | — | — | — |
| LAB171 | 30841.4 | 0.114375 | 0.08872 | 15.6485 | 1.05625 | 0.010239 | 12.3457 |
| LAB171 | 30842.3 | — | — | — | 0.94375 | 0.909778 | 0.3799 |
| LAB171 | 30843.2 | 0.10375 | 0.409127 | 4.9052 | 1.09375 | 0.372606 | 16.3343 |
| LAB171 | 30845.1 | — | — | — | 0.94375 | 0.961351 | 0.3799 |
| LAB172 | 30852.3 | 0.1025 | 0.871259 | 3.6413 | 0.975 | 0.7254 | 3.7037 |
| LAB172 | 30853.4 | 0.102143 | 0.385466 | 3.2802 | 0.942857 | 0.963444 | 0.2849 |
| LAB172 | 30854.1 | 0.11375 | 0.01784 | 15.0166 | 1.06875 | 0.056079 | 13.6752 |
| LAB172 | 30855.3 | 0.11 | 0.021656 | 11.2248 | 0.9875 | 0.409276 | 5.0332 |
| LAB204 | 30862.3 | 0.1 | 0.769352 | 1.1135 | — | — | — |
| LAB204 | 30863.1 | 0.1075 | 0.05074 | 8.697 | 1.11875 | 0.136092 | 18.9934 |
| LAB204 | 30863.2 | 0.113125 | 0.007717 | 14.3846 | 0.9875 | 0.189382 | 5.0332 |
| LAB204 | 30864.1 | 0.116875 | 0.065926 | 18.1763 | 1.06875 | 0.211141 | 13.6752 |
| LAB204 | 30865.4 | 0.108125 | 0.04024 | 9.3289 | — | — | — |
| LAB263 | 30891.6 | — | — | — | 0.974107 | 0.324962 | 3.6087 |
| LAB263 | 30892.2 | 0.10875 | 0.392364 | 9.9609 | 1.08125 | 0.35691 | 15.0047 |
| LAB263 | 30892.3 | — | — | — | 0.94375 | 0.967839 | 0.3799 |
| LAB263 | 30893.3 | 0.118125 | 0.016523 | 19.4403 | 0.975 | 0.616125 | 3.7037 |
| LAB271 | 30905.4 | — | — | — | 0.95625 | 0.857055 | 1.7094 |
| LAB271 | 30905.6 | 0.113125 | 0.010801 | 14.3846 | 1.09375 | 0.002999 | 16.3343 |
| LAB271 | 30905.7 | — | — | — | 0.957143 | 0.774194 | 1.8044 |
| LAB284 | 30911.3 | 0.1025 | 0.333039 | 3.6413 | — | — | — |
| LAB284 | 30912.2 | 0.105625 | 0.49629 | 6.8011 | 0.94375 | 0.982789 | 0.3799 |
| LAB284 | 30913.1 | 0.105357 | 0.11309 | 6.5302 | 0.999107 | 0.694905 | 6.2678 |
| LAB286 | 30921.1 | 0.11875 | 0.587012 | 20.0722 | 1.0875 | 0.686801 | 15.6695 |
| LAB286 | 30922.1 | 0.11625 | 0.100901 | 17.5444 | 1.14375 | 0.289119 | 21.6524 |
| LAB286 | 30922.4 | — | — | — | 1.01875 | 0.655949 | 8.3571 |
| LAB286 | 30923.3 | 0.1075 | 0.440175 | 8.697 | 0.9875 | 0.285883 | 5.0332 |
| LAB286 | 30924.2 | 0.1025 | 0.822513 | 3.6413 | 1.09375 | 0.410115 | 16.3343 |
| LAB272 | 31123.6 | 0.110625 | 0.229489 | 11.8568 | 1 | 0.316775 | 6.3628 |
| LAB272 | 31125.4 | 0.1075 | 0.542344 | 8.697 | 1.0375 | 0.332752 | 10.3514 |
| LAB272 | 31125.5 | 0.11375 | 0.199154 | 15.0166 | 1.0125 | 0.246889 | 7.6923 |
| CONT | — | 0.098899 | — | 0 | 0.940179 | — | 0 |
| LAB329 | 30102.3 | 0.100625 | 0.719453 | 5.9211 | 0.89375 | 0.447449 | 7.7889 |
| LAB329 | 30103.2 | 0.105 | 0.443044 | 10.5263 | 0.90625 | 0.187075 | 9.2965 |
| LAB329 | 30104.1 | 0.12125 | 0.52749 | 27.6316 | 0.9625 | 0.605036 | 16.0804 |
| LAB175 | 30512.3 | 0.11 | 0.048718 | 15.7895 | 0.83125 | 0.974517 | 0.2513 |
| LAB175 | 30513.4 | 0.109375 | 0.048842 | 15.1316 | 0.85 | 0.687635 | 2.5126 |
| LAB175 | 30514.4 | 0.0975 | 0.675524 | 2.6316 | — | — | — |
| LAB164 | 30522.4 | 0.110625 | 0.052055 | 16.4474 | 0.88125 | 0.329126 | 6.2814 |
| LAB164 | 30524.1 | 0.108125 | 0.078021 | 13.8158 | 0.90625 | 0.379503 | 9.2965 |
| LAB164 | 30525.2 | 0.11625 | 0.03463 | 22.3684 | 1.05625 | 0.169601 | 27.3869 |
| LAB164 | 30525.3 | 0.10625 | 0.207215 | 11.8421 | 0.8625 | 0.529504 | 4.0201 |
| LAB107 | 30532.3 | 0.100446 | 0.362618 | 5.7331 | — | — | — |
| LAB107 | 30533.4 | 0.128125 | 0.165246 | 34.8684 | 1.075 | 0.172984 | 29.6482 |
| LAB107 | 30534.3 | 0.103125 | 0.200067 | 8.5526 | 0.8625 | 0.588322 | 4.0201 |
| LAB107 | 30535.2 | 0.129375 | 0.010576 | 36.1842 | 1.1 | 0.014665 | 32.6633 |
| LAB130 | 30541.3 | 0.099375 | 0.839246 | 4.6053 | 0.91875 | 0.585648 | 10.804 |
| LAB130 | 30542.1 | 0.103125 | 0.67223 | 8.5526 | — | — | — |
| LAB130 | 30544.2 | 0.124196 | 0.326082 | 30.7331 | 1.06786 | 0.16197 | 28.7868 |
| LAB130 | 30545.1 | 0.118125 | 0.393154 | 24.3421 | 1.15 | 0.306469 | 38.6935 |
| LAB101 | 30641.4 | 0.105625 | 0.446757 | 11.1842 | 0.875 | 0.541008 | 5.5276 |
| LAB101 | 30641.5 | 0.111875 | 0.044421 | 17.7632 | 0.86875 | 0.440288 | 4.7739 |
| LAB101 | 30644.2 | 0.11375 | 0.192997 | 19.7368 | 0.88125 | 0.528512 | 6.2814 |
| LAB101 | 30644.4 | 0.099375 | 0.518039 | 4.6053 | — | — | — |
| LAB121 | 30801.4 | 0.139821 | 0.221537 | 47.1805 | 1.18661 | 0.314685 | 43.1084 |
| LAB121 | 30802.1 | 0.097946 | 0.910765 | 3.1015 | — | — | — |
| LAB121 | 30802.2 | 0.1025 | 0.587602 | 7.8947 | 0.93125 | 0.504749 | 12.3116 |
| LAB121 | 30803.1 | 0.129375 | 0.017418 | 36.1842 | 0.99375 | 0.048026 | 19.8492 |
| LAB121 | 30804.1 | 0.109107 | 0.074187 | 14.8496 | 0.863393 | 0.63679 | 4.1278 |
| LAB129 | 30822.2 | 0.100625 | 0.41976 | 5.9211 | 0.84375 | 0.763918 | 1.7588 |
| LAB129 | 30824.1 | 0.105 | 0.687926 | 10.5263 | — | — | — |
| LAB129 | 30824.2 | 0.096875 | 0.772747 | 1.9737 | — | — | — |
| LAB129 | 30825.1 | 0.1275 | 0.282165 | 34.2105 | 1.075 | 0.172984 | 29.6482 |
| LAB129 | 30825.5 | 0.095625 | 0.885866 | 0.6579 | — | — | — |

TABLE 74-continued

Genes showing improved plant biomass production under high salinity conditions

| Gene Name | Event # | Dry Weight [g] | | | Fresh Weight [g] | | |
|---|---|---|---|---|---|---|---|
| | | Ave. | P-Val/ | % Incr. | Ave. | P-Val. | % Incr. |
| LAB163 | 30831.3 | 0.1025 | 0.181508 | 7.8947 | 0.94375 | 0.166662 | 13.8191 |
| LAB163 | 30832.2 | 0.0975 | 0.727225 | 2.6316 | — | — | — |
| LAB163 | 30833.1 | 0.105625 | 0.618429 | 11.1842 | — | — | — |
| LAB163 | 30833.2 | 0.1025 | 0.348517 | 7.8947 | 0.83125 | 0.974517 | 0.2513 |
| LAB171 | 30841.3 | 0.10375 | 0.291131 | 9.2105 | — | — | — |
| LAB171 | 30842.3 | 0.10875 | 0.381733 | 14.4737 | — | — | — |
| LAB171 | 30842.4 | 0.119375 | 0.073541 | 25.6579 | 0.9625 | 0.099783 | 16.0804 |
| LAB171 | 30843.2 | 0.130625 | 0.151899 | 37.5 | 1.04375 | 0.020559 | 25.8794 |
| LAB171 | 30845.1 | 0.114375 | 0.108554 | 20.3947 | 0.95625 | 0.087569 | 15.3266 |
| LAB172 | 30854.1 | 0.1175 | 0.030191 | 23.6842 | 0.95 | 0.320251 | 14.5729 |
| LAB172 | 30855.2 | 0.1175 | 0.195114 | 23.6842 | 1.04375 | 0.182292 | 25.8794 |
| LAB204 | 30862.3 | 0.130625 | 0.009824 | 37.5 | 1.04375 | 0.048794 | 25.8794 |
| LAB204 | 30863.1 | 0.11 | 0.494489 | 15.7895 | 0.925 | 0.185509 | 11.5578 |
| LAB204 | 30865.4 | 0.123393 | 0.203517 | 29.8872 | 1.02946 | 0.051417 | 24.1565 |
| LAB263 | 30891.6 | 0.1075 | 0.111378 | 13.1579 | 0.86875 | 0.559952 | 4.7739 |
| LAB263 | 30892.2 | 0.114375 | 0.03051 | 20.3947 | 0.94375 | 0.109244 | 13.8191 |
| LAB263 | 30892.3 | 0.13125 | 0.078068 | 38.1579 | 0.99375 | 0.048026 | 19.8492 |
| LAB263 | 30892.4 | 0.11125 | 0.041049 | 17.1053 | 0.9375 | 0.219468 | 13.0653 |
| LAB263 | 30893.3 | 0.113125 | 0.621645 | 19.0789 | 1.00625 | 0.424439 | 21.3568 |
| LAB271 | 30905.6 | — | — | — | 0.83125 | 0.981836 | 0.2513 |
| LAB271 | 30905.7 | 0.119018 | 0.048128 | 25.282 | 0.917857 | 0.182729 | 10.6963 |
| LAB284 | 30911.3 | 0.11 | 0.353093 | 15.7895 | 0.864286 | 0.84018 | 4.2355 |
| LAB286 | 30922.1 | 0.10125 | 0.64431 | 6.5789 | 0.8375 | 0.961893 | 1.005 |
| LAB286 | 30923.3 | 0.109911 | 0.048405 | 15.6955 | 0.949107 | 0.263338 | 14.4652 |
| LAB286 | 30924.3 | 0.10125 | 0.335664 | 6.5789 | 0.84375 | 0.7503 | 1.7588 |
| LAB261 | 31073.1 | 0.0975 | 0.727225 | 2.6316 | — | — | — |
| LAB261 | 31074.4 | 0.121875 | 0.175131 | 28.2895 | 0.9875 | 0.334502 | 19.0955 |
| LAB261 | 31075.1 | 0.105 | 0.320343 | 10.5263 | 0.89375 | 0.292233 | 7.7889 |
| LAB261 | 31075.3 | 0.1 | 0.834675 | 5.2632 | 0.8875 | 0.696568 | 7.0352 |
| LAB272 | 31121.1 | 0.104375 | 0.226604 | 9.8684 | 0.89375 | 0.24396 | 7.7889 |
| LAB272 | 31123.1 | 0.09875 | 0.816028 | 3.9474 | 0.8625 | 0.772993 | 4.0201 |
| LAB272 | 31123.5 | 0.098125 | 0.736858 | 3.2895 | — | — | — |
| LAB272 | 31123.6 | 0.106875 | 0.35615 | 12.5 | 0.89375 | 0.57013 | 7.7889 |
| LAB272 | 31125.4 | 0.10875 | 0.057465 | 14.4737 | 0.8625 | 0.489939 | 4.0201 |
| CONT | | 0.095 | — | 0 | 0.829167 | — | 0 |
| LAB54 | 28131.1 | — | — | — | 0.99375 | 0.802702 | 3.1437 |
| LAB54 | 28133.1 | — | — | — | 1.08125 | 0.530687 | 12.2255 |
| LAB54 | 28136.1 | — | — | — | 0.975 | 0.779948 | 1.1976 |
| LAB54 | 28136.2 | — | — | — | 0.975 | 0.729909 | 1.1976 |
| LAB178 | 30632.1 | — | — | — | 1.0625 | 0.600936 | 10.2794 |
| LAB178 | 30633.4 | — | — | — | 1.11875 | 0.000239 | 16.1178 |
| LAB178 | 30635.1 | — | — | — | 1.00625 | 0.830329 | 4.4411 |
| LAB154 | 30692.2 | — | — | — | 1.08125 | 0.062117 | 12.2255 |
| LAB154 | 30693.11 | — | — | — | 1.09375 | 0.425156 | 13.523 |
| LAB154 | 30693.2 | — | — | — | 1.0375 | 0.807803 | 7.6846 |
| LAB154 | 30693.8 | — | — | — | 1.025 | 0.708877 | 6.3872 |
| LAB86 | 30791.2 | — | — | — | 1 | 0.713307 | 3.7924 |
| LAB86 | 30794.3 | — | — | — | 1.01875 | 0.096458 | 5.7385 |
| LAB312 | 30944.2 | — | — | — | 0.98125 | 0.629609 | 1.8463 |
| LAB312 | 30945.4 | — | — | — | 1.03125 | 0.091603 | 7.0359 |
| LAB98 | 31011.2 | — | — | — | 1.21875 | 0.261182 | 26.497 |
| LAB98 | 31011.4 | — | — | — | 1.1125 | 0.498275 | 15.4691 |
| LAB98 | 31014.3 | — | — | — | 1.2375 | 0.015325 | 28.4431 |
| LAB120 | 31113.8 | — | — | — | 1.04375 | 0.543902 | 8.3333 |
| LAB120 | 31115.1 | — | — | — | 0.96875 | 0.885224 | 0.5489 |
| LAB122 | 31161.1 | — | — | — | 0.96875 | 0.952461 | 0.5489 |
| LAB122 | 31161.3 | — | — | — | 1.01875 | 0.660266 | 5.7385 |
| LAB122 | 31161.6 | — | — | — | 1.075 | 0.352853 | 11.5768 |
| LAB122 | 31161.7 | — | — | — | 1.0125 | 0.847212 | 5.0898 |
| LAB255 | 31215.1 | — | — | — | 1.0375 | 0.115983 | 7.6846 |
| LAB97 | 31302.4 | — | — | — | 0.98125 | 0.882025 | 1.8463 |
| LAB97 | 31306.1 | — | — | — | 1.0875 | 0.093931 | 12.8743 |
| LAB137 | 31312.2 | — | — | — | 1.0375 | 0.042382 | 7.6846 |
| LAB235 | 31321.1 | — | — | — | 0.976786 | 0.837459 | 1.3829 |
| LAB235 | 31322.1 | — | — | — | 1.04375 | 0.148839 | 8.3333 |
| LAB116 | 31441.1 | — | — | — | 1.33125 | 0.284511 | 38.1737 |
| LAB56 | 31451.2 | — | — | — | 1.05625 | 0.307518 | 9.6307 |
| LAB56 | 31451.3 | — | — | — | 1.04375 | 0.148839 | 8.3333 |
| LAB253 | 31464.6 | — | — | — | 1.04375 | 0.675369 | 8.3333 |
| LAB342 | 31705.3 | — | — | — | 0.99375 | 0.824425 | 3.1437 |
| LAB342 | 31705.4 | — | — | — | 0.99375 | 0.417887 | 3.1437 |

TABLE 74-continued

Genes showing improved plant biomass production under high salinity conditions

| Gene Name | Event # | Dry Weight [g] Ave. | P-Val/ | % Incr. | Fresh Weight [g] Ave. | P-Val. | % Incr. |
|---|---|---|---|---|---|---|---|
| LAB342 | 31705.6 | — | — | — | 1.0125 | 0.392904 | 5.0898 |
| CONT | — | — | — | — | 0.963462 | — | 0 |

Table 74.
"CONT."—Control;
"Ave."—Average;
"% Incr." = % increment;
"p-val."—p-value.

TABLE 75

Genes showing improved plant biomass production under high salinity conditions

| Gene Name | Event # | Rosette Diameter [cm] Ave. | P-Val. | % Incr. | Rosette Area [cm2] Ave. | P-Val. | % Incr. | Plot Coverage [%] Ave. | P-Val. | % Incr. |
|---|---|---|---|---|---|---|---|---|---|---|
| LAB113 | 28545.2 | 4.97807 | 0.18 | 8 | 8.32 | 0.07 | 16 | 66.57 | 0.07 | 16 |
| LAB113 | 28545.3 | 4.66718 | 0.75 | 1 | 7.62 | 0.20 | 7 | 60.97 | 0.20 | 7 |
| LAB131 | 28291.1 | 5.14688 | 0.01 | 11 | 8.89 | 0.00 | 24 | 71.12 | 0.00 | 24 |
| LAB131 | 28292.3 | 4.92485 | 0.11 | 7 | 8.22 | 0.03 | 15 | 65.75 | 0.03 | 15 |
| LAB131 | 28293.3 | — | — | — | 7.44 | 0.86 | 4 | 59.52 | 0.86 | 4 |
| LAB131 | 28294.2 | 4.64642 | 0.91 | 1 | 7.24 | 0.80 | 1 | 57.96 | 0.80 | 1 |
| LAB131 | 28295.3 | 4.78433 | 0.37 | 4 | 8.05 | 0.35 | 12 | 60.07 | 0.33 | 5 |
| LAB145 | 28551.1 | 4.87053 | 0.16 | 5 | 8.27 | 0.08 | 16 | 66.12 | 0.08 | 16 |
| LAB145 | 28551.3 | 5.15293 | 0.05 | 12 | 8.77 | 0.00 | 23 | 70.19 | 0.00 | 23 |
| LAB145 | 28553.2 | 5.18663 | 0.00 | 12 | 8.62 | 0.02 | 20 | 68.95 | 0.02 | 20 |
| LAB145 | 28553.3 | 5.49102 | 0.00 | 19 | 9.87 | 0.00 | 38 | 78.94 | 0.00 | 38 |
| LAB145 | 28555.1 | 4.78038 | 0.70 | 3 | 7.49 | 0.73 | 5 | 59.90 | 0.73 | 5 |
| LAB152 | 28471.1 | 4.76345 | 0.49 | 3 | 7.50 | 0.56 | 5 | 59.99 | 0.56 | 5 |
| LAB152 | 28472.3 | 4.83991 | 0.30 | 5 | 8.00 | 0.33 | 12 | 63.98 | 0.33 | 12 |
| LAB152 | 28473.2 | 5.23284 | 0.33 | 13 | 8.56 | 0.27 | 20 | 68.44 | 0.27 | 20 |
| LAB152 | 28473.3 | 4.91943 | 0.32 | 6 | 8.03 | 0.22 | 12 | 64.26 | 0.22 | 12 |
| LAB152 | 28474.4 | 4.8035 | 0.23 | 4 | 7.87 | 0.15 | 10 | 62.94 | 0.15 | 10 |
| LAB153 | 28301.2 | 4.73181 | 0.44 | 2 | 7.24 | 0.80 | 1 | 57.94 | 0.80 | 1 |
| LAB153 | 28302.2 | 5.05466 | 0.19 | 9 | 8.54 | 0.31 | 19 | 68.30 | 0.31 | 19 |
| LAB153 | 28303.1 | 5.20539 | 0.02 | 13 | 8.94 | 0.01 | 25 | 71.55 | 0.01 | 25 |
| LAB153 | 28304.1 | 5.09837 | 0.14 | 10 | 9.19 | 0.00 | 28 | 73.52 | 0.00 | 28 |
| LAB153 | 28305.3 | 5.13327 | 0.00 | 11 | 8.93 | 0.00 | 25 | 66.96 | 0.17 | 17 |
| LAB169 | 28391.1 | 4.78325 | 0.21 | 4 | 7.72 | 0.16 | 8 | 61.78 | 0.16 | 8 |
| LAB169 | 28391.4 | 5.17532 | 0.02 | 12 | 8.81 | 0.08 | 23 | 70.46 | 0.08 | 23 |
| LAB169 | 28392.1 | 4.72356 | 0.41 | 2 | 7.64 | 0.19 | 7 | 61.16 | 0.19 | 7 |
| LAB169 | 28393.3 | — | — | — | 7.29 | 0.73 | 2 | 58.29 | 0.73 | 2 |
| LAB169 | 28394.3 | 5.199 | 0.11 | 13 | 9.18 | 0.02 | 28 | 73.47 | 0.02 | 28 |
| LAB181 | 28481.1 | 5.08503 | 0.02 | 10 | 8.36 | 0.24 | 17 | 66.89 | 0.24 | 17 |
| LAB181 | 28482.2 | 4.77943 | 0.25 | 3 | 8.00 | 0.03 | 12 | 63.97 | 0.03 | 12 |
| LAB181 | 28483.2 | 4.6626 | 0.74 | 1 | — | — | — | — | — | — |
| LAB181 | 28484.3 | 5.00419 | 0.53 | 8 | 8.18 | 0.56 | 14 | 65.44 | 0.56 | 14 |
| LAB187 | 28431.5 | 4.8011 | 0.21 | 4 | 7.71 | 0.14 | 8 | 61.66 | 0.14 | 8 |
| LAB187 | 28434.1 | 5.56571 | 0.40 | 20 | 10.67 | 0.31 | 49 | 85.35 | 0.31 | 49 |
| LAB187 | 28435.3 | — | — | — | 7.16 | 1.00 | 0 | 57.25 | 1.00 | 0 |
| LAB213 | 28561.2 | 5.00667 | 0.22 | 8 | 8.68 | 0.20 | 21 | 69.43 | 0.20 | 21 |
| LAB213 | 28562.6 | 5.10727 | 0.04 | 11 | 8.74 | 0.01 | 22 | 69.88 | 0.01 | 22 |
| LAB213 | 28565.2 | 4.72722 | 0.47 | 2 | 7.34 | 0.73 | 3 | — | — | — |
| LAB230 | 28572.3 | 5.00456 | 0.01 | 8 | 8.20 | 0.01 | 15 | 65.59 | 0.01 | 15 |
| LAB230 | 28574.2 | 4.97078 | 0.11 | 8 | 7.77 | 0.27 | 9 | 62.19 | 0.27 | 9 |
| LAB247 | 28091.4 | 4.95845 | 0.06 | 7 | 8.32 | 0.14 | 16 | 66.56 | 0.14 | 16 |
| LAB247 | 28093.2 | 4.7703 | 0.24 | 3 | 7.35 | 0.70 | 3 | 58.83 | 0.70 | 3 |
| LAB247 | 28094.1 | 4.63582 | 0.97 | 0 | 7.39 | 0.85 | 3 | 59.16 | 0.85 | 3 |
| LAB247 | 28094.3 | 5.23544 | 0.00 | 13 | 8.72 | 0.00 | 22 | 65.35 | 0.14 | 14 |
| LAB247 | 28095.4 | 4.69822 | 0.53 | 2 | 7.58 | 0.24 | 6 | 60.63 | 0.24 | 6 |
| LAB249 | 28602.1 | 5.004 | 0.15 | 8 | 8.51 | 0.01 | 19 | 68.12 | 0.01 | 19 |
| LAB249 | 28603.3 | 5.14539 | 0.32 | 11 | 8.20 | 0.23 | 15 | 65.57 | 0.23 | 15 |
| LAB249 | 28604.2 | 4.72111 | 0.82 | 2 | 7.73 | 0.65 | 8 | 61.88 | 0.65 | 8 |
| LAB249 | 28604.4 | 4.83005 | 0.32 | 5 | 7.84 | 0.08 | 10 | 62.72 | 0.08 | 10 |
| LAB249 | 28605.2 | 4.74373 | 0.36 | 3 | 7.54 | 0.33 | 5 | 60.35 | 0.33 | 5 |
| LAB258 | 27441.4 | 4.98574 | 0.42 | 8 | 8.23 | 0.46 | 15 | 65.81 | 0.46 | 15 |
| LAB258 | 27441.6 | 5.17422 | 0.47 | 12 | 8.35 | 0.52 | 17 | 61.95 | 0.55 | 8 |
| LAB258 | 27442.2 | 5.18361 | 0.01 | 12 | 8.66 | 0.17 | 21 | 69.27 | 0.17 | 21 |
| LAB258 | 27442.5 | 4.8953 | 0.05 | 6 | 7.86 | 0.07 | 10 | 62.91 | 0.07 | 10 |

TABLE 75-continued

Genes showing improved plant biomass production under high salinity conditions

| Gene Name | Event # | Rosette Diameter [cm] | | | Rosette Area [cm2] | | | Plot Coverage [%] | | |
|---|---|---|---|---|---|---|---|---|---|---|
| | | Ave. | P-Val. | % Incr. | Ave. | P-Val. | % Incr. | Ave. | P-Val. | % Incr. |
| LAB258 | 27444.4 | 4.91631 | 0.18 | 6 | 7.86 | 0.10 | 10 | 62.88 | 0.10 | 10 |
| LAB294 | 28401.3 | 5.10879 | 0.00 | 11 | 8.89 | 0.00 | 24 | 71.13 | 0.00 | 24 |
| LAB294 | 28402.5 | 4.82305 | 0.13 | 4 | 7.70 | 0.26 | 8 | 61.62 | 0.26 | 8 |
| LAB294 | 28404.1 | 4.81685 | 0.33 | 4 | 7.78 | 0.14 | 9 | 62.23 | 0.14 | 9 |
| LAB70 | 28463.1 | 4.77296 | 0.49 | 3 | 7.19 | 0.95 | 0 | 57.50 | 0.95 | 0 |
| LAB74 | 28451.3 | 4.65386 | 0.80 | 1 | — | | — | — | | — |
| LAB74 | 28452.2 | 4.63677 | 0.95 | 0 | — | | — | — | | — |
| LAB74 | 28453.5 | 4.70053 | 0.52 | 2 | — | | — | — | | — |
| LAB74 | 28454.1 | 4.8585 | 0.20 | 5 | 7.77 | 0.38 | 9 | 62.13 | 0.38 | 9 |
| LAB88 | 28193.2 | 4.66542 | 0.82 | 1 | 7.27 | 0.78 | 2 | 58.18 | 0.78 | 2 |
| LAB88 | 28193.6 | 4.66773 | 0.88 | 1 | 7.39 | 0.77 | 3 | 59.13 | 0.77 | 3 |
| cont | — | 4.62109 | — | 0 | 7.16 | — | 0 | 57.25 | — | 0 |
| LAB113 | 28545.2 | 4.41833 | 0.55 | 7 | 5.93 | 0.69 | 8 | 47.47 | 0.69 | 8 |
| LAB113 | 28545.3 | 5.01798 | 0.01 | 22 | 7.88 | 0.09 | 44 | 63.02 | 0.09 | 44 |
| LAB131 | 28291.1 | 4.65726 | 0.02 | 13 | 7.08 | 0.00 | 29 | 56.68 | 0.00 | 29 |
| LAB131 | 28292.3 | 4.58443 | 0.04 | 11 | 6.82 | 0.00 | 24 | 54.53 | 0.00 | 24 |
| LAB131 | 28295.3 | 4.6826 | 0.50 | 14 | 7.02 | 0.54 | 28 | 56.16 | 0.54 | 28 |
| LAB145 | 28551.1 | 4.78621 | 0.42 | 16 | 7.36 | 0.46 | 34 | 58.89 | 0.46 | 34 |
| LAB145 | 28551.3 | 4.17052 | 0.66 | 1 | 5.56 | 0.82 | 1 | 44.44 | 0.82 | 1 |
| LAB145 | 28553.2 | 4.7237 | 0.08 | 15 | 7.19 | 0.19 | 31 | 57.51 | 0.19 | 31 |
| LAB145 | 28553.3 | 5.21512 | 0.05 | 27 | 8.57 | 0.16 | 56 | 68.55 | 0.16 | 56 |
| LAB145 | 28555.1 | 4.8017 | 0.01 | 17 | 7.19 | 0.12 | 31 | 57.54 | 0.12 | 31 |
| LAB152 | 28471.1 | 4.80501 | 0.17 | 17 | 7.15 | 0.29 | 31 | 57.23 | 0.29 | 31 |
| LAB152 | 28472.3 | 4.55202 | 0.00 | 11 | 6.46 | 0.00 | 18 | 51.66 | 0.00 | 18 |
| LAB152 | 28473.2 | 4.5739 | 0.03 | 11 | 6.46 | 0.01 | 18 | 51.69 | 0.01 | 18 |
| LAB152 | 28473.3 | 4.20664 | 0.74 | 2 | 5.56 | 0.89 | 1 | 44.46 | 0.89 | 1 |
| LAB153 | 28301.2 | 4.16766 | 0.68 | 1 | 5.56 | 0.79 | 1 | 44.46 | 0.79 | 1 |
| LAB153 | 28303.1 | 4.24963 | 0.70 | 3 | 5.82 | 0.72 | 6 | 46.53 | 0.72 | 6 |
| LAB153 | 28304.1 | 4.52632 | 0.05 | 10 | 6.60 | 0.02 | 20 | 52.80 | 0.02 | 20 |
| LAB169 | 28391.1 | 5.193 | 0.04 | 26 | 8.51 | 0.11 | 55 | 68.06 | 0.11 | 55 |
| LAB169 | 28392.1 | 5.35511 | 0.18 | 30 | 8.46 | 0.23 | 54 | 67.66 | 0.23 | 54 |
| LAB169 | 28393.2 | 4.75727 | 0.00 | 16 | 7.57 | 0.02 | 38 | 60.54 | 0.02 | 38 |
| LAB169 | 28394.3 | 4.57741 | 0.09 | 11 | 6.55 | 0.01 | 20 | 52.42 | 0.01 | 20 |
| LAB181 | 28481.1 | 4.46276 | 0.46 | 8 | 6.46 | 0.28 | 18 | 51.67 | 0.28 | 18 |
| LAB181 | 28482.2 | 4.56864 | 0.15 | 11 | 6.36 | 0.40 | 16 | 48.02 | 0.70 | 10 |
| LAB181 | 28483.2 | 4.26845 | 0.65 | 4 | 5.63 | 0.86 | 3 | 45.05 | 0.86 | 3 |
| LAB181 | 28484.3 | 4.3942 | 0.25 | 7 | 6.17 | 0.04 | 13 | 49.39 | 0.04 | 13 |
| LAB187 | 28433.3 | — | | — | 5.57 | 0.90 | 2 | 44.58 | 0.90 | 2 |
| LAB187 | 28434.1 | 4.76429 | 0.00 | 16 | 7.28 | 0.00 | 33 | 58.20 | 0.00 | 33 |
| LAB187 | 28434.2 | 4.11842 | 0.99 | 0 | 5.72 | 0.73 | 4 | 45.78 | 0.73 | 4 |
| LAB187 | 28435.4 | 4.60952 | 0.06 | 12 | 6.76 | 0.00 | 23 | 54.11 | 0.00 | 23 |
| LAB213 | 28561.2 | 4.69651 | 0.04 | 14 | 6.91 | 0.19 | 26 | 55.32 | 0.19 | 26 |
| LAB213 | 28562.6 | 4.24827 | 0.80 | 3 | 5.67 | 0.89 | 3 | 45.33 | 0.89 | 3 |
| LAB213 | 28565.2 | 4.29501 | 0.72 | 4 | 6.10 | 0.63 | 11 | 48.79 | 0.63 | 11 |
| LAB230 | 28571.6 | 4.27383 | 0.66 | 4 | 5.66 | 0.79 | 3 | 45.27 | 0.79 | 3 |
| LAB230 | 28572.2 | 4.44539 | 0.64 | 8 | 6.43 | 0.64 | 17 | 51.46 | 0.64 | 17 |
| LAB230 | 28572.3 | 4.51754 | 0.07 | 10 | 6.03 | 0.36 | 10 | 48.27 | 0.36 | 10 |
| LAB230 | 28574.2 | 4.22422 | 0.80 | 3 | 5.65 | 0.86 | 3 | — | | — |
| LAB230 | 28574.3 | 4.18668 | 0.57 | 2 | — | | — | — | | — |
| LAB247 | 28091.4 | 4.56123 | 0.48 | 11 | 6.65 | 0.54 | 21 | 53.21 | 0.54 | 21 |
| LAB247 | 28093.2 | 4.76091 | 0.02 | 16 | 6.94 | 0.04 | 27 | 55.50 | 0.04 | 27 |
| LAB247 | 28094.1 | 4.24394 | 0.76 | 3 | 6.06 | 0.67 | 11 | 48.47 | 0.67 | 11 |
| LAB247 | 28094.3 | 4.44679 | | 8 | 5.97 | | 9 | 47.77 | | 9 |
| LAB247 | 28095.4 | 4.52924 | 0.49 | 10 | 6.56 | 0.43 | 20 | 52.44 | 0.43 | 20 |
| LAB249 | 28602.1 | 4.21339 | 0.48 | 2 | 5.91 | 0.17 | 8 | 47.31 | 0.17 | 8 |
| LAB249 | 28604.2 | 4.35545 | 0.12 | 6 | 6.19 | 0.03 | 13 | 49.55 | 0.03 | 13 |
| LAB249 | 28605.2 | 4.45173 | 0.12 | 8 | 5.97 | 0.48 | 9 | 47.75 | 0.48 | 9 |
| LAB258 | 27441.4 | 4.33204 | 0.71 | 5 | 5.92 | 0.78 | 8 | 47.35 | 0.78 | 8 |
| LAB258 | 27442.5 | 4.35134 | 0.18 | 6 | 6.25 | 0.02 | 14 | 46.93 | 0.56 | 7 |
| LAB258 | 27444.4 | 4.1331 | 0.89 | 0 | — | | — | — | | — |
| LAB294 | 28402.4 | 4.17164 | 0.67 | 1 | 5.60 | 0.67 | 2 | 44.81 | 0.67 | 2 |
| LAB294 | 28405.1 | 4.35514 | 0.33 | 6 | 6.08 | 0.44 | 11 | 48.60 | 0.44 | 11 |
| LAB74 | 28451.3 | 4.77019 | 0.04 | 16 | 7.47 | 0.05 | 36 | 59.72 | 0.05 | 36 |
| LAB74 | 28452.4 | 4.15502 | 0.96 | 1 | 5.94 | 0.78 | 8 | 47.52 | 0.78 | 8 |
| LAB74 | 28453.5 | 4.12984 | 0.96 | 0 | 5.53 | 0.95 | 1 | 44.21 | 0.95 | 1 |
| LAB81 | 28531.1 | 4.15499 | 0.90 | 1 | 5.53 | 0.93 | 1 | 44.28 | 0.93 | 1 |
| LAB88 | 28191.3 | 4.20478 | 0.49 | 2 | 5.68 | 0.61 | 4 | 45.41 | 0.61 | 4 |
| LAB88 | 28193.2 | 4.40658 | 0.12 | 7 | 5.95 | 0.47 | 9 | 47.58 | 0.47 | 9 |
| cont | — | 4.11558 | — | 0 | 5.48 | — | 0 | 43.84 | — | 0 |
| LAB108 | 28502.2 | 5.45764 | 0.36 | 10 | 8.90 | 0.29 | 19 | 71.20 | 0.29 | 19 |
| LAB119 | 28412.1 | 5.47569 | 0.22 | 11 | 9.05 | 0.17 | 21 | 72.37 | 0.17 | 21 |
| LAB119 | 28413.1 | 5.4302 | 0.10 | 10 | 8.78 | 0.19 | 18 | 70.27 | 0.19 | 18 |

TABLE 75-continued

Genes showing improved plant biomass production under high salinity conditions

| Gene Name | Event # | Rosette Diameter [cm] | | | Rosette Area [cm2] | | | Plot Coverage [%] | | |
|---|---|---|---|---|---|---|---|---|---|---|
| | | Ave. | P-Val. | % Incr. | Ave. | P-Val. | % Incr. | Ave. | P-Val. | % Incr. |
| LAB119 | 28415.2 | — | | — | 7.79 | 0.69 | 4 | 62.31 | 0.69 | 4 |
| LAB157 | 28142.3 | 5.09135 | 0.47 | 3 | 8.18 | 0.18 | 9 | 61.45 | 0.83 | 3 |
| LAB157 | 28145.2 | 5.08697 | 0.82 | 3 | 8.48 | 0.58 | 13 | 67.80 | 0.58 | 13 |
| LAB157 | 28146.1 | — | | — | 7.82 | 0.10 | 5 | 62.57 | 0.10 | 5 |
| LAB231 | 28583.1 | 5.45244 | 0.13 | 10 | 8.86 | 0.21 | 19 | 70.86 | 0.21 | 19 |
| LAB231 | 28585.1 | 5.34626 | 0.26 | 8 | 8.91 | 0.25 | 19 | 71.25 | 0.25 | 19 |
| LAB238 | 28422.4 | — | | — | 7.60 | 0.60 | 2 | 60.78 | 0.60 | 2 |
| LAB238 | 28424.3 | — | | — | 7.69 | 0.81 | 3 | 61.53 | 0.81 | 3 |
| LAB238 | 28425.5 | 5.4049 | 0.43 | 9 | 8.70 | 0.49 | 16 | 69.60 | 0.49 | 16 |
| LAB240 | 28592.2 | 5.71911 | 0.08 | 15 | 10.10 | 0.00 | 35 | 80.82 | 0.00 | 35 |
| LAB240 | 28592.6 | 5.2784 | 0.33 | 7 | 8.87 | 0.24 | 19 | 70.98 | 0.24 | 19 |
| LAB240 | 28595.1 | 5.7467 | 0.00 | 16 | 9.91 | 0.06 | 33 | 79.29 | 0.06 | 33 |
| LAB240 | 28595.3 | 5.10321 | 0.83 | 3 | 8.28 | 0.67 | 11 | 66.23 | 0.67 | 11 |
| LAB242 | 28081.2 | 5.21438 | 0.55 | 5 | 8.71 | 0.48 | 17 | 69.72 | 0.48 | 17 |
| LAB242 | 28083.1 | 5.18649 | 0.34 | 5 | 7.93 | 0.51 | 6 | 63.40 | 0.51 | 6 |
| LAB242 | 28085.1 | 5.18898 | 0.79 | 5 | 8.34 | 0.75 | 12 | 66.76 | 0.75 | 12 |
| LAB267 | 28383.2 | 5.13924 | 0.18 | 4 | 7.81 | 0.17 | 5 | 62.50 | 0.17 | 5 |
| LAB267 | 28384.2 | 5.08348 | 0.06 | 3 | 8.08 | 0.27 | 8 | 64.67 | 0.27 | 8 |
| LAB267 | 28384.5 | — | | — | 7.82 | 0.54 | 5 | 62.56 | 0.54 | 5 |
| LAB267 | 28385.2 | — | | — | 7.74 | 0.49 | 4 | 61.91 | 0.49 | 4 |
| LAB269 | 28343.4 | 5.11956 | 0.43 | 3 | 7.95 | 0.06 | 6 | 63.62 | 0.06 | 6 |
| LAB269 | 28345.2 | 4.98426 | 0.91 | 1 | 7.52 | 0.86 | 1 | 60.16 | 0.86 | 1 |
| LAB269 | 28345.3 | 5.26921 | 0.00 | 6 | 8.00 | 0.30 | 7 | 64.02 | 0.30 | 7 |
| LAB279 | 28351.4 | 5.19956 | 0.43 | 5 | 8.36 | 0.56 | 12 | 66.85 | 0.56 | 12 |
| LAB279 | 28353.2 | 5.68363 | 0.01 | 15 | 9.62 | 0.12 | 29 | 76.97 | 0.12 | 29 |
| LAB283 | 28363.3 | 5.40713 | 0.02 | 9 | 8.96 | 0.00 | 20 | 71.72 | 0.00 | 20 |
| LAB283 | 28364.3 | 5.22335 | 0.36 | 5 | 8.49 | 0.47 | 14 | 67.94 | 0.47 | 14 |
| LAB283 | 28364.4 | — | | — | 7.69 | 0.78 | 3 | 61.49 | 0.78 | 3 |
| LAB283 | 28365.1 | 5.30472 | 0.01 | 7 | 8.20 | 0.01 | 10 | 65.59 | 0.01 | 10 |
| LAB298 | 29244.1 | 5.4609 | 0.06 | 10 | 8.50 | 0.33 | 14 | 68.01 | 0.33 | 14 |
| LAB298 | 29245.2 | 5.33329 | 0.19 | 8 | 8.56 | 0.01 | 15 | 68.44 | 0.01 | 15 |
| LAB298 | 29245.3 | 5.11346 | 0.78 | 3 | 8.24 | 0.67 | 10 | 65.94 | 0.67 | 10 |
| LAB298 | 29245.4 | 5.35429 | 0.20 | 8 | 8.68 | 0.10 | 16 | 69.45 | 0.10 | 16 |
| LAB299 | 28061.1 | — | | — | 7.54 | 0.88 | 1 | 60.35 | 0.88 | 1 |
| LAB299 | 28063.1 | 5.67645 | 0.12 | 15 | 9.68 | 0.16 | 30 | 72.30 | 0.00 | 21 |
| LAB299 | 28064.1 | 4.98629 | 0.92 | 1 | 7.90 | 0.69 | 6 | 63.19 | 0.69 | 6 |
| LAB299 | 28066.1 | 5.38366 | 0.53 | 9 | 8.99 | 0.46 | 20 | 71.94 | 0.46 | 20 |
| LAB302 | 28822.7 | 5.52873 | 0.44 | 12 | 9.70 | 0.34 | 30 | 77.62 | 0.34 | 30 |
| LAB302 | 28823.4 | — | | — | 7.54 | 0.92 | 1 | 60.31 | 0.92 | 1 |
| LAB302 | 28825.1 | 5.08708 | 0.64 | 3 | 7.59 | 0.85 | 2 | 60.69 | 0.85 | 2 |
| LAB336 | 28375.3 | 5.02233 | 0.44 | 1 | — | | — | — | | — |
| LAB339 | 27272.7 | 5.73611 | 0.00 | 16 | 9.80 | 0.00 | 31 | 78.37 | 0.00 | 31 |
| LAB345 | 28495.1 | 5.08055 | 0.70 | 3 | 8.27 | 0.57 | 11 | 66.18 | 0.57 | 11 |
| LAB58 | 28441.2 | — | | — | 7.90 | 0.40 | 6 | 63.19 | 0.40 | 6 |
| LAB58 | 28442.1 | 5.42957 | 0.52 | 10 | 9.16 | 0.44 | 23 | 73.30 | 0.44 | 23 |
| LAB58 | 28443.2 | 5.58028 | 0.10 | 13 | 9.41 | 0.09 | 26 | 75.32 | 0.09 | 26 |
| LAB58 | 28443.4 | 5.07059 | 0.50 | 2 | 7.94 | 0.05 | 6 | 63.53 | 0.05 | 6 |
| LAB58 | 28445.2 | 5.1605 | 0.70 | 4 | 8.49 | 0.54 | 14 | 67.89 | 0.54 | 14 |
| cont | — | 4.95398 | — | 0 | 7.47 | — | 0 | 59.77 | — | 0 |
| LAB133 | 28832.1 | — | | — | 9.36 | 0.19 | 6 | 74.90 | 0.19 | 6 |
| LAB160 | 29315.3 | — | | — | 9.57 | 0.57 | 9 | 76.58 | 0.57 | 9 |
| LAB210 | 28331.3 | 5.20896 | 0.96 | 0 | 9.17 | 0.69 | 4 | 73.38 | 0.69 | 4 |
| LAB310 | 28181.2 | — | | — | 9.18 | 0.62 | 4 | 73.47 | 0.62 | 4 |
| LAB310 | 28182.3 | 5.59366 | 0.25 | 8 | 10.18 | 0.28 | 15 | 81.41 | 0.28 | 15 |
| LAB327 | 29224.2 | 5.2981 | 0.26 | 2 | 9.59 | 0.01 | 9 | 76.68 | 0.01 | 9 |
| LAB327 | 29225.2 | — | | — | 9.14 | 0.47 | 4 | 73.16 | 0.47 | 4 |
| LAB335 | 27314.2 | 5.23853 | 0.88 | 1 | 9.27 | 0.67 | 5 | 74.18 | 0.67 | 5 |
| LAB335 | 27315.4 | 5.29317 | 0.51 | 2 | 9.13 | 0.81 | 4 | 73.01 | 0.81 | 4 |
| LAB54 | 28134.1 | 5.39345 | 0.08 | 4 | 9.99 | 0.00 | 13 | 79.95 | 0.00 | 13 |
| LAB54 | 28136.1 | 5.31487 | 0.37 | 2 | 9.61 | 0.28 | 9 | 76.90 | 0.28 | 9 |
| LAB54 | 28136.2 | — | | — | 9.40 | 0.03 | 7 | 75.21 | 0.03 | 7 |
| LAB73 | 30154.3 | 5.41158 | 0.57 | 4 | 9.74 | 0.31 | 10 | 77.90 | 0.31 | 10 |
| cont | — | 5.19902 | — | 0 | 8.82 | — | 0 | 70.52 | — | 0 |
| LAB102 | 30312.2 | 5.48814 | 0.00 | 6 | 8.66 | 0.55 | 2 | 69.28 | 0.55 | 2 |
| LAB126 | 30201.3 | 5.27373 | 0.67 | 2 | — | | — | — | | — |
| LAB126 | 30202.3 | 5.38659 | 0.11 | 4 | — | | — | — | | — |
| LAB126 | 30205.1 | 5.83591 | 0.01 | 13 | 9.95 | 0.00 | 17 | 79.59 | 0.00 | 17 |
| LAB165 | 30231.2 | 5.67294 | 0.33 | 10 | 8.97 | 0.79 | 6 | 71.78 | 0.79 | 6 |
| LAB165 | 30232.1 | 5.48614 | 0.06 | 6 | 8.78 | 0.42 | 3 | 70.24 | 0.42 | 3 |
| LAB165 | 30233.1 | 5.48836 | 0.06 | 6 | 9.03 | 0.03 | 6 | 72.22 | 0.03 | 6 |
| LAB165 | 30235.1 | 5.67358 | 0.13 | 10 | 9.39 | 0.04 | 11 | 75.15 | 0.04 | 11 |
| LAB167 | 27321.2 | 6.0411 | 0.00 | 17 | 10.09 | 0.11 | 19 | 80.71 | 0.11 | 19 |

TABLE 75-continued

Genes showing improved plant biomass production under high salinity conditions

| Gene Name | Event # | Rosette Diameter [cm] | | | Rosette Area [cm2] | | | Plot Coverage [%] | | |
|---|---|---|---|---|---|---|---|---|---|---|
| | | Ave. | P-Val. | % Incr. | Ave. | P-Val. | % Incr. | Ave. | P-Val. | % Incr. |
| LAB167 | 27321.3 | 5.44526 | 0.39 | 5 | 8.97 | 0.73 | 6 | 71.79 | 0.73 | 6 |
| LAB167 | 27321.4 | 5.6733 | 0.08 | 10 | 9.82 | 0.36 | 16 | 78.59 | 0.36 | 16 |
| LAB167 | 27321.6 | 5.72338 | 0.00 | 11 | 9.97 | 0.27 | 17 | 79.77 | 0.27 | 17 |
| LAB220 | 30321.4 | 5.22474 | 0.81 | 1 | — | — | — | — | — | — |
| LAB220 | 30322.2 | 5.2982 | 0.16 | 3 | 8.82 | 0.20 | 4 | 70.53 | 0.20 | 4 |
| LAB220 | 30324.4 | 5.30457 | 0.08 | 3 | — | — | — | — | — | — |
| LAB241 | 30211.3 | 5.45525 | 0.43 | 6 | 9.13 | 0.57 | 7 | 73.03 | 0.57 | 7 |
| LAB241 | 30212.1 | 5.36168 | 0.01 | 4 | 8.67 | 0.44 | 2 | 69.35 | 0.44 | 2 |
| LAB241 | 30212.2 | 5.67368 | 0.32 | 10 | 9.84 | 0.33 | 16 | 78.69 | 0.33 | 16 |
| LAB241 | 30213.1 | 5.46453 | 0.03 | 6 | 8.97 | 0.07 | 6 | 71.79 | 0.07 | 6 |
| LAB268 | 30391.4 | 5.30828 | 0.50 | 3 | 8.63 | 0.71 | 2 | 69.04 | 0.71 | 2 |
| LAB268 | 30392.1 | 5.43943 | 0.24 | 5 | 9.29 | 0.26 | 9 | 74.28 | 0.26 | 9 |
| LAB268 | 30393.1 | 5.54985 | 0.21 | 7 | 8.96 | 0.05 | 5 | 71.72 | 0.05 | 5 |
| LAB268 | 30393.3 | 5.16432 | 0.99 | 0 | — | — | — | — | — | — |
| LAB268 | 30395.1 | 5.6615 | 0.09 | 10 | 9.71 | 0.00 | 14 | 77.71 | 0.00 | 14 |
| LAB280 | 30041.2 | 5.24067 | 0.69 | 2 | — | — | — | — | — | — |
| LAB280 | 30042.1 | 5.7493 | 0.00 | 11 | 10.25 | 0.00 | 21 | 81.97 | 0.00 | 21 |
| LAB280 | 30044.1 | 6.22063 | 0.07 | 20 | 12.05 | 0.08 | 42 | 96.44 | 0.08 | 42 |
| LAB280 | 30045.1 | 5.89304 | 0.06 | 14 | 10.40 | 0.01 | 22 | 83.20 | 0.01 | 22 |
| LAB289 | 30371.6 | 5.35471 | 0.59 | 4 | 8.52 | 0.98 | 0 | 68.17 | 0.98 | 0 |
| LAB289 | 30373.1 | 5.44467 | 0.18 | 5 | 8.86 | 0.29 | 4 | 70.88 | 0.29 | 4 |
| LAB289 | 30375.2 | 5.57384 | 0.28 | 8 | 8.82 | 0.78 | 4 | 70.60 | 0.78 | 4 |
| LAB311 | 30221.4 | 5.36452 | 0.04 | 4 | 8.52 | 0.94 | 0 | 68.12 | 0.94 | 0 |
| LAB311 | 30222.2 | 5.8003 | 0.17 | 12 | 9.92 | 0.23 | 17 | 79.37 | 0.23 | 17 |
| LAB311 | 30223.2 | 5.54279 | 0.54 | 7 | 9.35 | 0.69 | 10 | 74.83 | 0.69 | 10 |
| LAB311 | 30224.2 | 5.38752 | 0.16 | 4 | 8.59 | 0.89 | 1 | 68.76 | 0.89 | 1 |
| LAB355 | 29282.1 | 5.47215 | 0.14 | 6 | 8.52 | 0.98 | 0 | 68.15 | 0.98 | 0 |
| LAB355 | 29282.2 | 5.65993 | 0.04 | 10 | 9.46 | 0.46 | 11 | 75.70 | 0.46 | 11 |
| LAB355 | 29283.1 | 5.8782 | 0.32 | 14 | 10.76 | 0.29 | 27 | 86.09 | 0.29 | 27 |
| LAB367 | 30172.3 | 5.36002 | 0.44 | 4 | 8.83 | 0.62 | 4 | 70.61 | 0.62 | 4 |
| LAB367 | 30173.1 | 5.56111 | 0.00 | 8 | 9.47 | 0.00 | 11 | 75.75 | 0.00 | 11 |
| LAB367 | 30173.3 | 5.18309 | 0.75 | 0 | — | — | — | — | — | — |
| LAB367 | 30174.1 | 5.21836 | 0.40 | 1 | — | — | — | — | — | — |
| LAB381 | 30351.4 | 5.36203 | 0.33 | 4 | 8.59 | 0.71 | 1 | 68.69 | 0.71 | 1 |
| LAB381 | 30352.2 | 5.49086 | 0.01 | 6 | 9.10 | 0.26 | 7 | 72.78 | 0.26 | 7 |
| LAB381 | 30352.4 | 5.65873 | 0.06 | 10 | 9.52 | 0.05 | 12 | 76.15 | 0.05 | 12 |
| LAB381 | 30354.2 | 5.6091 | 0.05 | 9 | 9.82 | 0.17 | 16 | 78.55 | 0.17 | 16 |
| LAB381 | 30356.1 | 5.26255 | 0.12 | 2 | 8.80 | 0.18 | 4 | 70.38 | 0.18 | 4 |
| LAB383 | 28111.3 | 5.3 | 0.36 | 3 | 8.60 | 0.85 | 1 | 68.84 | 0.85 | 1 |
| LAB383 | 28114.2 | 5.41553 | 0.67 | 5 | 8.57 | 0.93 | 1 | 68.60 | 0.93 | 1 |
| LAB383 | 28115.2 | 5.65455 | 0.00 | 10 | 9.49 | 0.23 | 12 | 75.93 | 0.23 | 12 |
| LAB64 | 30271.2 | 5.40571 | 0.33 | 5 | 8.89 | 0.14 | 5 | 71.09 | 0.14 | 5 |
| LAB64 | 30272.1 | 5.70742 | 0.00 | 11 | 10.22 | 0.04 | 20 | 81.79 | 0.04 | 20 |
| LAB64 | 30274.2 | 5.42614 | 0.21 | 5 | 9.57 | 0.13 | 13 | 76.53 | 0.13 | 13 |
| LAB64 | 30274.3 | 5.41944 | 0.32 | 5 | 9.11 | 0.37 | 7 | 72.85 | 0.37 | 7 |
| LAB65 | 30301.4 | 5.9284 | 0.09 | 15 | 11.18 | 0.00 | 32 | 89.46 | 0.00 | 32 |
| LAB65 | 30302.1 | 5.44725 | 0.01 | 6 | 9.36 | 0.07 | 10 | 74.90 | 0.07 | 10 |
| LAB65 | 30303.4 | 5.62873 | 0.13 | 9 | 9.87 | 0.30 | 16 | 78.99 | 0.30 | 16 |
| LAB65 | 30304.3 | 5.52623 | 0.17 | 7 | 8.77 | 0.48 | 3 | 70.15 | 0.48 | 3 |
| LAB92 | 29323.2 | 5.18514 | 0.91 | 0 | — | — | — | — | — | — |
| cont | — | 5.16294 | — | 0 | 8.50 | — | 0 | 67.99 | — | 0 |
| LAB159 | 30702.4 | 5.54648 | 0.80 | 1 | 10.45 | 0.52 | 9 | 83.60 | 0.52 | 9 |
| LAB159 | 30704.3 | 5.94872 | 0.04 | 9 | 11.33 | 0.05 | 18 | 90.61 | 0.05 | 18 |
| LAB159 | 30704.4 | 5.53061 | 0.80 | 1 | 9.83 | 0.65 | 2 | 78.64 | 0.65 | 2 |
| LAB161 | 30482.1 | 5.5826 | 0.60 | 2 | 9.72 | 0.93 | 1 | 77.72 | 0.93 | 1 |
| LAB161 | 30483.1 | 5.8798 | 0.37 | 7 | 10.81 | 0.44 | 12 | 86.48 | 0.44 | 12 |
| LAB161 | 30486.1 | 6.03948 | 0.10 | 10 | 11.38 | 0.29 | 18 | 91.01 | 0.29 | 18 |
| LAB166 | 30242.1 | 5.61116 | 0.10 | 2 | 10.64 | 0.21 | 11 | 85.16 | 0.21 | 11 |
| LAB166 | 30243.1 | 6.00352 | 0.11 | 10 | 11.84 | 0.20 | 23 | 94.74 | 0.20 | 23 |
| LAB166 | 30245.3 | — | — | — | 9.88 | 0.52 | 3 | 79.06 | 0.52 | 3 |
| LAB166 | 30245.4 | 5.50249 | 0.96 | 0 | 9.77 | 0.93 | 2 | 78.18 | 0.93 | 2 |
| LAB170 | 30713.2 | 5.56279 | 0.78 | 1 | — | — | — | — | — | — |
| LAB170 | 30715.2 | 5.58202 | 0.56 | 2 | 10.20 | 0.46 | 6 | 81.59 | 0.46 | 6 |
| LAB259 | 27112.14 | — | — | — | 9.69 | 0.91 | 1 | 77.55 | 0.91 | 1 |
| LAB259 | 27112.3 | 5.70858 | 0.13 | 4 | 10.17 | 0.15 | 6 | 81.32 | 0.15 | 6 |
| LAB259 | 27112.7 | — | — | — | 9.72 | 0.91 | 1 | 77.73 | 0.91 | 1 |
| LAB262 | 30611.4 | 5.77017 | 0.26 | 5 | 10.41 | 0.15 | 8 | 83.32 | 0.15 | 8 |
| LAB270 | 30594.3 | 5.52597 | 0.84 | 1 | 9.95 | 0.67 | 4 | 79.62 | 0.67 | 4 |
| LAB270 | 30595.2 | 5.84222 | 0.49 | 7 | 10.74 | 0.41 | 12 | 85.94 | 0.41 | 12 |
| LAB300 | 30061.2 | — | — | — | 9.63 | 0.98 | 0 | 77.07 | 0.98 | 0 |
| LAB300 | 30063.1 | — | — | — | 9.63 | 0.94 | 0 | 77.03 | 0.94 | 0 |
| LAB300 | 30064.1 | 5.51654 | 0.93 | 1 | 9.80 | 0.89 | 2 | 78.44 | 0.89 | 2 |

TABLE 75-continued

Genes showing improved plant biomass production under high salinity conditions

| Gene Name | Event # | Rosette Diameter [cm] | | | Rosette Area [cm2] | | | Plot Coverage [%] | | |
|---|---|---|---|---|---|---|---|---|---|---|
| | | Ave. | P-Val. | % Incr. | Ave. | P-Val. | % Incr. | Ave. | P-Val. | % Incr. |
| LAB300 | 30064.3 | 5.50644 | 0.95 | 0 | 9.80 | 0.93 | 2 | 78.38 | 0.93 | 2 |
| LAB306 | 30561.2 | 5.58767 | 0.86 | 2 | 9.96 | 0.84 | 4 | 79.69 | 0.84 | 4 |
| LAB306 | 30562.2 | 5.57026 | 0.46 | 2 | — | | — | — | | — |
| LAB306 | 30563.2 | 5.60248 | 0.38 | 2 | 9.84 | 0.12 | 2 | 78.76 | 0.12 | 2 |
| LAB306 | 30564.2 | 5.63579 | 0.53 | 3 | 10.04 | 0.01 | 4 | 80.32 | 0.01 | 4 |
| LAB306 | 30564.3 | — | | — | 9.88 | 0.85 | 3 | 79.07 | 0.85 | 3 |
| LAB323 | 30383.1 | 5.58669 | 0.81 | 2 | 9.95 | 0.81 | 4 | 79.60 | 0.81 | 4 |
| LAB347_H0 | 30441.1 | — | | — | 9.96 | 0.59 | 4 | 79.67 | 0.59 | 4 |
| LAB347_H0 | 30443.4 | — | | — | 10.24 | 0.49 | 7 | 81.90 | 0.49 | 7 |
| LAB347_H0 | 30444.1 | 5.59976 | 0.26 | 2 | 9.85 | 0.51 | 3 | 78.82 | 0.51 | 3 |
| LAB347_H0 | 30444.3 | 5.67146 | 0.16 | 3 | 10.07 | 0.02 | 5 | 80.58 | 0.02 | 5 |
| LAB55 | 30022.3 | 5.66455 | 0.42 | 3 | 10.32 | 0.48 | 7 | 82.57 | 0.48 | 7 |
| LAB55 | 30023.1 | 5.51772 | 0.81 | 1 | 9.83 | 0.34 | 2 | 78.65 | 0.34 | 2 |
| LAB55 | 30025.3 | — | | — | 10.00 | 0.74 | 4 | 80.01 | 0.74 | 4 |
| LAB83 | 30191.1 | 5.75408 | 0.40 | 5 | 10.43 | 0.00 | 9 | 83.43 | 0.00 | 9 |
| LAB83 | 30194.1 | 5.56564 | 0.53 | 2 | 9.75 | 0.84 | 1 | 77.98 | 0.84 | 1 |
| LAB94 | 30681.4 | — | | — | 9.73 | 0.95 | 1 | 77.84 | 0.95 | 1 |
| LAB94 | 30682.2 | — | | — | 9.91 | 0.15 | 3 | 79.30 | 0.15 | 3 |
| LAB94 | 30682.3 | — | | — | 9.62 | 1.00 | 0 | 76.92 | 1.00 | 0 |
| cont | — | 5.48072 | — | 0 | 9.61 | — | 0 | 76.89 | — | 0 |
| LAB138 | 30781.1 | 4.02896 | 0.13 | 9 | 5.48 | 0.27 | 9 | 43.84 | 0.27 | 9 |
| LAB138 | 30781.2 | 3.93885 | 0.13 | 6 | — | | — | — | | — |
| LAB138 | 30783.2 | 3.70918 | 0.99 | 0 | — | | — | — | | — |
| LAB159 | 30701.6 | 3.85064 | 0.41 | 4 | 5.09 | 0.85 | 1 | 40.69 | 0.85 | 1 |
| LAB159 | 30702.3 | 4.20423 | 0.05 | 13 | 6.05 | 0.10 | 21 | 48.38 | 0.10 | 21 |
| LAB159 | 30702.4 | 4.18568 | 0.13 | 13 | 5.81 | 0.33 | 16 | 46.46 | 0.33 | 16 |
| LAB159 | 30704.3 | 4.11838 | 0.02 | 11 | 5.58 | 0.13 | 11 | 44.67 | 0.13 | 11 |
| LAB159 | 30704.4 | 3.96689 | 0.42 | 7 | 5.45 | 0.59 | 9 | 43.61 | 0.59 | 9 |
| LAB161 | 30482.2 | 3.96715 | 0.09 | 7 | 5.07 | 0.88 | 1 | 40.55 | 0.88 | 1 |
| LAB161 | 30483.1 | 3.88775 | 0.33 | 5 | 5.24 | 0.59 | 4 | 41.88 | 0.59 | 4 |
| LAB161 | 30485.1 | 4.27449 | 0.00 | 15 | 5.63 | 0.19 | 12 | 45.02 | 0.19 | 12 |
| LAB161 | 30486.1 | 3.99756 | 0.11 | 8 | 5.57 | 0.18 | 11 | 44.56 | 0.18 | 11 |
| LAB166 | 30242.1 | 3.72844 | 0.92 | 1 | — | | — | — | | — |
| LAB166 | 30243.1 | 3.92621 | 0.32 | 6 | 5.51 | 0.40 | 10 | 44.05 | 0.40 | 10 |
| LAB166 | 30244.3 | 4.1866 | 0.08 | 13 | 6.10 | 0.02 | 22 | 48.81 | 0.02 | 22 |
| LAB166 | 30245.3 | 4.0032 | 0.16 | 8 | 5.60 | 0.35 | 12 | 44.80 | 0.35 | 12 |
| LAB166 | 30245.4 | 4.2939 | 0.00 | 16 | 6.24 | 0.01 | 24 | 49.89 | 0.01 | 24 |
| LAB170 | 30712.1 | 4.04859 | 0.04 | 9 | 5.70 | 0.08 | 14 | 45.58 | 0.08 | 14 |
| LAB170 | 30712.2 | 4.11395 | 0.33 | 11 | 5.63 | 0.43 | 12 | 45.02 | 0.43 | 12 |
| LAB170 | 30713.2 | 4.17482 | 0.35 | 13 | 5.50 | 0.55 | 10 | 44.01 | 0.55 | 10 |
| LAB170 | 30715.1 | 3.77859 | 0.71 | 2 | — | | — | — | | — |
| LAB170 | 30715.2 | 4.09759 | 0.02 | 11 | 5.83 | 0.07 | 16 | 46.66 | 0.07 | 16 |
| LAB176 | 30141.4 | 4.22238 | 0.29 | 14 | 5.83 | 0.22 | 16 | 46.64 | 0.22 | 16 |
| LAB176 | 30142.1 | 4.21017 | 0.01 | 14 | 5.97 | 0.03 | 19 | 47.76 | 0.03 | 19 |
| LAB176 | 30143.1 | 4.1125 | 0.02 | 11 | 5.68 | 0.11 | 13 | 45.43 | 0.11 | 13 |
| LAB176 | 30143.2 | 4.27289 | 0.01 | 15 | 6.47 | 0.01 | 29 | 51.72 | 0.01 | 29 |
| LAB176 | 30144.2 | 4.09878 | 0.19 | 11 | 5.99 | 0.11 | 20 | 47.94 | 0.11 | 20 |
| LAB237 | 30281.4 | 4.03809 | 0.27 | 9 | 5.85 | 0.23 | 17 | 46.77 | 0.23 | 17 |
| LAB237 | 30282.1 | 3.8655 | 0.33 | 4 | 5.46 | 0.22 | 9 | 43.71 | 0.22 | 9 |
| LAB237 | 30283.2 | 3.91759 | 0.16 | 6 | 5.42 | 0.27 | 8 | 43.36 | 0.27 | 8 |
| LAB237 | 30284.1 | 3.74816 | 0.76 | 1 | 5.20 | 0.61 | 4 | 41.62 | 0.61 | 4 |
| LAB259 | 27112.12 | 3.93966 | 0.42 | 6 | 5.37 | 0.62 | 7 | 42.97 | 0.62 | 7 |
| LAB259 | 27112.14 | 3.92695 | 0.37 | 6 | 5.29 | 0.64 | 6 | 42.32 | 0.64 | 6 |
| LAB259 | 27112.3 | 4.31941 | 0.02 | 17 | 6.46 | 0.03 | 29 | 51.66 | 0.03 | 29 |
| LAB259 | 27112.7 | 4.05546 | 0.05 | 9 | 5.62 | 0.17 | 12 | 44.92 | 0.17 | 12 |
| LAB259 | 27112.9 | 4.38779 | 0.00 | 18 | 6.84 | 0.00 | 36 | 54.69 | 0.00 | 36 |
| LAB262 | 30614.2 | 4.05077 | 0.27 | 9 | 6.19 | 0.11 | 23 | 49.48 | 0.11 | 23 |
| LAB270 | 30591.2 | 3.9694 | 0.16 | 7 | 5.75 | 0.09 | 15 | 45.99 | 0.09 | 15 |
| LAB270 | 30594.1 | 3.79218 | 0.71 | 2 | 5.16 | 0.79 | 3 | 41.28 | 0.79 | 3 |
| LAB300 | 30061.2 | 3.80895 | 0.58 | 3 | 5.25 | 0.61 | 5 | 42.02 | 0.61 | 5 |
| LAB300 | 30064.1 | 3.80639 | 0.60 | 3 | — | | — | — | | — |
| LAB300 | 30064.3 | 4.2494 | 0.00 | 15 | 5.88 | 0.04 | 17 | 47.03 | 0.04 | 17 |
| LAB306 | 30561.2 | 3.84996 | 0.32 | 4 | — | | — | — | | — |
| LAB306 | 30562.2 | 3.98193 | 0.14 | 7 | 5.32 | 0.38 | 6 | 42.60 | 0.38 | 6 |
| LAB306 | 30563.2 | 4.01199 | 0.30 | 8 | 5.36 | 0.58 | 7 | 42.86 | 0.58 | 7 |
| LAB306 | 30564.2 | 4.19802 | 0.35 | 13 | 6.05 | 0.47 | 21 | 48.42 | 0.47 | 21 |
| LAB306 | 30564.3 | 4.25543 | 0.01 | 15 | 6.00 | 0.04 | 20 | 48.01 | 0.04 | 20 |
| LAB323 | 30381.1 | 3.77704 | 0.80 | 2 | — | | — | — | | — |
| LAB323 | 30381.4 | 4.03465 | 0.04 | 9 | 5.14 | 0.73 | 2 | 41.09 | 0.73 | 2 |
| LAB323 | 30383.1 | 4.03865 | 0.41 | 9 | 5.48 | 0.45 | 9 | 43.82 | 0.45 | 9 |
| LAB94 | 30681.8 | 3.75838 | 0.92 | 1 | — | | — | — | | — |
| cont | — | 3.70545 | — | 0 | 5.01 | — | 0 | 40.11 | — | 0 |

TABLE 75-continued

Genes showing improved plant biomass production under high salinity conditions

| Gene Name | Event # | Rosette Diameter [cm] | | | Rosette Area [cm2] | | | Plot Coverage [%] | | |
|---|---|---|---|---|---|---|---|---|---|---|
| | | Ave. | P-Val. | % Incr. | Ave. | P-Val. | % Incr. | Ave. | P-Val. | % Incr. |
| LAB182 | 30451.3 | 4.26317 | 0.71 | 2 | 6.08 | 0.80 | 1 | 48.60 | 0.80 | 1 |
| LAB182 | 30453.4 | 4.79078 | 0.34 | 14 | 7.85 | 0.33 | 31 | 62.78 | 0.33 | 31 |
| LAB182 | 30454.2 | 4.33095 | 0.32 | 3 | 6.09 | 0.87 | 2 | 48.70 | 0.87 | 2 |
| LAB182 | 30455.2 | 4.42554 | 0.00 | 6 | 6.25 | 0.26 | 4 | 50.02 | 0.26 | 4 |
| LAB191 | 28156.2 | 4.3718 | 0.42 | 4 | 6.48 | 0.41 | 8 | 51.88 | 0.41 | 8 |
| LAB191 | 28156.4 | 4.22136 | 0.61 | 1 | — | — | — | — | — | — |
| LAB221 | 30122.2 | 5.08213 | 0.06 | 21 | 8.39 | 0.06 | 40 | 67.15 | 0.06 | 40 |
| LAB221 | 30123.2 | 4.23561 | 0.79 | 1 | — | — | — | — | — | — |
| LAB221 | 30124.4 | 4.54709 | 0.00 | 9 | 7.02 | 0.04 | 17 | 56.19 | 0.04 | 17 |
| LAB221 | 30125.2 | 4.8109 | 0.19 | 15 | 7.69 | 0.12 | 28 | 61.51 | 0.12 | 28 |
| LAB222 | 30472.2 | 4.43809 | 0.59 | 6 | 6.38 | 0.73 | 7 | 51.07 | 0.73 | 7 |
| LAB222 | 30473.1 | 4.41186 | 0.37 | 5 | 6.54 | 0.15 | 9 | 52.35 | 0.15 | 9 |
| LAB222 | 30474.1 | 4.70082 | 0.17 | 12 | 7.25 | 0.10 | 21 | 57.98 | 0.10 | 21 |
| LAB222 | 30476.1 | 4.58808 | 0.03 | 10 | 7.06 | 0.00 | 18 | 56.46 | 0.00 | 18 |
| LAB222 | 30476.2 | 4.46929 | 0.31 | 7 | 6.88 | 0.22 | 15 | 55.08 | 0.22 | 15 |
| LAB225 | 30491.4 | 4.58599 | 0.03 | 10 | 7.04 | 0.03 | 18 | 56.34 | 0.03 | 18 |
| LAB225 | 30492.1 | 4.18982 | 0.99 | 0 | — | — | — | — | — | — |
| LAB225 | 30492.2 | 5.07543 | 0.00 | 21 | 8.67 | 0.00 | 45 | 69.40 | 0.00 | 45 |
| LAB225 | 30493.1 | 4.47954 | 0.14 | 7 | 6.63 | 0.02 | 11 | 53.06 | 0.02 | 11 |
| LAB232 | 30461.5 | 4.2041 | 0.96 | 0 | 5.99 | 0.99 | 0 | 47.96 | 0.99 | 0 |
| LAB232 | 30462.4 | 4.65898 | 0.00 | 11 | 7.67 | 0.00 | 28 | 61.36 | 0.00 | 28 |
| LAB232 | 30462.5 | 4.32325 | 0.20 | 3 | — | — | — | — | — | — |
| LAB260 | 30071.4 | 4.67414 | 0.00 | 12 | 7.00 | 0.00 | 17 | 56.03 | 0.00 | 17 |
| LAB260 | 30072.2 | 4.68635 | 0.00 | 12 | 6.96 | 0.15 | 16 | 55.66 | 0.15 | 16 |
| LAB260 | 30073.2 | 4.89309 | 0.33 | 17 | 8.03 | 0.35 | 34 | 64.28 | 0.35 | 34 |
| LAB260 | 30073.4 | 4.30556 | 0.81 | 3 | 6.17 | 0.89 | 3 | 49.35 | 0.89 | 3 |
| LAB264 | 30131.1 | 4.48499 | 0.20 | 7 | 6.94 | 0.08 | 16 | 55.48 | 0.08 | 16 |
| LAB264 | 30133.2 | 4.36175 | 0.59 | 4 | 6.47 | 0.58 | 8 | 51.73 | 0.58 | 8 |
| LAB264 | 30134.4 | 4.84026 | 0.00 | 16 | 7.52 | 0.00 | 26 | 60.19 | 0.00 | 26 |
| LAB265 | 30731.3 | 4.44747 | 0.36 | 6 | 6.49 | 0.43 | 8 | 51.90 | 0.43 | 8 |
| LAB265 | 30733.4 | 4.20827 | 0.79 | 0 | — | — | — | — | — | — |
| LAB265 | 30734.4 | 4.26936 | 0.91 | 2 | 6.13 | 0.94 | 2 | 49.07 | 0.94 | 2 |
| LAB290_H0 | 30661.2 | 4.5605 | 0.30 | 9 | 7.04 | 0.42 | 17 | 56.28 | 0.42 | 17 |
| LAB290_H0 | 30662.3 | 4.43601 | 0.61 | 6 | 6.50 | 0.73 | 9 | 52.02 | 0.73 | 9 |
| LAB290_H0 | 30663.3 | 4.30499 | 0.77 | 3 | 6.62 | 0.59 | 11 | 53.00 | 0.59 | 11 |
| LAB290_H0 | 30663.7 | 4.42334 | 0.00 | 6 | 6.34 | 0.36 | 6 | 50.68 | 0.36 | 6 |
| LAB303 | 30421.3 | 4.46484 | 0.30 | 7 | 6.59 | 0.57 | 10 | 52.72 | 0.57 | 10 |
| LAB307 | 30761.5 | 4.48088 | 0.15 | 7 | 7.02 | 0.22 | 17 | 56.19 | 0.22 | 17 |
| LAB307 | 30763.3 | 4.52615 | 0.00 | 8 | 6.78 | 0.00 | 13 | 54.20 | 0.00 | 13 |
| LAB307 | 30764.1 | 4.37034 | 0.36 | 4 | 6.70 | 0.10 | 12 | 53.57 | 0.10 | 12 |
| LAB307 | 30764.4 | 4.29811 | 0.11 | 3 | 6.29 | 0.20 | 5 | 50.33 | 0.20 | 5 |
| LAB308 | 30931.4 | 4.36735 | 0.02 | 4 | 6.40 | 0.11 | 7 | 51.16 | 0.11 | 7 |
| LAB308 | 30932.3 | 5.03483 | 0.14 | 20 | 9.02 | 0.08 | 51 | 72.13 | 0.08 | 51 |
| LAB308 | 30933.2 | 4.31363 | 0.18 | 3 | — | — | — | — | — | — |
| LAB308 | 30933.3 | 4.32825 | 0.07 | 3 | 6.17 | 0.44 | 3 | 49.32 | 0.44 | 3 |
| LAB308 | 30934.4 | 4.24294 | 0.85 | 1 | 6.01 | 0.98 | 0 | 48.07 | 0.98 | 0 |
| LAB319 | 30771.5 | 4.27619 | 0.20 | 2 | 6.04 | 0.92 | 1 | 48.28 | 0.92 | 1 |
| LAB319 | 30774.1 | 4.57659 | 0.02 | 9 | 6.56 | 0.28 | 10 | 52.52 | 0.28 | 10 |
| LAB319 | 30774.3 | 4.35789 | 0.02 | 4 | 6.27 | 0.23 | 5 | 50.16 | 0.23 | 5 |
| LAB319 | 30775.2 | 4.3037 | 0.16 | 3 | — | — | — | — | — | — |
| LAB319 | 30775.4 | 4.45925 | 0.24 | 6 | 6.37 | 0.47 | 6 | 50.94 | 0.47 | 6 |
| LAB320 | 30601.3 | 4.30871 | 0.73 | 3 | 6.62 | 0.55 | 11 | 52.97 | 0.55 | 11 |
| LAB343 | 30622.2 | 4.41383 | 0.32 | 5 | 6.49 | 0.50 | 8 | 51.94 | 0.50 | 8 |
| LAB343 | 30623.4 | 4.41562 | 0.69 | 5 | 6.52 | 0.75 | 9 | 52.20 | 0.75 | 9 |
| LAB353 | 30553.1 | 4.28877 | 0.68 | 2 | 6.41 | 0.54 | 7 | 51.29 | 0.54 | 7 |
| LAB353 | 30554.2 | 4.50839 | 0.49 | 8 | 6.82 | 0.50 | 14 | 54.59 | 0.50 | 14 |
| LAB353 | 30554.3 | 4.56496 | 0.40 | 9 | 6.69 | 0.50 | 12 | 53.54 | 0.50 | 12 |
| cont | — | 4.18762 | — | 0 | 5.99 | — | 0 | 47.90 | — | 0 |
| LAB182 | 30451.3 | 5.34438 | 0.77 | 2 | 9.97 | 0.76 | 8 | 79.80 | 0.72 | 9 |
| LAB182 | 30453.4 | 5.77655 | 0.00 | 11 | 11.25 | 0.04 | 21 | 90.03 | 0.03 | 23 |
| LAB191 | 28152.1 | — | — | — | — | — | — | 74.11 | 0.83 | 1 |
| LAB191 | 28153.1 | 5.30652 | 0.43 | 2 | 9.53 | 0.51 | 3 | 76.22 | 0.44 | 4 |
| LAB191 | 28156.4 | 5.4045 | 0.60 | 4 | 10.49 | 0.17 | 13 | 83.89 | 0.14 | 15 |
| LAB221 | 30122.2 | 5.3019 | 0.86 | 2 | — | — | — | — | — | — |
| LAB221 | 30123.2 | 5.50556 | 0.15 | 6 | 10.19 | 0.53 | 10 | 81.51 | 0.49 | 11 |
| LAB222 | 30472.1 | 5.4993 | 0.41 | 5 | 10.65 | 0.25 | 15 | 85.23 | 0.21 | 16 |
| LAB222 | 30472.2 | 5.27339 | 0.87 | 1 | — | — | — | — | — | — |
| LAB222 | 30473.1 | 5.37616 | 0.40 | 3 | 10.18 | 0.41 | 10 | 81.46 | 0.36 | 11 |
| LAB222 | 30476.1 | 5.32024 | 0.54 | 2 | 9.47 | 0.67 | 2 | 75.79 | 0.56 | 3 |
| LAB222 | 30476.2 | 5.72531 | 0.22 | 10 | 10.99 | 0.23 | 18 | 87.91 | 0.20 | 20 |
| LAB225 | 30491.4 | 5.265 | 0.88 | 1 | 9.37 | 0.93 | 1 | 75.00 | 0.85 | 2 |
| LAB225 | 30492.2 | 5.85858 | 0.06 | 12 | 11.09 | 0.02 | 20 | 88.69 | 0.01 | 21 |

TABLE 75-continued

Genes showing improved plant biomass production under high salinity conditions

| Gene Name | Event # | Rosette Diameter [cm] | | | Rosette Area [cm2] | | | Plot Coverage [%] | | |
|---|---|---|---|---|---|---|---|---|---|---|
| | | Ave. | P-Val. | % Incr. | Ave. | P-Val. | % Incr. | Ave. | P-Val. | % Incr. |
| LAB225 | 30493.2 | 5.43812 | 0.22 | 4 | 9.67 | 0.62 | 4 | 77.35 | 0.54 | 6 |
| LAB232 | 30462.4 | 5.53665 | 0.03 | 6 | 10.03 | 0.28 | 8 | 80.24 | 0.24 | 10 |
| LAB260 | 30071.4 | 5.32394 | 0.62 | 2 | — | | — | — | | — |
| LAB260 | 30072.2 | 5.58968 | 0.29 | 7 | 10.26 | 0.15 | 11 | 82.10 | 0.12 | 12 |
| LAB260 | 30073.4 | 5.47502 | 0.52 | 5 | 9.90 | 0.58 | 7 | 79.16 | 0.53 | 8 |
| LAB264 | 30131.1 | 5.22335 | 0.96 | 0 | 9.51 | 0.53 | 3 | 76.10 | 0.46 | 4 |
| LAB264 | 30135.2 | — | | — | 9.43 | 0.73 | 2 | 75.42 | 0.60 | 3 |
| LAB265 | 30731.3 | 5.41782 | 0.72 | 4 | — | | — | — | | — |
| LAB290_H0 | 30661.2 | 5.37357 | 0.58 | 3 | 9.81 | 0.56 | 6 | 78.51 | 0.49 | 7 |
| LAB290_H0 | 30662.3 | 5.34203 | 0.34 | 2 | 10.19 | 0.11 | 10 | 81.55 | 0.10 | 11 |
| LAB290_H0 | 30663.1 | 5.54518 | 0.43 | 6 | 10.58 | 0.54 | 14 | 84.61 | 0.51 | 15 |
| LAB290_H0 | 30663.3 | 5.29405 | 0.76 | 1 | 9.34 | 0.89 | 1 | 74.76 | 0.75 | 2 |
| LAB290_H0 | 30663.7 | 5.39379 | 0.22 | 3 | 9.92 | 0.44 | 7 | 79.33 | 0.38 | 8 |
| LAB307 | 30761.5 | 5.27845 | 0.78 | 1 | — | | — | — | | — |
| LAB307 | 30764.4 | 5.25221 | 0.76 | 1 | 9.39 | 0.87 | 1 | 75.08 | 0.75 | 2 |
| LAB308 | 30931.4 | — | | — | 9.34 | 0.95 | 1 | 74.70 | 0.87 | 2 |
| LAB308 | 30932.3 | 5.42547 | 0.57 | 4 | 10.24 | 0.33 | 10 | 81.90 | 0.28 | 12 |
| LAB308 | 30933.3 | 5.62361 | 0.30 | 8 | 10.03 | 0.27 | 8 | 80.24 | 0.23 | 10 |
| LAB308 | 30934.4 | 5.46179 | 0.13 | 5 | 10.01 | 0.19 | 8 | 80.11 | 0.17 | 9 |
| LAB319 | 30771.5 | 5.47996 | 0.06 | 5 | 10.44 | 0.02 | 13 | 83.51 | 0.03 | 14 |
| LAB319 | 30774.1 | 5.28536 | 0.61 | 1 | — | | — | — | | — |
| LAB319 | 30774.3 | 5.22482 | 0.95 | 0 | — | | — | — | | — |
| LAB319 | 30775.1 | 5.53951 | 0.32 | 6 | 10.14 | 0.17 | 9 | 81.10 | 0.15 | 11 |
| LAB319 | 30775.2 | 5.29086 | 0.77 | 1 | — | | — | 73.52 | 0.96 | 0 |
| LAB320 | 30601.2 | 5.4697 | 0.15 | 5 | 10.17 | 0.09 | 10 | 81.32 | 0.09 | 11 |
| LAB320 | 30601.3 | 5.49183 | 0.18 | 5 | 10.12 | 0.23 | 9 | 80.99 | 0.19 | 11 |
| LAB320 | 30602.2 | — | | — | 9.33 | 0.93 | 1 | 74.65 | 0.79 | 2 |
| LAB320 | 30603.1 | 5.45442 | 0.62 | 5 | 10.35 | 0.38 | 12 | 82.80 | 0.34 | 13 |
| LAB320 | 30605.1 | 5.25367 | 0.88 | 1 | 9.50 | 0.59 | 2 | 76.02 | 0.50 | 4 |
| LAB343 | 30622.4 | 5.3595 | 0.24 | 3 | 9.57 | 0.52 | 3 | 76.59 | 0.44 | 5 |
| LAB343 | 30623.4 | 5.42311 | 0.74 | 4 | 10.20 | 0.62 | 10 | 81.61 | 0.58 | 11 |
| cont | — | 5.21743 | — | 0 | 9.27 | — | 0 | 73.26 | — | 0 |
| LAB157 | 28146.2 | 5.19031 | 0.80 | 1 | — | | — | — | | — |
| LAB269 | 28343.4 | 5.31634 | 0.13 | 3 | — | | — | — | | — |
| LAB283 | 28361.1 | — | | — | 8.17 | 0.50 | 2 | 65.39 | 0.50 | 2 |
| LAB299 | 28063.1 | — | | — | 8.31 | 0.26 | 4 | 66.47 | 0.26 | 4 |
| LAB299 | 28064.1 | 5.18915 | 0.75 | 1 | — | | — | — | | — |
| LAB299 | 28066.1 | 5.24888 | 0.72 | 2 | 8.66 | 0.43 | 8 | 69.27 | 0.43 | 8 |
| cont | — | 5.15568 | — | 0 | 7.99 | — | 0 | 63.91 | — | 0 |
| LAB101 | 30641.5 | — | | — | — | | — | 90.05 | 0.78 | 1 |
| LAB101 | 30644.2 | 5.94576 | 0.70 | 3 | — | | — | 89.52 | 0.94 | 1 |
| LAB101 | 30644.4 | 6.04963 | 0.64 | 4 | 11.71 | 0.80 | 3 | 93.67 | 0.68 | 5 |
| LAB107 | 30533.4 | 5.96725 | 0.28 | 3 | 12.15 | 0.12 | 7 | 91.18 | 0.80 | 3 |
| LAB107 | 30534.3 | 5.85705 | 0.92 | 1 | 11.94 | 0.84 | 5 | 95.48 | 0.77 | 7 |
| LAB107 | 30535.2 | 5.80576 | 0.98 | 0 | — | | — | 90.57 | 0.74 | 2 |
| LAB121 | 30802.1 | 6.11174 | 0.60 | 5 | 12.16 | 0.70 | 7 | 97.27 | 0.63 | 9 |
| LAB121 | 30804.1 | 5.85764 | 0.59 | 1 | — | | — | 89.37 | 0.89 | 1 |
| LAB129 | 30825.1 | 5.98291 | 0.20 | 3 | 11.70 | 0.70 | 3 | 93.58 | 0.53 | 5 |
| LAB130 | 30542.1 | 6.07564 | 0.37 | 5 | 12.62 | 0.36 | 11 | 100.93 | 0.30 | 14 |
| LAB130 | 30544.2 | — | | — | — | | — | 90.47 | 0.89 | 2 |
| LAB130 | 30545.1 | — | | — | 11.59 | 0.60 | 2 | 92.68 | 0.35 | 4 |
| LAB130 | 30545.2 | 5.82609 | 0.88 | 0 | 11.41 | 0.95 | 1 | 91.28 | 0.78 | 3 |
| LAB163 | 30831.3 | 6.69354 | 0.22 | 15 | 14.87 | 0.19 | 31 | 118.96 | 0.17 | 34 |
| LAB163 | 30832.2 | 6.21345 | 0.36 | 7 | 12.00 | 0.72 | 6 | 96.02 | 0.63 | 8 |
| LAB163 | 30833.1 | 5.85274 | 0.83 | 1 | — | | — | — | | — |
| LAB163 | 30834.2 | 6.12741 | 0.47 | 6 | 13.03 | 0.38 | 15 | 104.26 | 0.33 | 17 |
| LAB164 | 30524.1 | 6.12751 | 0.37 | 6 | 12.19 | 0.25 | 7 | 97.53 | 0.17 | 10 |
| LAB164 | 30525.2 | 6.07914 | 0.13 | 5 | 12.33 | 0.17 | 9 | 98.68 | 0.11 | 11 |
| LAB164 | 30525.3 | 6.09582 | 0.22 | 5 | 12.91 | 0.14 | 14 | 103.27 | 0.10 | 16 |
| LAB171 | 30841.4 | 6.05124 | 0.18 | 4 | 12.72 | 0.02 | 12 | 101.79 | 0.02 | 15 |
| LAB171 | 30842.3 | 6.01018 | 0.11 | 4 | 11.99 | 0.23 | 6 | 95.91 | 0.14 | 8 |
| LAB171 | 30843.2 | 5.82332 | 0.95 | 0 | 11.79 | 0.83 | 4 | 94.33 | 0.75 | 6 |
| LAB171 | 30845.1 | 5.82729 | 0.86 | 1 | 12.01 | 0.19 | 6 | 96.08 | 0.12 | 8 |
| LAB172 | 30854.1 | 6.03834 | 0.05 | 4 | 12.21 | 0.10 | 8 | 97.71 | 0.06 | 10 |
| LAB172 | 30855.3 | — | | — | — | | — | 90.48 | 0.75 | 2 |
| LAB175 | 30514.4 | 5.84136 | 0.66 | 1 | — | | — | — | | — |
| LAB204 | 30863.1 | 5.90634 | 0.75 | 2 | 12.35 | 0.61 | 9 | 98.83 | 0.54 | 11 |
| LAB204 | 30863.2 | — | | — | 11.65 | 0.67 | 3 | 93.18 | 0.48 | 5 |
| LAB204 | 30864.1 | 6.01264 | 0.14 | 4 | 11.48 | 0.78 | 1 | 91.87 | 0.48 | 3 |
| LAB263 | 30891.6 | 5.98651 | 0.56 | 3 | 11.59 | 0.87 | 2 | — | | — |
| LAB263 | 30892.2 | 6.52853 | 0.40 | 13 | 13.88 | 0.44 | 22 | 111.05 | 0.41 | 25 |
| LAB271 | 30905.6 | 5.81454 | 0.97 | 0 | 11.87 | 0.62 | 5 | 94.99 | 0.49 | 7 |

TABLE 75-continued

Genes showing improved plant biomass production under high salinity conditions

| Gene Name | Event # | Rosette Diameter [cm] | | | Rosette Area [cm2] | | | Plot Coverage [%] | | |
|---|---|---|---|---|---|---|---|---|---|---|
| | | Ave. | P-Val. | % Incr. | Ave. | P-Val. | % Incr. | Ave. | P-Val. | % Incr. |
| LAB272 | 31125.4 | 5.82238 | 0.92 | 0 | 11.77 | 0.82 | 4 | 94.18 | 0.72 | 6 |
| LAB272 | 31125.5 | 5.91018 | 0.70 | 2 | 11.76 | 0.72 | 4 | 94.05 | 0.59 | 6 |
| LAB284 | 30911.3 | 5.82678 | 0.85 | 0 | 11.52 | 0.72 | 1 | 92.12 | 0.44 | 4 |
| LAB284 | 30912.2 | 5.80408 | 0.95 | 0 | — | — | — | — | — | — |
| LAB284 | 30913.1 | — | — | — | 11.67 | 0.86 | 3 | 93.33 | 0.76 | 5 |
| LAB286 | 30921.1 | 6.30009 | 0.63 | 9 | 13.66 | 0.59 | 20 | 109.30 | 0.56 | 23 |
| LAB286 | 30922.1 | 6.57165 | 0.37 | 13 | 14.31 | 0.42 | 26 | 114.46 | 0.39 | 29 |
| LAB286 | 30922.4 | — | — | — | 11.74 | 0.81 | 3 | 93.93 | 0.70 | 6 |
| LAB286 | 30923.3 | 5.94126 | 0.53 | 2 | 11.56 | 0.73 | 2 | 92.44 | 0.49 | 4 |
| LAB329 | 30103.1 | 6.69874 | 0.00 | 16 | 12.96 | 0.01 | 14 | 103.69 | 0.01 | 17 |
| LAB329 | 30104.1 | 6.02622 | 0.16 | 4 | 12.09 | 0.38 | 7 | 96.69 | 0.28 | 9 |
| cont | — | 5.79792 | — | 0 | 11.35 | — | 0 | 88.84 | — | 0 |
| LAB107 | 30533.4 | 4.8513 | 0.04 | 15 | 7.89 | 0.13 | 32 | 63.13 | 0.13 | 32 |
| LAB107 | 30535.2 | 4.74319 | 0.07 | 12 | 7.14 | 0.05 | 19 | 57.15 | 0.05 | 19 |
| LAB121 | 30801.4 | 4.80174 | 0.04 | 13 | 7.43 | 0.04 | 24 | 59.45 | 0.04 | 24 |
| LAB121 | 30802.2 | 4.46335 | 0.47 | 5 | 6.69 | 0.34 | 12 | 53.50 | 0.34 | 12 |
| LAB121 | 30803.1 | 4.47113 | 0.23 | 6 | 6.49 | 0.31 | 8 | 51.90 | 0.31 | 8 |
| LAB121 | 30804.1 | 4.63543 | 0.10 | 10 | 6.19 | 0.76 | 3 | 49.50 | 0.76 | 3 |
| LAB129 | 30824.1 | 4.39961 | 0.58 | 4 | 6.46 | 0.67 | 8 | 51.66 | 0.67 | 8 |
| LAB129 | 30825.1 | 4.76734 | 0.28 | 13 | 7.47 | 0.27 | 25 | 59.74 | 0.27 | 25 |
| LAB130 | 30541.3 | 4.32108 | 0.61 | 2 | 6.14 | 0.68 | 3 | 49.13 | 0.68 | 3 |
| LAB130 | 30544.2 | 4.48487 | 0.36 | 6 | 6.83 | 0.22 | 14 | 54.61 | 0.22 | 14 |
| LAB130 | 30545.1 | 4.95215 | 0.32 | 17 | 8.37 | 0.34 | 40 | 66.99 | 0.34 | 40 |
| LAB163 | 30831.3 | 4.46016 | 0.25 | 5 | 6.38 | 0.30 | 7 | 51.06 | 0.30 | 7 |
| LAB163 | 30833.1 | 4.35312 | 0.65 | 3 | — | — | — | — | — | — |
| LAB164 | 30522.4 | 4.26747 | 0.90 | 1 | 6.07 | 0.88 | 1 | 48.54 | 0.88 | 1 |
| LAB164 | 30524.1 | 4.35195 | 0.49 | 3 | 6.43 | 0.25 | 7 | 51.48 | 0.25 | 7 |
| LAB164 | 30525.2 | 4.49355 | 0.20 | 6 | 6.60 | 0.15 | 10 | 52.83 | 0.15 | 10 |
| LAB164 | 30525.3 | 4.41789 | 0.32 | 4 | — | — | — | — | — | — |
| LAB171 | 30842.4 | 4.5345 | 0.32 | 7 | 6.30 | 0.47 | 5 | 50.36 | 0.47 | 5 |
| LAB171 | 30843.2 | 4.60948 | 0.12 | 9 | 6.89 | 0.09 | 15 | 55.08 | 0.09 | 15 |
| LAB171 | 30845.1 | 4.4151 | 0.52 | 4 | 6.46 | 0.43 | 8 | 51.70 | 0.43 | 8 |
| LAB172 | 30855.2 | 4.40195 | 0.60 | 4 | 6.51 | 0.50 | 9 | 52.09 | 0.50 | 9 |
| LAB204 | 30862.3 | 4.61641 | 0.17 | 9 | 6.91 | 0.26 | 15 | 55.28 | 0.26 | 15 |
| LAB204 | 30863.1 | 4.65483 | 0.17 | 10 | 6.77 | 0.27 | 13 | 54.18 | 0.27 | 13 |
| LAB204 | 30864.1 | 4.31658 | 0.62 | 2 | — | — | — | — | — | — |
| LAB204 | 30865.4 | 4.53539 | 0.16 | 7 | 6.79 | 0.14 | 13 | 54.31 | 0.14 | 13 |
| LAB261 | 31074.4 | 4.46555 | 0.24 | 5 | 6.41 | 0.27 | 7 | 51.31 | 0.27 | 7 |
| LAB261 | 31075.1 | 4.46873 | 0.53 | 6 | 6.50 | 0.49 | 9 | 52.00 | 0.49 | 9 |
| LAB261 | 31075.3 | 4.32989 | 0.78 | 2 | 6.04 | 0.96 | 1 | 48.35 | 0.96 | 1 |
| LAB263 | 30891.6 | 4.52826 | 0.17 | 7 | 6.26 | 0.49 | 4 | 50.04 | 0.49 | 4 |
| LAB263 | 30892.2 | 4.50436 | 0.19 | 6 | 6.61 | 0.17 | 10 | 52.88 | 0.17 | 10 |
| LAB263 | 30892.3 | 4.41691 | 0.42 | 4 | 6.28 | 0.47 | 5 | 50.25 | 0.47 | 5 |
| LAB263 | 30892.4 | 4.5466 | 0.16 | 7 | 6.59 | 0.16 | 10 | 52.70 | 0.16 | 10 |
| LAB263 | 30893.3 | 4.52632 | 0.23 | 7 | 6.87 | 0.39 | 15 | 54.95 | 0.39 | 15 |
| LAB272 | 31121.1 | 4.49455 | 0.21 | 6 | 6.25 | 0.45 | 4 | 49.99 | 0.45 | 4 |
| LAB272 | 31123.1 | 4.36763 | 0.44 | 3 | 6.13 | 0.70 | 2 | 49.01 | 0.70 | 2 |
| LAB272 | 31125.4 | 4.2734 | 0.83 | 1 | 6.19 | 0.65 | 3 | 49.53 | 0.65 | 3 |
| LAB286 | 30923.3 | 4.25659 | 0.93 | 1 | 6.06 | 0.91 | 1 | 48.44 | 0.91 | 1 |
| LAB329 | 30102.3 | 4.32752 | 0.58 | 2 | 6.15 | 0.65 | 3 | 49.19 | 0.65 | 3 |
| LAB329 | 30103.2 | 4.38492 | 0.48 | 4 | 6.22 | 0.60 | 4 | 49.77 | 0.60 | 4 |
| cont | — | 4.23316 | — | 0 | 5.99 | — | 0 | 47.91 | — | 0 |
| LAB178 | 30632.4 | 5.38758 | 0.89 | 2 | — | | — | — | | — |
| LAB342 | 31705.6 | 5.87959 | | 12 | 12.22 | | 25 | 97.72 | | 25 |
| LAB56 | 31455.1 | 5.54812 | 0.02 | 5 | 11.01 | 0.00 | 13 | 88.07 | 0.00 | 13 |
| LAB98 | 31011.2 | — | | — | 9.91 | 0.65 | 2 | 79.26 | 0.65 | 2 |
| cont | — | 5.27271 | — | 0 | 9.76 | — | 0 | 78.07 | — | 0 |

Table 75.
"CONT."—Control;
"Ave."—Average;
"% Incr." = % increment;
"p-val."—p-value.

TABLE 76

Genes showing improved plant photosynthetic capacity under high salinity conditions

| Gene Name | Event # | Leaf Number | | | Leaf Blade Area [cm2] | | | Leaf Petiole Length [cm] | | |
|---|---|---|---|---|---|---|---|---|---|---|
| | | Ave. | P-Val. | % Incr. | Ave | P-Val | % Incr. | Ave. | P-Val. | % Incr. |
| 28543.1 | LAB113 | — | | — | 1.06 | 0.78 | 3 | — | | — |
| 28543.5 | LAB113 | — | | — | 1.06 | 0.57 | 3 | — | | — |
| 28545.2 | LAB113 | 9.88 | 0.67 | 2 | 1.21 | 0.24 | 17 | 0.97 | 0.01 | 9 |
| 28545.3 | LAB113 | — | | — | 1.13 | 0.03 | 10 | — | | — |
| 28291.1 | LAB131 | 10.44 | 0.20 | 7 | 1.26 | 0.09 | 23 | 1.03 | 0.26 | 16 |
| 28292.3 | LAB131 | 10.38 | 0.15 | 7 | 1.14 | 0.23 | 11 | 0.93 | 0.12 | 5 |
| 28293.3 | LAB131 | 10.06 | 0.12 | 4 | 1.07 | 0.85 | 4 | 0.91 | 0.84 | 3 |
| 28294.2 | LAB131 | — | | — | 1.06 | 0.56 | 3 | — | | — |
| 28295.3 | LAB131 | — | | — | 1.20 | 0.32 | 16 | 0.89 | 0.94 | 0 |
| 28551.1 | LAB145 | 10.44 | 0.00 | 7 | 1.13 | 0.29 | 10 | 0.94 | 0.62 | 6 |
| 28551.3 | LAB145 | 9.81 | 0.87 | 1 | 1.27 | 0.00 | 24 | 0.94 | 0.45 | 6 |
| 28553.2 | LAB145 | 10.19 | 0.47 | 5 | 1.22 | 0.00 | 19 | 0.98 | 0.00 | 11 |
| 28553.3 | LAB145 | 9.94 | 0.62 | 2 | 1.37 | 0.00 | 34 | 1.02 | 0.22 | 15 |
| 28555.1 | LAB145 | — | | — | 1.10 | 0.41 | 7 | 0.91 | 0.75 | 3 |
| 28471.1 | LAB152 | 10.00 | 0.45 | 3 | 1.08 | 0.34 | 5 | 0.93 | 0.34 | 5 |
| 28472.3 | LAB152 | 10.31 | 0.26 | 6 | 1.12 | 0.31 | 9 | 0.98 | 0.02 | 10 |
| 28473.2 | LAB152 | 10.00 | 0.45 | 3 | 1.28 | 0.26 | 25 | 1.05 | 0.07 | 18 |
| 28473.3 | LAB152 | 9.81 | 0.83 | 1 | 1.15 | 0.34 | 12 | 0.93 | 0.48 | 5 |
| 28474.4 | LAB152 | 9.94 | 0.62 | 2 | 1.13 | 0.27 | 10 | 0.93 | 0.17 | 5 |
| 28301.2 | LAB153 | 9.75 | 0.93 | 0 | — | | — | 0.96 | 0.33 | 8 |
| 28302.2 | LAB153 | 10.56 | 0.36 | 9 | 1.21 | 0.24 | 18 | 0.92 | 0.21 | 4 |
| 28303.1 | LAB153 | 10.38 | 0.01 | 7 | 1.24 | 0.14 | 20 | 1.03 | 0.02 | 16 |
| 28304.1 | LAB153 | 10.38 | 0.40 | 7 | 1.25 | 0.05 | 22 | 0.96 | 0.17 | 8 |
| 28305.3 | LAB153 | 10.06 | 0.12 | 4 | 1.25 | 0.02 | 21 | 0.95 | 0.23 | 7 |
| 28391.1 | LAB169 | — | | — | 1.16 | 0.02 | 13 | — | | — |
| 28391.4 | LAB169 | 10.06 | 0.46 | 4 | 1.26 | 0.01 | 23 | 0.98 | 0.00 | 11 |
| 28392.1 | LAB169 | 9.94 | 0.47 | 2 | 1.08 | 0.35 | 5 | — | | — |
| 28393.3 | LAB169 | 10.00 | 0.26 | 3 | — | | — | — | | — |
| 28394.3 | LAB169 | 10.50 | 0.11 | 8 | 1.26 | 0.20 | 23 | 1.06 | 0.00 | 20 |
| 28481.1 | LAB181 | — | | — | 1.22 | 0.18 | 19 | 0.98 | 0.20 | 10 |
| 28482.2 | LAB181 | 10.25 | 0.21 | 5 | 1.06 | 0.48 | 3 | — | | — |
| 28484.3 | LAB181 | 9.81 | 0.87 | 1 | 1.17 | 0.49 | 14 | 0.94 | 0.71 | 6 |
| 28431.5 | LAB187 | 9.75 | 0.88 | 0 | 1.07 | 0.34 | 4 | — | | — |
| 28434.1 | LAB187 | 10.50 | 0.11 | 8 | 1.50 | 0.28 | 46 | 1.05 | 0.38 | 18 |
| 28435.3 | LAB187 | — | | — | 1.04 | 0.82 | 2 | — | | — |
| 28561.2 | LAB213 | 10.50 | 0.11 | 8 | 1.18 | 0.28 | 15 | 0.96 | 0.54 | 8 |
| 28562.6 | LAB213 | 10.38 | 0.02 | 7 | 1.21 | 0.19 | 17 | 0.96 | 0.02 | 8 |
| 28565.2 | LAB213 | 10.53 | 0.00 | 8 | — | | — | 0.90 | 0.64 | 2 |
| 28572.3 | LAB230 | 10.19 | 0.34 | 5 | 1.17 | 0.00 | 14 | 0.98 | 0.07 | 10 |
| 28574.2 | LAB230 | 9.94 | 0.47 | 2 | 1.14 | 0.02 | 11 | 1.01 | 0.14 | 14 |
| 28091.4 | LAB247 | 10.19 | 0.16 | 5 | 1.18 | 0.06 | 15 | 0.99 | 0.00 | 12 |
| 28093.2 | LAB247 | 10.13 | 0.06 | 4 | 1.07 | 0.43 | 4 | 0.95 | 0.09 | 7 |
| 28094.1 | LAB247 | — | | — | 1.10 | 0.62 | 7 | — | | — |
| 28094.3 | LAB247 | 10.29 | 0.24 | 6 | 1.23 | 0.05 | 19 | 1.03 | 0.00 | 16 |
| 28095.4 | LAB247 | 9.94 | 0.30 | 2 | 1.11 | 0.18 | 8 | 0.90 | 0.90 | 1 |
| 28602.1 | LAB249 | 10.19 | 0.47 | 5 | 1.24 | 0.00 | 21 | 1.02 | 0.47 | 15 |
| 28603.3 | LAB249 | 9.88 | 0.52 | 2 | 1.18 | 0.27 | 15 | 1.08 | 0.27 | 22 |
| 28604.2 | LAB249 | — | | — | 1.11 | 0.51 | 8 | — | | — |
| 28604.4 | LAB249 | 9.81 | 0.87 | 1 | 1.12 | 0.05 | 9 | 0.95 | 0.48 | 7 |
| 28605.2 | LAB249 | 9.94 | 0.71 | 2 | 1.07 | 0.28 | 5 | — | | — |
| 27441.4 | LAB258 | 10.56 | 0.48 | 9 | 1.14 | 0.36 | 11 | 0.96 | 0.70 | 8 |
| 27441.6 | LAB258 | 10.63 | 0.30 | 9 | 1.13 | 0.60 | 10 | 1.05 | 0.47 | 19 |
| 27442.2 | LAB258 | 9.94 | 0.77 | 2 | 1.25 | 0.09 | 22 | 0.95 | 0.61 | 7 |
| 27442.5 | LAB258 | — | | — | 1.11 | 0.09 | 8 | — | | — |
| 27444.4 | LAB258 | 10.50 | 0.24 | 8 | 1.09 | 0.35 | 6 | 0.98 | 0.01 | 11 |
| 28401.3 | LAB294 | 10.00 | 0.45 | 3 | 1.22 | 0.08 | 19 | 1.02 | 0.04 | 15 |
| 28402.5 | LAB294 | — | | — | 1.12 | 0.05 | 9 | 0.95 | 0.05 | 7 |
| 28404.1 | LAB294 | — | | — | 1.13 | 0.28 | 10 | 0.96 | 0.14 | 9 |
| 28463.1 | LAB70 | 9.94 | 0.62 | 2 | — | | — | — | | — |
| 28463.3 | LAB70 | 9.75 | 0.90 | 0 | — | | — | — | | — |
| 28451.3 | LAB74 | — | | — | 1.04 | 0.86 | 1 | 0.91 | 0.43 | 3 |
| 28452.2 | LAB74 | — | | — | 1.05 | 0.86 | 3 | — | | — |
| 28453.5 | LAB74 | 9.75 | 0.90 | 0 | 1.03 | 0.96 | 0 | 0.96 | 0.12 | 8 |
| 28454.1 | LAB74 | 10.25 | 0.21 | 5 | 1.11 | 0.56 | 8 | 1.03 | 0.00 | 16 |
| 28534.3 | LAB81 | 10.06 | 0.28 | 4 | — | | — | — | | — |
| 28191.3 | LAB88 | 10.31 | 0.01 | 6 | — | | — | — | | — |
| 28192.4 | LAB88 | 9.75 | 0.98 | 0 | — | | — | — | | — |
| 28192.6 | LAB88 | 10.69 | 0.02 | 10 | — | | — | — | | — |
| 28193.2 | LAB88 | 10.19 | 0.04 | 5 | — | | — | — | | — |
| 28193.6 | LAB88 | 10.13 | 0.12 | 4 | — | | — | — | | — |
| — | cont | 9.72 | — | 0 | 1.03 | — | 0 | 0.89 | — | 0 |

TABLE 76-continued

Genes showing improved plant photosynthetic capacity under high salinity conditions

| Gene Name | Event # | Leaf Number | | | Leaf Blade Area [cm2] | | | Leaf Petiole Length [cm] | | |
|---|---|---|---|---|---|---|---|---|---|---|
| | | Ave. | P-Val. | % Incr. | Ave | P-Val | % Incr. | Ave. | P-Val. | % Incr. |
| 28545.2 | LAB113 | — | | — | 0.93 | 0.63 | 11 | — | | — |
| 28545.3 | LAB113 | 9.81 | 0.26 | 7 | 1.19 | 0.03 | 41 | 1.01 | 0.33 | 22 |
| 28291.1 | LAB131 | 9.94 | 0.00 | 8 | 1.07 | 0.11 | 27 | 0.93 | 0.26 | 13 |
| 28292.3 | LAB131 | 10.06 | 0.56 | 10 | 1.01 | 0.00 | 20 | 0.86 | 0.70 | 4 |
| 28294.2 | LAB131 | 9.19 | 0.95 | 0 | — | | — | — | | — |
| 28295.3 | LAB131 | 9.25 | 0.92 | 1 | 1.05 | 0.45 | 25 | 0.92 | 0.63 | 12 |
| 28551.1 | LAB145 | 9.88 | 0.29 | 8 | 1.09 | 0.39 | 29 | 0.95 | 0.51 | 15 |
| 28551.3 | LAB145 | 9.44 | 0.07 | 3 | — | | — | 0.85 | 0.40 | 3 |
| 28553.2 | LAB145 | 9.50 | 0.54 | 4 | 1.10 | 0.03 | 31 | 0.91 | 0.21 | 11 |
| 28553.3 | LAB145 | 10.13 | 0.12 | 10 | 1.23 | 0.13 | 46 | 1.10 | 0.02 | 33 |
| 28555.1 | LAB145 | 9.19 | 0.99 | 0 | 1.14 | 0.00 | 35 | 0.90 | 0.29 | 9 |
| 28471.1 | LAB152 | — | | — | 1.15 | 0.21 | 37 | 0.91 | 0.42 | 11 |
| 28472.3 | LAB152 | — | | — | 1.04 | 0.00 | 24 | 0.89 | 0.34 | 8 |
| 28473.2 | LAB152 | — | | — | 1.05 | 0.00 | 25 | 0.88 | 0.17 | 6 |
| 28473.3 | LAB152 | 9.19 | 0.95 | 0 | 0.90 | 0.55 | 7 | — | | — |
| 28474.4 | LAB152 | — | | — | 0.85 | 0.96 | 1 | — | | — |
| 28301.2 | LAB153 | 9.38 | 0.69 | 2 | — | | — | 0.87 | 0.47 | 5 |
| 28303.1 | LAB153 | 9.44 | 0.36 | 3 | 0.86 | 0.88 | 2 | 0.85 | 0.70 | 3 |
| 28304.1 | LAB153 | 9.56 | 0.01 | 4 | 1.01 | 0.00 | 21 | 0.90 | 0.07 | 9 |
| 28391.1 | LAB169 | 9.44 | 0.77 | 3 | 1.27 | 0.01 | 52 | 0.93 | 0.48 | 13 |
| 28392.1 | LAB169 | 9.81 | 0.26 | 7 | 1.24 | 0.19 | 48 | 1.09 | 0.21 | 33 |
| 28393.2 | LAB169 | 9.31 | 0.59 | 2 | 1.16 | 0.02 | 38 | 0.86 | 0.75 | 5 |
| 28394.3 | LAB169 | 9.38 | 0.10 | 2 | 1.02 | 0.00 | 22 | 0.92 | 0.00 | 11 |
| 28481.1 | LAB181 | — | | — | 1.04 | 0.27 | 23 | 0.83 | 0.91 | 0 |
| 28482.2 | LAB181 | — | | — | 1.00 | 0.31 | 19 | 0.97 | 0.00 | 17 |
| 28483.2 | LAB181 | — | | — | 0.90 | 0.73 | 7 | 0.85 | 0.62 | 2 |
| 28484.3 | LAB181 | 9.50 | 0.74 | 4 | 0.92 | 0.21 | 10 | 0.84 | 0.86 | 1 |
| 28433.3 | LAB187 | 9.44 | 0.07 | 3 | 0.88 | 0.70 | 5 | — | | — |
| 28434.1 | LAB187 | 9.38 | 0.10 | 2 | 1.13 | 0.05 | 35 | 0.90 | 0.22 | 9 |
| 28434.2 | LAB187 | — | | — | 0.91 | 0.33 | 9 | — | | — |
| 28435.4 | LAB187 | 9.31 | 0.73 | 2 | 1.02 | 0.08 | 21 | 0.89 | 0.49 | 8 |
| 28561.2 | LAB213 | — | | — | 1.07 | 0.14 | 27 | 0.88 | 0.28 | 7 |
| 28562.6 | LAB213 | — | | — | 0.90 | 0.75 | 7 | 0.84 | 0.91 | 1 |
| 28565.2 | LAB213 | 9.75 | 0.52 | 6 | 0.92 | 0.61 | 10 | 0.87 | 0.74 | 5 |
| 28571.6 | LAB230 | — | | — | 0.95 | 0.30 | 14 | — | | — |
| 28572.2 | LAB230 | — | | — | 1.04 | 0.53 | 24 | 0.90 | 0.22 | 9 |
| 28572.3 | LAB230 | — | | — | 0.99 | 0.11 | 18 | 0.85 | 0.36 | 3 |
| 28574.2 | LAB230 | — | | — | 0.89 | 0.76 | 6 | 0.83 | 0.96 | 0 |
| 28574.3 | LAB230 | — | | — | — | | — | 0.89 | 0.12 | 8 |
| 28091.4 | LAB247 | 9.44 | 0.65 | 3 | 1.01 | 0.51 | 20 | 0.95 | 0.44 | 15 |
| 28093.2 | LAB247 | 9.38 | 0.69 | 2 | 1.05 | 0.03 | 26 | 0.94 | 0.07 | 14 |
| 28094.1 | LAB247 | 9.25 | 0.90 | 1 | 0.92 | 0.62 | 9 | 0.85 | 0.83 | 3 |
| 28094.3 | LAB247 | — | | — | 0.92 | | 9 | — | | — |
| 28095.4 | LAB247 | 9.44 | 0.55 | 3 | 1.02 | 0.32 | 21 | 0.88 | 0.63 | 7 |
| 28602.1 | LAB249 | — | | — | 0.93 | 0.14 | 11 | — | | — |
| 28604.2 | LAB249 | 9.38 | 0.10 | 2 | 0.92 | 0.09 | 9 | 0.85 | 0.37 | 3 |
| 28605.2 | LAB249 | — | | — | 0.93 | 0.48 | 10 | 0.93 | 0.14 | 12 |
| 27441.4 | LAB258 | 9.25 | 0.94 | 1 | 0.90 | 0.74 | 7 | 0.84 | 0.93 | 2 |
| 27441.6 | LAB258 | 9.31 | 0.87 | 2 | — | | — | — | | — |
| 27442.5 | LAB258 | 9.75 | 0.22 | 6 | 0.93 | 0.07 | 10 | — | | — |
| 27444.4 | LAB258 | — | | — | 0.86 | 0.63 | 3 | — | | — |
| 28402.4 | LAB294 | — | | — | 0.87 | 0.45 | 4 | — | | — |
| 28405.1 | LAB294 | — | | — | 0.95 | 0.31 | 13 | 0.90 | 0.33 | 9 |
| 28463.3 | LAB70 | 9.19 | 0.95 | 0 | — | | — | — | | — |
| 28451.3 | LAB74 | 9.50 | 0.14 | 4 | 1.11 | 0.14 | 32 | 0.95 | 0.00 | 16 |
| 28452.4 | LAB74 | 9.44 | 0.55 | 3 | 0.85 | 0.97 | 1 | 0.83 | 0.97 | 1 |
| 28531.1 | LAB81 | — | | — | 0.84 | 0.99 | 0 | — | | — |
| 28191.3 | LAB88 | 9.75 | 0.45 | 6 | 0.85 | 0.79 | 1 | — | | — |
| 28193.2 | LAB88 | — | | — | 0.90 | 0.30 | 8 | 0.87 | 0.51 | 5 |
| 28193.6 | LAB88 | 9.50 | 0.01 | 4 | — | | — | — | | — |
| — | cont | 9.17 | — | 0 | 0.84 | — | 0 | 0.83 | — | 0 |
| 28501.4 | LAB108 | 9.31 | 0.57 | 1 | — | | — | — | | — |
| 28502.2 | LAB108 | 9.88 | 0.22 | 7 | 1.33 | 0.34 | 14 | 1.16 | 0.17 | 21 |
| 28412.1 | LAB119 | — | | — | 1.46 | 0.06 | 25 | 1.06 | 0.62 | 10 |
| 28413.1 | LAB119 | 9.56 | 0.32 | 3 | 1.37 | 0.14 | 18 | 1.04 | 0.04 | 8 |
| 28415.2 | LAB119 | — | | — | 1.25 | 0.48 | 7 | 0.97 | 0.93 | 0 |
| 28142.3 | LAB157 | 9.46 | 0.06 | 2 | 1.23 | 0.20 | 6 | 1.04 | 0.30 | 8 |
| 28144.2 | LAB157 | 9.31 | 0.88 | 1 | — | | — | 0.99 | 0.80 | 3 |
| 28145.2 | LAB157 | 9.38 | 0.49 | 1 | 1.28 | 0.65 | 10 | — | | — |
| 28146.1 | LAB157 | 9.63 | 0.01 | 4 | 1.19 | 0.65 | 2 | 0.97 | 0.84 | 1 |
| 28581.3 | LAB231 | 9.31 | 0.57 | 1 | 1.20 | 0.63 | 3 | 0.98 | 0.73 | 1 |

TABLE 76-continued

Genes showing improved plant photosynthetic capacity under high salinity conditions

| Gene Name | Event # | Leaf Number | | | Leaf Blade Area [cm2] | | | Leaf Petiole Length [cm] | | |
|---|---|---|---|---|---|---|---|---|---|---|
| | | Ave. | P-Val. | % Incr. | Ave | P-Val | % Incr. | Ave. | P-Val. | % Incr. |
| 28583.1 | LAB231 | — | — | — | 1.45 | 0.11 | 25 | 1.06 | 0.60 | 10 |
| 28585.1 | LAB231 | — | — | — | 1.41 | 0.15 | 21 | 1.06 | 0.04 | 10 |
| 28422.4 | LAB238 | — | — | — | 1.21 | 0.63 | 4 | — | — | — |
| 28424.3 | LAB238 | 9.38 | 0.49 | 1 | 1.20 | 0.65 | 3 | 0.98 | 0.88 | 2 |
| 28424.4 | LAB238 | — | — | — | 1.18 | 0.90 | 2 | 0.98 | 0.77 | 2 |
| 28425.5 | LAB238 | — | — | — | 1.38 | 0.36 | 19 | 1.09 | 0.35 | 13 |
| 28592.2 | LAB240 | 9.88 | 0.43 | 7 | 1.46 | 0.06 | 25 | 1.12 | 0.00 | 17 |
| 28592.6 | LAB240 | 9.75 | 0.40 | 5 | 1.35 | 0.09 | 16 | 1.05 | 0.35 | 9 |
| 28595.1 | LAB240 | 9.44 | 0.13 | 2 | 1.52 | 0.00 | 31 | 1.20 | 0.00 | 24 |
| 28595.3 | LAB240 | 9.38 | 0.71 | 1 | 1.24 | 0.76 | 7 | 0.99 | 0.89 | 3 |
| 28081.2 | LAB242 | 9.69 | 0.01 | 5 | 1.34 | 0.54 | 15 | 0.97 | 0.90 | 1 |
| 28081.3 | LAB242 | — | — | — | 1.21 | 0.86 | 4 | — | — | — |
| 28083.1 | LAB242 | — | — | — | 1.28 | 0.38 | 10 | 1.03 | 0.50 | 7 |
| 28085.1 | LAB242 | 9.38 | 0.71 | 1 | 1.29 | 0.74 | 10 | 1.05 | 0.66 | 9 |
| 28383.2 | LAB267 | 9.31 | 0.91 | 1 | 1.19 | 0.60 | 2 | 1.04 | 0.49 | 8 |
| 28384.2 | LAB267 | 9.75 | 0.08 | 5 | 1.31 | 0.13 | 12 | 1.01 | 0.42 | 5 |
| 28384.5 | LAB267 | — | — | — | 1.24 | 0.30 | 7 | 0.99 | 0.47 | 3 |
| 28385.2 | LAB267 | — | — | — | 1.22 | 0.13 | 5 | — | — | — |
| 28343.4 | LAB269 | — | — | — | 1.28 | 0.20 | 10 | 1.03 | 0.41 | 7 |
| 28345.3 | LAB269 | — | — | — | 1.30 | 0.05 | 11 | 1.06 | 0.22 | 10 |
| 28351.1 | LAB279 | 9.56 | 0.32 | 3 | — | — | — | 0.96 | 0.99 | 0 |
| 28351.4 | LAB279 | 9.38 | 0.80 | 1 | 1.31 | 0.45 | 12 | — | — | — |
| 28353.2 | LAB279 | 9.69 | 0.38 | 5 | 1.48 | 0.07 | 27 | 1.13 | 0.37 | 17 |
| 28363.3 | LAB283 | 9.69 | 0.01 | 5 | 1.37 | 0.00 | 18 | 1.11 | 0.04 | 15 |
| 28364.3 | LAB283 | — | — | — | 1.33 | 0.43 | 15 | 1.01 | 0.70 | 4 |
| 28364.4 | LAB283 | — | — | — | 1.24 | 0.56 | 6 | — | — | — |
| 28365.1 | LAB283 | 9.56 | 0.32 | 3 | 1.27 | 0.09 | 9 | 1.12 | 0.01 | 16 |
| 29242.1 | LAB298 | 9.75 | 0.08 | 5 | — | — | — | — | — | — |
| 29244.1 | LAB298 | — | — | — | 1.38 | 0.19 | 19 | 1.08 | 0.08 | 12 |
| 29245.2 | LAB298 | — | — | — | 1.36 | 0.01 | 16 | 1.13 | 0.00 | 18 |
| 29245.3 | LAB298 | — | — | — | 1.28 | 0.60 | 10 | 0.99 | 0.88 | 3 |
| 29245.4 | LAB298 | 9.75 | 0.40 | 5 | 1.38 | 0.16 | 18 | 1.08 | 0.01 | 12 |
| 28061.1 | LAB299 | — | — | — | 1.17 | 0.93 | 1 | — | — | — |
| 28063.1 | LAB299 | 9.59 | 0.24 | 4 | 1.46 | 0.17 | 25 | 1.17 | 0.00 | 22 |
| 28064.1 | LAB299 | 9.63 | 0.01 | 4 | 1.19 | 0.83 | 2 | 1.01 | 0.66 | 5 |
| 28066.1 | LAB299 | 10.00 | 0.18 | 8 | 1.32 | 0.52 | 14 | 1.05 | 0.65 | 9 |
| 28822.7 | LAB302 | 10.00 | 0.00 | 8 | 1.42 | 0.35 | 22 | 1.09 | 0.42 | 14 |
| 28823.4 | LAB302 | 9.81 | 0.16 | 6 | — | — | — | 0.98 | 0.71 | 1 |
| 28825.1 | LAB302 | 9.50 | 0.24 | 3 | 1.20 | 0.64 | 3 | 1.01 | 0.51 | 5 |
| 28374.3 | LAB336 | — | — | — | — | — | — | 0.98 | 0.54 | 2 |
| 28375.3 | LAB336 | — | — | — | 1.19 | 0.41 | 2 | 0.98 | 0.68 | 1 |
| 27272.2 | LAB339 | — | — | — | 1.20 | 0.42 | 3 | — | — | — |
| 27272.7 | LAB339 | — | — | — | 1.54 | 0.00 | 32 | 1.13 | 0.02 | 18 |
| 28494.1 | LAB345 | — | — | — | 1.17 | 0.98 | 0 | — | — | — |
| 28495.1 | LAB345 | 9.31 | 0.80 | 1 | 1.27 | 0.58 | 9 | 1.05 | 0.16 | 9 |
| 28441.2 | LAB58 | 9.56 | 0.03 | 3 | 1.20 | 0.58 | 3 | 0.98 | 0.68 | 2 |
| 28442.1 | LAB58 | 9.56 | 0.32 | 3 | 1.45 | 0.44 | 24 | 1.12 | 0.49 | 17 |
| 28443.2 | LAB58 | 9.56 | 0.32 | 3 | 1.45 | 0.14 | 25 | 1.09 | 0.01 | 13 |
| 28443.4 | LAB58 | 9.63 | 0.36 | 4 | 1.20 | 0.49 | 3 | 1.05 | 0.09 | 9 |
| 28445.2 | LAB58 | 9.94 | 0.35 | 7 | 1.26 | 0.54 | 8 | 0.97 | 0.95 | 1 |
| — | cont | 9.25 | — | 0 | 1.16 | — | 0 | 0.96 | — | 0 |
| 28832.1 | LAB133 | 9.81 | 0.43 | 1 | 3.92 | 0.19 | 23 | — | — | — |
| 28832.5 | LAB133 | — | — | — | 3.56 | 0.51 | 12 | — | — | — |
| 28833.1 | LAB133 | — | — | — | 3.61 | 0.50 | 13 | — | — | — |
| 28833.2 | LAB133 | — | — | — | 3.76 | 0.29 | 18 | — | — | — |
| 28835.1 | LAB133 | — | — | — | 3.44 | 0.63 | 8 | — | — | — |
| 29412.1 | LAB158 | — | — | — | 3.22 | 0.96 | 1 | — | — | — |
| 29414.3 | LAB158 | — | — | — | 3.21 | 0.97 | 1 | — | — | — |
| 29312.1 | LAB160 | — | — | — | 3.47 | 0.74 | 9 | — | — | — |
| 29314.2 | LAB160 | — | — | — | 3.76 | 0.29 | 18 | — | — | — |
| 29315.2 | LAB160 | 9.81 | 0.62 | 1 | 3.70 | 0.35 | 16 | — | — | — |
| 29315.3 | LAB160 | 10.00 | 0.17 | 3 | 4.18 | 0.12 | 31 | — | — | — |
| 29341.2 | LAB162 | 9.94 | 0.55 | 3 | — | — | — | — | — | — |
| 29342.6 | LAB162 | — | — | — | — | — | — | 0.88 | 0.26 | 15 |
| 29344.1 | LAB162 | — | — | — | 3.27 | 0.88 | 2 | — | — | — |
| 29421.2 | LAB177 | — | — | — | 3.24 | 0.92 | 2 | — | — | — |
| 29422.1 | LAB177 | — | — | — | 3.38 | 0.78 | 6 | — | — | — |
| 29424.3 | LAB177 | — | — | — | — | — | — | 0.82 | 0.88 | 6 |
| 29424.4 | LAB177 | — | — | — | 3.24 | 0.92 | 2 | — | — | — |
| 29301.4 | LAB179 | 9.75 | 0.93 | 1 | — | — | — | — | — | — |
| 29303.2 | LAB179 | — | — | — | 3.79 | 0.27 | 19 | — | — | — |

TABLE 76-continued

Genes showing improved plant photosynthetic capacity under high salinity conditions

| Gene Name | Event # | Leaf Number | | | Leaf Blade Area [cm2] | | | Leaf Petiole Length [cm] | | |
|---|---|---|---|---|---|---|---|---|---|---|
| | | Ave. | P-Val. | % Incr. | Ave | P-Val | % Incr. | Ave. | P-Val. | % Incr. |
| 29304.2 | LAB179 | — | — | — | — | — | — | 0.80 | 0.87 | 4 |
| 28172.4 | LAB185 | 9.81 | 0.85 | 1 | — | — | — | — | — | — |
| 28173.4 | LAB185 | — | — | — | — | — | — | 0.78 | 0.87 | 2 |
| 28175.3 | LAB185 | — | — | — | 3.25 | 0.90 | 2 | — | — | — |
| 28331.3 | LAB210 | 9.88 | 0.23 | 2 | 4.00 | 0.15 | 25 | — | — | — |
| 28333.4 | LAB210 | — | — | — | 3.64 | 0.40 | 14 | — | — | — |
| 28813.1 | LAB254 | — | — | — | 3.44 | 0.62 | 8 | — | — | — |
| 29232.3 | LAB293 | — | — | — | 3.32 | 0.82 | 4 | — | — | — |
| 29233.2 | LAB293 | — | — | — | 3.83 | 0.25 | 20 | — | — | — |
| 29273.1 | LAB297 | — | — | — | 3.20 | 0.98 | 0 | — | — | — |
| 29274.1 | LAB297 | — | — | — | 3.23 | 0.95 | 1 | — | — | — |
| 29275.1 | LAB297 | — | — | — | 3.28 | 0.88 | 3 | — | — | — |
| 28181.2 | LAB310 | — | — | — | — | — | — | 0.80 | 0.89 | 4 |
| 28181.3 | LAB310 | — | — | — | 3.27 | 0.91 | 2 | — | — | — |
| 28182.3 | LAB310 | 10.69 | 0.04 | 10 | — | — | — | 0.89 | 0.64 | 16 |
| 28183.2 | LAB310 | — | — | — | 3.44 | 0.65 | 8 | — | — | — |
| 29221.6 | LAB327 | — | — | — | 3.45 | 0.63 | 8 | — | — | — |
| 29221.8 | LAB327 | — | — | — | 3.56 | 0.62 | 11 | — | — | — |
| 29224.2 | LAB327 | — | — | — | 4.24 | 0.08 | 33 | — | — | — |
| 29225.2 | LAB327 | — | — | — | 4.12 | 0.10 | 29 | — | — | — |
| 29225.3 | LAB327 | — | — | — | 3.36 | 0.85 | 5 | — | — | — |
| 27311.2 | LAB335 | — | — | — | — | — | — | 0.80 | 0.89 | 4 |
| 27312.1 | LAB335 | — | — | — | 3.74 | 0.32 | 17 | — | — | — |
| 27314.1 | LAB335 | — | — | — | 3.56 | 0.52 | 12 | — | — | — |
| 27314.2 | LAB335 | — | — | — | 4.20 | 0.10 | 32 | — | — | — |
| 27315.4 | LAB335 | 10.25 | 0.20 | 6 | — | — | — | 0.85 | 0.78 | 11 |
| 28131.1 | LAB54 | — | — | — | 3.47 | 0.59 | 9 | — | — | — |
| 28133.1 | LAB54 | — | — | — | 3.83 | 0.24 | 20 | — | — | — |
| 28134.1 | LAB54 | — | — | — | 4.53 | 0.03 | 42 | — | — | — |
| 28136.1 | LAB54 | 9.88 | 0.76 | 2 | 4.21 | 0.09 | 32 | — | — | — |
| 28136.2 | LAB54 | — | — | — | 4.33 | 0.06 | 36 | — | — | — |
| 29331.5 | LAB68 | — | — | — | — | — | — | 0.83 | 0.87 | 8 |
| 29331.6 | LAB68 | 9.69 | 0.99 | 0 | 3.51 | 0.54 | 10 | — | — | — |
| 29332.3 | LAB68 | 9.88 | 0.36 | 2 | 3.71 | 0.38 | 16 | — | — | — |
| 29332.4 | LAB68 | — | — | — | — | — | — | 0.81 | 0.83 | 5 |
| 29335.1 | LAB68 | 10.13 | 0.28 | 5 | 3.58 | 0.46 | 12 | — | — | — |
| 30152.1 | LAB73 | — | — | — | 3.44 | 0.65 | 8 | — | — | — |
| 30152.2 | LAB73 | — | — | — | — | — | — | 0.84 | 0.83 | 9 |
| 30153.1 | LAB73 | 9.81 | 0.90 | 1 | — | — | — | 0.79 | 0.89 | 2 |
| 30154.3 | LAB73 | 9.94 | 0.55 | 3 | 4.25 | 0.09 | 33 | — | — | — |
| — | cont | 9.68 | — | 0 | 3.19 | — | 0 | 0.77 | — | 0 |
| 30312.2 | LAB102 | — | — | — | 3.85 | 0.11 | 14 | 0.72 | 0.91 | 1 |
| 30313.3 | LAB102 | — | — | — | — | — | — | 0.78 | 0.68 | 9 |
| 30201.3 | LAB126 | — | — | — | 3.60 | 0.41 | 7 | — | — | — |
| 30202.3 | LAB126 | — | — | — | 3.69 | 0.37 | 10 | 0.73 | 0.75 | 3 |
| 30205.1 | LAB126 | 10.69 | 0.29 | 6 | 4.05 | 0.03 | 20 | 0.75 | 0.57 | 5 |
| 30231.1 | LAB165 | — | — | — | 3.57 | 0.58 | 6 | — | — | — |
| 30231.2 | LAB165 | — | — | — | — | — | — | 1.03 | 0.46 | 45 |
| 30232.1 | LAB165 | — | — | — | — | — | — | 0.99 | 0.39 | 38 |
| 30233.1 | LAB165 | — | — | — | 3.65 | 0.34 | 8 | 0.77 | 0.37 | 7 |
| 30235.1 | LAB165 | — | — | — | — | — | — | 0.98 | 0.51 | 38 |
| 27321.2 | LAB167 | 10.19 | 0.50 | 1 | — | — | — | 1.08 | 0.36 | 51 |
| 27321.3 | LAB167 | 10.25 | 0.16 | 1 | — | — | — | 1.00 | 0.31 | 40 |
| 27321.4 | LAB167 | 10.56 | 0.48 | 5 | 4.10 | 0.10 | 22 | 0.74 | 0.76 | 3 |
| 27321.6 | LAB167 | 10.25 | 0.88 | 1 | 4.23 | 0.01 | 26 | 0.74 | 0.63 | 4 |
| 27324.1 | LAB167 | — | — | — | — | — | — | 0.85 | 0.56 | 19 |
| 30321.4 | LAB220 | 10.25 | 0.82 | 1 | 3.39 | 0.96 | 0 | — | — | — |
| 30322.2 | LAB220 | 10.56 | 0.19 | 5 | 3.67 | 0.32 | 9 | — | — | — |
| 30322.3 | LAB220 | — | — | — | — | — | — | 0.88 | 0.57 | 24 |
| 30324.4 | LAB220 | — | — | — | 3.50 | 0.63 | 4 | — | — | — |
| 30211.3 | LAB241 | — | — | — | 3.91 | 0.13 | 16 | — | — | — |
| 30212.1 | LAB241 | — | — | — | 3.61 | 0.41 | 7 | 0.72 | 0.86 | 1 |
| 30212.2 | LAB241 | 10.31 | 0.11 | 2 | 4.01 | 0.26 | 19 | 0.75 | 0.54 | 5 |
| 30213.1 | LAB241 | 10.63 | 0.00 | 5 | — | — | — | 0.98 | 0.46 | 37 |
| 30391.4 | LAB268 | 10.63 | 0.06 | 5 | 3.67 | 0.39 | 9 | — | — | — |
| 30392.1 | LAB268 | 10.25 | 0.86 | 1 | 3.93 | 0.06 | 17 | — | — | — |
| 30393.1 | LAB268 | 10.13 | 0.99 | 0 | — | — | — | 0.96 | 0.53 | 35 |
| 30393.3 | LAB268 | — | — | — | 3.51 | 0.62 | 4 | — | — | — |
| 30395.1 | LAB268 | 10.31 | 0.45 | 2 | 4.11 | 0.03 | 22 | 0.73 | 0.82 | 2 |
| 30041.2 | LAB280 | — | — | — | — | — | — | 0.93 | 0.43 | 30 |
| 30042.1 | LAB280 | — | — | — | 4.30 | 0.01 | 28 | 0.78 | 0.35 | 9 |

TABLE 76-continued

Genes showing improved plant photosynthetic capacity under high salinity conditions

| Gene Name | Event # | Leaf Number | | | Leaf Blade Area [cm2] | | | Leaf Petiole Length [cm] | | |
|---|---|---|---|---|---|---|---|---|---|---|
| | | Ave. | P-Val. | % Incr. | Ave | P-Val | % Incr. | Ave. | P-Val. | % Incr. |
| 30044.1 | LAB280 | 11.06 | 0.18 | 9 | 4.67 | 0.02 | 38 | 0.88 | 0.01 | 23 |
| 30045.1 | LAB280 | 10.56 | 0.00 | 5 | 4.12 | 0.02 | 22 | 0.82 | 0.25 | 14 |
| 30371.6 | LAB289 | — | — | — | 3.69 | 0.45 | 9 | 0.72 | 0.95 | 1 |
| 30373.1 | LAB289 | — | — | — | 3.67 | 0.29 | 9 | 0.73 | 0.85 | 2 |
| 30373.2 | LAB289 | — | — | — | — | — | — | 0.85 | 0.70 | 20 |
| 30375.2 | LAB289 | — | — | — | 3.85 | 0.28 | 14 | 0.74 | 0.67 | 4 |
| 30221.4 | LAB311 | — | — | — | 3.74 | 0.20 | 11 | 0.72 | 0.86 | 1 |
| 30222.2 | LAB311 | — | — | — | 4.27 | 0.07 | 27 | 0.75 | 0.51 | 5 |
| 30223.2 | LAB311 | — | — | — | 3.98 | 0.33 | 18 | 0.74 | 0.82 | 4 |
| 30224.2 | LAB311 | — | — | — | 3.69 | 0.35 | 9 | — | — | — |
| 30096.3 | LAB344 | 10.13 | 0.91 | 0 | — | — | — | 0.88 | 0.60 | 24 |
| 29282.1 | LAB355 | — | — | — | 3.87 | 0.20 | 15 | — | — | — |
| 29282.2 | LAB355 | 10.31 | 0.72 | 2 | — | — | — | 0.97 | 0.51 | 36 |
| 29283.1 | LAB355 | 10.19 | 0.88 | 1 | 4.59 | 0.27 | 36 | 0.75 | 0.52 | 6 |
| 30172.3 | LAB367 | — | — | — | 3.82 | 0.21 | 13 | — | — | — |
| 30173.1 | LAB367 | 10.19 | 0.74 | 1 | 4.22 | 0.01 | 25 | — | — | — |
| 30173.3 | LAB367 | — | — | — | 3.68 | 0.34 | 9 | — | — | — |
| 30174.1 | LAB367 | — | — | — | 3.43 | 0.83 | 2 | — | — | — |
| 30351.4 | LAB381 | — | — | — | 3.84 | 0.11 | 14 | — | — | — |
| 30352.2 | LAB381 | — | — | — | — | — | — | 0.97 | 0.54 | 35 |
| 30352.4 | LAB381 | — | — | — | 4.10 | 0.02 | 22 | 0.75 | 0.59 | 4 |
| 30354.2 | LAB381 | 10.50 | 0.57 | 4 | 4.25 | 0.01 | 26 | — | — | — |
| 30356.1 | LAB381 | — | — | — | 4.10 | 0.02 | 22 | — | — | — |
| 28111.3 | LAB383 | — | — | — | 3.75 | 0.20 | 11 | — | — | — |
| 28111.4 | LAB383 | — | — | — | 3.51 | 0.76 | 4 | — | — | — |
| 28114.2 | LAB383 | — | — | — | 3.63 | 0.47 | 8 | 0.72 | 0.97 | 1 |
| 28115.2 | LAB383 | — | — | — | — | — | — | 1.07 | 0.42 | 50 |
| 30271.2 | LAB64 | 10.31 | 0.11 | 2 | — | — | — | 1.01 | 0.52 | 41 |
| 30272.1 | LAB64 | 10.13 | 0.95 | 0 | 4.44 | 0.00 | 32 | 0.73 | 0.75 | 3 |
| 30273.2 | LAB64 | — | — | — | 3.52 | 0.62 | 4 | — | — | — |
| 30274.2 | LAB64 | — | — | — | 4.19 | 0.03 | 24 | — | — | — |
| 30274.3 | LAB64 | — | — | — | 3.95 | 0.05 | 17 | — | — | — |
| 30301.4 | LAB65 | 10.19 | 0.50 | 1 | 4.61 | 0.00 | 37 | 0.79 | 0.22 | 11 |
| 30302.1 | LAB65 | 10.25 | 0.77 | 1 | 3.97 | 0.05 | 18 | — | — | — |
| 30303.4 | LAB65 | 10.19 | 0.74 | 1 | 3.93 | 0.08 | 16 | 0.78 | 0.26 | 9 |
| 30304.3 | LAB65 | — | — | — | — | — | — | 0.94 | 0.50 | 32 |
| 29323.2 | LAB92 | — | — | — | 3.71 | 0.23 | 10 | — | — | — |
| 29324.2 | LAB92 | — | — | — | 3.54 | 0.54 | 5 | — | — | — |
| — | cont | 10.11 | — | 0 | 3.37 | — | 0 | 0.71 | — | 0 |
| 30781.1 | LAB138 | — | — | — | 3.61 | 0.34 | 13 | — | — | — |
| 30781.2 | LAB138 | — | — | — | 3.29 | 0.83 | 3 | — | — | — |
| 30781.5 | LAB138 | — | — | — | 3.63 | 0.31 | 14 | — | — | — |
| 30781.6 | LAB138 | — | — | — | 3.38 | 0.64 | 6 | — | — | — |
| 30783.2 | LAB138 | — | — | — | 3.26 | 0.86 | 2 | — | — | — |
| 30701.6 | LAB159 | — | — | — | 4.08 | 0.05 | 28 | — | — | — |
| 30702.3 | LAB159 | — | — | — | — | — | — | 0.85 | 0.89 | 5 |
| 30702.4 | LAB159 | 10.19 | 0.73 | 1 | 4.32 | 0.06 | 36 | — | — | — |
| 30704.3 | LAB159 | 10.81 | 0.34 | 7 | 4.49 | 0.02 | 41 | — | — | — |
| 30704.4 | LAB159 | — | — | — | 4.35 | 0.02 | 37 | — | — | — |
| 30482.1 | LAB161 | — | — | — | — | — | — | 0.83 | 0.87 | 3 |
| 30482.2 | LAB161 | 10.19 | 0.73 | 1 | — | — | — | 0.88 | 0.78 | 9 |
| 30483.1 | LAB161 | 10.50 | 0.32 | 4 | 4.35 | 0.06 | 37 | — | — | — |
| 30485.1 | LAB161 | — | — | — | — | — | — | 0.89 | 0.73 | 10 |
| 30486.1 | LAB161 | 10.44 | 0.04 | 3 | — | — | — | 1.02 | 0.51 | 27 |
| 30242.1 | LAB166 | — | — | — | 4.49 | 0.01 | 41 | — | — | — |
| 30243.1 | LAB166 | 10.69 | 0.28 | 6 | 3.27 | 0.97 | 3 | 1.01 | 0.56 | 25 |
| 30244.3 | LAB166 | — | — | — | 3.92 | 0.24 | 23 | — | — | — |
| 30245.3 | LAB166 | 10.13 | 0.97 | 0 | 4.08 | 0.05 | 28 | — | — | — |
| 30245.4 | LAB166 | — | — | — | 4.29 | 0.15 | 35 | — | — | — |
| 30712.2 | LAB170 | — | — | — | 3.97 | 0.10 | 24 | — | — | — |
| 30713.2 | LAB170 | 10.19 | 0.90 | 1 | 4.02 | 0.08 | 26 | — | — | — |
| 30715.1 | LAB170 | — | — | — | — | — | — | 0.92 | 0.67 | 14 |
| 30715.2 | LAB170 | — | — | — | 4.37 | 0.02 | 37 | — | — | — |
| 30141.4 | LAB176 | — | — | — | 3.49 | 0.51 | 10 | — | — | — |
| 30142.1 | LAB176 | — | — | — | — | — | — | 0.89 | 0.77 | 10 |
| 30143.1 | LAB176 | — | — | — | 3.78 | 0.23 | 19 | — | — | — |
| 30143.2 | LAB176 | — | — | — | 3.95 | 0.12 | 24 | — | — | — |
| 30722.2 | LAB188 | 10.13 | 0.84 | 0 | 3.86 | 0.21 | 21 | — | — | — |
| 30723.7 | LAB188 | — | — | — | 3.95 | 0.09 | 24 | — | — | — |
| 30724.1 | LAB188 | — | — | — | 3.61 | 0.53 | 13 | — | — | — |
| 30724.2 | LAB188 | — | — | — | 3.77 | 0.18 | 18 | — | — | — |

TABLE 76-continued

Genes showing improved plant photosynthetic capacity under high salinity conditions

| Gene Name | Event # | Leaf Number Ave. | Leaf Number P-Val. | Leaf Number % Incr. | Leaf Blade Area [cm2] Ave | Leaf Blade Area [cm2] P-Val | Leaf Blade Area [cm2] % Incr. | Leaf Petiole Length [cm] Ave. | Leaf Petiole Length [cm] P-Val. | Leaf Petiole Length [cm] % Incr. |
|---|---|---|---|---|---|---|---|---|---|---|
| 30281.4 | LAB237 | — | — | — | 3.52 | 0.55 | 11 | — | — | — |
| 30282.1 | LAB237 | — | — | — | 3.46 | 0.51 | 9 | — | — | — |
| 30283.2 | LAB237 | — | — | — | 3.81 | 0.20 | 20 | — | — | — |
| 30284.1 | LAB237 | — | — | — | 3.60 | 0.34 | 13 | — | — | — |
| 27112.1 | LAB259 | — | — | — | — | — | — | 0.85 | 0.86 | 6 |
| 27112.1 | LAB259 | — | — | — | 4.09 | 0.09 | 28 | — | — | — |
| 27112.3 | LAB259 | 10.13 | 0.94 | 0 | 4.27 | 0.02 | 34 | — | — | — |
| 27112.7 | LAB259 | — | — | — | 4.03 | 0.15 | 26 | — | — | — |
| 27112.9 | LAB259 | 10.13 | 0.84 | 0 | 3.99 | 0.14 | 25 | — | — | — |
| 30611.4 | LAB262 | — | — | — | 4.48 | 0.02 | 41 | — | — | — |
| 30612.1 | LAB262 | — | — | — | 3.73 | 0.28 | 17 | — | — | — |
| 30612.4 | LAB262 | — | — | — | — | — | — | 0.87 | 0.79 | 9 |
| 30614.1 | LAB262 | — | — | — | 4.13 | 0.05 | 30 | — | — | — |
| 30614.2 | LAB262 | 10.31 | 0.81 | 2 | 3.99 | 0.13 | 25 | — | — | — |
| 30591.2 | LAB270 | — | — | — | — | — | — | 0.84 | 0.84 | 4 |
| 30594.1 | LAB270 | — | — | — | 4.09 | 0.05 | 28 | — | — | — |
| 30594.3 | LAB270 | 10.31 | 0.62 | 2 | 4.03 | 0.09 | 26 | — | — | — |
| 30595.1 | LAB270 | 10.38 | 0.68 | 3 | 3.80 | 0.16 | 19 | — | — | — |
| 30595.2 | LAB270 | — | — | — | 4.60 | 0.09 | 44 | — | — | — |
| 30061.2 | LAB300 | 10.31 | 0.44 | 2 | 3.96 | 0.11 | 24 | — | — | — |
| 30062.2 | LAB300 | — | — | — | 4.18 | 0.08 | 31 | — | — | — |
| 30063.1 | LAB300 | — | — | — | 4.25 | 0.03 | 33 | — | — | — |
| 30064.1 | LAB300 | — | — | — | — | — | — | 0.95 | 0.48 | 18 |
| 30064.3 | LAB300 | 10.38 | 0.74 | 3 | — | — | — | 0.89 | 0.65 | 11 |
| 30561.2 | LAB306 | — | — | — | 4.19 | 0.12 | 31 | — | — | — |
| 30562.2 | LAB306 | — | — | — | — | — | — | 0.84 | 0.87 | 5 |
| 30563.2 | LAB306 | — | — | — | — | — | — | 0.92 | 0.72 | 14 |
| 30564.2 | LAB306 | 11.00 | 0.00 | 9 | 3.93 | 0.10 | 23 | — | — | — |
| 30564.3 | LAB306 | 10.38 | 0.68 | 3 | 3.95 | 0.09 | 24 | — | — | — |
| 30381.1 | LAB323 | 10.31 | 0.71 | 2 | 3.65 | 0.31 | 14 | — | — | — |
| 30381.4 | LAB323 | — | — | — | 3.73 | 0.28 | 17 | — | — | — |
| 30383.1 | LAB323 | 10.69 | 0.12 | 6 | 4.07 | 0.27 | 28 | — | — | — |
| 30383.2 | LAB323 | — | — | — | 3.99 | 0.08 | 25 | — | — | — |
| 30385.1 | LAB323 | — | — | — | 3.57 | 0.44 | 12 | — | — | — |
| 30441.1 | LAB347_H0 | 10.44 | 0.58 | 3 | 4.22 | 0.03 | 33 | — | — | — |
| 30442.4 | LAB347_H0 | — | — | — | 3.40 | 0.65 | 7 | — | — | — |
| 30443.4 | LAB347_H0 | 10.25 | 0.85 | 1 | 4.15 | 0.04 | 30 | — | — | — |
| 30444.1 | LAB347_H0 | 10.13 | 0.94 | 0 | — | — | — | 0.94 | 0.65 | 17 |
| 30444.3 | LAB347_H0 | 10.25 | 0.76 | 1 | 4.21 | 0.03 | 32 | — | — | — |
| 30022.3 | LAB55 | 10.88 | 0.35 | 8 | — | — | — | 0.93 | 0.62 | 16 |
| 30023.1 | LAB55 | 10.69 | 0.12 | 6 | 3.98 | 0.09 | 25 | — | — | — |
| 30023.3 | LAB55 | — | — | — | — | — | — | 0.90 | 0.81 | 11 |
| 30025.3 | LAB55 | 10.31 | 0.15 | 2 | 4.16 | 0.05 | 30 | — | — | — |
| 30025.4 | LAB55 | — | — | — | 3.45 | 0.58 | 8 | — | — | — |
| 30191.1 | LAB83 | 10.44 | 0.46 | 3 | — | — | — | 0.96 | 0.65 | 20 |
| 30191.3 | LAB83 | — | — | — | 3.38 | 0.65 | 6 | — | — | — |
| 30194.1 | LAB83 | — | — | — | 4.06 | 0.06 | 28 | — | — | — |
| 30194.2 | LAB83 | — | — | — | 3.56 | 0.46 | 12 | — | — | — |
| 30194.3 | LAB83 | 10.25 | 0.76 | 1 | 3.77 | 0.23 | 18 | — | — | — |
| 30681.4 | LAB94 | 10.81 | 0.09 | 7 | 4.04 | 0.39 | 27 | — | — | — |
| 30681.8 | LAB94 | 10.31 | 0.71 | 2 | 4.06 | 0.06 | 27 | — | — | — |
| 30682.2 | LAB94 | 10.44 | 0.04 | 3 | 4.11 | 0.05 | 29 | — | — | — |
| 30682.3 | LAB94 | 10.50 | 0.09 | 4 | 3.93 | 0.14 | 23 | — | — | — |
| 30684.2 | LAB94 | — | — | — | 3.42 | 0.57 | 8 | — | — | — |
| — | cont | 10.10 | — | 0 | 3.19 | — | 0 | 0.81 | — | 0 |
| 30781.1 | LAB138 | — | — | — | 2.70 | 0.11 | 22 | 0.50 | 0.44 | 3 |
| 30781.2 | LAB138 | — | — | — | 2.40 | 0.48 | 9 | 0.49 | 0.78 | 1 |
| 30783.2 | LAB138 | 8.81 | 0.82 | 0 | 2.41 | 0.63 | 9 | — | — | — |
| 30701.6 | LAB159 | — | — | — | 2.46 | 0.40 | 12 | — | — | — |
| 30702.3 | LAB159 | 8.88 | 0.62 | 1 | 2.87 | 0.04 | 30 | 0.52 | 0.41 | 7 |
| 30702.4 | LAB159 | — | — | — | 2.95 | 0.17 | 34 | 0.49 | 0.82 | 2 |
| 30704.3 | LAB159 | — | — | — | 2.68 | 0.11 | 22 | 0.50 | 0.33 | 3 |
| 30704.4 | LAB159 | — | — | — | 2.59 | 0.37 | 17 | 0.49 | 0.93 | 1 |
| 30482.1 | LAB161 | — | — | — | 2.38 | 0.65 | 8 | — | — | — |
| 30482.2 | LAB161 | — | — | — | 2.49 | 0.31 | 13 | — | — | — |
| 30483.1 | LAB161 | — | — | — | 2.60 | 0.22 | 18 | — | — | — |
| 30485.1 | LAB161 | — | — | — | 2.71 | 0.10 | 23 | 0.54 | 0.10 | 10 |
| 30486.1 | LAB161 | — | — | — | 2.67 | 0.12 | 21 | — | — | — |
| 30242.1 | LAB166 | — | — | — | 2.48 | 0.37 | 12 | — | — | — |
| 30243.1 | LAB166 | 8.94 | 0.56 | 2 | 2.63 | 0.22 | 19 | — | — | — |
| 30244.3 | LAB166 | — | — | — | 3.03 | 0.02 | 37 | 0.50 | 0.38 | 3 |

TABLE 76-continued

Genes showing improved plant photosynthetic capacity under high salinity conditions

| Gene Name | Event # | Leaf Number Ave. | Leaf Number P-Val. | Leaf Number % Incr. | Leaf Blade Area [cm2] Ave | Leaf Blade Area [cm2] P-Val | Leaf Blade Area [cm2] % Incr. | Leaf Petiole Length [cm] Ave. | Leaf Petiole Length [cm] P-Val. | Leaf Petiole Length [cm] % Incr. |
|---|---|---|---|---|---|---|---|---|---|---|
| 30245.3 | LAB166 | — | — | — | 2.82 | 0.09 | 28 | — | — | — |
| 30245.4 | LAB166 | — | — | — | 3.04 | 0.01 | 38 | 0.51 | 0.15 | 5 |
| 30712.1 | LAB170 | — | — | — | 2.84 | 0.04 | 29 | 0.49 | 0.79 | 1 |
| 30712.2 | LAB170 | — | — | — | 2.77 | 0.27 | 26 | 0.49 | 0.94 | 1 |
| 30713.2 | LAB170 | — | — | — | 2.54 | 0.46 | 15 | 0.52 | 0.49 | 7 |
| 30715.1 | LAB170 | — | — | — | — | — | — | 0.53 | 0.71 | 8 |
| 30715.2 | LAB170 | — | — | — | 2.84 | 0.05 | 29 | — | — | — |
| 30141.4 | LAB176 | — | — | — | — | — | — | 0.63 | 0.52 | 30 |
| 30142.1 | LAB176 | 9.00 | 0.66 | 2 | 2.85 | 0.04 | 29 | 0.51 | 0.35 | 5 |
| 30143.1 | LAB176 | — | — | — | 2.71 | 0.10 | 23 | 0.51 | 0.20 | 5 |
| 30143.2 | LAB176 | 9.00 | 0.54 | 2 | 2.93 | 0.03 | 33 | 0.53 | 0.40 | 8 |
| 30144.2 | LAB176 | — | — | — | 2.73 | 0.12 | 24 | 0.54 | 0.15 | 11 |
| 30724.2 | LAB188 | — | — | — | 2.26 | 0.85 | 2 | — | — | — |
| 30281.4 | LAB237 | 9.00 | 0.10 | 2 | 2.66 | 0.26 | 21 | 0.51 | 0.52 | 4 |
| 30282.1 | LAB237 | — | — | — | 2.65 | 0.13 | 20 | 0.49 | 0.89 | 0 |
| 30283.2 | LAB237 | 8.88 | 0.62 | 1 | 2.56 | 0.24 | 16 | 0.50 | 0.63 | 2 |
| 30283.4 | LAB237 | — | — | — | 2.32 | 0.72 | 5 | — | — | — |
| 30284.1 | LAB237 | — | — | — | 2.39 | 0.51 | 8 | 0.49 | 0.73 | 1 |
| 27112.1 | LAB259 | 8.88 | 0.85 | 1 | 2.42 | 0.54 | 10 | 0.52 | 0.46 | 6 |
| 27112.1 | LAB259 | — | — | — | — | — | — | 0.62 | 0.43 | 27 |
| 27112.3 | LAB259 | 9.19 | 0.66 | 5 | 2.99 | 0.02 | 36 | 0.52 | 0.29 | 7 |
| 27112.7 | LAB259 | — | — | — | — | — | — | 0.64 | 0.49 | 32 |
| 27112.9 | LAB259 | 8.88 | 0.85 | 1 | 3.20 | 0.01 | 45 | 0.55 | 0.01 | 12 |
| 30612.1 | LAB262 | — | — | — | 2.24 | 0.91 | 2 | — | — | — |
| 30612.4 | LAB262 | — | — | — | — | — | — | 0.51 | 0.88 | 4 |
| 30614.1 | LAB262 | — | — | — | 2.29 | 0.80 | 4 | — | — | — |
| 30614.2 | LAB262 | — | — | — | 2.88 | 0.11 | 31 | 0.51 | 0.53 | 6 |
| 30591.2 | LAB270 | — | — | — | 2.66 | 0.13 | 21 | 0.50 | 0.52 | 2 |
| 30594.1 | LAB270 | — | — | — | 2.46 | 0.39 | 12 | 0.49 | 0.93 | 1 |
| 30595.2 | LAB270 | — | — | — | 2.32 | 0.68 | 5 | — | — | — |
| 30061.2 | LAB300 | 8.88 | 0.78 | 1 | 2.46 | 0.45 | 11 | — | — | — |
| 30064.1 | LAB300 | — | — | — | 2.37 | 0.60 | 8 | — | — | — |
| 30064.3 | LAB300 | — | — | — | 2.70 | 0.10 | 23 | 0.52 | 0.27 | 7 |
| 30561.2 | LAB306 | — | — | — | 2.43 | 0.41 | 10 | — | — | — |
| 30562.2 | LAB306 | 8.81 | 0.94 | 0 | 2.51 | 0.28 | 14 | — | — | — |
| 30563.2 | LAB306 | — | — | — | 2.49 | 0.44 | 13 | 0.49 | 0.89 | 1 |
| 30564.2 | LAB306 | 8.94 | 0.56 | 2 | 2.69 | 0.36 | 22 | 0.54 | 0.55 | 10 |
| 30564.3 | LAB306 | — | — | — | 2.91 | 0.03 | 32 | 0.55 | 0.01 | 13 |
| 30381.1 | LAB323 | — | — | — | 2.35 | 0.66 | 7 | — | — | — |
| 30381.4 | LAB323 | — | — | — | 2.54 | 0.23 | 15 | — | — | — |
| 30383.1 | LAB323 | — | — | — | 2.68 | 0.27 | 22 | 0.52 | 0.20 | 6 |
| 30442.4 | LAB347__H0 | — | — | — | — | — | — | 0.54 | 0.71 | 11 |
| 30194.1 | LAB83 | — | — | — | — | — | — | 0.56 | 0.01 | 15 |
| 30681.4 | LAB94 | — | — | — | 2.25 | 0.88 | 2 | — | — | — |
| 30681.8 | LAB94 | — | — | — | 2.38 | 0.77 | 8 | — | — | — |
| 30682.2 | LAB94 | — | — | — | — | — | — | 0.55 | 0.62 | 13 |
| 30682.3 | LAB94 | — | — | — | 2.24 | 0.95 | 1 | — | — | — |
| — | cont | 8.78 | — | 0 | 2.21 | — | 0 | 0.49 | — | 0 |
| 30451.3 | LAB182 | — | — | — | 2.94 | 0.49 | 6 | 0.55 | 0.48 | 2 |
| 30453.4 | LAB182 | 9.56 | 0.07 | 7 | 3.45 | 0.35 | 24 | 0.61 | 0.34 | 14 |
| 30454.2 | LAB182 | 9.06 | 0.82 | 2 | 2.84 | 0.54 | 2 | 0.56 | 0.57 | 4 |
| 30455.2 | LAB182 | — | — | — | 2.87 | 0.21 | 3 | 0.56 | 0.13 | 3 |
| 28153.2 | LAB191 | — | — | — | 2.82 | 0.65 | 2 | — | — | — |
| 28156.2 | LAB191 | — | — | — | 3.10 | 0.24 | 12 | 0.58 | 0.47 | 7 |
| 28156.4 | LAB191 | — | — | — | 2.84 | 0.46 | 2 | 0.55 | 0.74 | 2 |
| 30122.2 | LAB221 | 9.25 | 0.51 | 4 | 3.73 | 0.01 | 34 | 0.66 | 0.14 | 23 |
| 30123.2 | LAB221 | — | — | — | 2.90 | 0.10 | 5 | — | — | — |
| 30124.4 | LAB221 | 9.19 | 0.51 | 3 | 3.13 | 0.00 | 13 | 0.60 | 0.00 | 11 |
| 30125.2 | LAB221 | 9.50 | 0.03 | 7 | 3.43 | 0.19 | 24 | 0.59 | 0.45 | 10 |
| 30472.2 | LAB222 | — | — | — | 3.01 | 0.62 | 8 | 0.57 | 0.63 | 6 |
| 30473.1 | LAB222 | — | — | — | 3.16 | 0.00 | 14 | 0.57 | 0.11 | 6 |
| 30474.1 | LAB222 | 9.25 | 0.78 | 4 | — | — | — | 0.79 | 0.39 | 47 |
| 30476.1 | LAB222 | 9.19 | 0.17 | 3 | 3.12 | 0.00 | 12 | 0.60 | 0.15 | 11 |
| 30476.2 | LAB222 | 9.38 | 0.07 | 5 | 3.13 | 0.26 | 13 | 0.57 | 0.54 | 6 |
| 30491.4 | LAB225 | 9.06 | 0.77 | 2 | 3.26 | 0.09 | 18 | 0.60 | 0.28 | 11 |
| 30492.2 | LAB225 | 9.50 | 0.32 | 7 | 3.63 | 0.00 | 31 | 0.70 | 0.03 | 30 |
| 30493.1 | LAB225 | 9.31 | 0.06 | 5 | 3.07 | 0.14 | 11 | 0.56 | 0.07 | 4 |
| 30461.5 | LAB232 | — | — | — | 2.89 | 0.74 | 4 | — | — | — |
| 30462.4 | LAB232 | 9.13 | 0.35 | 3 | 3.34 | 0.00 | 20 | 0.64 | 0.00 | 18 |
| 30462.5 | LAB232 | — | — | — | — | — | — | 0.70 | 0.47 | 29 |
| 30071.4 | LAB260 | — | — | — | 3.28 | 0.12 | 18 | 0.59 | 0.00 | 9 |

TABLE 76-continued

Genes showing improved plant photosynthetic capacity under high salinity conditions

| Gene Name | Event # | Leaf Number | | | Leaf Blade Area [cm2] | | | Leaf Petiole Length [cm] | | |
|---|---|---|---|---|---|---|---|---|---|---|
| | | Ave. | P-Val. | % Incr. | Ave | P-Val | % Incr. | Ave. | P-Val. | % Incr. |
| 30072.2 | LAB260 | — | | — | 3.34 | 0.13 | 20 | 0.60 | 0.00 | 11 |
| 30073.2 | LAB260 | 9.44 | 0.12 | 6 | 3.43 | 0.39 | 24 | 0.65 | 0.36 | 20 |
| 30073.4 | LAB260 | — | | — | — | | — | 0.72 | 0.56 | 34 |
| 30074.3 | LAB260 | — | | — | 2.84 | 0.67 | 2 | — | | — |
| 30131.1 | LAB264 | 9.63 | 0.12 | 8 | 3.09 | 0.07 | 11 | 0.56 | 0.34 | 4 |
| 30133.2 | LAB264 | — | | — | 3.00 | 0.47 | 8 | 0.57 | 0.59 | 5 |
| 30134.4 | LAB264 | 9.06 | 0.70 | 2 | 3.64 | 0.12 | 31 | 0.61 | 0.12 | 12 |
| 30731.3 | LAB265 | 9.00 | 0.83 | 1 | 3.00 | 0.37 | 8 | 0.56 | 0.47 | 3 |
| 30733.4 | LAB265 | — | | — | — | | — | 0.54 | 0.78 | 1 |
| 30734.4 | LAB265 | — | | — | — | | — | 0.55 | 0.93 | 2 |
| 30661.2 | LAB290_H0 | 9.00 | 0.77 | 1 | 3.27 | 0.32 | 18 | 0.57 | 0.60 | 7 |
| 30662.3 | LAB290_H0 | — | | — | 3.07 | 0.57 | 11 | 0.56 | 0.81 | 3 |
| 30663.3 | LAB290_H0 | — | | — | 3.08 | 0.45 | 11 | 0.55 | 0.82 | 2 |
| 30663.7 | LAB290_H0 | — | | — | 3.00 | 0.01 | 8 | 0.54 | 0.97 | 0 |
| 30421.3 | LAB303 | 9.00 | 0.93 | 1 | 3.09 | 0.21 | 11 | 0.57 | 0.35 | 5 |
| 30761.1 | LAB307 | — | | — | 2.85 | 0.84 | 3 | — | | — |
| 30761.5 | LAB307 | — | | — | 3.41 | 0.00 | 23 | 0.57 | 0.32 | 6 |
| 30763.3 | LAB307 | 8.94 | 0.84 | 0 | 3.12 | 0.00 | 13 | 0.58 | 0.10 | 8 |
| 30764.1 | LAB307 | — | | — | 3.41 | 0.11 | 23 | — | | — |
| 30764.4 | LAB307 | — | | — | 3.04 | 0.19 | 10 | 0.55 | 0.50 | 2 |
| 30931.4 | LAB308 | — | | — | — | | — | 0.70 | 0.38 | 30 |
| 30932.3 | LAB308 | 10.38 | 0.10 | 17 | 3.69 | 0.13 | 33 | 0.66 | 0.08 | 22 |
| 30933.2 | LAB308 | — | | — | 2.97 | 0.05 | 7 | 0.55 | 0.46 | 3 |
| 30933.3 | LAB308 | — | | — | 2.90 | 0.17 | 5 | 0.56 | 0.10 | 3 |
| 30934.4 | LAB308 | — | | — | 2.90 | 0.70 | 4 | — | | — |
| 30771.5 | LAB319 | — | | — | — | | — | 0.67 | 0.50 | 24 |
| 30774.1 | LAB319 | — | | — | 3.05 | 0.34 | 10 | 0.60 | 0.01 | 11 |
| 30774.3 | LAB319 | 9.19 | 0.17 | 3 | 2.88 | 0.14 | 4 | 0.57 | 0.26 | 7 |
| 30775.2 | LAB319 | — | | — | 2.84 | 0.63 | 2 | 0.56 | 0.30 | 4 |
| 30775.4 | LAB319 | 9.00 | 0.77 | 1 | 3.08 | 0.28 | 11 | 0.57 | 0.42 | 7 |
| 30601.3 | LAB320 | 9.31 | 0.20 | 5 | 2.85 | 0.80 | 3 | 0.57 | 0.59 | 6 |
| 30602.2 | LAB320 | — | | — | 2.81 | 0.83 | 1 | — | | — |
| 30605.1 | LAB320 | 9.00 | 0.66 | 1 | — | | — | — | | — |
| 30622.2 | LAB343 | 9.13 | 0.25 | 3 | 2.86 | 0.82 | 3 | 0.59 | 0.12 | 10 |
| 30623.4 | LAB343 | 9.00 | 0.91 | 1 | 2.98 | 0.65 | 8 | 0.58 | 0.64 | 8 |
| 30623.5 | LAB343 | — | | — | — | | — | 0.54 | 0.90 | 1 |
| 30504.3 | LAB348 | — | | — | 2.83 | 0.77 | 2 | — | | — |
| 30551.3 | LAB353 | — | | — | — | | — | 0.58 | 0.81 | 7 |
| 30551.4 | LAB353 | 9.06 | 0.57 | 2 | — | | — | — | | — |
| 30553.1 | LAB353 | — | | — | 2.88 | 0.71 | 4 | 0.57 | 0.45 | 5 |
| 30554.2 | LAB353 | 9.13 | 0.73 | 3 | 3.13 | 0.35 | 13 | 0.59 | 0.29 | 9 |
| 30554.3 | LAB353 | 9.13 | 0.65 | 3 | 3.17 | 0.27 | 14 | 0.58 | 0.52 | 7 |
| — | cont | 8.90 | — | 0 | 2.77 | — | 0 | 0.54 | — | 0 |
| 30451.3 | LAB182 | 10.13 | 0.67 | 4 | — | | — | 0.85 | 0.80 | 5 |
| 30453.4 | LAB182 | 10.69 | 0.32 | 9 | 4.54 | 0.03 | 48 | — | | — |
| 30454.2 | LAB182 | — | | — | 3.58 | 0.37 | 16 | — | | — |
| 30455.2 | LAB182 | 10.19 | 0.65 | 4 | 3.46 | 0.49 | 12 | — | | — |
| 28152.1 | LAB191 | 9.88 | 0.68 | 1 | 3.99 | 0.13 | 30 | — | | — |
| 28153.1 | LAB191 | 10.00 | 0.54 | 2 | 4.00 | 0.16 | 30 | — | | — |
| 28153.2 | LAB191 | — | | — | 3.14 | 0.90 | 2 | — | | — |
| 28156.2 | LAB191 | — | | — | 3.27 | 0.72 | 6 | — | | — |
| 28156.4 | LAB191 | 10.25 | 0.40 | 5 | 4.25 | 0.08 | 38 | — | | — |
| 30122.2 | LAB221 | 9.88 | 0.77 | 1 | 3.70 | 0.43 | 20 | — | | — |
| 30123.2 | LAB221 | 10.13 | 0.20 | 4 | 4.28 | 0.09 | 39 | — | | — |
| 30124.3 | LAB221 | — | | — | 3.73 | 0.44 | 21 | — | | — |
| 30124.4 | LAB221 | — | | — | 3.85 | 0.20 | 25 | — | | — |
| 30472.1 | LAB222 | 10.44 | 0.02 | 7 | 4.30 | 0.06 | 40 | — | | — |
| 30472.2 | LAB222 | 10.31 | 0.13 | 6 | — | | — | 0.88 | 0.80 | 9 |
| 30473.1 | LAB222 | 10.06 | 0.62 | 3 | 4.37 | 0.05 | 42 | — | | — |
| 30474.1 | LAB222 | — | | — | 3.83 | 0.20 | 25 | — | | — |
| 30476.1 | LAB222 | 10.00 | 0.54 | 2 | 3.94 | 0.15 | 28 | — | | — |
| 30476.2 | LAB222 | 9.81 | 0.95 | 0 | 4.65 | 0.02 | 51 | — | | — |
| 30491.4 | LAB225 | — | | — | 3.96 | 0.14 | 29 | — | | — |
| 30492.1 | LAB225 | — | | — | 3.80 | 0.21 | 24 | — | | — |
| 30492.2 | LAB225 | 10.50 | 0.50 | 7 | 3.14 | 0.97 | 2 | 0.96 | 0.64 | 19 |
| 30493.1 | LAB225 | — | | — | 3.09 | 0.98 | 1 | — | | — |
| 30493.2 | LAB225 | — | | — | 4.32 | 0.05 | 41 | — | | — |
| 30461.5 | LAB232 | — | | — | 3.77 | 0.27 | 23 | — | | — |
| 30462.3 | LAB232 | — | | — | 3.11 | 0.95 | 1 | — | | — |
| 30462.4 | LAB232 | 9.94 | 0.70 | 2 | 4.33 | 0.05 | 41 | — | | — |
| 30462.5 | LAB232 | — | | — | 3.84 | 0.19 | 25 | — | | — |

TABLE 76-continued

Genes showing improved plant photosynthetic capacity under high salinity conditions

| Gene Name | Event # | Leaf Number | | | Leaf Blade Area [cm2] | | | Leaf Petiole Length [cm] | | |
|---|---|---|---|---|---|---|---|---|---|---|
| | | Ave. | P-Val. | % Incr. | Ave | P-Val | % Incr. | Ave. | P-Val. | % Incr. |
| 30463.2 | LAB232 | — | | — | 3.33 | 0.65 | 8 | — | | — |
| 30071.4 | LAB260 | — | | — | 4.00 | 0.16 | 30 | — | | — |
| 30072.2 | LAB260 | 9.94 | 0.58 | 2 | 4.37 | 0.04 | 42 | — | | — |
| 30073.2 | LAB260 | — | | — | 3.67 | 0.33 | 19 | — | | — |
| 30073.4 | LAB260 | 9.81 | 0.85 | 0 | 4.29 | 0.11 | 39 | — | | — |
| 30074.3 | LAB260 | — | | — | 3.47 | 0.48 | 13 | — | | — |
| 30131.1 | LAB264 | 9.94 | 0.82 | 2 | 4.13 | 0.10 | 34 | — | | — |
| 30131.2 | LAB264 | 10.19 | 0.38 | 4 | — | | — | 0.92 | 0.71 | 14 |
| 30133.2 | LAB264 | — | | — | 3.92 | 0.21 | 28 | — | | — |
| 30134.4 | LAB264 | — | | — | 3.88 | 0.27 | 26 | — | | — |
| 30135.2 | LAB264 | — | | — | 4.20 | 0.07 | 37 | — | | — |
| 30731.3 | LAB265 | — | | — | — | | — | 0.88 | 0.82 | 9 |
| 30732.2 | LAB265 | — | | — | 4.02 | 0.14 | 31 | — | | — |
| 30732.3 | LAB265 | — | | — | 3.89 | 0.17 | 26 | — | | — |
| 30733.4 | LAB265 | — | | — | 3.97 | 0.14 | 29 | — | | — |
| 30734.1 | LAB265 | — | | — | 3.51 | 0.43 | 14 | — | | — |
| 30734.4 | LAB265 | 9.94 | 0.85 | 2 | 3.91 | 0.20 | 27 | — | | — |
| 30661.2 | LAB290_H0 | — | | — | 4.35 | 0.05 | 41 | — | | — |
| 30662.3 | LAB290_H0 | 11.00 | 0.27 | 13 | 4.12 | 0.09 | 34 | — | | — |
| 30663.1 | LAB290_H0 | — | | — | 4.54 | 0.06 | 48 | — | | — |
| 30663.3 | LAB290_H0 | — | | — | — | | — | 0.86 | 0.87 | 7 |
| 30663.7 | LAB290_H0 | 9.81 | 0.94 | 0 | 4.34 | 0.05 | 41 | — | | — |
| 30761.1 | LAB307 | — | | — | 3.67 | 0.29 | 19 | — | | — |
| 30761.5 | LAB307 | — | | — | 3.98 | 0.14 | 29 | — | | — |
| 30763.3 | LAB307 | — | | — | 3.27 | 0.78 | 6 | — | | — |
| 30764.1 | LAB307 | — | | — | 4.11 | 0.10 | 34 | — | | — |
| 30764.4 | LAB307 | 10.31 | 0.04 | 6 | — | | — | 0.90 | 0.74 | 11 |
| 30931.4 | LAB308 | 10.19 | 0.59 | 4 | 3.90 | 0.17 | 27 | — | | — |
| 30932.3 | LAB308 | 10.25 | 0.10 | 5 | 4.38 | 0.08 | 43 | — | | — |
| 30933.2 | LAB308 | — | | — | 4.00 | 0.12 | 30 | — | | — |
| 30933.3 | LAB308 | 9.94 | 0.70 | 2 | — | | — | 0.93 | 0.69 | 15 |
| 30934.4 | LAB308 | 10.13 | 0.60 | 4 | 4.18 | 0.08 | 36 | — | | — |
| 30771.5 | LAB319 | 10.19 | 0.10 | 4 | 4.65 | 0.02 | 51 | — | | — |
| 30774.1 | LAB319 | — | | — | 4.15 | 0.08 | 35 | — | | — |
| 30774.3 | LAB319 | 9.94 | 0.58 | 2 | 4.03 | 0.11 | 31 | — | | — |
| 30775.1 | LAB319 | 9.81 | 0.96 | 0 | 4.43 | 0.06 | 44 | — | | — |
| 30775.2 | LAB319 | 10.25 | 0.10 | 5 | 3.98 | 0.14 | 30 | — | | — |
| 30775.4 | LAB319 | 9.88 | 0.77 | 1 | 3.86 | 0.25 | 26 | — | | — |
| 30601.2 | LAB320 | — | | — | — | | — | 0.86 | 0.77 | 7 |
| 30601.3 | LAB320 | 9.94 | 0.58 | 2 | 4.32 | 0.05 | 40 | — | | — |
| 30601.4 | LAB320 | — | | — | 3.67 | 0.47 | 19 | — | | — |
| 30602.2 | LAB320 | — | | — | 4.28 | 0.06 | 39 | — | | — |
| 30603.1 | LAB320 | — | | — | 4.33 | 0.06 | 41 | — | | — |
| 30605.1 | LAB320 | — | | — | 4.21 | 0.08 | 37 | — | | — |
| 30622.2 | LAB343 | — | | — | 3.15 | 0.91 | 2 | — | | — |
| 30622.4 | LAB343 | 10.06 | 0.62 | 3 | 4.13 | 0.09 | 34 | — | | — |
| 30623.4 | LAB343 | 10.00 | 0.39 | 2 | 4.40 | 0.13 | 43 | — | | — |
| 30623.5 | LAB343 | — | | — | 3.30 | 0.69 | 7 | — | | — |
| 30503.1 | LAB348 | — | | — | 4.20 | 0.07 | 37 | — | | — |
| 30503.3 | LAB348 | — | | — | 3.19 | 0.91 | 4 | — | | — |
| 30504.2 | LAB348 | — | | — | 3.90 | 0.16 | 27 | — | | — |
| 30504.3 | LAB348 | — | | — | 3.50 | 0.46 | 14 | — | | — |
| 30506.2 | LAB348 | — | | — | 4.22 | 0.08 | 37 | — | | — |
| 30551.3 | LAB353 | 9.94 | 0.58 | 2 | — | | — | — | | — |
| 30551.4 | LAB353 | — | | — | 4.04 | 0.17 | 31 | — | | — |
| 30553.1 | LAB353 | — | | — | 3.43 | 0.62 | 12 | — | | — |
| 30554.2 | LAB353 | — | | — | 3.88 | 0.17 | 26 | — | | — |
| 30554.3 | LAB353 | — | | — | 3.84 | 0.19 | 25 | — | | — |
| — | cont | 9.77 | — | 0 | 3.08 | — | 0 | 0.81 | — | 0 |
| 28502.2 | LAB108 | 9.63 | 0.16 | 4 | — | | — | 0.68 | 0.46 | 4 |
| 28505.4 | LAB108 | — | | — | — | | — | 0.76 | 0.63 | 16 |
| 28412.1 | LAB119 | 9.38 | 0.86 | 1 | — | | — | 0.67 | 0.89 | 2 |
| 28413.1 | LAB119 | — | | — | — | | — | 0.68 | 0.34 | 4 |
| 28142.3 | LAB157 | 9.56 | 0.16 | 3 | — | | — | — | | — |
| 28145.2 | LAB157 | 9.75 | 0.52 | 5 | — | | — | — | | — |
| 28146.1 | LAB157 | 9.31 | 0.89 | 0 | — | | — | — | | — |
| 28146.2 | LAB157 | 9.50 | 0.75 | 2 | — | | — | 0.81 | 0.51 | 24 |
| 28585.1 | LAB231 | 9.31 | 0.97 | 0 | — | | — | — | | — |
| 28425.5 | LAB238 | 9.50 | 0.35 | 2 | — | | — | — | | — |
| 28592.5 | LAB240 | 9.44 | 0.59 | 2 | — | | — | — | | — |
| 28592.6 | LAB240 | 9.31 | 0.89 | 0 | — | | — | — | | — |

TABLE 76-continued

Genes showing improved plant photosynthetic capacity under high salinity conditions

| Gene Name | Event # | Leaf Number Ave. | P-Val. | % Incr. | Leaf Blade Area [cm2] Ave | P-Val | % Incr. | Leaf Petiole Length [cm] Ave. | P-Val. | % Incr. |
|---|---|---|---|---|---|---|---|---|---|---|
| 28595.1 | LAB240 | — | — | — | — | — | — | 0.67 | 0.24 | 3 |
| 28595.3 | LAB240 | 9.44 | 0.42 | 2 | — | — | — | — | — | — |
| 28085.5 | LAB242 | — | — | — | — | — | — | 0.86 | 0.60 | 32 |
| 28381.2 | LAB267 | 9.44 | 0.59 | 2 | — | — | — | — | — | — |
| 28383.2 | LAB267 | 9.56 | 0.16 | 3 | — | — | — | 0.67 | 0.39 | 3 |
| 28384.5 | LAB267 | — | — | — | — | — | — | 0.68 | 0.31 | 4 |
| 28343.4 | LAB269 | — | — | — | — | — | — | 0.86 | 0.43 | 31 |
| 28345.3 | LAB269 | 9.63 | 0.38 | 4 | — | — | — | — | — | — |
| 28351.1 | LAB279 | 9.63 | 0.38 | 4 | — | — | — | — | — | — |
| 28351.4 | LAB279 | 9.50 | 0.35 | 2 | — | — | — | — | — | — |
| 28353.2 | LAB279 | 9.44 | 0.84 | 2 | — | — | — | — | — | — |
| 28361.1 | LAB283 | 9.31 | 0.89 | 0 | — | — | — | 0.70 | 0.01 | 7 |
| 28364.3 | LAB283 | — | — | — | — | — | — | 0.81 | 0.54 | 24 |
| 28365.1 | LAB283 | — | — | — | — | — | — | 0.67 | 0.46 | 2 |
| 28063.1 | LAB299 | 9.56 | 0.64 | 3 | 3.66 | 0.78 | 1 | — | — | — |
| 28064.1 | LAB299 | — | — | — | — | — | — | 0.67 | 0.27 | 3 |
| 28066.1 | LAB299 | 9.38 | 0.61 | 1 | 3.71 | 0.80 | 3 | 0.70 | 0.41 | 7 |
| 28495.1 | LAB345 | 9.31 | 0.89 | 0 | — | — | — | — | — | — |
| — | cont | 9.29 | — | 0 | 3.61 | — | 0 | 0.65 | — | 0 |
| 30641.5 | LAB101 | 10.69 | 0.41 | 5 | 4.82 | 0.44 | 12 | — | — | — |
| 30644.2 | LAB101 | 10.38 | 0.77 | 2 | — | — | — | 1.00 | 0.57 | 23 |
| 30644.4 | LAB101 | 10.44 | 0.32 | 3 | — | — | — | 0.93 | 0.66 | 14 |
| 30532.3 | LAB107 | 10.44 | 0.69 | 3 | 4.59 | 0.70 | 7 | — | — | — |
| 30533.4 | LAB107 | 11.03 | 0.36 | 9 | 4.86 | 0.35 | 13 | — | — | — |
| 30534.3 | LAB107 | 10.88 | 0.59 | 7 | 4.93 | 0.57 | 15 | — | — | — |
| 30535.2 | LAB107 | 11.06 | 0.15 | 9 | — | — | — | 1.01 | 0.59 | 24 |
| 30801.4 | LAB121 | 10.50 | 0.66 | 4 | 4.59 | 0.67 | 7 | — | — | — |
| 30802.1 | LAB121 | 10.94 | 0.00 | 8 | — | — | — | 1.25 | 0.12 | 53 |
| 30803.1 | LAB121 | — | — | — | 4.52 | 0.76 | 5 | — | — | — |
| 30804.1 | LAB121 | 10.38 | 0.87 | 2 | — | — | — | 0.82 | 0.99 | 0 |
| 30822.2 | LAB129 | 10.38 | 0.22 | 2 | 4.33 | 0.97 | 1 | — | — | — |
| 30824.2 | LAB129 | 10.19 | 0.93 | 0 | — | — | — | — | — | — |
| 30825.1 | LAB129 | 10.38 | 0.72 | 2 | — | — | — | 0.92 | 0.58 | 13 |
| 30825.5 | LAB129 | — | — | — | — | — | — | 0.87 | 0.51 | 7 |
| 30541.3 | LAB130 | — | — | — | — | — | — | 0.85 | 0.88 | 5 |
| 30542.1 | LAB130 | — | — | — | — | — | — | 1.09 | 0.00 | 34 |
| 30544.2 | LAB130 | 11.38 | 0.00 | 12 | 4.56 | 0.75 | 6 | — | — | — |
| 30545.1 | LAB130 | 10.63 | 0.24 | 5 | 4.95 | 0.30 | 15 | — | — | — |
| 30545.2 | LAB130 | 11.06 | 0.33 | 9 | 4.62 | 0.59 | 7 | — | — | — |
| 30831.3 | LAB163 | 11.50 | 0.12 | 13 | — | — | — | 1.06 | 0.52 | 30 |
| 30832.2 | LAB163 | 10.81 | 0.34 | 7 | 4.70 | 0.58 | 9 | — | — | — |
| 30833.1 | LAB163 | 10.63 | 0.07 | 5 | 4.47 | 0.78 | 4 | — | — | — |
| 30833.2 | LAB163 | — | — | — | — | — | — | 0.89 | 0.74 | 9 |
| 30834.2 | LAB163 | 11.13 | 0.00 | 10 | 5.54 | 0.27 | 29 | — | — | — |
| 30522.4 | LAB164 | 10.56 | 0.58 | 4 | — | — | — | — | — | — |
| 30523.3 | LAB164 | 10.66 | 0.04 | 5 | 4.50 | 0.74 | 5 | — | — | — |
| 30524.1 | LAB164 | 11.06 | 0.04 | 9 | 5.16 | 0.18 | 20 | — | — | — |
| 30525.2 | LAB164 | 10.38 | 0.51 | 2 | — | — | — | 0.95 | 0.50 | 17 |
| 30525.3 | LAB164 | 10.81 | 0.22 | 7 | 5.43 | 0.12 | 26 | — | — | — |
| 30841.3 | LAB171 | — | — | — | 4.70 | 0.52 | 9 | — | — | — |
| 30841.4 | LAB171 | 10.81 | 0.22 | 7 | — | — | — | 0.94 | 0.48 | 15 |
| 30842.3 | LAB171 | 10.38 | 0.72 | 2 | — | — | — | 0.96 | 0.43 | 17 |
| 30843.2 | LAB171 | 10.56 | 0.38 | 4 | 4.78 | 0.63 | 11 | — | — | — |
| 30845.1 | LAB171 | 10.25 | 0.82 | 1 | 4.93 | 0.31 | 15 | — | — | — |
| 30852.3 | LAB172 | 10.69 | 0.29 | 5 | — | — | — | — | — | — |
| 30852.4 | LAB172 | 10.31 | 0.76 | 2 | — | — | — | 0.92 | 0.75 | 12 |
| 30853.4 | LAB172 | 10.14 | 0.99 | 0 | 4.33 | 0.96 | 1 | — | — | — |
| 30854.1 | LAB172 | 10.44 | 0.50 | 3 | 5.10 | 0.21 | 19 | — | — | — |
| 30854.4 | LAB172 | — | — | — | 4.49 | 0.81 | 4 | — | — | — |
| 30855.3 | LAB172 | 10.50 | 0.35 | 4 | 4.70 | 0.50 | 9 | — | — | — |
| 30513.4 | LAB175 | 10.56 | 0.50 | 4 | 4.60 | 0.73 | 7 | — | — | — |
| 30514.4 | LAB175 | — | — | — | — | — | — | 1.06 | 0.01 | 30 |
| 30862.3 | LAB204 | 10.19 | 0.90 | 0 | — | — | — | — | — | — |
| 30863.1 | LAB204 | 10.25 | 0.86 | 1 | — | — | — | 0.93 | 0.69 | 14 |
| 30863.2 | LAB204 | 11.00 | 0.00 | 9 | 4.74 | 0.47 | 10 | — | — | — |
| 30864.1 | LAB204 | 10.44 | 0.50 | 3 | — | — | — | 0.94 | 0.62 | 15 |
| 30865.4 | LAB204 | 10.63 | 0.63 | 5 | — | — | — | — | — | — |
| 31073.1 | LAB261 | 10.31 | 0.37 | 2 | — | — | — | — | — | — |
| 31074.2 | LAB261 | — | — | — | — | — | — | 1.03 | 0.02 | 26 |
| 31074.4 | LAB261 | 10.38 | 0.51 | 2 | — | — | — | 0.88 | 0.81 | 8 |
| 31075.1 | LAB261 | 10.25 | 0.74 | 1 | — | — | — | — | — | — |

TABLE 76-continued

Genes showing improved plant photosynthetic capacity under high salinity conditions

| Gene Name | Event # | Leaf Number | | | Leaf Blade Area [cm2] | | | Leaf Petiole Length [cm] | | |
|---|---|---|---|---|---|---|---|---|---|---|
| | | Ave. | P-Val. | % Incr. | Ave | P-Val | % Incr. | Ave. | P-Val. | % Incr. |
| 31075.3 | LAB261 | 10.38 | 0.31 | 2 | — | — | — | — | — | — |
| 30891.6 | LAB263 | 11.19 | 0.03 | 10 | 4.51 | 0.74 | 5 | — | — | — |
| 30892.2 | LAB263 | 10.69 | 0.02 | 5 | — | — | — | 1.00 | 0.50 | 23 |
| 30892.3 | LAB263 | — | — | — | 4.37 | 0.92 | 2 | — | — | — |
| 30892.4 | LAB263 | 10.50 | 0.35 | 4 | — | — | — | 1.00 | 0.63 | 23 |
| 30893.3 | LAB263 | 10.94 | 0.55 | 8 | 4.62 | 0.61 | 7 | — | — | — |
| 30905.4 | LAB271 | 10.69 | 0.12 | 5 | 4.57 | 0.69 | 6 | — | — | — |
| 30905.6 | LAB271 | 10.38 | 0.51 | 2 | — | — | — | 0.89 | 0.76 | 10 |
| 30905.7 | LAB271 | 10.55 | 0.37 | 4 | 5.17 | 0.23 | 20 | — | — | — |
| 31121.1 | LAB272 | 10.50 | 0.15 | 4 | — | — | — | 0.88 | 0.78 | 8 |
| 31123.1 | LAB272 | — | — | — | — | — | — | 0.82 | 0.97 | 1 |
| 31123.6 | LAB272 | 10.38 | 0.77 | 2 | 4.54 | 0.77 | 5 | — | — | — |
| 31125.4 | LAB272 | 10.56 | 0.58 | 4 | 5.03 | 0.26 | 17 | — | — | — |
| 31125.5 | LAB272 | 10.19 | 0.90 | 0 | 4.91 | 0.33 | 14 | — | — | — |
| 30911.3 | LAB284 | 10.25 | 0.74 | 1 | 4.94 | 0.30 | 15 | — | — | — |
| 30912.2 | LAB284 | — | — | — | 4.77 | 0.47 | 11 | — | — | — |
| 30913.1 | LAB284 | 10.88 | 0.44 | 7 | 5.00 | 0.49 | 16 | — | — | — |
| 30913.3 | LAB284 | — | — | — | — | — | — | 0.94 | 0.67 | 15 |
| 30914.3 | LAB284 | — | — | — | 4.34 | 0.97 | 1 | — | — | — |
| 30921.1 | LAB286 | — | — | — | — | — | — | 0.96 | 0.63 | 17 |
| 30922.1 | LAB286 | 11.00 | 0.22 | 9 | — | — | — | 1.08 | 0.08 | 33 |
| 30922.4 | LAB286 | 11.06 | 0.33 | 9 | 4.79 | 0.57 | 11 | — | — | — |
| 30923.3 | LAB286 | 10.25 | 0.54 | 1 | 4.97 | 0.28 | 15 | — | — | — |
| 30924.2 | LAB286 | 10.75 | 0.04 | 6 | 4.82 | 0.41 | 12 | — | — | — |
| 30102.2 | LAB329 | — | — | — | — | — | — | 1.10 | 0.00 | 36 |
| 30103.1 | LAB329 | 10.38 | 0.77 | 2 | — | — | — | 1.24 | 0.00 | 53 |
| 30103.2 | LAB329 | 11.19 | 0.00 | 10 | 4.38 | 0.89 | 2 | — | — | — |
| 30104.1 | LAB329 | 10.31 | 0.37 | 2 | 5.26 | 0.14 | 22 | — | — | — |
| 30104.2 | LAB329 | — | — | — | 4.45 | 0.80 | 3 | — | — | — |
| — | cont | 10.14 | — | 0 | 4.30 | — | 0 | 0.81 | — | 0 |
| 30641.5 | LAB101 | — | — | — | — | — | — | 0.66 | 0.46 | 24 |
| 30645.1 | LAB101 | — | — | — | — | — | — | 0.53 | 0.95 | 0 |
| 30533.1 | LAB107 | 9.06 | 0.92 | 0 | — | — | — | — | — | — |
| 30533.4 | LAB107 | 9.38 | 0.23 | 4 | 3.48 | 0.07 | 22 | 0.64 | 0.00 | 20 |
| 30534.3 | LAB107 | 9.06 | 0.98 | 0 | 2.85 | 0.98 | 0 | — | — | — |
| 30535.2 | LAB107 | — | — | — | 3.36 | 0.09 | 18 | 0.61 | 0.01 | 15 |
| 30801.4 | LAB121 | 9.13 | 0.92 | 1 | 3.52 | 0.05 | 24 | 0.59 | 0.00 | 12 |
| 30802.1 | LAB121 | — | — | — | — | — | — | 0.63 | 0.52 | 18 |
| 30802.2 | LAB121 | 9.25 | 0.57 | 2 | 2.98 | 0.52 | 5 | 0.58 | 0.36 | 10 |
| 30803.1 | LAB121 | 9.38 | 0.39 | 4 | — | — | — | 0.73 | 0.39 | 38 |
| 30804.1 | LAB121 | — | — | — | — | — | — | 0.56 | 0.01 | 6 |
| 30822.2 | LAB129 | 9.50 | 0.13 | 5 | — | — | — | — | — | — |
| 30824.1 | LAB129 | — | — | — | 3.08 | 0.53 | 8 | 0.58 | 0.10 | 9 |
| 30824.2 | LAB129 | — | — | — | — | — | — | 0.55 | 0.17 | 4 |
| 30825.1 | LAB129 | 9.44 | 0.15 | 4 | 3.36 | 0.26 | 18 | 0.60 | 0.43 | 14 |
| 30541.3 | LAB130 | — | — | — | 3.01 | 0.45 | 6 | 0.54 | 0.47 | 2 |
| 30544.2 | LAB130 | — | — | — | 3.15 | 0.27 | 11 | 0.58 | 0.24 | 9 |
| 30545.1 | LAB130 | 9.44 | 0.67 | 4 | 3.71 | 0.35 | 30 | 0.64 | 0.29 | 20 |
| 30545.2 | LAB130 | — | — | — | — | — | — | 0.63 | 0.45 | 19 |
| 30831.3 | LAB163 | — | — | — | 3.10 | 0.26 | 9 | 0.55 | 0.32 | 3 |
| 30832.2 | LAB163 | — | — | — | — | — | — | 0.53 | 1.00 | 0 |
| 30833.1 | LAB163 | 9.06 | 0.98 | 0 | — | — | — | 0.55 | 0.03 | 3 |
| 30833.2 | LAB163 | 9.44 | 0.77 | 4 | — | — | — | — | — | — |
| 30522.4 | LAB164 | — | — | — | 2.93 | 0.80 | 3 | 0.55 | 0.27 | 3 |
| 30524.1 | LAB164 | — | — | — | 3.00 | 0.46 | 5 | 0.54 | 0.10 | 3 |
| 30525.2 | LAB164 | — | — | — | 3.12 | 0.24 | 10 | 0.55 | 0.23 | 4 |
| 30525.3 | LAB164 | — | — | — | 2.98 | 0.49 | 5 | 0.54 | 0.05 | 3 |
| 30841.3 | LAB171 | — | — | — | — | — | — | 0.54 | 0.71 | 2 |
| 30842.4 | LAB171 | — | — | — | — | — | — | 0.75 | 0.48 | 41 |
| 30843.2 | LAB171 | — | — | — | 3.12 | 0.26 | 10 | 0.60 | 0.02 | 14 |
| 30845.1 | LAB171 | — | — | — | 3.06 | 0.50 | 7 | 0.54 | 0.75 | 2 |
| 30852.3 | LAB172 | — | — | — | — | — | — | 0.57 | 0.81 | 8 |
| 30854.1 | LAB172 | — | — | — | — | — | — | 0.54 | 0.50 | 2 |
| 30855.2 | LAB172 | 9.38 | 0.23 | 4 | 2.95 | 0.76 | 4 | 0.56 | 0.51 | 6 |
| 30513.4 | LAB175 | — | — | — | 2.86 | 0.97 | 0 | — | — | — |
| 30514.3 | LAB175 | — | — | — | — | — | — | 0.61 | 0.55 | 16 |
| 30862.3 | LAB204 | 9.06 | 0.92 | 0 | 3.28 | 0.16 | 15 | 0.57 | 0.49 | 8 |
| 30863.1 | LAB204 | — | — | — | 3.22 | 0.26 | 13 | 0.59 | 0.36 | 11 |
| 30863.2 | LAB204 | 9.31 | 0.27 | 3 | — | — | — | — | — | — |
| 30864.1 | LAB204 | — | — | — | — | — | — | 0.58 | 0.33 | 9 |
| 30865.4 | LAB204 | — | — | — | 3.14 | 0.22 | 10 | 0.58 | 0.05 | 10 |

TABLE 76-continued

Genes showing improved plant photosynthetic capacity under high salinity conditions

| Gene Name | Event # | Leaf Number Ave. | Leaf Number P-Val. | Leaf Number % Incr. | Leaf Blade Area [cm2] Ave | Leaf Blade Area [cm2] P-Val | Leaf Blade Area [cm2] % Incr. | Leaf Petiole Length [cm] Ave. | Leaf Petiole Length [cm] P-Val. | Leaf Petiole Length [cm] % Incr. |
|---|---|---|---|---|---|---|---|---|---|---|
| 31074.4 | LAB261 | — | — | — | 3.06 | 0.33 | 7 | 0.57 | 0.01 | 8 |
| 31075.1 | LAB261 | 9.06 | 0.94 | 0 | 2.91 | 0.85 | 2 | 0.58 | 0.35 | 9 |
| 31075.3 | LAB261 | — | — | — | 2.86 | 0.97 | 0 | 0.55 | 0.49 | 4 |
| 30891.6 | LAB263 | — | — | — | — | — | — | 0.74 | 0.50 | 40 |
| 30892.2 | LAB263 | 9.19 | 0.73 | 2 | 3.19 | 0.16 | 12 | 0.54 | 0.13 | 2 |
| 30892.3 | LAB263 | — | — | — | 2.96 | 0.66 | 4 | 0.54 | 0.28 | 3 |
| 30892.4 | LAB263 | — | — | — | 3.10 | 0.26 | 9 | 0.57 | 0.00 | 8 |
| 30893.3 | LAB263 | 9.44 | 0.67 | 4 | — | — | — | 0.71 | 0.43 | 35 |
| 30905.6 | LAB271 | — | — | — | — | — | — | 0.64 | 0.52 | 21 |
| 30905.7 | LAB271 | — | — | — | 2.95 | 0.69 | 4 | — | — | — |
| 31121.1 | LAB272 | 9.25 | 0.41 | 2 | 2.90 | 0.77 | 2 | 0.57 | 0.07 | 8 |
| 31123.1 | LAB272 | — | — | — | 2.94 | 0.64 | 3 | 0.55 | 0.23 | 5 |
| 31125.4 | LAB272 | — | — | — | 3.07 | 0.40 | 8 | 0.54 | 0.81 | 1 |
| 30911.3 | LAB284 | — | — | — | — | — | — | 0.53 | 0.94 | 1 |
| 30923.3 | LAB286 | 9.31 | 0.39 | 3 | — | — | — | 0.54 | 0.60 | 2 |
| 30102.3 | LAB329 | — | — | — | 2.87 | 0.91 | 1 | 0.55 | 0.44 | 3 |
| 30103.2 | LAB329 | — | — | — | 2.97 | 0.62 | 4 | 0.59 | 0.30 | 12 |
| — | cont | 9.04 | — | 0 | 2.84 | — | 0 | 0.53 | — | 0 |
| 31441.4 | LAB116 | 10.75 | 0.90 | 1 | — | — | — | — | — | — |
| 31115.1 | LAB120 | 10.94 | 0.35 | 3 | — | — | — | — | — | — |
| 31161.1 | LAB122 | 10.81 | 0.73 | 1 | — | — | — | — | — | — |
| 30632.4 | LAB178 | — | — | — | — | — | — | 0.68 | 0.85 | 2 |
| 31322.1 | LAB235 | 11.06 | 0.40 | 4 | — | — | — | — | — | — |
| 31462.1 | LAB253 | 10.94 | 0.54 | 3 | — | — | — | — | — | — |
| 30102.3 | LAB329 | 10.75 | 0.69 | 1 | — | — | — | — | — | — |
| 31705.6 | LAB342 | 11.00 | | 3 | 4.69 | | 17 | 0.75 | | 12 |
| 31455.1 | LAB56 | 11.06 | 0.40 | 4 | 4.46 | 0.00 | 11 | 0.69 | 0.50 | 3 |
| 31301.2 | LAB97 | 10.88 | | 2 | — | — | — | — | — | — |
| 31306.4 | LAB97 | — | — | — | — | — | — | 0.67 | | 0 |
| 31011.2 | LAB98 | 10.69 | 0.90 | 0 | — | — | — | 0.70 | 0.32 | 5 |
| 31011.4 | LAB98 | — | — | — | — | — | — | 0.71 | 0.09 | 7 |
| — | cont | 10.67 | — | 0 | 4.03 | — | 0 | 0.66 | — | 0 |

Table 76.
"CONT."—Control;
"Ave."—Average;
"% Incr." = % increment;
"p-val."—p-value.

TABLE 77

Genes showing improved plant photosynthetic capacity under high salinity conditions

| Gene Name | Event # | Petiole Relative Area [%] Ave. | P-Val. | % Incr. |
|---|---|---|---|---|
| LAB113 | 28543.2 | 7.25861 | 0.007649 | 6.4497 |
| LAB113 | 28545.2 | 6.82528 | 0.991347 | 0.0948 |
| LAB152 | 28473.2 | 7.7975 | 0.181605 | 14.3527 |
| LAB152 | 28471.1 | 7.10137 | 0.446585 | 4.1437 |
| LAB153 | 28303.1 | 7.85041 | 0.405463 | 15.1286 |
| LAB153 | 28301.2 | 7.77208 | 0.388309 | 13.9799 |
| LAB169 | 28394.3 | 6.91895 | 0.568267 | 1.4684 |
| LAB181 | 28483.2 | 7.29041 | 0.5655 | 6.9161 |
| LAB181 | 28482.3 | 6.90734 | 0.650073 | 1.2982 |
| LAB181 | 28484.3 | 6.88919 | 0.904388 | 1.0321 |
| LAB187 | 28433.5 | 7.56748 | 0.524954 | 10.9794 |
| LAB187 | 28434.1 | 7.29117 | 0.738605 | 6.9272 |
| LAB187 | 28431.3 | 6.85183 | 0.947315 | 0.4841 |
| LAB213 | 28561.2 | 6.99267 | 0.223837 | 2.5496 |
| LAB213 | 28565.2 | 6.95961 | 0.613231 | 2.0648 |
| LAB213 | 28562.6 | 6.9499 | 0.717597 | 1.9223 |
| LAB230 | 28574.2 | 7.70137 | 0.335507 | 12.9429 |
| LAB230 | 28572.3 | 7.29385 | 0.36772 | 6.9666 |
| LAB247 | 28094.3 | 7.67765 | 0.045348 | 12.5951 |
| LAB247 | 28093.2 | 7.21449 | 0.269436 | 5.8027 |
| LAB247 | 28091.4 | 6.85979 | 0.76968 | 0.6009 |
| LAB249 | 28603.3 | 7.5762 | 0.516273 | 11.1073 |
| LAB249 | 28604.4 | 7.41181 | 0.507318 | 8.6965 |
| LAB249 | 28602.1 | 6.89665 | 0.886089 | 1.1415 |
| LAB258 | 27441.6 | 8.36338 | 0.105004 | 22.6515 |
| LAB258 | 27442.2 | 7.25016 | 0.013719 | 6.3258 |
| LAB258 | 27444.4 | 6.86788 | 0.880703 | 0.7195 |
| LAB294 | 28401.3 | 7.48831 | 0.425338 | 9.8184 |
| LAB294 | 28402.5 | 7.05173 | 0.817985 | 3.4158 |
| LAB70 | 28463.1 | 7.39288 | 0.63027 | 8.4188 |
| LAB70 | 28461.2 | 7.3918 | 0.526634 | 8.403 |
| LAB70 | 28462.2 | 6.96331 | 0.814227 | 2.119 |
| LAB70 | 28463.3 | 6.95085 | 0.75686 | 1.9363 |
| LAB74 | 28453.5 | 7.22478 | 0.263641 | 5.9536 |
| LAB74 | 28452.2 | 7.14042 | 0.545413 | 4.7164 |
| LAB74 | 28454.1 | 7.12442 | 0.490378 | 4.4817 |
| LAB74 | 28451.3 | 7.09295 | 0.234469 | 4.0203 |
| LAB81 | 28531.1 | 7.09746 | 0.512037 | 4.0864 |
| LAB81 | 28531.2 | 6.88508 | 0.884382 | 0.9718 |
| LAB81 | 28533.4 | 6.83546 | 0.989095 | 0.2441 |
| LAB88 | 28193.2 | 7.4358 | 0.582183 | 9.0483 |
| LAB88 | 28193.6 | 7.00306 | 0.656828 | 2.702 |

TABLE 77-continued

Genes showing improved plant photosynthetic capacity under high salinity conditions

| Gene Name | Event # | Petiole Relative Area [%] Ave. | P-Val. | % Incr. |
|---|---|---|---|---|
| LAB88 | 28192.6 | 6.83371 | 0.926424 | 0.2184 |
| control | — | 6.81882 | — | 0 |
| LAB131 | 28294.2 | 7.45348 | 0.460217 | 2.1079 |
| LAB131 | 28291.1 | 7.40177 | 0.865967 | 1.3994 |
| LAB145 | 28553.3 | 7.71465 | 0.443561 | 5.6857 |
| LAB145 | 28551.3 | 7.50767 | 0.454262 | 2.8502 |
| LAB152 | 28474.4 | 7.697 | 0.677244 | 5.4438 |
| LAB152 | 28472.3 | 7.41773 | 0.925076 | 1.618 |
| LAB153 | 28301.2 | 8.13011 | 0.512437 | 11.3772 |
| LAB153 | 28303.1 | 7.51892 | 0.376489 | 3.0043 |
| LAB153 | 28304.1 | 7.39767 | 0.842625 | 1.3433 |
| LAB169 | 28392.1 | 7.86428 | 0.224427 | 7.7355 |
| LAB181 | 28482.2 | 7.78511 | 0.631007 | 6.6509 |
| LAB181 | 28482.3 | 7.55637 | 0.236889 | 3.5173 |
| LAB181 | 28484.3 | 7.30014 | 0.998988 | 0.0071 |
| LAB230 | 28574.3 | 8.29895 | 0.259973 | 13.6902 |
| LAB230 | 28572.2 | 8.1316 | 0.530483 | 11.3976 |
| LAB247 | 28093.2 | 7.72128 | 0.160134 | 5.7764 |
| LAB249 | 28605.2 | 8.47226 | 0.225406 | 16.0644 |
| LAB249 | 28603.3 | 7.80589 | 0.093546 | 6.9357 |
| LAB249 | 28604.4 | 7.46171 | 0.844259 | 2.2206 |
| LAB258 | 27441.4 | 8.05767 | 0.481569 | 10.3848 |
| LAB70 | 28463.3 | 7.45758 | 0.393596 | 2.164 |
| LAB70 | 28462.2 | 7.31549 | 0.940513 | 0.2174 |
| LAB74 | 28452.2 | 7.45094 | 0.699898 | 2.0731 |
| LAB81 | 28531.1 | 7.53348 | 0.802792 | 3.2038 |
| LAB88 | 28193.2 | 7.76567 | 0.308068 | 6.3846 |
| LAB88 | 28192.4 | 7.53831 | 0.202385 | 3.2699 |
| control | — | 7.29962 | — | 0 |
| LAB108 | 28502.2 | 8.56131 | 0.159318 | 20.185 |
| LAB119 | 28413.1 | 7.6585 | 0.175607 | 7.5112 |
| LAB119 | 28415.2 | 7.48834 | 0.134703 | 5.1226 |
| LAB119 | 28411.1 | 7.35852 | 0.793817 | 3.3001 |
| LAB119 | 28412.1 | 7.31081 | 0.808779 | 2.6303 |
| LAB157 | 28144.2 | 7.6018 | 0.08312 | 6.7152 |
| LAB157 | 28142.3 | 7.27283 | 0.710766 | 2.0971 |
| LAB231 | 28582.1 | 7.70395 | 0.002929 | 8.1493 |
| LAB231 | 28585.3 | 7.23129 | 0.658843 | 1.514 |
| LAB231 | 28585.1 | 7.22687 | 0.851254 | 1.452 |
| LAB238 | 28424.4 | 7.34607 | 0.317195 | 3.1253 |
| LAB240 | 28595.1 | 8.30771 | 0.114763 | 16.6249 |
| LAB240 | 28592.2 | 7.51436 | 0.554355 | 5.4878 |
| LAB240 | 28595.3 | 7.32287 | 0.809446 | 2.7996 |
| LAB242 | 28081.2 | 7.64323 | 0.008185 | 7.2968 |
| LAB242 | 28085.1 | 7.35343 | 0.741077 | 3.2287 |
| LAB267 | 28383.2 | 7.46852 | 0.407532 | 4.8443 |
| LAB267 | 28384.2 | 7.3901 | 0.633928 | 3.7434 |
| LAB269 | 28345.2 | 7.95751 | 0.117691 | 11.7088 |
| LAB269 | 28345.3 | 7.77608 | 0.458008 | 9.1619 |
| LAB269 | 28342.3 | 7.36908 | 0.859451 | 3.4483 |
| LAB269 | 28343.4 | 7.15782 | 0.885842 | 0.4826 |
| LAB279 | 28351.1 | 9.53234 | 0.237171 | 33.8165 |
| LAB279 | 28353.2 | 8.20726 | 0.020246 | 15.2148 |
| LAB283 | 28365.1 | 8.00604 | 0.024221 | 12.39 |
| LAB283 | 28363.3 | 7.71293 | 0.068157 | 8.2753 |
| LAB283 | 28361.1 | 7.13721 | 0.962639 | 0.1933 |
| LAB298 | 29245.2 | 8.41771 | 0.301611 | 18.1692 |
| LAB298 | 29244.1 | 7.52057 | 0.567988 | 5.575 |
| LAB298 | 29245.4 | 7.21693 | 0.748473 | 1.3125 |
| LAB298 | 29245.3 | 7.20557 | 0.925966 | 1.153 |
| LAB299 | 28066.1 | 7.82638 | 0.29069 | 9.868 |
| LAB299 | 28063.1 | 7.3607 | 0.122124 | 3.3307 |
| LAB302 | 28825.1 | 7.88743 | 0.005978 | 10.7251 |
| LAB302 | 28822.6 | 7.5281 | 0.514161 | 5.6807 |
| LAB302 | 28825.2 | 7.27565 | 0.669778 | 2.1368 |
| LAB302 | 28822.7 | 7.23738 | 0.868367 | 1.5995 |
| LAB336 | 28374.3 | 7.62494 | 0.003533 | 7.0401 |
| LAB339 | 27272.7 | 7.16777 | 0.935686 | 0.6223 |
| LAB345 | 28495.4 | 7.5507 | 0.802534 | 5.998 |
| LAB345 | 28494.1 | 7.29002 | 0.7495 | 2.3385 |
| LAB345 | 28495.1 | 7.23541 | 0.686389 | 1.5718 |
| LAB58 | 28443.2 | 7.67142 | 0.595777 | 7.6926 |
| LAB58 | 28443.4 | 7.50515 | 0.028466 | 5.3586 |
| control | — | 7.12344 | — | 0 |
| LAB133 | 28832.1 | 10.082 | 0.23573 | 20.1798 |
| LAB133 | 28832.5 | 9.09955 | 0.278089 | 8.4686 |
| LAB133 | 28833.1 | 8.9705 | 0.527036 | 6.9304 |
| LAB162 | 29341.2 | 9.26873 | 0.670218 | 10.4853 |
| LAB162 | 29342.7 | 8.9028 | 0.763612 | 6.1233 |
| LAB177 | 29424.3 | 10.0968 | 0.175792 | 20.3555 |
| LAB179 | 29303.2 | 9.01511 | 0.358987 | 7.462 |
| LAB179 | 29304.2 | 8.91137 | 0.682559 | 6.2255 |
| LAB185 | 28174.2 | 10.5238 | 0.449633 | 25.4459 |
| LAB185 | 28175.3 | 9.89612 | 0.468419 | 17.9639 |
| LAB185 | 28172.4 | 9.41553 | 0.839086 | 12.2352 |
| LAB210 | 28331.3 | 10.7038 | 0.007891 | 27.5919 |
| LAB254 | 28814.2 | 8.58776 | 0.848872 | 2.368 |
| LAB293 | 29235.1 | 9.59229 | 0.089627 | 14.3422 |
| LAB293 | 29232.3 | 9.15799 | 0.780329 | 9.1653 |
| LAB310 | 28182.3 | 9.78052 | 0.057424 | 16.586 |
| LAB327 | 29225.3 | 9.07366 | 0.396067 | 8.16 |
| LAB327 | 29225.2 | 8.89364 | 0.5304 | 6.0141 |
| LAB335 | 27312.1 | 9.50339 | 0.562977 | 13.2825 |
| LAB335 | 27311.2 | 9.16506 | 0.534976 | 9.2495 |
| LAB335 | 27314.2 | 8.60474 | 0.731066 | 2.5704 |
| LAB335 | 27314.1 | 8.57677 | 0.797441 | 2.237 |
| LAB54 | 28136.1 | 10.3362 | 0.271745 | 23.2098 |
| LAB54 | 28134.1 | 8.91719 | 0.484156 | 6.2948 |
| LAB68 | 29335.1 | 11.9102 | 0.076601 | 41.9728 |
| LAB68 | 29332.3 | 10.962 | 0.188923 | 30.6697 |
| LAB68 | 29331.6 | 10.6819 | 0.534287 | 27.3301 |
| LAB68 | 29332.4 | 9.25866 | 0.571621 | 10.3652 |
| LAB68 | 29331.5 | 9.19982 | 0.5356 | 9.6639 |
| LAB73 | 30152.1 | 11.0429 | 0.230452 | 31.6337 |
| LAB73 | 30153.1 | 8.98941 | 0.863978 | 7.1557 |
| LAB73 | 30154.3 | 8.52716 | 0.940397 | 1.6456 |
| control | — | 8.38911 | — | 0 |
| LAB102 | 30313.1 | 15.2164 | 0.20639 | 44.6134 |
| LAB102 | 30312.2 | 13.796 | 0.013932 | 31.1144 |
| LAB102 | 30314.1 | 12.6044 | 0.458799 | 19.7897 |
| LAB102 | 30314.3 | 12.1003 | 0.347464 | 14.9983 |
| LAB126 | 30205.1 | 13.9385 | 0 | 32.4688 |
| LAB126 | 30202.3 | 13.4748 | 0.148795 | 28.0618 |
| LAB126 | 30205.3 | 12.7098 | 0.561379 | 20.7908 |
| LAB126 | 30203.3 | 12.5016 | 0.111642 | 18.8129 |
| LAB126 | 30201.3 | 12.0862 | 0.46134 | 14.8643 |
| LAB165 | 30233.1 | 15.2397 | 0 | 44.8352 |
| LAB165 | 30231.1 | 12.0077 | 0.020376 | 14.1188 |
| LAB165 | 30231.2 | 11.3707 | 0.785634 | 8.0646 |
| LAB165 | 30232.1 | 10.92 | 0.842394 | 3.7815 |
| LAB167 | 27321.4 | 15.2241 | 0.082445 | 44.687 |
| LAB167 | 27321.2 | 14.1691 | 0.428562 | 34.6605 |
| LAB167 | 27321.3 | 13.9386 | 0.572095 | 32.4697 |
| LAB167 | 27321.6 | 13.2504 | 0.000004 | 25.9287 |
| LAB167 | 27324.1 | 12.2974 | 0.72158 | 16.8719 |
| LAB220 | 30321.4 | 15.0127 | 0.176019 | 42.6775 |
| LAB220 | 30324.4 | 14.6042 | 0.002979 | 38.7949 |
| LAB220 | 30322.2 | 12.5033 | 0.259411 | 18.8283 |
| LAB220 | 30323.1 | 11.7103 | 0.565417 | 11.292 |
| LAB241 | 30212.2 | 15.9571 | 0.025037 | 51.6526 |
| LAB241 | 30212.1 | 14.2808 | 0.000436 | 35.7217 |
| LAB241 | 30213.4 | 12.2703 | 0.369143 | 16.6143 |
| LAB241 | 30213.1 | 11.9584 | 0.549532 | 13.6506 |
| LAB241 | 30211.3 | 11.7604 | 0.100869 | 11.7686 |
| LAB268 | 30392.1 | 14.4444 | 0.375438 | 37.2767 |
| LAB268 | 30391.4 | 14.0801 | 0.312268 | 33.8142 |
| LAB268 | 30395.1 | 12.9034 | 0.267518 | 22.6317 |
| LAB268 | 30393.1 | 12.282 | 0.633635 | 16.7255 |
| LAB268 | 30393.3 | 11.4471 | 0.227239 | 8.791 |
| LAB280 | 30044.1 | 15.1079 | 0 | 43.5819 |
| LAB280 | 30045.1 | 15.0389 | 0.121597 | 42.927 |
| LAB280 | 30044.2 | 12.8034 | 0.382991 | 21.6811 |
| LAB280 | 30042.1 | 12.5051 | 0.22637 | 18.8463 |
| LAB280 | 30041.2 | 11.5226 | 0.790532 | 9.5082 |
| LAB289 | 30373.1 | 17.7395 | 0.014651 | 68.5922 |
| LAB289 | 30375.2 | 12.8555 | 0.251049 | 22.1756 |

TABLE 77-continued

Genes showing improved plant photosynthetic capacity under high salinity conditions

| Gene Name | Event # | Petiole Relative Area [%] Ave. | P-Val. | % Incr. |
|---|---|---|---|---|
| LAB289 | 30371.6 | 12.5621 | 0.33865 | 19.3872 |
| LAB289 | 30371.4 | 12.3224 | 0.25767 | 17.1094 |
| LAB289 | 30373.2 | 10.7386 | 0.91877 | 2.0572 |
| LAB311 | 30223.4 | 14.0762 | 0.494563 | 33.7769 |
| LAB311 | 30222.2 | 13.9727 | 0.310017 | 32.7935 |
| LAB311 | 30224.2 | 13.9441 | 0.000004 | 32.5219 |
| LAB311 | 30223.2 | 13.848 | 0.537534 | 31.6088 |
| LAB311 | 30221.4 | 13.0215 | 0.000003 | 23.7538 |
| LAB344 | 30096.1 | 16.5145 | 0.078775 | 56.9506 |
| LAB344 | 30093.3 | 13.6159 | 0.025617 | 29.403 |
| LAB344 | 30091.2 | 12.3779 | 0.008417 | 17.6365 |
| LAB344 | 30092.3 | 11.8088 | 0.279309 | 12.228 |
| LAB344 | 30096.3 | 11.0652 | 0.860257 | 5.1609 |
| LAB355 | 29281.3 | 14.2783 | 0.000001 | 35.6978 |
| LAB355 | 29283.1 | 14.1859 | 0.058864 | 34.8196 |
| LAB355 | 29282.1 | 12.3315 | 0.0412 | 17.196 |
| LAB355 | 29282.3 | 11.3582 | 0.251635 | 7.9457 |
| LAB367 | 30174.1 | 15.1882 | 0.145239 | 44.3459 |
| LAB367 | 30171.3 | 13.98 | 0.309109 | 32.8627 |
| LAB367 | 30173.1 | 12.8196 | 0.07746 | 21.8344 |
| LAB367 | 30172.3 | 12.7124 | 0.134877 | 20.8159 |
| LAB367 | 30173.3 | 12.4463 | 0.447398 | 18.2868 |
| LAB381 | 30352.4 | 14.5682 | 0.28768 | 38.4534 |
| LAB381 | 30354.2 | 12.6657 | 0.147865 | 20.3722 |
| LAB381 | 30351.4 | 11.4898 | 0.502324 | 9.1971 |
| LAB381 | 30352.2 | 11.0204 | 0.810272 | 4.7354 |
| LAB383 | 28115.1 | 13.6177 | 0.295905 | 29.4194 |
| LAB383 | 28111.3 | 13.1602 | 0.00029 | 25.0714 |
| LAB383 | 28114.2 | 13.0351 | 0.263098 | 23.8826 |
| LAB383 | 28111.4 | 11.9452 | 0.648489 | 13.5244 |
| LAB383 | 28115.3 | 11.3354 | 0.739628 | 7.729 |
| LAB64 | 30274.3 | 13.1455 | 0.557361 | 24.9322 |
| LAB64 | 30273.2 | 12.6699 | 0.000015 | 20.4124 |
| LAB64 | 30271.2 | 12.3467 | 0.636882 | 17.3406 |
| LAB64 | 30272.1 | 11.9304 | 0.525824 | 13.3837 |
| LAB65 | 30303.4 | 15.1014 | 0.238233 | 43.5206 |
| LAB65 | 30301.4 | 12.9348 | 0.210178 | 22.9299 |
| LAB65 | 30303.1 | 11.2768 | 0.473305 | 7.1719 |
| LAB65 | 30304.3 | 11.2108 | 0.779481 | 6.5451 |
| LAB65 | 30302.1 | 10.918 | 0.697502 | 3.7627 |
| LAB92 | 29323.2 | 13.2518 | 0.145779 | 25.942 |
| LAB92 | 29325.1 | 12.4378 | 0.518827 | 18.2063 |
| LAB92 | 29321.2 | 12.0857 | 0.20927 | 14.8598 |
| control | — | 10.5221 | — | 0 |
| LAB138 | 30781.2 | 10.9126 | 0.955798 | 0.7131 |
| LAB159 | 30704.3 | 13.5902 | 0.006504 | 25.4246 |
| LAB159 | 30702.4 | 11.2072 | 0.751174 | 3.4324 |
| LAB161 | 30483.1 | 11.9515 | 0.66215 | 10.3017 |
| LAB161 | 30485.1 | 10.9424 | 0.975909 | 0.9887 |
| LAB170 | 30713.2 | 13.4799 | 0.007915 | 24.4072 |
| LAB170 | 30712.2 | 11.068 | 0.831285 | 2.1472 |
| LAB176 | 30143.1 | 11.1703 | 0.778057 | 3.0913 |
| LAB259 | 27112.3 | 11.8079 | 0.519346 | 8.9757 |
| LAB259 | 27112.14 | 10.9247 | 0.927981 | 0.825 |
| LAB262 | 30612.1 | 12.6028 | 0.495057 | 16.3119 |
| LAB262 | 30611.4 | 11.7337 | 0.280904 | 8.2911 |
| LAB270 | 30595.1 | 14.8633 | 0.00056 | 37.1744 |
| LAB270 | 30594.3 | 12.359 | 0.246632 | 14.0623 |
| LAB270 | 30595.2 | 12.2242 | 0.537279 | 12.8182 |
| LAB306 | 30564.2 | 12.482 | 0.075214 | 15.1973 |
| LAB306 | 30564.3 | 12.33 | 0.674582 | 13.795 |
| LAB306 | 30561.2 | 11.1911 | 0.850015 | 3.2836 |
| LAB323 | 30381.1 | 13.6944 | 0.014941 | 26.3867 |
| LAB323 | 30383.3 | 12.3246 | 0.170342 | 13.7449 |
| LAB347_H0 | 30444.3 | 13.1907 | 0.014345 | 21.7379 |
| LAB347_H0 | 30443.4 | 11.0402 | 0.91764 | 1.8912 |
| LAB347_H0 | 30444.1 | 10.9391 | 0.962786 | 0.958 |
| LAB55 | 30023.1 | 11.7679 | 0.300628 | 8.6065 |
| LAB83 | 30194.1 | 11.3649 | 0.708364 | 4.8876 |
| LAB94 | 30682.2 | 11.0103 | 0.882689 | 1.6153 |
| LAB94 | 30681.8 | 10.8456 | 0.990119 | 0.0951 |
| control | — | 10.8353 | — | 0 |
| LAB138 | 30781.2 | 10.3142 | 0.003016 | 34.1164 |
| LAB138 | 30781.1 | 8.52655 | 0.232829 | 10.8711 |
| LAB159 | 30704.4 | 8.77146 | 0.11449 | 14.0557 |
| LAB159 | 30702.3 | 8.0976 | 0.51735 | 5.2935 |
| LAB159 | 30701.6 | 7.87114 | 0.923488 | 2.3488 |
| LAB159 | 30704.3 | 7.83531 | 0.81677 | 1.8829 |
| LAB161 | 30485.1 | 8.91584 | 0.109335 | 15.933 |
| LAB161 | 30483.1 | 8.02551 | 0.836665 | 4.356 |
| LAB161 | 30486.1 | 7.87182 | 0.808979 | 2.3576 |
| LAB170 | 30713.2 | 11.2709 | 0.006484 | 46.5566 |
| LAB170 | 30712.2 | 9.11993 | 0.071684 | 18.5868 |
| LAB170 | 30715.2 | 8.32823 | 0.571842 | 8.2924 |
| LAB176 | 30143.1 | 9.41695 | 0.431677 | 22.449 |
| LAB176 | 30143.2 | 7.91633 | 0.727505 | 2.9364 |
| LAB176 | 30142.1 | 7.86761 | 0.903691 | 2.3029 |
| LAB188 | 30723.7 | 8.16708 | 0.829943 | 6.1968 |
| LAB188 | 30724.1 | 8.13864 | 0.505002 | 5.827 |
| LAB188 | 30723.3 | 7.73843 | 0.938294 | 0.6231 |
| LAB237 | 30281.4 | 8.78773 | 0.284234 | 14.2672 |
| LAB237 | 30284.1 | 8.37907 | 0.302962 | 8.9534 |
| LAB259 | 27112.12 | 8.93353 | 0.12247 | 16.1631 |
| LAB259 | 27112.3 | 8.72221 | 0.614365 | 13.4152 |
| LAB259 | 27112.9 | 8.15757 | 0.725983 | 6.0732 |
| LAB259 | 27112.7 | 7.80489 | 0.955665 | 1.4874 |
| LAB262 | 30611.4 | 7.78748 | 0.909234 | 1.2609 |
| LAB270 | 30591.2 | 8.2891 | 0.397328 | 7.7836 |
| LAB270 | 30595.2 | 7.99801 | 0.761085 | 3.9985 |
| LAB270 | 30594.1 | 7.70223 | 0.987283 | 0.1525 |
| LAB300 | 30064.3 | 10.8025 | 0.008307 | 40.4655 |
| LAB300 | 30062.2 | 9.13571 | 0.45668 | 18.7921 |
| LAB300 | 30064.1 | 8.63832 | 0.478215 | 12.3245 |
| LAB300 | 30061.2 | 8.17067 | 0.574142 | 6.2435 |
| LAB306 | 30563.2 | 10.6438 | 0.263406 | 38.4019 |
| LAB306 | 30562.2 | 9.96286 | 0.017646 | 29.5475 |
| LAB306 | 30564.2 | 9.95333 | 0.368023 | 29.4235 |
| LAB306 | 30561.2 | 9.78677 | 0.156687 | 27.2577 |
| LAB323 | 30381.1 | 8.3621 | 0.62721 | 8.7328 |
| LAB347_H0 | 30444.1 | 7.99006 | 0.63474 | 3.8951 |
| LAB55 | 30022.3 | 8.21141 | 0.719324 | 6.7733 |
| LAB55 | 30023.3 | 8.10965 | 0.52581 | 5.4501 |
| LAB83 | 30194.2 | 8.75889 | 0.479705 | 13.8922 |
| LAB94 | 30681.8 | 8.00572 | 0.703009 | 4.0987 |
| LAB94 | 30681.4 | 7.88679 | 0.895528 | 2.5523 |
| control | — | 7.69051 | — | 0 |
| LAB182 | 30453.4 | 9.51488 | 0.807517 | 4.6824 |
| LAB221 | 30122.2 | 9.30215 | 0.789519 | 2.342 |
| LAB222 | 30472.2 | 9.13986 | 0.932388 | 0.5564 |
| LAB225 | 30492.2 | 10.1187 | 0.051513 | 11.3256 |
| LAB232 | 30463.2 | 9.37088 | 0.747873 | 3.098 |
| LAB260 | 30073.2 | 9.77729 | 0.665509 | 7.5693 |
| LAB264 | 30131.1 | 9.54647 | 0.586838 | 5.0299 |
| LAB265 | 30734.4 | 11.4836 | 0.47618 | 26.3419 |
| LAB303 | 30424.3 | 10.2327 | 0.686935 | 12.5795 |
| LAB308 | 30932.3 | 11.3656 | 0.03335 | 25.0439 |
| LAB308 | 30933.2 | 9.22235 | 0.85561 | 1.464 |
| LAB319 | 30774.3 | 11.0734 | 0.321832 | 21.8294 |
| LAB319 | 30774.1 | 10.3177 | 0.090686 | 13.5151 |
| LAB319 | 30775.2 | 9.65103 | 0.668447 | 6.1803 |
| LAB319 | 30775.4 | 9.19146 | 0.91586 | 1.1241 |
| LAB320 | 30601.3 | 9.99162 | 0.694578 | 9.9274 |
| LAB343 | 30623.5 | 9.76518 | 0.549023 | 7.4361 |
| LAB343 | 30622.2 | 9.39058 | 0.764649 | 3.3148 |
| LAB353 | 30553.1 | 9.37823 | 0.743113 | 3.179 |
| control | — | 9.08929 | — | 0 |
| LAB182 | 30453.4 | 10.7968 | 0.123604 | 38.021 |
| LAB182 | 30455.2 | 8.94243 | 0.017076 | 14.3153 |
| LAB182 | 30451.3 | 8.13922 | 0.789368 | 4.0475 |
| LAB182 | 30453.1 | 7.83342 | 0.994207 | 0.1383 |
| LAB191 | 28156.4 | 9.75565 | 0.001516 | 24.7112 |
| LAB191 | 28152.1 | 9.5562 | 0.472675 | 22.1615 |
| LAB191 | 28153.1 | 8.78542 | 0.713174 | 12.3082 |
| LAB191 | 28156.2 | 8.47671 | 0.616615 | 8.3618 |
| LAB221 | 30122.2 | 12.7269 | 0.000002 | 62.694 |
| LAB221 | 30123.2 | 10.6222 | 0.007939 | 35.7883 |

TABLE 77-continued

Genes showing improved plant photosynthetic capacity under high salinity conditions

| Gene Name | Event # | Petiole Relative Area [%] Ave. | P-Val. | % Incr. |
|---|---|---|---|---|
| LAB221 | 30124.3 | 10.2941 | 0.033235 | 31.5945 |
| LAB221 | 30124.4 | 9.06136 | 0.33968 | 15.8357 |
| LAB222 | 30476.1 | 12.0032 | 0.007147 | 53.442 |
| LAB222 | 30474.1 | 10.6136 | 0.000091 | 35.6781 |
| LAB222 | 30473.1 | 9.71824 | 0.12675 | 24.2329 |
| LAB222 | 30476.2 | 9.54787 | 0.339175 | 22.055 |
| LAB222 | 30472.1 | 9.48977 | 0.018087 | 21.3123 |
| LAB222 | 30472.2 | 8.87068 | 0.487907 | 13.3981 |
| LAB225 | 30493.2 | 10.4781 | 0.261273 | 33.946 |
| LAB225 | 30491.4 | 10.3161 | 0.478679 | 31.876 |
| LAB225 | 30492.2 | 8.62685 | 0.485357 | 10.2812 |
| LAB225 | 30493.1 | 8.34431 | 0.56022 | 6.6693 |
| LAB225 | 30492.1 | 8.19888 | 0.854981 | 4.8102 |
| LAB232 | 30462.5 | 9.94454 | 0.105637 | 27.1257 |
| LAB232 | 30462.4 | 8.57599 | 0.458211 | 9.631 |
| LAB232 | 30462.3 | 8.23426 | 0.81542 | 5.2625 |
| LAB232 | 30463.2 | 8.14132 | 0.760637 | 4.0744 |
| LAB232 | 30461.5 | 7.90562 | 0.824691 | 1.0613 |
| LAB260 | 30073.4 | 10.1438 | 0.088367 | 29.6736 |
| LAB260 | 30072.2 | 9.32625 | 0.229548 | 19.2219 |
| LAB260 | 30071.4 | 9.06814 | 0.05876 | 15.9223 |
| LAB260 | 30074.3 | 8.79726 | 0.114844 | 12.4596 |
| LAB264 | 30134.4 | 9.72314 | 0.153667 | 24.2956 |
| LAB264 | 30131.1 | 9.26881 | 0.327649 | 18.4876 |
| LAB264 | 30131.2 | 8.73403 | 0.618996 | 11.6513 |
| LAB264 | 30135.2 | 8.36674 | 0.794544 | 6.956 |
| LAB265 | 30734.4 | 9.36524 | 0.638491 | 19.7203 |
| LAB265 | 30733.4 | 9.1304 | 0.604476 | 16.7183 |
| LAB265 | 30731.3 | 8.99546 | 0.485025 | 14.9933 |
| LAB265 | 30732.2 | 8.30232 | 0.724407 | 6.1325 |
| LAB265 | 30732.3 | 8.01014 | 0.854562 | 2.3974 |
| LAB290_H0 | 30662.3 | 10.5097 | 0.145581 | 34.3507 |
| LAB290_H0 | 30663.1 | 9.40722 | 0.17296 | 20.257 |
| LAB290_H0 | 30663.7 | 8.48963 | 0.683227 | 8.527 |
| LAB307 | 30761.5 | 10.2357 | 0.243249 | 30.8475 |
| LAB307 | 30761.1 | 9.24029 | 0.005621 | 18.1231 |
| LAB307 | 30763.3 | 8.39287 | 0.163485 | 7.29 |
| LAB308 | 30933.3 | 9.46609 | 0.48907 | 21.0095 |
| LAB308 | 30931.4 | 9.34348 | 0.354167 | 19.4422 |
| LAB308 | 30934.4 | 9.00443 | 0.431187 | 15.1079 |
| LAB308 | 30933.2 | 8.80664 | 0.032355 | 12.5795 |
| LAB308 | 30932.3 | 8.04655 | 0.811961 | 2.8628 |
| LAB319 | 30775.2 | 9.84389 | 0.083655 | 25.8392 |
| LAB319 | 30774.3 | 9.77777 | 0.292948 | 24.9938 |
| LAB319 | 30775.4 | 9.77496 | 0.054019 | 24.958 |
| LAB319 | 30771.5 | 8.83015 | 0.131911 | 12.88 |
| LAB319 | 30774.1 | 8.50579 | 0.233403 | 8.7336 |
| LAB319 | 30775.1 | 8.15797 | 0.409692 | 4.2872 |
| LAB320 | 30601.4 | 9.39625 | 0.663425 | 20.1167 |
| LAB320 | 30603.1 | 9.38251 | 0.562077 | 19.9411 |
| LAB320 | 30601.3 | 9.12827 | 0.167054 | 16.691 |
| LAB343 | 30623.5 | 10.085 | 0.147069 | 28.9211 |
| LAB343 | 30622.4 | 9.65402 | 0.196051 | 23.412 |
| LAB343 | 30622.2 | 9.59388 | 0.001568 | 22.6432 |
| LAB343 | 30623.4 | 9.03785 | 0.17577 | 15.5352 |
| LAB343 | 30623.3 | 7.87593 | 0.983099 | 0.6817 |
| LAB353 | 30551.3 | 12.1684 | 0.187172 | 55.5549 |
| LAB353 | 30554.2 | 10.3104 | 0.128834 | 31.8023 |
| LAB353 | 30553.1 | 10.0984 | 0.00032 | 29.0924 |
| LAB353 | 30554.3 | 9.27579 | 0.097145 | 18.5768 |
| LAB353 | 30551.4 | 8.94524 | 0.567473 | 14.3513 |
| control | — | 7.8226 | — | 0 |
| LAB108 | 28504.1 | 14.0518 | 0.243267 | 29.4383 |
| LAB108 | 28502.2 | 11.562 | 0.711461 | 6.5037 |
| LAB108 | 28505.2 | 11.4703 | 0.719546 | 5.6587 |
| LAB108 | 28501.4 | 11.1314 | 0.695834 | 2.5374 |
| LAB119 | 28413.1 | 14.1454 | 0.226193 | 30.3002 |
| LAB119 | 28411.1 | 12.7283 | 0.021579 | 17.2467 |
| LAB119 | 28412.1 | 12.6987 | 0.571527 | 16.9738 |
| LAB157 | 28144.2 | 11.7814 | 0.691873 | 8.5247 |
| LAB157 | 28142.3 | 11.149 | 0.770316 | 2.6993 |
| LAB157 | 28145.2 | 11.0226 | 0.925822 | 1.5349 |
| LAB157 | 28146.2 | 10.8968 | 0.979225 | 0.3762 |
| LAB231 | 28582.1 | 13.6432 | 0.312115 | 25.6745 |
| LAB231 | 28585.1 | 13.3584 | 0.244783 | 23.0509 |
| LAB231 | 28583.1 | 12.8199 | 0.185275 | 18.0909 |
| LAB231 | 28581.3 | 12.4729 | 0.599297 | 14.8942 |
| LAB231 | 28585.3 | 11.6677 | 0.585349 | 7.4771 |
| LAB238 | 28424.4 | 12.6411 | 0.437658 | 16.4431 |
| LAB238 | 28422.4 | 11.9488 | 0.547272 | 10.066 |
| LAB238 | 28422.5 | 11.5007 | 0.341387 | 5.9387 |
| LAB238 | 28425.5 | 11.3703 | 0.285837 | 4.7375 |
| LAB240 | 28595.1 | 13.2636 | 0.000225 | 22.1775 |
| LAB240 | 28595.3 | 13.1887 | 0.443191 | 21.4876 |
| LAB240 | 28592.6 | 11.4432 | 0.332429 | 5.4089 |
| LAB240 | 28592.5 | 11.0732 | 0.903813 | 2.0006 |
| LAB242 | 28081.2 | 11.9281 | 0.558548 | 9.8754 |
| LAB242 | 28085.1 | 11.624 | 0.640121 | 7.0741 |
| LAB242 | 28083.1 | 11.4498 | 0.781006 | 5.4701 |
| LAB267 | 28384.5 | 14.3782 | 0.309508 | 32.4449 |
| LAB267 | 28383.2 | 13.237 | 0.065018 | 21.9329 |
| LAB267 | 28384.2 | 12.257 | 0.408693 | 12.9055 |
| LAB267 | 28381.2 | 11.9369 | 0.269148 | 9.9568 |
| LAB267 | 28385.3 | 11.6197 | 0.407754 | 7.0351 |
| LAB269 | 28345.2 | 13.9772 | 0.266703 | 28.7514 |
| LAB269 | 28345.3 | 13.3661 | 0.030381 | 23.1223 |
| LAB269 | 28341.3 | 12.1955 | 0.091931 | 12.3386 |
| LAB279 | 28351.1 | 16.9997 | 0.000058 | 56.5929 |
| LAB279 | 28354.1 | 12.6231 | 0.530948 | 16.2774 |
| LAB279 | 28355.4 | 12.0303 | 0.504118 | 10.8172 |
| LAB279 | 28351.4 | 11.2091 | 0.749226 | 3.2528 |
| LAB283 | 28361.1 | 12.1513 | 0.435254 | 11.9318 |
| LAB283 | 28365.1 | 11.8289 | 0.339275 | 8.9619 |
| LAB283 | 28364.3 | 10.9679 | 0.976839 | 1.0304 |
| LAB298 | 29245.3 | 14.2413 | 0.117553 | 31.1839 |
| LAB298 | 29244.1 | 11.3115 | 0.82276 | 4.1963 |
| LAB298 | 29245.2 | 11.1423 | 0.844639 | 2.6372 |
| LAB299 | 28066.1 | 14.8442 | 0.019689 | 36.7374 |
| LAB299 | 28064.1 | 12.3026 | 0.15277 | 13.3253 |
| LAB299 | 28063.2 | 11.1919 | 0.923294 | 3.0946 |
| LAB299 | 28061.1 | 11.1495 | 0.651599 | 2.7039 |
| LAB302 | 28825.1 | 12.3092 | 0.585099 | 13.3859 |
| LAB302 | 28825.2 | 11.6149 | 0.804255 | 6.9903 |
| LAB302 | 28822.7 | 11.5443 | 0.256554 | 6.3406 |
| LAB336 | 28374.3 | 13.9013 | 0.000055 | 28.0516 |
| LAB336 | 28375.1 | 12.1498 | 0.59076 | 11.9177 |
| LAB336 | 28374.1 | 11.9146 | 0.615959 | 9.7518 |
| LAB336 | 28375.3 | 11.1159 | 0.80551 | 2.3937 |
| LAB339 | 27271.5 | 13.4558 | 0.142791 | 23.9478 |
| LAB339 | 27272.4 | 12.0542 | 0.545248 | 11.0372 |
| LAB339 | 27272.7 | 11.6036 | 0.675643 | 6.8862 |
| LAB339 | 27272.2 | 11.2794 | 0.842265 | 3.8999 |
| LAB345 | 28494.1 | 11.9638 | 0.446095 | 10.205 |
| LAB345 | 28495.1 | 11.417 | 0.721872 | 5.1681 |
| LAB58 | 28442.4 | 12.8068 | 0.56215 | 17.9701 |
| LAB58 | 28445.2 | 11.5399 | 0.846003 | 6.2995 |
| LAB58 | 28442.1 | 11.231 | 0.689887 | 3.4545 |
| control | — | 10.856 | — | 0 |
| LAB101 | 30643.2 | 11.5624 | 0.940654 | 0.9726 |
| LAB101 | 30645.1 | 11.5252 | 0.959703 | 0.6478 |
| LAB107 | 30533.4 | 12.4327 | 0.320197 | 8.5731 |
| LAB107 | 30533.1 | 12.1863 | 0.48404 | 6.4214 |
| LAB107 | 30534.3 | 11.4831 | 0.972602 | 0.2799 |
| LAB130 | 30545.2 | 13.3737 | 0.472561 | 16.791 |
| LAB163 | 30833.1 | 13.586 | 0.087113 | 18.6446 |
| LAB163 | 30832.2 | 13.2028 | 0.28764 | 15.2979 |
| LAB164 | 30524.1 | 11.6374 | 0.882941 | 1.628 |
| LAB172 | 30854.4 | 12.7659 | 0.198144 | 11.4828 |
| LAB172 | 30853.4 | 12.6893 | 0.222509 | 10.8138 |
| LAB172 | 30855.3 | 12.2347 | 0.441997 | 6.8442 |
| LAB261 | 31073.1 | 11.8536 | 0.686192 | 3.5159 |
| LAB261 | 31075.3 | 11.827 | 0.711894 | 3.2835 |
| LAB261 | 31075.1 | 11.6975 | 0.830813 | 2.1525 |
| LAB263 | 30891.6 | 14.0967 | 0.031325 | 23.1044 |
| LAB271 | 30905.4 | 11.4846 | 0.972316 | 0.2931 |
| LAB272 | 31123.5 | 12.2587 | 0.697179 | 7.0532 |

TABLE 77-continued

Genes showing improved plant photosynthetic capacity under high salinity conditions

| Gene Name | Event # | Petiole Relative Area [%] Ave. | P-Val. | % Incr. |
|---|---|---|---|---|
| LAB286 | 30924.2 | 11.9143 | 0.623811 | 4.0462 |
| LAB286 | 30923.3 | 11.8145 | 0.887937 | 3.1743 |
| LAB286 | 30922.4 | 11.5798 | 0.928224 | 1.1245 |
| LAB329 | 30103.2 | 13.3748 | 0.082007 | 16.8001 |
| control | — | 11.451 | — | 0 |
| LAB101 | 30645.1 | 10.8082 | 0.063148 | 25.735 |
| LAB101 | 30644.2 | 10.1179 | 0.468003 | 17.7039 |
| LAB101 | 30641.4 | 9.18423 | 0.806907 | 6.8426 |
| LAB107 | 30535.2 | 9.81118 | 0.383131 | 14.136 |
| LAB107 | 30532.3 | 9.72119 | 0.635607 | 13.0892 |
| LAB107 | 30533.1 | 9.14492 | 0.654057 | 6.3852 |
| LAB107 | 30533.4 | 9.06674 | 0.7636 | 5.4757 |
| LAB107 | 30534.3 | 8.641 | 0.954857 | 0.523 |
| LAB121 | 30804.1 | 12.4083 | 0.288031 | 44.3488 |
| LAB121 | 30802.2 | 10.5053 | 0.082273 | 22.2104 |
| LAB121 | 30801.4 | 10.486 | 0.486696 | 21.9863 |
| LAB129 | 30825.1 | 10.8754 | 0.161052 | 26.5163 |
| LAB129 | 30822.2 | 10.7597 | 0.147342 | 25.17 |
| LAB129 | 30824.1 | 9.52773 | 0.709243 | 10.8385 |
| LAB129 | 30825.5 | 8.86849 | 0.855476 | 3.1695 |
| LAB130 | 30545.1 | 9.78803 | 0.305957 | 13.8667 |
| LAB130 | 30541.3 | 8.92376 | 0.753497 | 3.8125 |
| LAB163 | 30833.1 | 14.1546 | 0.170728 | 64.6643 |
| LAB163 | 30832.2 | 10.2328 | 0.12404 | 19.0403 |
| LAB163 | 30834.2 | 10.2212 | 0.11484 | 18.9058 |
| LAB164 | 30522.1 | 9.77899 | 0.357469 | 13.7615 |
| LAB164 | 30525.2 | 9.63171 | 0.435773 | 12.0481 |
| LAB164 | 30524.1 | 9.47311 | 0.384683 | 10.2032 |
| LAB164 | 30525.3 | 8.93342 | 0.691495 | 3.9247 |
| LAB164 | 30522.4 | 8.63283 | 0.983208 | 0.4279 |
| LAB171 | 30841.3 | 9.7422 | 0.451867 | 13.3335 |
| LAB171 | 30842.3 | 9.42255 | 0.604134 | 9.6149 |
| LAB171 | 30843.2 | 9.13076 | 0.519446 | 6.2205 |
| LAB172 | 30854.4 | 10.9479 | 0.201752 | 27.3593 |
| LAB172 | 30853.3 | 10.4286 | 0.096901 | 21.3184 |
| LAB172 | 30854.1 | 9.68927 | 0.660721 | 12.7178 |
| LAB172 | 30855.2 | 9.04359 | 0.587445 | 5.2064 |
| LAB175 | 30514.4 | 9.04478 | 0.629444 | 5.2202 |
| LAB204 | 30865.4 | 11.6825 | 0.038808 | 35.9054 |
| LAB204 | 30863.1 | 10.6485 | 0.082266 | 23.8771 |
| LAB204 | 30864.1 | 10.5115 | 0.372743 | 22.283 |
| LAB261 | 31075.1 | 11.2786 | 0.045083 | 31.2066 |
| LAB261 | 31073.1 | 9.79717 | 0.250907 | 13.973 |
| LAB261 | 31075.3 | 9.49423 | 0.689628 | 10.4489 |
| LAB263 | 30892.3 | 10.7514 | 0.163423 | 25.0737 |
| LAB263 | 30892.4 | 10.2553 | 0.120622 | 19.3031 |
| LAB263 | 30893.3 | 9.86045 | 0.734944 | 14.7092 |
| LAB271 | 30903.1 | 10.364 | 0.460683 | 20.5666 |
| LAB271 | 30905.4 | 9.88014 | 0.441339 | 14.9382 |
| LAB271 | 30901.3 | 8.74841 | 0.907254 | 1.7725 |
| LAB272 | 31123.1 | 9.97996 | 0.450837 | 16.0995 |
| LAB272 | 31121.1 | 9.42071 | 0.544848 | 9.5936 |
| LAB272 | 31123.5 | 9.07798 | 0.635178 | 5.6065 |
| LAB272 | 31123.6 | 9.06625 | 0.538136 | 5.47 |
| LAB284 | 30913.1 | 9.58046 | 0.537892 | 11.452 |
| LAB284 | 30913.3 | 8.95054 | 0.863946 | 4.124 |
| LAB286 | 30921.1 | 9.42346 | 0.40807 | 9.6256 |
| LAB286 | 30924.3 | 9.32598 | 0.371287 | 8.4916 |
| LAB329 | 30102.3 | 10.0788 | 0.145666 | 17.2497 |
| LAB329 | 30103.2 | 10.0366 | 0.168264 | 16.7584 |
| LAB329 | 30104.2 | 9.22849 | 0.783962 | 7.3574 |
| LAB329 | 30104.1 | 8.95199 | 0.753697 | 4.1409 |
| control | — | 8.59604 | — | 0 |
| LAB116 | 31441.1 | 12.4098 | 0.069808 | 21.1125 |
| LAB116 | 31441.4 | 10.5934 | 0.381696 | 3.3851 |
| LAB122 | 31161.3 | 11.0774 | 0.165074 | 8.1093 |
| LAB137 | 31316.3 | 10.7514 | 0.72425 | 4.9276 |
| LAB137 | 31312.2 | 10.478 | | 2.2594 |
| LAB154 | 30692.2 | 19.4718 | 0.516116 | 90.0333 |
| LAB178 | 30632.4 | 21.5171 | 0.508526 | 109.994 |
| LAB178 | 30633.3 | 10.5655 | 0.834542 | 3.113 |
| LAB235 | 31322.2 | 11.5704 | 0.576991 | 12.9203 |
| LAB255 | 31212.1 | 11.4729 | 0.490815 | 11.9689 |
| LAB292 | 31221.3 | 11.2752 | 0.601741 | 10.0396 |
| LAB312 | 30942.2 | 12.2131 | 0.136369 | 19.1923 |
| LAB312 | 30945.4 | 11.0162 | 0.762436 | 7.5119 |
| LAB329 | 30103.2 | 10.4195 | | 1.6881 |
| LAB342 | 31703.5 | 10.7179 | 0.791441 | 4.6002 |
| LAB342 | 31702.3 | 10.4012 | 0.944339 | 1.5096 |
| LAB342 | 31705.4 | 11.061 | | 7.9484 |
| LAB342 | 31705.6 | 12.9984 | | 26.8571 |
| LAB56 | 31451.3 | 10.7946 | | 5.3492 |
| LAB56 | 31455.9 | 10.7701 | | 5.1094 |
| LAB97 | 31306.3 | 12.2683 | 0.000034 | 19.7315 |
| LAB98 | 31011.4 | 13.0693 | 0.283771 | 27.5485 |
| LAB98 | 31011.2 | 12.1505 | 0.000099 | 18.5815 |
| control | — | 10.2465 | — | 0 |

Table 77.
"CONT."—Control;
"Ave."—Average;
"% Incr." = % increment;
"p-val."—p-value.

TABLE 78

Genes showing improved rosette growth performance under high salinity conditions

| Gene Name | Event # | RGR Of Rosette Area Ave. | P-Val. | % Incr. | RGR Of Rosette Diameter Ave. | P-Val. | % Incr. | RGR Of Plot Coverage Ave. | P-Val | % Incr. |
|---|---|---|---|---|---|---|---|---|---|---|
| LAB258 | 27441.4 | 1.01 | 0.30 | 15 | 0.44 | 0.42 | 9 | 8.09 | 0.30 | 15 |
| LAB258 | 27441.6 | 1.04 | 0.22 | 19 | 0.48 | 0.11 | 19 | 7.74 | 0.48 | 10 |
| LAB258 | 27442.2 | 1.06 | 0.15 | 21 | 0.47 | 0.11 | 17 | 8.49 | 0.15 | 21 |
| LAB258 | 27442.5 | 0.96 | 0.49 | 10 | 0.42 | 0.62 | 5 | 7.70 | 0.49 | 10 |
| LAB258 | 27444.4 | 0.95 | 0.55 | 8 | 0.42 | 0.68 | 4 | 7.60 | 0.55 | 8 |
| LAB247 | 28091.4 | 1.02 | 0.27 | 16 | 0.43 | 0.53 | 7 | 8.14 | 0.27 | 16 |
| LAB247 | 28093.2 | 0.91 | 0.78 | 4 | 0.44 | 0.44 | 8 | 7.29 | 0.78 | 4 |
| LAB247 | 28094.1 | 0.91 | 0.78 | 4 | 0.41 | 0.87 | 2 | 7.29 | 0.78 | 4 |
| LAB247 | 28094.3 | 1.07 | 0.13 | 22 | 0.46 | 0.22 | 13 | 8.14 | 0.26 | 16 |
| LAB247 | 28095.4 | 0.94 | 0.61 | 7 | 0.42 | 0.63 | 5 | 7.53 | 0.61 | 7 |
| LAB88 | 28193.6 | 0.88 | 0.95 | 1 | — | | — | 7.07 | 0.95 | 1 |
| LAB131 | 28291.1 | 1.09 | 0.10 | 24 | 0.45 | 0.29 | 11 | 8.69 | 0.10 | 24 |

TABLE 78-continued

Genes showing improved rosette growth performance under high salinity conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val | % Incr. |
| LAB131 | 28292.3 | 1.00 | 0.32 | 14 | 0.42 | 0.66 | 5 | 8.01 | 0.32 | 14 |
| LAB131 | 28293.3 | 0.90 | 0.86 | 3 | — | | — | 7.20 | 0.86 | 3 |
| LAB131 | 28294.2 | 0.89 | 0.92 | 1 | — | | — | 7.11 | 0.92 | 1 |
| LAB131 | 28295.3 | 0.98 | 0.41 | 12 | 0.41 | 0.80 | 3 | 7.32 | 0.76 | 4 |
| LAB153 | 28301.2 | 0.89 | 0.91 | 2 | 0.42 | 0.66 | 5 | 7.12 | 0.91 | 2 |
| LAB153 | 28302.2 | 1.04 | 0.19 | 19 | 0.45 | 0.30 | 11 | 8.36 | 0.19 | 19 |
| LAB153 | 28303.1 | 1.10 | 0.07 | 26 | 0.46 | 0.16 | 15 | 8.83 | 0.07 | 26 |
| LAB153 | 28304.1 | 1.12 | 0.06 | 28 | 0.45 | 0.24 | 12 | 8.97 | 0.06 | 28 |
| LAB153 | 28305.3 | 1.09 | 0.10 | 24 | 0.45 | 0.24 | 13 | 8.08 | 0.30 | 15 |
| LAB169 | 28391.1 | 0.95 | 0.56 | 8 | 0.43 | 0.55 | 6 | 7.59 | 0.56 | 8 |
| LAB169 | 28391.4 | 1.09 | 0.11 | 24 | 0.44 | 0.34 | 10 | 8.68 | 0.11 | 24 |
| LAB169 | 28392.1 | 0.94 | 0.61 | 7 | 0.41 | 0.82 | 2 | 7.52 | 0.61 | 7 |
| LAB169 | 28393.3 | 0.89 | 0.90 | 2 | — | | — | 7.13 | 0.90 | 2 |
| LAB169 | 28394.3 | 1.12 | 0.05 | 28 | 0.44 | 0.37 | 10 | 9.00 | 0.05 | 28 |
| LAB294 | 28401.3 | 1.10 | 0.08 | 25 | 0.44 | 0.43 | 8 | 8.79 | 0.08 | 25 |
| LAB294 | 28402.5 | 0.97 | 0.45 | 11 | 0.45 | 0.26 | 12 | 7.78 | 0.45 | 11 |
| LAB294 | 28404.1 | 0.96 | 0.51 | 9 | 0.43 | 0.58 | 6 | 7.67 | 0.51 | 9 |
| LAB294 | 28404.3 | — | | — | 0.42 | 0.76 | 3 | — | | — |
| LAB187 | 28431.3 | — | | — | 0.40 | 0.98 | 0 | — | | — |
| LAB187 | 28431.5 | 0.94 | 0.59 | 8 | 0.41 | 0.79 | 3 | 7.55 | 0.59 | 8 |
| LAB187 | 28434.1 | 1.32 | 0.00 | 51 | 0.48 | 0.12 | 20 | 10.59 | 0.00 | 51 |
| LAB74 | 28451.3 | — | | — | 0.41 | 0.91 | 1 | — | | — |
| LAB74 | 28452.2 | — | | — | 0.41 | 0.94 | 1 | — | | — |
| LAB74 | 28454.1 | 0.95 | 0.53 | 9 | 0.42 | 0.65 | 5 | 7.64 | 0.53 | 9 |
| LAB70 | 28463.1 | — | | — | 0.42 | 0.61 | 5 | — | | — |
| LAB152 | 28471.1 | 0.92 | 0.75 | 5 | 0.42 | 0.65 | 5 | 7.33 | 0.75 | 5 |
| LAB152 | 28472.3 | 0.96 | 0.49 | 10 | — | | — | 7.70 | 0.49 | 10 |
| LAB152 | 28473.2 | 1.03 | 0.22 | 18 | 0.46 | 0.21 | 14 | 8.27 | 0.22 | 18 |
| LAB152 | 28473.3 | 0.98 | 0.40 | 12 | 0.43 | 0.56 | 6 | 7.87 | 0.40 | 12 |
| LAB152 | 28474.4 | 0.96 | 0.52 | 9 | 0.41 | 0.89 | 1 | 7.66 | 0.52 | 9 |
| LAB181 | 28481.1 | 1.03 | 0.23 | 17 | 0.46 | 0.24 | 13 | 8.24 | 0.23 | 17 |
| LAB181 | 28482.2 | 0.98 | 0.41 | 12 | — | | — | 7.84 | 0.41 | 12 |
| LAB181 | 28484.3 | 1.00 | 0.35 | 14 | 0.44 | 0.45 | 9 | 8.00 | 0.35 | 14 |
| LAB113 | 28543.5 | — | | — | 0.42 | 0.72 | 4 | — | | — |
| LAB113 | 28545.2 | 1.01 | 0.27 | 16 | 0.44 | 0.37 | 10 | 8.11 | 0.27 | 16 |
| LAB113 | 28545.3 | 0.94 | 0.62 | 7 | — | | — | 7.50 | 0.62 | 7 |
| LAB145 | 28551.1 | 1.00 | 0.32 | 14 | 0.42 | 0.73 | 4 | 8.02 | 0.32 | 14 |
| LAB145 | 28551.3 | 1.08 | 0.11 | 23 | 0.44 | 0.34 | 10 | 8.64 | 0.11 | 23 |
| LAB145 | 28553.2 | 1.04 | 0.19 | 19 | 0.44 | 0.35 | 10 | 8.34 | 0.19 | 19 |
| LAB145 | 28553.3 | 1.23 | 0.01 | 40 | 0.49 | 0.04 | 22 | 9.80 | 0.01 | 40 |
| LAB145 | 28555.1 | 0.92 | 0.75 | 5 | 0.41 | 0.91 | 1 | 7.34 | 0.75 | 5 |
| LAB213 | 28561.2 | 1.06 | 0.14 | 22 | 0.43 | 0.59 | 6 | 8.52 | 0.14 | 22 |
| LAB213 | 28562.6 | 1.07 | 0.14 | 22 | 0.43 | 0.52 | 7 | 8.53 | 0.14 | 22 |
| LAB213 | 28565.2 | 0.88 | 0.97 | 1 | 0.41 | 0.90 | 1 | — | | — |
| LAB230 | 28572.3 | 1.02 | 0.24 | 17 | 0.45 | 0.25 | 12 | 8.20 | 0.24 | 17 |
| LAB230 | 28574.2 | 0.96 | 0.48 | 10 | 0.44 | 0.33 | 10 | 7.71 | 0.48 | 10 |
| LAB249 | 28602.1 | 1.06 | 0.15 | 21 | 0.46 | 0.17 | 15 | 8.47 | 0.15 | 21 |
| LAB249 | 28603.3 | 1.03 | 0.23 | 18 | 0.48 | 0.10 | 18 | 8.25 | 0.23 | 18 |
| LAB249 | 28604.2 | 0.97 | 0.47 | 11 | 0.43 | 0.56 | 6 | 7.68 | 0.52 | 10 |
| LAB249 | 28604.4 | 0.97 | 0.48 | 10 | 0.42 | 0.61 | 5 | 7.72 | 0.48 | 10 |
| LAB249 | 28605.2 | 0.91 | 0.76 | 4 | — | | — | 7.32 | 0.76 | 4 |
| cont | — | 0.88 | — | 0 | 0.40 | — | 0 | 7.01 | — | 0 |
| LAB258 | 27441.4 | 0.74 | 0.60 | 8 | 0.38 | 0.56 | 7 | 5.91 | 0.60 | 8 |
| LAB258 | 27442.5 | 0.78 | 0.35 | 14 | 0.37 | 0.76 | 4 | 5.83 | 0.64 | 7 |
| LAB247 | 28091.4 | 0.84 | 0.17 | 23 | 0.40 | 0.34 | 12 | 6.70 | 0.17 | 23 |
| LAB247 | 28093.2 | 0.86 | 0.09 | 26 | 0.41 | 0.22 | 15 | 6.89 | 0.09 | 26 |
| LAB247 | 28094.1 | 0.76 | 0.44 | 12 | 0.38 | 0.61 | 6 | 6.11 | 0.44 | 12 |
| LAB247 | 28095.4 | 0.82 | 0.19 | 21 | 0.39 | 0.39 | 11 | 6.58 | 0.19 | 21 |
| LAB88 | 28191.3 | 0.70 | 0.83 | 3 | 0.36 | 0.88 | 2 | 5.63 | 0.83 | 3 |
| LAB88 | 28192.6 | — | | — | 0.37 | 0.76 | 4 | — | | — |
| LAB88 | 28193.2 | 0.73 | 0.65 | 7 | 0.37 | 0.73 | 4 | 5.83 | 0.65 | 7 |
| LAB131 | 28291.1 | 0.89 | 0.05 | 30 | 0.40 | 0.32 | 12 | 7.11 | 0.05 | 30 |
| LAB131 | 28292.3 | 0.85 | 0.11 | 25 | 0.40 | 0.31 | 12 | 6.80 | 0.11 | 25 |
| LAB131 | 28295.3 | 0.88 | 0.09 | 29 | 0.42 | 0.20 | 17 | 7.04 | 0.09 | 29 |
| LAB153 | 28301.2 | 0.71 | 0.77 | 4 | 0.37 | 0.80 | 3 | 5.69 | 0.77 | 4 |
| LAB153 | 28303.1 | 0.72 | 0.70 | 6 | 0.37 | 0.75 | 4 | 5.78 | 0.70 | 6 |
| LAB153 | 28304.1 | 0.83 | 0.16 | 21 | 0.39 | 0.41 | 10 | 6.61 | 0.16 | 21 |
| LAB169 | 28391.1 | 1.07 | 0.00 | 57 | 0.46 | 0.01 | 30 | 8.55 | 0.00 | 57 |
| LAB169 | 28392.1 | 1.08 | 0.00 | 58 | 0.49 | 0.00 | 38 | 8.61 | 0.00 | 58 |
| LAB169 | 28393.2 | 0.95 | 0.01 | 40 | 0.41 | 0.18 | 16 | 7.62 | 0.01 | 40 |
| LAB169 | 28394.3 | 0.82 | 0.17 | 21 | 0.39 | 0.36 | 11 | 6.59 | 0.17 | 21 |

TABLE 78-continued

Genes showing improved rosette growth performance under high salinity conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val | % Incr. |
| LAB294 | 28402.4 | 0.68 | 0.99 | 0 | — | — | — | 5.47 | 0.99 | 0 |
| LAB294 | 28405.1 | 0.77 | 0.39 | 13 | 0.39 | 0.47 | 9 | 6.18 | 0.39 | 13 |
| LAB187 | 28433.3 | 0.71 | 0.79 | 4 | — | — | — | 5.68 | 0.79 | 4 |
| LAB187 | 28434.1 | 0.90 | 0.04 | 32 | 0.40 | 0.24 | 14 | 7.23 | 0.04 | 32 |
| LAB187 | 28434.2 | 0.72 | 0.70 | 6 | — | — | — | 5.77 | 0.70 | 6 |
| LAB187 | 28435.4 | 0.85 | 0.11 | 25 | 0.39 | 0.35 | 11 | 6.81 | 0.11 | 25 |
| LAB74 | 28451.3 | 0.92 | 0.03 | 35 | 0.39 | 0.40 | 10 | 7.36 | 0.03 | 35 |
| LAB74 | 28452.4 | 0.70 | 0.87 | 3 | — | — | — | 5.59 | 0.87 | 3 |
| LAB152 | 28471.1 | 0.91 | 0.04 | 33 | 0.43 | 0.07 | 22 | 7.24 | 0.04 | 33 |
| LAB152 | 28472.3 | 0.81 | 0.20 | 20 | 0.41 | 0.16 | 17 | 6.52 | 0.20 | 20 |
| LAB152 | 28473.2 | 0.81 | 0.20 | 19 | 0.40 | 0.26 | 14 | 6.51 | 0.20 | 19 |
| LAB152 | 28473.3 | 0.69 | 0.92 | 2 | — | — | — | 5.54 | 0.92 | 2 |
| LAB181 | 28481.1 | 0.82 | 0.20 | 20 | 0.39 | 0.38 | 11 | 6.52 | 0.20 | 20 |
| LAB181 | 28482.2 | 0.82 | 0.20 | 20 | 0.42 | 0.10 | 20 | 6.11 | 0.45 | 12 |
| LAB181 | 28482.3 | 0.71 | 0.80 | 4 | — | — | — | 5.65 | 0.80 | 4 |
| LAB181 | 28483.2 | 0.69 | 0.90 | 2 | 0.36 | 0.83 | 3 | 5.55 | 0.90 | 2 |
| LAB181 | 28484.3 | 0.75 | 0.50 | 10 | 0.36 | 0.84 | 2 | 6.01 | 0.50 | 10 |
| LAB81 | 28531.1 | 0.68 | 0.99 | 0 | — | — | — | 5.46 | 0.99 | 0 |
| LAB113 | 28545.2 | 0.74 | 0.61 | 8 | 0.38 | 0.53 | 8 | 5.89 | 0.61 | 8 |
| LAB113 | 28545.3 | 1.00 | 0.00 | 47 | 0.45 | 0.03 | 26 | 8.00 | 0.00 | 47 |
| LAB145 | 28551.1 | 0.93 | 0.03 | 36 | 0.44 | 0.06 | 25 | 7.44 | 0.03 | 36 |
| LAB145 | 28553.2 | 0.90 | 0.05 | 32 | 0.41 | 0.18 | 16 | 7.18 | 0.05 | 32 |
| LAB145 | 28553.3 | 1.10 | 0.00 | 61 | 0.47 | 0.01 | 32 | 8.78 | 0.00 | 61 |
| LAB145 | 28555.1 | 0.91 | 0.04 | 33 | 0.43 | 0.10 | 20 | 7.28 | 0.04 | 33 |
| LAB213 | 28561.2 | 0.86 | 0.09 | 26 | 0.40 | 0.34 | 11 | 6.89 | 0.09 | 26 |
| LAB213 | 28562.6 | 0.71 | 0.77 | 5 | 0.38 | 0.57 | 7 | 5.70 | 0.77 | 5 |
| LAB213 | 28565.2 | 0.77 | 0.41 | 13 | 0.38 | 0.59 | 7 | 6.16 | 0.41 | 13 |
| LAB230 | 28571.6 | 0.73 | 0.66 | 7 | 0.41 | 0.23 | 15 | 5.82 | 0.66 | 7 |
| LAB230 | 28572.2 | 0.83 | 0.21 | 21 | 0.39 | 0.42 | 10 | 6.60 | 0.21 | 21 |
| LAB230 | 28572.3 | 0.78 | 0.34 | 14 | 0.42 | 0.13 | 18 | 6.23 | 0.34 | 14 |
| LAB230 | 28574.2 | 0.70 | 0.88 | 2 | — | — | — | — | — | — |
| LAB230 | 28574.3 | — | — | — | 0.37 | 0.64 | 5 | — | — | — |
| LAB249 | 28602.1 | 0.76 | 0.47 | 11 | 0.39 | 0.44 | 9 | 6.05 | 0.47 | 11 |
| LAB249 | 28603.3 | — | — | — | 0.36 | 0.96 | 1 | — | — | — |
| LAB249 | 28604.2 | 0.77 | 0.40 | 13 | 0.36 | 0.90 | 1 | 6.15 | 0.40 | 13 |
| LAB249 | 28605.2 | 0.74 | 0.59 | 8 | 0.38 | 0.50 | 8 | 5.91 | 0.59 | 8 |
| cont | | 0.68 | — | 0 | 0.35 | — | 0 | 5.45 | — | 0 |
| LAB339 | 27272.7 | 1.28 | 0.01 | 31 | 0.56 | 0.01 | 15 | 10.22 | 0.01 | 31 |
| LAB299 | 28061.1 | 0.98 | 0.94 | 1 | — | — | — | 7.86 | 0.94 | 1 |
| LAB299 | 28063.1 | 1.26 | 0.02 | 29 | 0.55 | 0.01 | 14 | 9.41 | 0.08 | 21 |
| LAB299 | 28064.1 | 1.04 | 0.54 | 7 | — | — | — | 8.34 | 0.54 | 7 |
| LAB299 | 28066.1 | 1.17 | 0.16 | 20 | 0.52 | 0.32 | 8 | 9.36 | 0.16 | 20 |
| LAB242 | 28081.2 | 1.15 | 0.16 | 18 | 0.50 | 0.51 | 4 | 9.18 | 0.16 | 18 |
| LAB242 | 28083.1 | 1.04 | 0.58 | 7 | 0.51 | 0.36 | 6 | 8.30 | 0.58 | 7 |
| LAB242 | 28085.1 | 1.09 | 0.46 | 12 | 0.51 | 0.58 | 5 | 8.72 | 0.46 | 12 |
| LAB157 | 28142.3 | 1.07 | 0.40 | 9 | 0.49 | 0.87 | 1 | 8.02 | 0.81 | 3 |
| LAB157 | 28145.2 | 1.10 | 0.34 | 13 | 0.50 | 0.76 | 2 | 8.82 | 0.34 | 13 |
| LAB157 | 28146.1 | 1.03 | 0.59 | 6 | 0.50 | 0.56 | 3 | 8.26 | 0.59 | 6 |
| LAB269 | 28343.4 | 1.05 | 0.54 | 7 | 0.50 | 0.47 | 4 | 8.36 | 0.54 | 7 |
| LAB269 | 28345.2 | 0.98 | 0.93 | 1 | — | — | — | 7.87 | 0.93 | 1 |
| LAB269 | 28345.3 | 1.05 | 0.47 | 8 | 0.53 | 0.10 | 9 | 8.43 | 0.47 | 8 |
| LAB279 | 28351.4 | 1.09 | 0.37 | 11 | 0.50 | 0.69 | 2 | 8.69 | 0.37 | 11 |
| LAB279 | 28353.2 | 1.26 | 0.03 | 29 | 0.57 | 0.01 | 17 | 10.06 | 0.03 | 29 |
| LAB283 | 28363.3 | 1.17 | 0.10 | 20 | 0.52 | 0.17 | 8 | 9.35 | 0.10 | 20 |
| LAB283 | 28364.3 | 1.11 | 0.27 | 14 | 0.50 | 0.65 | 3 | 8.90 | 0.27 | 14 |
| LAB283 | 28364.4 | 1.00 | 0.82 | 3 | — | — | — | 8.01 | 0.82 | 3 |
| LAB283 | 28365.1 | 1.07 | 0.41 | 10 | 0.52 | 0.15 | 8 | 8.54 | 0.41 | 10 |
| LAB336 | 28375.3 | — | — | — | 0.50 | 0.59 | 3 | — | — | — |
| LAB267 | 28383.2 | 1.01 | 0.71 | 4 | 0.49 | 0.77 | 2 | 8.12 | 0.71 | 4 |
| LAB267 | 28384.2 | 1.06 | 0.44 | 9 | 0.50 | 0.44 | 4 | 8.51 | 0.44 | 9 |
| LAB267 | 28384.5 | 1.04 | 0.59 | 6 | — | — | — | 8.29 | 0.59 | 6 |
| LAB267 | 28385.2 | 1.02 | 0.65 | 5 | — | — | — | 8.20 | 0.65 | 5 |
| LAB119 | 28412.1 | 1.19 | 0.09 | 22 | 0.53 | 0.16 | 10 | 9.50 | 0.09 | 22 |
| LAB119 | 28413.1 | 1.16 | 0.11 | 19 | 0.55 | 0.02 | 14 | 9.26 | 0.11 | 19 |
| LAB119 | 28415.2 | 1.03 | 0.64 | 6 | 0.49 | 0.86 | 1 | 8.23 | 0.64 | 6 |
| LAB238 | 28422.4 | 1.00 | 0.82 | 2 | 0.49 | 0.94 | 0 | 7.99 | 0.82 | 2 |
| LAB238 | 28424.3 | 1.01 | 0.75 | 4 | 0.49 | 0.81 | 1 | 8.09 | 0.75 | 4 |
| LAB238 | 28425.5 | 1.14 | 0.22 | 17 | 0.53 | 0.20 | 10 | 9.09 | 0.22 | 17 |
| LAB58 | 28441.2 | 1.04 | 0.59 | 6 | — | — | — | 8.29 | 0.59 | 6 |
| LAB58 | 28442.1 | 1.19 | 0.13 | 22 | 0.52 | 0.47 | 7 | 9.51 | 0.13 | 22 |
| LAB58 | 28443.2 | 1.23 | 0.03 | 27 | 0.54 | 0.05 | 11 | 9.87 | 0.03 | 27 |

TABLE 78-continued

Genes showing improved rosette growth performance under high salinity conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val | % Incr. |
| LAB58 | 28443.4 | 1.02 | 0.63 | 5 | — | — | — | 8.19 | 0.63 | 5 |
| LAB58 | 28445.2 | 1.10 | 0.33 | 13 | 0.49 | 0.93 | 1 | 8.80 | 0.33 | 13 |
| LAB345 | 28495.1 | 1.08 | 0.41 | 10 | 0.49 | 0.74 | 2 | 8.61 | 0.41 | 10 |
| LAB108 | 28502.2 | 1.15 | 0.13 | 18 | 0.51 | 0.38 | 5 | 9.21 | 0.13 | 18 |
| LAB231 | 28583.1 | 1.17 | 0.10 | 20 | 0.55 | 0.04 | 14 | 9.38 | 0.10 | 20 |
| LAB231 | 28585.1 | 1.18 | 0.10 | 21 | 0.54 | 0.05 | 12 | 9.43 | 0.10 | 21 |
| LAB240 | 28592.2 | 1.32 | 0.01 | 35 | 0.57 | 0.00 | 18 | 10.54 | 0.01 | 35 |
| LAB240 | 28592.6 | 1.17 | 0.10 | 20 | 0.52 | 0.26 | 7 | 9.37 | 0.10 | 20 |
| LAB240 | 28595.1 | 1.31 | 0.01 | 35 | 0.58 | 0.00 | 20 | 10.52 | 0.01 | 35 |
| LAB240 | 28595.3 | 1.10 | 0.35 | 13 | 0.51 | 0.55 | 5 | 8.79 | 0.35 | 13 |
| LAB302 | 28822.7 | 1.28 | 0.04 | 31 | 0.53 | 0.26 | 10 | 10.23 | 0.04 | 31 |
| LAB302 | 28823.4 | 0.99 | 0.88 | 2 | — | — | — | 7.93 | 0.88 | 2 |
| LAB302 | 28825.1 | 0.99 | 0.91 | 1 | 0.49 | 0.71 | 2 | 7.90 | 0.91 | 1 |
| LAB298 | 29244.1 | 1.11 | 0.25 | 14 | 0.55 | 0.05 | 13 | 8.88 | 0.25 | 14 |
| LAB298 | 29245.2 | 1.12 | 0.18 | 15 | 0.52 | 0.12 | 8 | 9.00 | 0.18 | 15 |
| LAB298 | 29245.3 | 1.07 | 0.47 | 10 | — | — | — | 8.56 | 0.47 | 10 |
| LAB298 | 29245.4 | 1.12 | 0.17 | 15 | 0.51 | 0.24 | 6 | 8.99 | 0.17 | 15 |
| cont | — | 0.97 | — | 0 | 0.48 | — | 0 | 7.80 | — | 0 |
| LAB335 | 27314.2 | 1.24 | 0.60 | 7 | 0.50 | 0.71 | 3 | 9.88 | 0.60 | 7 |
| LAB335 | 27315.4 | 1.18 | 0.91 | 1 | — | — | — | 9.41 | 0.91 | 1 |
| LAB54 | 28134.1 | 1.30 | 0.32 | 12 | — | — | — | 10.43 | 0.32 | 12 |
| LAB54 | 28136.1 | 1.26 | 0.50 | 8 | — | — | — | 10.06 | 0.50 | 8 |
| LAB54 | 28136.2 | 1.24 | 0.56 | 7 | — | — | — | 9.95 | 0.56 | 7 |
| LAB310 | 28181.2 | 1.20 | 0.77 | 4 | — | — | — | 9.61 | 0.77 | 4 |
| LAB310 | 28182.3 | 1.33 | 0.23 | 15 | 0.51 | 0.65 | 3 | 10.63 | 0.23 | 15 |
| LAB210 | 28331.3 | 1.21 | 0.75 | 4 | — | — | — | 9.65 | 0.75 | 4 |
| LAB133 | 28832.1 | 1.25 | 0.51 | 8 | 0.50 | 0.73 | 3 | 10.03 | 0.51 | 8 |
| LAB327 | 29224.2 | 1.27 | 0.44 | 10 | 0.50 | 0.80 | 2 | 10.18 | 0.44 | 10 |
| LAB327 | 29225.2 | 1.20 | 0.79 | 3 | — | — | — | 9.59 | 0.79 | 3 |
| LAB160 | 29315.3 | 1.25 | 0.57 | 7 | — | — | — | 9.96 | 0.57 | 7 |
| LAB73 | 30154.3 | 1.28 | 0.41 | 10 | 0.50 | 0.84 | 2 | 10.25 | 0.41 | 10 |
| cont | — | 1.16 | — | 0 | 0.49 | — | 0 | 9.28 | — | 0 |
| LAB167 | 27321.2 | 1.30 | 0.09 | 19 | 0.56 | 0.01 | 20 | 10.43 | 0.09 | 19 |
| LAB167 | 27321.3 | 1.17 | 0.55 | 7 | 0.49 | 0.38 | 6 | 9.33 | 0.55 | 7 |
| LAB167 | 27321.4 | 1.28 | 0.14 | 17 | 0.53 | 0.04 | 15 | 10.23 | 0.14 | 17 |
| LAB167 | 27321.6 | 1.29 | 0.10 | 19 | 0.53 | 0.05 | 14 | 10.36 | 0.10 | 19 |
| LAB383 | 28111.3 | 1.12 | 0.80 | 3 | 0.50 | 0.32 | 7 | 8.98 | 0.80 | 3 |
| LAB383 | 28114.2 | 1.10 | 0.95 | 1 | 0.48 | 0.56 | 5 | 8.80 | 0.95 | 1 |
| LAB383 | 28115.2 | 1.23 | 0.25 | 13 | 0.53 | 0.05 | 14 | 9.84 | 0.25 | 13 |
| LAB355 | 29282.1 | 1.11 | 0.90 | 1 | 0.52 | 0.07 | 13 | 8.85 | 0.90 | 1 |
| LAB355 | 29282.2 | 1.21 | 0.35 | 11 | 0.51 | 0.12 | 11 | 9.66 | 0.35 | 11 |
| LAB355 | 29282.3 | — | — | — | 0.47 | 0.80 | 2 | — | — | — |
| LAB355 | 29283.1 | 1.39 | 0.02 | 27 | 0.55 | 0.02 | 18 | 11.12 | 0.02 | 27 |
| LAB92 | 29324.2 | — | — | — | 0.47 | 0.92 | 1 | — | — | — |
| LAB280 | 30041.2 | — | — | — | 0.47 | 0.77 | 2 | — | — | — |
| LAB280 | 30042.1 | 1.34 | 0.05 | 23 | 0.54 | 0.03 | 16 | 10.72 | 0.05 | 23 |
| LAB280 | 30044.1 | 1.57 | 0.00 | 44 | 0.58 | 0.00 | 27 | 12.56 | 0.00 | 44 |
| LAB280 | 30045.1 | 1.34 | 0.05 | 23 | 0.54 | 0.03 | 16 | 10.74 | 0.05 | 23 |
| LAB344 | 30091.2 | — | — | — | 0.47 | 0.87 | 1 | — | — | — |
| LAB344 | 30096.1 | — | — | — | 0.48 | 0.61 | 4 | — | — | — |
| LAB367 | 30172.3 | 1.14 | 0.69 | 5 | 0.49 | 0.41 | 6 | 9.13 | 0.69 | 5 |
| LAB367 | 30173.1 | 1.22 | 0.31 | 11 | 0.50 | 0.32 | 7 | 9.72 | 0.31 | 11 |
| LAB367 | 30173.3 | — | — | — | 0.47 | 0.91 | 1 | — | — | — |
| LAB367 | 30174.1 | — | — | — | 0.48 | 0.67 | 3 | — | — | — |
| LAB126 | 30201.3 | — | — | — | 0.48 | 0.59 | 4 | — | — | — |
| LAB126 | 30202.3 | 1.10 | 0.97 | 0 | 0.49 | 0.41 | 6 | 8.77 | 0.97 | 0 |
| LAB126 | 30205.1 | 1.28 | 0.13 | 17 | 0.53 | 0.04 | 15 | 10.21 | 0.13 | 17 |
| LAB241 | 30211.3 | 1.16 | 0.60 | 6 | 0.48 | 0.67 | 3 | 9.25 | 0.60 | 6 |
| LAB241 | 30212.1 | 1.12 | 0.79 | 3 | 0.49 | 0.49 | 5 | 8.99 | 0.79 | 3 |
| LAB241 | 30212.2 | 1.27 | 0.15 | 17 | 0.51 | 0.16 | 11 | 10.20 | 0.15 | 17 |
| LAB241 | 30213.1 | 1.16 | 0.59 | 6 | 0.51 | 0.20 | 9 | 9.25 | 0.59 | 6 |
| LAB311 | 30221.4 | 1.10 | 0.95 | 1 | 0.49 | 0.37 | 6 | 8.79 | 0.95 | 1 |
| LAB311 | 30222.2 | 1.30 | 0.10 | 19 | 0.55 | 0.01 | 20 | 10.41 | 0.10 | 19 |
| LAB311 | 30223.2 | 1.21 | 0.37 | 11 | 0.51 | 0.20 | 10 | 9.68 | 0.37 | 11 |
| LAB311 | 30224.2 | 1.11 | 0.88 | 2 | 0.49 | 0.42 | 6 | 8.88 | 0.88 | 2 |
| LAB165 | 30231.1 | — | — | — | 0.46 | 0.94 | 1 | — | — | — |
| LAB165 | 30231.2 | 1.15 | 0.64 | 5 | 0.52 | 0.11 | 13 | 9.20 | 0.64 | 5 |
| LAB165 | 30232.1 | 1.13 | 0.78 | 3 | 0.50 | 0.31 | 7 | 9.00 | 0.78 | 3 |
| LAB165 | 30233.1 | 1.17 | 0.53 | 7 | 0.49 | 0.46 | 5 | 9.34 | 0.53 | 7 |
| LAB165 | 30235.1 | 1.21 | 0.35 | 10 | 0.51 | 0.20 | 10 | 9.64 | 0.35 | 10 |
| LAB64 | 30271.2 | 1.15 | 0.64 | 5 | 0.49 | 0.32 | 7 | 9.17 | 0.64 | 5 |

TABLE 78-continued

Genes showing improved rosette growth performance under high salinity conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val | % Incr. |
| LAB64 | 30272.1 | 1.33 | 0.05 | 22 | 0.54 | 0.02 | 16 | 10.63 | 0.05 | 22 |
| LAB64 | 30273.2 | — | | — | 0.48 | 0.55 | 4 | — | | — |
| LAB64 | 30274.2 | 1.21 | 0.32 | 11 | — | | — | 9.69 | 0.32 | 11 |
| LAB64 | 30274.3 | 1.18 | 0.48 | 8 | 0.48 | 0.50 | 5 | 9.41 | 0.48 | 8 |
| LAB65 | 30301.4 | 1.44 | 0.01 | 32 | 0.54 | 0.03 | 16 | 11.55 | 0.01 | 32 |
| LAB65 | 30302.1 | 1.21 | 0.32 | 11 | 0.49 | 0.43 | 6 | 9.69 | 0.32 | 11 |
| LAB65 | 30303.4 | 1.28 | 0.13 | 18 | 0.52 | 0.10 | 12 | 10.27 | 0.13 | 18 |
| LAB65 | 30304.3 | 1.13 | 0.75 | 3 | 0.51 | 0.19 | 10 | 9.03 | 0.75 | 3 |
| LAB102 | 30312.2 | 1.13 | 0.75 | 4 | 0.51 | 0.15 | 11 | 9.05 | 0.75 | 4 |
| LAB220 | 30321.4 | — | | — | 0.47 | 0.78 | 2 | — | | — |
| LAB220 | 30322.2 | 1.12 | 0.84 | 2 | 0.47 | 0.91 | 1 | 8.93 | 0.84 | 2 |
| LAB220 | 30324.4 | — | | — | 0.49 | 0.38 | 6 | — | | — |
| LAB381 | 30351.4 | 1.10 | 0.96 | 1 | 0.48 | 0.55 | 4 | 8.78 | 0.96 | 1 |
| LAB381 | 30352.2 | 1.17 | 0.51 | 7 | 0.50 | 0.25 | 8 | 9.37 | 0.51 | 7 |
| LAB381 | 30352.4 | 1.24 | 0.21 | 14 | 0.53 | 0.04 | 15 | 9.95 | 0.21 | 14 |
| LAB381 | 30354.2 | 1.28 | 0.13 | 17 | 0.52 | 0.07 | 13 | 10.22 | 0.13 | 17 |
| LAB381 | 30356.1 | 1.13 | 0.74 | 4 | 0.47 | 0.87 | 1 | 9.05 | 0.74 | 4 |
| LAB289 | 30371.6 | 1.10 | 0.94 | 1 | 0.49 | 0.41 | 6 | 8.81 | 0.94 | 1 |
| LAB289 | 30373.1 | 1.15 | 0.61 | 6 | 0.51 | 0.16 | 10 | 9.24 | 0.61 | 6 |
| LAB289 | 30375.2 | 1.15 | 0.66 | 5 | 0.52 | 0.11 | 12 | 9.17 | 0.66 | 5 |
| LAB268 | 30391.4 | 1.11 | 0.90 | 1 | 0.47 | 0.84 | 1 | 8.85 | 0.90 | 1 |
| LAB268 | 30392.1 | 1.20 | 0.38 | 10 | 0.49 | 0.39 | 6 | 9.59 | 0.38 | 10 |
| LAB268 | 30393.1 | 1.17 | 0.51 | 7 | 0.53 | 0.06 | 14 | 9.37 | 0.51 | 7 |
| LAB268 | 30393.3 | — | | — | 0.47 | 0.88 | 1 | — | | — |
| LAB268 | 30395.1 | 1.25 | 0.20 | 14 | 0.51 | 0.20 | 9 | 9.99 | 0.20 | 14 |
| cont | — | 1.09 | — | 0 | 0.46 | — | 0 | 8.73 | — | 0 |
| LAB259 | 27112.1 | 1.26 | 0.90 | 1 | — | | — | 10.06 | 0.90 | 1 |
| LAB259 | 27112.3 | 1.33 | 0.47 | 7 | 0.54 | 0.16 | 7 | 10.66 | 0.47 | 7 |
| LAB259 | 27112.7 | 1.28 | 0.78 | 3 | — | | — | 10.21 | 0.78 | 3 |
| LAB55 | 30022.3 | 1.35 | 0.40 | 8 | 0.53 | 0.35 | 5 | 10.76 | 0.40 | 8 |
| LAB55 | 30023.1 | 1.28 | 0.77 | 3 | 0.52 | 0.51 | 3 | 10.22 | 0.77 | 3 |
| LAB55 | 30025.3 | 1.29 | 0.67 | 4 | — | | — | 10.36 | 0.67 | 4 |
| LAB300 | 30061.2 | 1.25 | 0.95 | 1 | — | | — | 10.00 | 0.95 | 1 |
| LAB300 | 30064.1 | 1.27 | 0.85 | 2 | 0.51 | 0.73 | 2 | 10.14 | 0.85 | 2 |
| LAB300 | 30064.3 | 1.26 | 0.92 | 1 | — | | — | 10.05 | 0.92 | 1 |
| LAB83 | 30191.1 | 1.34 | 0.40 | 8 | 0.53 | 0.39 | 4 | 10.75 | 0.40 | 8 |
| LAB83 | 30194.1 | 1.28 | 0.77 | 3 | 0.52 | 0.56 | 3 | 10.22 | 0.77 | 3 |
| LAB166 | 30242.1 | 1.39 | 0.22 | 12 | 0.52 | 0.59 | 3 | 11.14 | 0.22 | 12 |
| LAB166 | 30243.1 | 1.55 | 0.02 | 25 | 0.56 | 0.02 | 11 | 12.43 | 0.02 | 25 |
| LAB166 | 30245.3 | 1.27 | 0.79 | 2 | — | | — | 10.19 | 0.79 | 2 |
| LAB166 | 30245.4 | 1.28 | 0.77 | 3 | 0.53 | 0.37 | 5 | 10.24 | 0.77 | 3 |
| LAB323 | 30383.1 | 1.29 | 0.68 | 4 | 0.52 | 0.69 | 2 | 10.36 | 0.68 | 4 |
| LAB347_H0 | 30441.1 | 1.29 | 0.70 | 4 | — | | — | 10.31 | 0.70 | 4 |
| LAB347_H0 | 30443.4 | 1.32 | 0.50 | 7 | — | | — | 10.59 | 0.50 | 7 |
| LAB347_H0 | 30444.1 | 1.29 | 0.69 | 4 | 0.53 | 0.30 | 5 | 10.32 | 0.69 | 4 |
| LAB347_H0 | 30444.3 | 1.31 | 0.56 | 6 | 0.51 | 0.70 | 2 | 10.51 | 0.56 | 6 |
| LAB161 | 30482.1 | 1.26 | 0.92 | 1 | 0.51 | 0.70 | 2 | 10.04 | 0.92 | 1 |
| LAB161 | 30483.1 | 1.41 | 0.18 | 14 | 0.55 | 0.07 | 10 | 11.31 | 0.18 | 14 |
| LAB161 | 30485.1 | — | | — | 0.50 | 0.98 | 0 | — | | — |
| LAB161 | 30486.1 | 1.49 | 0.06 | 20 | 0.57 | 0.01 | 14 | 11.90 | 0.06 | 20 |
| LAB306 | 30561.2 | 1.30 | 0.65 | 5 | 0.52 | 0.49 | 4 | 10.41 | 0.65 | 5 |
| LAB306 | 30563.2 | 1.29 | 0.70 | 4 | 0.52 | 0.42 | 4 | 10.30 | 0.70 | 4 |
| LAB306 | 30564.2 | 1.30 | 0.61 | 5 | 0.52 | 0.43 | 4 | 10.41 | 0.61 | 5 |
| LAB306 | 30564.3 | 1.29 | 0.68 | 4 | 0.51 | 0.81 | 1 | 10.34 | 0.68 | 4 |
| LAB270 | 30591.2 | 1.25 | 0.93 | 1 | 0.51 | 0.92 | 0 | 10.03 | 0.93 | 1 |
| LAB270 | 30594.3 | 1.29 | 0.67 | 4 | — | | — | 10.35 | 0.67 | 4 |
| LAB270 | 30595.1 | — | | — | 0.51 | 0.88 | 1 | — | | — |
| LAB270 | 30595.2 | 1.39 | 0.23 | 12 | 0.53 | 0.32 | 5 | 11.13 | 0.23 | 12 |
| LAB262 | 30611.4 | 1.36 | 0.34 | 9 | 0.54 | 0.18 | 7 | 10.88 | 0.34 | 9 |
| LAB94 | 30681.4 | 1.27 | 0.85 | 2 | — | | — | 10.14 | 0.85 | 2 |
| LAB94 | 30682.2 | 1.29 | 0.71 | 4 | — | | — | 10.30 | 0.71 | 4 |
| LAB159 | 30702.4 | 1.36 | 0.35 | 9 | — | | — | 10.87 | 0.35 | 9 |
| LAB159 | 30704.3 | 1.49 | 0.06 | 20 | 0.56 | 0.02 | 12 | 11.91 | 0.06 | 20 |
| LAB159 | 30704.4 | 1.26 | 0.89 | 1 | — | | — | 10.08 | 0.89 | 1 |
| LAB170 | 30713.2 | — | | — | 0.51 | 0.72 | 2 | — | | — |
| LAB170 | 30715.2 | 1.34 | 0.44 | 8 | 0.52 | 0.51 | 3 | 10.71 | 0.44 | 8 |
| cont | — | 1.24 | — | 0 | 0.50 | — | 0 | 9.94 | — | 0 |
| LAB259 | 27112.1 | 0.71 | 0.67 | 7 | 0.37 | 0.64 | 5 | 5.70 | 0.67 | 7 |
| LAB259 | 27112.1 | 0.70 | 0.74 | 5 | 0.39 | 0.42 | 8 | 5.62 | 0.74 | 5 |
| LAB259 | 27112.3 | 0.86 | 0.09 | 29 | 0.41 | 0.11 | 17 | 6.90 | 0.09 | 29 |
| LAB259 | 27112.7 | 0.74 | 0.52 | 11 | 0.38 | 0.46 | 8 | 5.89 | 0.52 | 11 |

TABLE 78-continued

Genes showing improved rosette growth performance under high salinity conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val | % Incr. |
| LAB259 | 27112.9 | 0.91 | 0.03 | 37 | 0.41 | 0.10 | 17 | 7.29 | 0.03 | 37 |
| LAB300 | 30061.2 | 0.69 | 0.80 | 4 | 0.36 | 0.90 | 1 | 5.55 | 0.80 | 4 |
| LAB300 | 30064.1 | — | | — | 0.37 | 0.76 | 3 | — | | — |
| LAB300 | 30064.3 | 0.78 | 0.32 | 17 | 0.41 | 0.13 | 16 | 6.22 | 0.32 | 17 |
| LAB176 | 30141.4 | 0.78 | 0.33 | 16 | 0.41 | 0.15 | 16 | 6.20 | 0.33 | 16 |
| LAB176 | 30142.1 | 0.79 | 0.25 | 19 | 0.41 | 0.15 | 15 | 6.34 | 0.25 | 19 |
| LAB176 | 30143.1 | 0.75 | 0.45 | 12 | 0.40 | 0.19 | 13 | 5.99 | 0.45 | 12 |
| LAB176 | 30143.2 | 0.85 | 0.10 | 28 | 0.40 | 0.20 | 13 | 6.81 | 0.10 | 28 |
| LAB176 | 30144.2 | 0.79 | 0.27 | 19 | 0.39 | 0.39 | 9 | 6.32 | 0.27 | 19 |
| LAB166 | 30242.1 | — | | — | 0.38 | 0.60 | 6 | — | | — |
| LAB166 | 30243.1 | 0.72 | 0.60 | 9 | 0.37 | 0.65 | 5 | 5.79 | 0.60 | 9 |
| LAB166 | 30244.3 | 0.81 | 0.20 | 22 | 0.41 | 0.16 | 15 | 6.48 | 0.20 | 22 |
| LAB166 | 30245.3 | 0.74 | 0.48 | 12 | 0.40 | 0.26 | 12 | 5.96 | 0.48 | 12 |
| LAB166 | 30245.4 | 0.81 | 0.18 | 22 | 0.41 | 0.17 | 14 | 6.52 | 0.18 | 22 |
| LAB237 | 30281.4 | 0.77 | 0.35 | 16 | 0.39 | 0.42 | 9 | 6.17 | 0.35 | 16 |
| LAB237 | 30282.1 | 0.73 | 0.58 | 9 | 0.37 | 0.64 | 5 | 5.82 | 0.58 | 9 |
| LAB237 | 30283.2 | 0.71 | 0.66 | 7 | 0.36 | 0.83 | 2 | 5.72 | 0.66 | 7 |
| LAB237 | 30284.1 | 0.69 | 0.82 | 4 | 0.36 | 0.87 | 2 | 5.53 | 0.82 | 4 |
| LAB323 | 30381.1 | — | | — | 0.37 | 0.70 | 4 | — | | — |
| LAB323 | 30381.4 | 0.68 | 0.90 | 2 | 0.40 | 0.19 | 14 | 5.44 | 0.90 | 2 |
| LAB323 | 30383.1 | 0.74 | 0.52 | 11 | 0.40 | 0.23 | 13 | 5.90 | 0.52 | 11 |
| LAB161 | 30482.1 | — | | — | 0.36 | 0.84 | 2 | — | | — |
| LAB161 | 30482.2 | 0.67 | 0.96 | 1 | 0.39 | 0.39 | 9 | 5.37 | 0.96 | 1 |
| LAB161 | 30483.1 | 0.69 | 0.80 | 4 | 0.38 | 0.47 | 8 | 5.55 | 0.80 | 4 |
| LAB161 | 30485.1 | 0.75 | 0.45 | 12 | 0.42 | 0.07 | 19 | 5.99 | 0.45 | 12 |
| LAB161 | 30486.1 | 0.76 | 0.42 | 13 | 0.41 | 0.15 | 15 | 6.04 | 0.42 | 13 |
| LAB306 | 30561.2 | — | | — | 0.38 | 0.47 | 7 | — | | — |
| LAB306 | 30562.2 | 0.70 | 0.73 | 6 | 0.39 | 0.34 | 10 | 5.64 | 0.73 | 6 |
| LAB306 | 30563.2 | 0.70 | 0.75 | 5 | 0.39 | 0.42 | 8 | 5.62 | 0.75 | 5 |
| LAB306 | 30564.2 | 0.81 | 0.22 | 22 | 0.41 | 0.15 | 16 | 6.49 | 0.22 | 22 |
| LAB306 | 30564.3 | 0.79 | 0.25 | 19 | 0.41 | 0.15 | 15 | 6.35 | 0.25 | 19 |
| LAB270 | 30591.2 | 0.76 | 0.37 | 15 | 0.38 | 0.50 | 7 | 6.12 | 0.37 | 15 |
| LAB270 | 30594.1 | 0.69 | 0.84 | 3 | 0.36 | 0.81 | 3 | 5.50 | 0.84 | 3 |
| LAB262 | 30614.2 | 0.82 | 0.17 | 23 | 0.38 | 0.51 | 7 | 6.56 | 0.17 | 23 |
| LAB94 | 30681.4 | — | | — | 0.36 | 0.90 | 1 | — | | — |
| LAB94 | 30681.8 | 0.67 | 1.00 | 0 | 0.37 | 0.74 | 4 | 5.33 | 1.00 | 0 |
| LAB159 | 30701.6 | 0.68 | 0.93 | 1 | 0.37 | 0.61 | 5 | 5.40 | 0.93 | 1 |
| LAB159 | 30702.3 | 0.81 | 0.21 | 21 | 0.42 | 0.10 | 17 | 6.46 | 0.21 | 21 |
| LAB159 | 30702.4 | 0.77 | 0.35 | 16 | 0.40 | 0.19 | 14 | 6.16 | 0.35 | 16 |
| LAB159 | 30704.3 | 0.75 | 0.45 | 13 | 0.41 | 0.13 | 16 | 6.00 | 0.45 | 13 |
| LAB159 | 30704.4 | 0.72 | 0.62 | 8 | 0.39 | 0.43 | 9 | 5.77 | 0.62 | 8 |
| LAB170 | 30712.1 | 0.75 | 0.43 | 13 | 0.39 | 0.34 | 10 | 6.03 | 0.43 | 13 |
| LAB170 | 30712.2 | 0.75 | 0.47 | 12 | 0.40 | 0.25 | 13 | 5.98 | 0.47 | 12 |
| LAB170 | 30713.2 | 0.73 | 0.58 | 9 | 0.40 | 0.25 | 13 | 5.82 | 0.58 | 9 |
| LAB170 | 30715.1 | — | | — | 0.37 | 0.78 | 3 | — | | — |
| LAB170 | 30715.2 | 0.78 | 0.32 | 16 | 0.40 | 0.27 | 11 | 6.21 | 0.32 | 16 |
| LAB138 | 30781.1 | 0.73 | 0.57 | 10 | 0.40 | 0.20 | 14 | 5.84 | 0.57 | 10 |
| LAB138 | 30781.2 | — | | — | 0.39 | 0.37 | 9 | — | | — |
| cont | — | 0.67 | — | 0 | 0.36 | — | 0 | 5.33 | — | 0 |
| LAB191 | 28153.2 | 0.77 | 0.95 | 1 | — | | — | 6.18 | 0.95 | 1 |
| LAB191 | 28156.2 | 0.84 | 0.47 | 9 | 0.41 | 0.38 | 8 | 6.70 | 0.47 | 9 |
| LAB191 | 28156.4 | 0.77 | 0.96 | 1 | 0.42 | 0.14 | 13 | 6.18 | 0.96 | 1 |
| LAB260 | 30071.4 | 0.89 | 0.21 | 16 | 0.41 | 0.26 | 9 | 7.10 | 0.21 | 16 |
| LAB260 | 30072.2 | 0.89 | 0.21 | 16 | 0.43 | 0.07 | 15 | 7.11 | 0.21 | 16 |
| LAB260 | 30073.2 | 1.04 | 0.01 | 35 | 0.44 | 0.08 | 16 | 8.31 | 0.01 | 35 |
| LAB260 | 30073.4 | 0.78 | 0.86 | 2 | — | | — | 6.27 | 0.86 | 2 |
| LAB221 | 30122.2 | 1.09 | 0.00 | 43 | 0.48 | 0.00 | 28 | 8.75 | 0.00 | 43 |
| LAB221 | 30123.2 | — | | — | 0.42 | 0.17 | 12 | — | | — |
| LAB221 | 30124.3 | — | | — | 0.39 | 0.62 | 4 | — | | — |
| LAB221 | 30124.4 | 0.90 | 0.16 | 18 | 0.41 | 0.29 | 9 | 7.23 | 0.16 | 18 |
| LAB221 | 30125.2 | 1.00 | 0.02 | 30 | 0.46 | 0.02 | 21 | 7.98 | 0.02 | 30 |
| LAB264 | 30131.1 | 0.91 | 0.15 | 18 | 0.42 | 0.17 | 12 | 7.25 | 0.15 | 18 |
| LAB264 | 30131.2 | — | | — | 0.38 | 0.94 | 1 | — | | — |
| LAB264 | 30133.2 | 0.84 | 0.47 | 9 | 0.41 | 0.36 | 8 | 6.70 | 0.47 | 9 |
| LAB264 | 30134.4 | 0.98 | 0.03 | 28 | 0.47 | 0.01 | 24 | 7.86 | 0.03 | 28 |
| LAB303 | 30421.3 | 0.86 | 0.36 | 12 | 0.41 | 0.26 | 10 | 6.85 | 0.36 | 12 |
| LAB182 | 30451.3 | 0.79 | 0.80 | 3 | 0.41 | 0.26 | 10 | 6.33 | 0.80 | 3 |
| LAB182 | 30453.1 | — | | — | 0.40 | 0.58 | 5 | — | | — |
| LAB182 | 30453.4 | 1.02 | 0.02 | 34 | 0.46 | 0.01 | 23 | 8.19 | 0.02 | 34 |
| LAB182 | 30454.2 | 0.79 | 0.83 | 3 | 0.41 | 0.38 | 8 | 6.30 | 0.83 | 3 |
| LAB182 | 30455.2 | 0.81 | 0.65 | 6 | 0.42 | 0.19 | 11 | 6.48 | 0.65 | 6 |

TABLE 78-continued

Genes showing improved rosette growth performance under high salinity conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val | % Incr. |
| LAB232 | 30462.4 | 0.96 | 0.05 | 25 | 0.39 | 0.62 | 4 | 7.68 | 0.05 | 25 |
| LAB232 | 30462.5 | 0.77 | 0.97 | 1 | 0.41 | 0.32 | 8 | 6.17 | 0.97 | 1 |
| LAB232 | 30463.2 | — | | — | 0.40 | 0.47 | 7 | — | | — |
| LAB222 | 30472.2 | 0.83 | 0.50 | 9 | 0.43 | 0.13 | 13 | 6.67 | 0.50 | 9 |
| LAB222 | 30473.1 | 0.85 | 0.40 | 10 | 0.42 | 0.17 | 12 | 6.78 | 0.40 | 10 |
| LAB222 | 30474.1 | 0.92 | 0.12 | 20 | 0.42 | 0.19 | 11 | 7.33 | 0.12 | 20 |
| LAB222 | 30476.1 | 0.90 | 0.17 | 17 | 0.41 | 0.36 | 8 | 7.18 | 0.17 | 17 |
| LAB222 | 30476.2 | 0.87 | 0.28 | 14 | 0.39 | 0.75 | 3 | 6.97 | 0.28 | 14 |
| LAB225 | 30491.4 | 0.91 | 0.15 | 18 | 0.42 | 0.16 | 12 | 7.25 | 0.15 | 18 |
| LAB225 | 30492.1 | — | | — | 0.41 | 0.35 | 8 | — | | — |
| LAB225 | 30492.2 | 1.13 | 0.00 | 47 | 0.46 | 0.01 | 23 | 9.01 | 0.00 | 47 |
| LAB225 | 30493.1 | 0.84 | 0.42 | 10 | 0.40 | 0.49 | 6 | 6.74 | 0.42 | 10 |
| LAB353 | 30553.1 | 0.82 | 0.57 | 7 | 0.39 | 0.70 | 3 | 6.58 | 0.57 | 7 |
| LAB353 | 30554.2 | 0.88 | 0.27 | 14 | 0.40 | 0.52 | 6 | 7.01 | 0.27 | 14 |
| LAB353 | 30554.3 | 0.86 | 0.32 | 13 | 0.43 | 0.15 | 13 | 6.92 | 0.32 | 13 |
| LAB320 | 30601.2 | — | | — | 0.38 | 0.98 | 0 | — | | — |
| LAB320 | 30601.3 | 0.84 | 0.45 | 10 | — | | — | 6.73 | 0.45 | 10 |
| LAB320 | 30602.2 | — | | — | 0.38 | 0.82 | 2 | — | | — |
| LAB343 | 30622.2 | 0.83 | 0.50 | 8 | 0.39 | 0.81 | 2 | 6.65 | 0.50 | 8 |
| LAB343 | 30623.4 | 0.84 | 0.50 | 9 | 0.40 | 0.49 | 7 | 6.69 | 0.50 | 9 |
| LAB290_H0 | 30661.2 | 0.91 | 0.16 | 18 | 0.42 | 0.21 | 11 | 7.26 | 0.16 | 18 |
| LAB290_H0 | 30662.3 | 0.85 | 0.44 | 10 | 0.42 | 0.23 | 11 | 6.77 | 0.44 | 10 |
| LAB290_H0 | 30663.3 | 0.86 | 0.36 | 12 | 0.40 | 0.43 | 7 | 6.86 | 0.36 | 12 |
| LAB290_H0 | 30663.7 | 0.82 | 0.57 | 7 | 0.42 | 0.19 | 11 | 6.58 | 0.57 | 7 |
| LAB265 | 30731.3 | 0.83 | 0.51 | 8 | 0.41 | 0.33 | 8 | 6.64 | 0.51 | 8 |
| LAB265 | 30732.2 | — | | — | 0.38 | 0.92 | 1 | — | | — |
| LAB265 | 30733.4 | — | | — | 0.38 | 0.99 | 0 | — | | — |
| LAB265 | 30734.4 | 0.79 | 0.82 | 3 | 0.40 | 0.63 | 5 | 6.33 | 0.82 | 3 |
| LAB307 | 30761.1 | — | | — | 0.40 | 0.59 | 5 | — | | — |
| LAB307 | 30761.5 | 0.90 | 0.16 | 18 | 0.41 | 0.30 | 9 | 7.23 | 0.16 | 18 |
| LAB307 | 30763.3 | 0.87 | 0.29 | 13 | 0.42 | 0.17 | 12 | 6.94 | 0.29 | 13 |
| LAB307 | 30764.1 | 0.87 | 0.28 | 14 | 0.42 | 0.24 | 10 | 6.97 | 0.28 | 14 |
| LAB307 | 30764.4 | 0.79 | 0.78 | 3 | — | | — | 6.35 | 0.78 | 3 |
| LAB319 | 30774.1 | 0.85 | 0.41 | 10 | 0.42 | 0.14 | 12 | 6.77 | 0.41 | 10 |
| LAB319 | 30774.3 | 0.82 | 0.57 | 7 | 0.42 | 0.13 | 12 | 6.57 | 0.57 | 7 |
| LAB319 | 30775.2 | 0.77 | 0.93 | 1 | 0.41 | 0.30 | 9 | 6.20 | 0.93 | 1 |
| LAB319 | 30775.4 | 0.83 | 0.52 | 8 | 0.43 | 0.10 | 14 | 6.63 | 0.52 | 8 |
| LAB308 | 30931.4 | 0.82 | 0.60 | 6 | 0.40 | 0.52 | 5 | 6.53 | 0.60 | 6 |
| LAB308 | 30932.3 | 1.17 | 0.00 | 53 | 0.47 | 0.01 | 25 | 9.40 | 0.00 | 53 |
| LAB308 | 30933.2 | 0.77 | 0.95 | 1 | 0.42 | 0.17 | 11 | 6.18 | 0.95 | 1 |
| LAB308 | 30933.3 | 0.77 | 0.95 | 1 | — | | — | 6.18 | 0.95 | 1 |
| LAB308 | 30934.4 | — | | — | 0.39 | 0.79 | 2 | — | | — |
| cont | — | 0.77 | — | 0 | 0.38 | — | 0 | 6.13 | — | 0 |
| LAB191 | 28152.1 | — | | — | — | | — | 9.51 | 0.94 | 1 |
| LAB191 | 28153.1 | 1.22 | 0.82 | 3 | 0.51 | 0.77 | 2 | 9.79 | 0.76 | 4 |
| LAB191 | 28156.4 | 1.35 | 0.29 | 13 | 0.51 | 0.76 | 2 | 10.80 | 0.27 | 15 |
| LAB260 | 30071.4 | — | | — | 0.50 | 0.94 | 1 | — | | — |
| LAB260 | 30072.2 | 1.32 | 0.38 | 11 | 0.53 | 0.45 | 6 | 10.55 | 0.35 | 12 |
| LAB260 | 30073.4 | 1.27 | 0.61 | 6 | 0.52 | 0.61 | 4 | 10.14 | 0.56 | 8 |
| LAB221 | 30122.2 | — | | — | 0.52 | 0.67 | 3 | — | | — |
| LAB221 | 30123.2 | 1.31 | 0.43 | 10 | 0.53 | 0.40 | 6 | 10.49 | 0.39 | 11 |
| LAB264 | 30131.1 | 1.21 | 0.89 | 2 | — | | — | 9.69 | 0.82 | 3 |
| LAB264 | 30135.2 | — | | — | — | | — | 9.44 | 0.98 | 0 |
| LAB182 | 30451.3 | 1.28 | 0.56 | 8 | 0.50 | 0.90 | 1 | 10.28 | 0.51 | 9 |
| LAB182 | 30453.4 | 1.44 | 0.09 | 21 | 0.55 | 0.20 | 9 | 11.55 | 0.09 | 23 |
| LAB232 | 30462.4 | 1.27 | 0.58 | 7 | 0.52 | 0.54 | 4 | 10.17 | 0.53 | 8 |
| LAB222 | 30472.1 | 1.35 | 0.29 | 14 | 0.52 | 0.64 | 4 | 10.81 | 0.27 | 15 |
| LAB222 | 30472.2 | — | | — | 0.51 | 0.76 | 2 | — | | — |
| LAB222 | 30473.1 | 1.31 | 0.44 | 10 | 0.51 | 0.82 | 2 | 10.45 | 0.40 | 11 |
| LAB222 | 30476.1 | 1.23 | 0.80 | 3 | 0.53 | 0.34 | 7 | 9.82 | 0.73 | 4 |
| LAB222 | 30476.2 | 1.40 | 0.17 | 17 | 0.54 | 0.34 | 7 | 11.19 | 0.16 | 19 |
| LAB225 | 30491.4 | 1.19 | 0.99 | 0 | — | | — | 9.54 | 0.91 | 1 |
| LAB225 | 30492.2 | 1.42 | 0.12 | 19 | 0.56 | 0.09 | 13 | 11.38 | 0.11 | 21 |
| LAB225 | 30493.2 | 1.23 | 0.79 | 3 | 0.52 | 0.66 | 3 | 9.84 | 0.73 | 4 |
| LAB320 | 30601.2 | 1.30 | 0.47 | 9 | 0.51 | 0.78 | 2 | 10.37 | 0.43 | 10 |
| LAB320 | 30601.3 | 1.29 | 0.51 | 8 | 0.51 | 0.83 | 2 | 10.30 | 0.46 | 9 |
| LAB320 | 30602.2 | — | | — | — | | — | 9.52 | 0.93 | 1 |
| LAB320 | 30603.1 | 1.31 | 0.42 | 10 | — | | — | 10.50 | 0.38 | 12 |
| LAB320 | 30605.1 | 1.21 | 0.91 | 1 | — | | — | 9.66 | 0.84 | 3 |
| LAB343 | 30622.4 | 1.23 | 0.76 | 4 | 0.50 | 0.91 | 1 | 9.88 | 0.69 | 5 |
| LAB343 | 30623.4 | 1.31 | 0.46 | 10 | 0.52 | 0.64 | 4 | 10.45 | 0.43 | 11 |

TABLE 78-continued

Genes showing improved rosette growth performance under high salinity conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val | % Incr. |
| LAB290_H0 | 30661.2 | 1.25 | 0.67 | 5 | 0.51 | 0.73 | 3 | 10.02 | 0.62 | 6 |
| LAB290_H0 | 30662.3 | 1.31 | 0.42 | 10 | 0.51 | 0.77 | 2 | 10.48 | 0.38 | 11 |
| LAB290_H0 | 30663.1 | 1.35 | 0.30 | 14 | 0.53 | 0.47 | 6 | 10.84 | 0.28 | 15 |
| LAB290_H0 | 30663.3 | — | — | — | — | — | — | 9.50 | 0.94 | 1 |
| LAB290_H0 | 30663.7 | 1.27 | 0.61 | 6 | — | — | — | 10.12 | 0.56 | 8 |
| LAB265 | 30731.3 | — | — | — | 0.54 | 0.37 | 7 | — | — | — |
| LAB265 | 30732.2 | — | — | — | 0.50 | 0.94 | 1 | — | — | — |
| LAB307 | 30761.5 | — | — | — | 0.50 | 0.95 | 0 | — | — | — |
| LAB307 | 30764.4 | 1.21 | 0.91 | 1 | — | — | — | 9.66 | 0.83 | 3 |
| LAB319 | 30771.5 | 1.34 | 0.30 | 13 | 0.52 | 0.61 | 4 | 10.76 | 0.28 | 14 |
| LAB319 | 30774.1 | — | — | — | — | — | — | 9.43 | 0.99 | 0 |
| LAB319 | 30774.3 | — | — | — | 0.50 | 0.97 | 0 | — | — | — |
| LAB319 | 30775.1 | 1.29 | 0.51 | 8 | 0.51 | 0.71 | 3 | 10.30 | 0.46 | 9 |
| LAB319 | 30775.4 | — | — | — | 0.50 | 0.92 | 1 | — | — | — |
| LAB308 | 30931.4 | 1.20 | 0.97 | 1 | — | — | — | 9.58 | 0.89 | 2 |
| LAB308 | 30932.3 | 1.31 | 0.41 | 10 | 0.51 | 0.80 | 2 | 10.51 | 0.37 | 12 |
| LAB308 | 30933.2 | — | — | — | 0.51 | 0.81 | 2 | 9.47 | 0.96 | 1 |
| LAB308 | 30933.3 | 1.29 | 0.49 | 8 | 0.53 | 0.37 | 7 | 10.32 | 0.44 | 10 |
| LAB308 | 30934.4 | 1.29 | 0.49 | 8 | 0.52 | 0.57 | 4 | 10.34 | 0.45 | 10 |
| cont | — | 1.19 | — | 0 | 0.50 | — | 0 | 9.41 | — | 0 |
| LAB299 | 28063.1 | 1.11 | 0.65 | 6 | 0.51 | 0.61 | 4 | 8.85 | 0.65 | 6 |
| LAB299 | 28064.1 | — | — | — | 0.50 | 0.84 | 1 | — | — | — |
| LAB299 | 28066.1 | 1.15 | 0.44 | 10 | 0.51 | 0.77 | 2 | 9.18 | 0.44 | 10 |
| LAB157 | 28146.2 | — | — | — | 0.50 | 0.80 | 2 | — | — | — |
| LAB269 | 28341.3 | — | — | — | 0.51 | 0.77 | 2 | — | — | — |
| LAB269 | 28342.3 | — | — | — | 0.49 | 0.99 | 0 | — | — | — |
| LAB269 | 28343.4 | — | — | — | 0.53 | 0.35 | 7 | — | — | — |
| LAB283 | 28361.1 | 1.08 | 0.82 | 3 | — | — | — | 8.61 | 0.82 | 3 |
| LAB267 | 28384.5 | — | — | — | 0.51 | 0.72 | 3 | — | — | — |
| LAB119 | 28412.1 | 1.05 | 0.99 | 0 | — | — | — | 8.40 | 0.99 | 0 |
| LAB240 | 28595.1 | — | — | — | 0.50 | 0.83 | 2 | — | — | — |
| LAB298 | 29244.1 | — | — | — | 0.51 | 0.66 | 3 | — | — | — |
| cont | — | 1.05 | — | 0 | 0.49 | — | 0 | 8.38 | — | 0 |
| LAB329 | 30102.2 | — | — | — | 0.51 | 0.68 | 2 | — | — | — |
| LAB329 | 30103.1 | 1.50 | 0.31 | 12 | 0.57 | 0.02 | 14 | 12.00 | 0.22 | 15 |
| LAB329 | 30104.1 | 1.42 | 0.61 | 6 | 0.51 | 0.60 | 3 | 11.35 | 0.47 | 9 |
| LAB175 | 30514.4 | — | — | — | 0.53 | 0.32 | 6 | — | — | — |
| LAB164 | 30524.1 | 1.41 | 0.63 | 6 | 0.51 | 0.75 | 2 | 11.32 | 0.49 | 8 |
| LAB164 | 30525.2 | 1.44 | 0.51 | 8 | 0.50 | 0.92 | 1 | 11.54 | 0.39 | 10 |
| LAB164 | 30525.3 | 1.52 | 0.27 | 13 | 0.51 | 0.66 | 3 | 12.13 | 0.19 | 16 |
| LAB107 | 30533.4 | 1.43 | 0.57 | 7 | 0.50 | 0.86 | 1 | 10.67 | 0.86 | 2 |
| LAB107 | 30534.3 | 1.41 | 0.69 | 5 | — | — | — | 11.28 | 0.57 | 8 |
| LAB107 | 30535.2 | — | — | — | — | — | — | 10.63 | 0.89 | 2 |
| LAB130 | 30542.1 | 1.49 | 0.36 | 11 | 0.52 | 0.39 | 5 | 11.93 | 0.26 | 14 |
| LAB130 | 30544.2 | — | — | — | — | — | — | 10.68 | 0.87 | 2 |
| LAB130 | 30545.1 | 1.36 | 0.88 | 2 | — | — | — | 10.91 | 0.72 | 4 |
| LAB130 | 30545.2 | 1.36 | 0.91 | 1 | 0.52 | 0.50 | 4 | 10.86 | 0.75 | 4 |
| LAB101 | 30641.5 | 1.35 | 0.95 | 1 | 0.50 | 0.91 | 1 | 10.79 | 0.79 | 3 |
| LAB101 | 30644.2 | — | — | — | 0.52 | 0.60 | 4 | 10.62 | 0.90 | 2 |
| LAB101 | 30644.4 | 1.39 | 0.74 | 4 | 0.53 | 0.31 | 7 | 11.14 | 0.60 | 7 |
| LAB121 | 30802.1 | 1.43 | 0.61 | 6 | 0.50 | 0.91 | 1 | 11.40 | 0.48 | 9 |
| LAB121 | 30804.1 | — | — | — | 0.50 | 0.86 | 1 | 10.52 | 0.96 | 1 |
| LAB129 | 30825.1 | 1.38 | 0.78 | 3 | 0.52 | 0.41 | 5 | 11.06 | 0.63 | 6 |
| LAB163 | 30831.3 | 1.77 | 0.02 | 32 | 0.58 | 0.01 | 17 | 14.14 | 0.01 | 35 |
| LAB163 | 30832.2 | 1.42 | 0.64 | 6 | 0.54 | 0.15 | 9 | 11.33 | 0.50 | 8 |
| LAB163 | 30834.2 | 1.53 | 0.26 | 14 | 0.51 | 0.72 | 2 | 12.20 | 0.19 | 17 |
| LAB171 | 30841.4 | 1.49 | 0.35 | 11 | 0.52 | 0.53 | 4 | 11.94 | 0.26 | 14 |
| LAB171 | 30842.3 | 1.41 | 0.65 | 5 | 0.52 | 0.41 | 5 | 11.28 | 0.51 | 8 |
| LAB171 | 30843.2 | 1.39 | 0.77 | 4 | 0.50 | 0.94 | 1 | 11.10 | 0.63 | 6 |
| LAB171 | 30845.1 | 1.41 | 0.64 | 6 | — | — | — | 11.31 | 0.50 | 8 |
| LAB172 | 30854.1 | 1.43 | 0.54 | 7 | 0.51 | 0.55 | 3 | 11.48 | 0.41 | 10 |
| LAB172 | 30855.3 | — | — | — | — | — | — | 10.65 | 0.88 | 2 |
| LAB204 | 30863.1 | 1.47 | 0.46 | 9 | 0.51 | 0.71 | 2 | 11.72 | 0.35 | 12 |
| LAB204 | 30863.2 | 1.37 | 0.82 | 3 | — | — | — | 10.99 | 0.67 | 5 |
| LAB204 | 30864.1 | 1.36 | 0.91 | 1 | 0.53 | 0.33 | 6 | 10.85 | 0.75 | 4 |
| LAB263 | 30891.6 | 1.37 | 0.83 | 3 | 0.52 | 0.45 | 5 | — | — | — |
| LAB263 | 30892.2 | 1.64 | 0.11 | 22 | 0.56 | 0.10 | 12 | 13.11 | 0.08 | 25 |
| LAB271 | 30905.6 | 1.41 | 0.67 | 5 | 0.50 | 0.93 | 1 | 11.25 | 0.54 | 8 |
| LAB284 | 30911.3 | 1.36 | 0.88 | 2 | 0.50 | 0.94 | 0 | 10.89 | 0.73 | 4 |
| LAB284 | 30912.2 | — | — | — | 0.50 | 1.00 | 0 | — | — | — |
| LAB284 | 30913.1 | 1.38 | 0.82 | 3 | — | — | — | 11.01 | 0.67 | 5 |

TABLE 78-continued

Genes showing improved rosette growth performance under high salinity conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val | % Incr. |
| LAB286 | 30921.1 | 1.61 | 0.18 | 21 | 0.54 | 0.33 | 9 | 12.90 | 0.14 | 23 |
| LAB286 | 30922.1 | 1.70 | 0.06 | 27 | 0.58 | 0.04 | 16 | 13.60 | 0.04 | 30 |
| LAB286 | 30922.4 | 1.39 | 0.76 | 4 | — | | — | 11.10 | 0.62 | 6 |
| LAB286 | 30923.3 | — | | — | — | | — | 10.67 | 0.86 | 2 |
| LAB286 | 30924.2 | — | | — | 0.51 | 0.79 | 2 | — | | — |
| LAB261 | 31074.2 | — | | — | 0.50 | 0.95 | 0 | — | | — |
| LAB261 | 31075.1 | — | | — | 0.50 | 0.96 | 0 | — | | — |
| LAB272 | 31121.1 | — | | — | 0.50 | 0.97 | 0 | — | | — |
| LAB272 | 31125.4 | 1.39 | 0.77 | 4 | — | | — | 11.09 | 0.63 | 6 |
| LAB272 | 31125.5 | 1.37 | 0.82 | 3 | — | | — | 11.00 | 0.67 | 5 |
| cont | — | 1.34 | — | 0 | 0.50 | — | 0 | 10.46 | — | 0 |
| LAB329 | 30102.3 | 0.81 | 0.87 | 3 | 0.42 | 0.87 | 1 | 6.49 | 0.87 | 3 |
| LAB329 | 30103.2 | 0.83 | 0.77 | 5 | 0.42 | 0.83 | 2 | 6.61 | 0.77 | 5 |
| LAB164 | 30522.4 | 0.81 | 0.91 | 2 | — | | — | 6.44 | 0.91 | 2 |
| LAB164 | 30524.1 | 0.85 | 0.66 | 7 | 0.42 | 0.99 | 0 | 6.77 | 0.66 | 7 |
| LAB164 | 30525.2 | 0.87 | 0.53 | 10 | 0.44 | 0.58 | 5 | 6.97 | 0.53 | 10 |
| LAB164 | 30525.3 | — | | — | 0.43 | 0.63 | 4 | — | | — |
| LAB107 | 30533.4 | 1.04 | 0.10 | 31 | 0.46 | 0.28 | 9 | 8.28 | 0.10 | 31 |
| LAB107 | 30535.2 | 0.95 | 0.26 | 20 | 0.46 | 0.21 | 11 | 7.59 | 0.26 | 20 |
| LAB130 | 30541.3 | 0.81 | 0.86 | 3 | 0.43 | 0.76 | 3 | 6.50 | 0.86 | 3 |
| LAB130 | 30544.2 | 0.90 | 0.40 | 14 | 0.43 | 0.62 | 4 | 7.22 | 0.40 | 14 |
| LAB130 | 30545.1 | 1.11 | 0.07 | 41 | 0.48 | 0.18 | 16 | 8.92 | 0.07 | 41 |
| LAB121 | 30801.4 | 0.99 | 0.17 | 25 | 0.48 | 0.08 | 16 | 7.95 | 0.16 | 26 |
| LAB121 | 30802.2 | 0.89 | 0.48 | 12 | 0.44 | 0.51 | 6 | 7.10 | 0.48 | 12 |
| LAB121 | 30803.1 | 0.86 | 0.58 | 9 | 0.44 | 0.57 | 4 | 6.89 | 0.58 | 9 |
| LAB121 | 30804.1 | 0.82 | 0.81 | 4 | 0.46 | 0.38 | 11 | 6.60 | 0.80 | 4 |
| LAB129 | 30824.1 | 0.86 | 0.63 | 9 | 0.43 | 0.66 | 4 | 6.86 | 0.63 | 9 |
| LAB129 | 30825.1 | 0.98 | 0.20 | 24 | 0.45 | 0.41 | 8 | 7.86 | 0.20 | 24 |
| LAB163 | 30831.3 | 0.84 | 0.67 | 7 | 0.44 | 0.53 | 5 | 6.75 | 0.67 | 7 |
| LAB163 | 30833.1 | — | | — | 0.43 | 0.64 | 4 | — | | — |
| LAB171 | 30842.4 | 0.84 | 0.70 | 6 | 0.47 | 0.19 | 12 | 6.71 | 0.70 | 6 |
| LAB171 | 30843.2 | 0.91 | 0.36 | 15 | 0.45 | 0.39 | 7 | 7.28 | 0.36 | 15 |
| LAB171 | 30845.1 | 0.86 | 0.59 | 9 | 0.43 | 0.76 | 3 | 6.87 | 0.59 | 9 |
| LAB172 | 30854.1 | — | | — | 0.42 | 0.97 | 0 | — | | — |
| LAB172 | 30855.2 | 0.86 | 0.58 | 9 | 0.44 | 0.61 | 5 | 6.91 | 0.58 | 9 |
| LAB204 | 30862.3 | 0.91 | 0.37 | 15 | 0.45 | 0.37 | 8 | 7.30 | 0.37 | 15 |
| LAB204 | 30863.1 | 0.90 | 0.41 | 14 | 0.46 | 0.32 | 9 | 7.18 | 0.41 | 14 |
| LAB204 | 30864.1 | — | | — | 0.42 | 0.87 | 1 | — | | — |
| LAB204 | 30865.4 | 0.90 | 0.40 | 14 | 0.45 | 0.38 | 7 | 7.25 | 0.39 | 15 |
| LAB263 | 30891.6 | 0.83 | 0.77 | 5 | 0.44 | 0.49 | 6 | 6.61 | 0.77 | 5 |
| LAB263 | 30892.2 | 0.87 | 0.53 | 10 | 0.42 | 0.84 | 2 | 6.96 | 0.53 | 10 |
| LAB263 | 30892.3 | 0.83 | 0.73 | 6 | 0.44 | 0.59 | 5 | 6.67 | 0.73 | 6 |
| LAB263 | 30892.4 | 0.87 | 0.53 | 10 | 0.44 | 0.48 | 6 | 6.98 | 0.53 | 10 |
| LAB263 | 30893.3 | 0.91 | 0.38 | 15 | 0.44 | 0.42 | 7 | 7.29 | 0.38 | 15 |
| LAB261 | 31074.4 | 0.85 | 0.64 | 7 | 0.42 | 0.91 | 1 | 6.79 | 0.64 | 7 |
| LAB261 | 31075.1 | 0.86 | 0.61 | 9 | 0.43 | 0.80 | 2 | 6.86 | 0.61 | 9 |
| LAB261 | 31075.3 | 0.80 | 0.95 | 1 | — | | — | 6.39 | 0.95 | 1 |
| LAB272 | 31121.1 | 0.82 | 0.79 | 4 | 0.44 | 0.48 | 6 | 6.58 | 0.79 | 4 |
| LAB272 | 31123.1 | 0.81 | 0.86 | 3 | 0.42 | 0.87 | 1 | 6.50 | 0.86 | 3 |
| LAB272 | 31125.4 | 0.81 | 0.85 | 3 | — | | — | 6.51 | 0.85 | 3 |
| cont | — | 0.79 | — | 0 | 0.42 | — | 0 | 6.32 | — | 0 |
| LAB102 | 30314.3 | — | | — | — | | — | -1.11 | 0.94 | 38 |
| LAB154 | 30693.2 | — | | — | — | | — | -1.56 | 0.86 | 95 |
| LAB98 | 31011.2 | — | | — | — | | — | -0.99 | 0.96 | 24 |
| LAB122 | 31161.3 | — | | — | — | | — | -1.06 | 0.95 | 32 |
| LAB255 | 31213.1 | — | | — | — | | — | -2.01 | 0.78 | 152 |
| LAB255 | 31214.1 | — | | — | — | | — | -0.92 | 0.98 | 15 |
| LAB235 | 31321.1 | — | | — | — | | — | -1.07 | 0.95 | 34 |
| LAB116 | 31441.1 | — | | — | — | | — | -1.19 | 0.93 | 48 |
| LAB253 | 31462.1 | — | | — | — | | — | -1.63 | 0.84 | 104 |
| cont | — | — | | — | — | | — | -0.80 | — | 0 |
| LAB178 | 30632.4 | — | | — | 0.48 | 0.83 | 2 | — | | — |
| LAB98 | 31011.2 | 1.25 | 0.82 | 3 | — | | — | 10.00 | 0.82 | 3 |
| LAB56 | 31455.1 | 1.36 | 0.31 | 12 | 0.49 | 0.55 | 5 | 10.88 | 0.31 | 12 |

TABLE 78-continued

Genes showing improved rosette growth performance under high salinity conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % Incr. | Ave. | P-Val. | % Incr. | Ave. | P-Val | % Incr. |
| LAB342 | 31705.6 | 1.42 | 0.22 | 16 | 0.50 | 0.45 | 7 | 11.33 | 0.22 | 16 |
| cont | — | 1.22 | — | 0 | 0.47 | — | 0 | 9.73 | — | 0 |

Table 78.
"CONT."—Control;
"Ave."—Average;
"% Incr." = % increment;
"p-val."—p-value.

TABLE 79

Genes showing improved plant biomass production at standard growth conditions

| Gene Name | Event # | Dry Weight [gr] | | | Fresh Weight [gr] | | |
|---|---|---|---|---|---|---|---|
| | | Ave. | P-Val. | % incr. | Ave. | P-Val. | % incr. |
| LAB131 | 28291.1 | 0.15125 | 0.261593 | 5.7124 | 1.575 | 0.597555 | 2.5031 |
| LAB131 | 28294.2 | 0.15125 | 0.661123 | 5.7124 | 1.55 | 0.909789 | 0.8761 |
| LAB131 | 28295.3 | 0.1675 | 0.575375 | 17.0699 | 1.59375 | 0.658779 | 3.7234 |
| LAB145 | 28551.1 | 0.163125 | 0.629851 | 14.0121 | — | — | — |
| LAB145 | 28551.3 | 0.15375 | 0.254842 | 7.4597 | 1.7 | 0.42767 | 10.6383 |
| LAB145 | 28553.2 | 0.16 | 0.057736 | 11.828 | 1.76875 | 0.01858 | 15.1126 |
| LAB145 | 28553.3 | 0.1875 | 0.473204 | 31.0484 | 1.7625 | 0.544357 | 14.7059 |
| LAB145 | 28555.1 | 0.15375 | 0.206031 | 7.4597 | 1.59375 | 0.354174 | 3.7234 |
| LAB152 | 28472.3 | 0.159286 | 0.690711 | 11.3287 | — | — | — |
| LAB152 | 28473.2 | 0.17125 | 0.301414 | 19.6909 | 1.54375 | 0.924931 | 0.4693 |
| LAB152 | 28474.4 | 0.16 | 0.603564 | 11.828 | — | — | — |
| LAB153 | 28301.2 | 0.160625 | 0.447216 | 12.2648 | — | — | — |
| LAB153 | 28302.2 | 0.148125 | 0.634242 | 3.5282 | 1.60625 | 0.595691 | 4.5369 |
| LAB153 | 28304.1 | 0.159375 | 0.037102 | 11.3911 | 1.70625 | 0.269857 | 11.0451 |
| LAB153 | 28305.3 | 0.149375 | 0.823135 | 4.4019 | — | — | — |
| LAB169 | 28391.1 | 0.148125 | 0.892304 | 3.5282 | — | — | — |
| LAB169 | 28391.4 | 0.175625 | 0.379128 | 22.7487 | 1.6 | 0.64483 | 4.1302 |
| LAB169 | 28392.1 | — | — | — | 1.61875 | 0.370355 | 5.3504 |
| LAB169 | 28393.3 | 0.18375 | 0.000441 | 28.4274 | — | — | — |
| LAB169 | 28394.3 | 0.1825 | 0.131354 | 27.5538 | 1.6875 | 0.284323 | 9.8248 |
| LAB181 | 28482.2 | — | — | — | 1.55 | 0.962284 | 0.8761 |
| LAB181 | 28482.3 | 0.156875 | 0.720667 | 9.6438 | — | — | — |
| LAB181 | 28483.2 | 0.1525 | 0.617481 | 6.586 | — | — | — |
| LAB181 | 28484.3 | 0.155625 | 0.272507 | 8.7702 | 1.54375 | 0.941776 | 0.4693 |
| LAB187 | 28431.3 | 0.144375 | 0.878126 | 0.9073 | 1.5625 | 0.751079 | 1.6896 |
| LAB187 | 28431.5 | 0.149375 | 0.510337 | 4.4019 | 1.56875 | 0.612053 | 2.0964 |
| LAB187 | 28434.1 | 0.18625 | 0.163779 | 30.1747 | 1.86875 | 0.194325 | 21.6208 |
| LAB213 | 28561.2 | 0.153125 | 0.365315 | 7.0228 | 1.58125 | 0.879244 | 2.9099 |
| LAB213 | 28562.6 | — | — | — | 1.6125 | 0.740657 | 4.9437 |
| LAB213 | 28565.2 | 0.1475 | 0.877723 | 3.0914 | — | — | — |
| LAB213 | 28565.4 | 0.171875 | 0.001495 | 20.1277 | — | — | — |
| LAB230 | 28572.3 | 0.161875 | 0.708347 | 13.1384 | — | — | — |
| LAB230 | 28574.2 | 0.15125 | 0.566736 | 5.7124 | — | — | — |
| LAB247 | 28091.4 | 0.165 | 0.114346 | 15.3226 | 1.68125 | 0.150456 | 9.418 |
| LAB247 | 28093.2 | 0.169375 | 0.308997 | 18.3804 | 1.5875 | 0.591004 | 3.3166 |
| LAB247 | 28094.1 | 0.186875 | 0.235241 | 30.6116 | 1.76875 | 0.005861 | 15.1126 |
| LAB247 | 28094.3 | 0.161875 | 0.050761 | 13.1384 | 1.75625 | 0.008045 | 14.2991 |
| LAB247 | 28095.4 | — | — | — | 1.58036 | 0.75655 | 2.8518 |
| LAB249 | 28602.1 | 0.151875 | 0.594743 | 6.1492 | 1.74375 | 0.362503 | 13.4856 |
| LAB249 | 28603.3 | 0.16625 | 0.417336 | 16.1962 | 1.6375 | 0.14142 | 6.5707 |
| LAB249 | 28604.2 | 0.1475 | 0.541538 | 3.0914 | 1.63125 | 0.309957 | 6.164 |
| LAB249 | 28604.4 | 0.17125 | 0.453531 | 19.6909 | 1.675 | 0.037142 | 9.0113 |
| LAB258 | 27441.4 | 0.180625 | 0.296747 | 26.2433 | 1.70625 | 0.058727 | 11.0451 |
| LAB258 | 27441.6 | 0.165625 | 0.012218 | 15.7594 | — | — | — |
| LAB258 | 27442.2 | 0.174375 | 0.228183 | 21.875 | 1.9125 | 0.095813 | 24.4681 |
| LAB258 | 27444.4 | 0.1525 | 0.872312 | 6.586 | 1.5375 | 0.988287 | 0.0626 |
| LAB294 | 28401.3 | 0.201875 | 0.000002 | 41.0954 | 1.5875 | 0.414232 | 3.3166 |
| LAB294 | 28402.5 | 0.176875 | 0.524936 | 23.6223 | 1.64375 | 0.748182 | 6.9775 |
| LAB294 | 28404.3 | 0.176875 | 0.178934 | 23.6223 | 1.75625 | 0.234115 | 14.2991 |
| LAB294 | 28405.1 | 0.146875 | 0.938999 | 2.6546 | — | — | — |
| LAB70 | 28462.2 | 0.14375 | 0.92543 | 0.4704 | — | — | — |
| LAB74 | 28452.2 | 0.14625 | 0.833862 | 2.2177 | — | — | — |

TABLE 79-continued

Genes showing improved plant biomass production at standard growth conditions

| Gene Name | Event # | Dry Weight [gr] | | | Fresh Weight [gr] | | |
|---|---|---|---|---|---|---|---|
| | | Ave. | P-Val. | % incr. | Ave. | P-Val. | % incr. |
| LAB74 | 28453.5 | 0.15875 | 0.572775 | 10.9543 | — | | — |
| LAB74 | 28454.1 | 0.145 | 0.812324 | 1.3441 | — | | — |
| LAB81 | 28531.1 | 0.148125 | 0.907585 | 3.5282 | — | | — |
| LAB81 | 28534.4 | 0.148125 | 0.670245 | 3.5282 | — | | — |
| LAB88 | 28192.6 | 0.15125 | 0.52525 | 5.7124 | 1.6875 | 0.167515 | 9.8248 |
| CONT | — | 0.143077 | — | 0 | 1.53654 | — | 0 |
| LAB113 | 28543.5 | 0.171875 | 0.035831 | 11.649 | — | | — |
| LAB113 | 28545.3 | 0.16625 | 0.607487 | 7.995 | 1.94375 | 0.97063 | 0.6222 |
| LAB131 | 28291.1 | 0.165625 | 0.687868 | 7.589 | 1.98125 | 0.782747 | 2.5635 |
| LAB131 | 28292.3 | — | | — | 2.01875 | 0.682106 | 4.5047 |
| LAB131 | 28294.2 | 0.155625 | 0.973736 | 1.0931 | — | | — |
| LAB131 | 28295.3 | 0.190625 | 0.132004 | 23.8289 | 2.43125 | 0.189533 | 25.8586 |
| LAB145 | 28551.3 | 0.17625 | 0.531381 | 14.4909 | 1.94375 | 0.963895 | 0.6222 |
| LAB145 | 28553.2 | 0.213125 | 0.135335 | 38.4447 | 2.225 | 0.216956 | 15.1817 |
| LAB145 | 28553.3 | 0.2025 | 0.005058 | 31.5428 | 2.48125 | 0.000057 | 28.447 |
| LAB145 | 28555.1 | 0.17875 | 0.247035 | 16.1149 | 2.425 | 0.000236 | 25.5351 |
| LAB152 | 28471.1 | 0.186429 | 0.667233 | 21.1029 | 2.05446 | 0.818351 | 6.3536 |
| LAB152 | 28473.2 | 0.17625 | 0.00729 | 14.4909 | 2.30625 | 0.137363 | 19.3878 |
| LAB152 | 28473.3 | 0.19375 | 0.075111 | 25.8588 | 2.31875 | 0.428918 | 20.0348 |
| LAB152 | 28474.4 | 0.20375 | | 32.3548 | 2.025 | | 4.8283 |
| LAB153 | 28301.2 | 0.15625 | 0.794515 | 1.4991 | — | | — |
| LAB153 | 28303.1 | 0.16375 | 0.453631 | 6.371 | — | | — |
| LAB153 | 28304.1 | — | | — | 2.1 | 0.251271 | 8.7108 |
| LAB153 | 28305.3 | 0.19 | 0.150211 | 23.4229 | 2.3375 | 0.273898 | 21.0055 |
| LAB169 | 28391.1 | 0.20625 | 0.02627 | 33.9788 | 2.59375 | 0.116279 | 34.2708 |
| LAB169 | 28391.4 | 0.183125 | 0.002408 | 18.9569 | 2.08125 | 0.616522 | 7.7402 |
| LAB169 | 28392.1 | 0.229375 | 0.242095 | 49.0006 | 2.54375 | 0.013973 | 31.6824 |
| LAB169 | 28393.2 | 0.1725 | 0.493881 | 12.055 | 2.26875 | 0.162606 | 17.4465 |
| LAB169 | 28394.3 | 0.220625 | 0.0098 | 43.3167 | 2.55625 | 0.000059 | 32.3295 |
| LAB181 | 28481.1 | 0.20625 | 0.202668 | 33.9788 | 2.3125 | 0.000969 | 19.7113 |
| LAB181 | 28482.2 | 0.195625 | 0.560337 | 27.0768 | 2.1125 | 0.714189 | 9.3579 |
| LAB181 | 28482.3 | 0.18625 | 0.142885 | 20.9869 | 2.1 | 0.164536 | 8.7108 |
| LAB181 | 28483.2 | 0.173125 | 0.080685 | 12.461 | 2.11875 | 0.111157 | 9.6814 |
| LAB181 | 28484.3 | 0.18625 | 0.046018 | 20.9869 | 2.25 | 0.003537 | 16.4759 |
| LAB187 | 28433.3 | 0.16875 | 0.385213 | 9.619 | 2.14375 | 0.636342 | 10.9756 |
| LAB187 | 28434.1 | 0.181875 | 0.465047 | 18.1449 | 2.28125 | 0.55463 | 18.0936 |
| LAB187 | 28435.3 | — | | — | 1.98125 | 0.723323 | 2.5635 |
| LAB187 | 28435.4 | — | | — | 2.26875 | 0.025058 | 17.4465 |
| LAB213 | 28561.2 | 0.1725 | 0.068692 | 12.055 | 2.01875 | 0.367886 | 4.5047 |
| LAB213 | 28562.6 | 0.203125 | 0.000314 | 31.9488 | 2.20625 | 0.365233 | 14.2111 |
| LAB213 | 28565.2 | 0.1625 | 0.744108 | 5.559 | — | | — |
| LAB230 | 28572.3 | 0.17375 | 0.055746 | 12.867 | 2.125 | 0.522023 | 10.005 |
| LAB230 | 28574.2 | 0.175 | 0.58141 | 13.679 | 1.975 | 0.643472 | 2.2399 |
| LAB247 | 28091.4 | 0.163125 | 0.877097 | 5.965 | 2.00625 | 0.881531 | 3.8576 |
| LAB247 | 28094.1 | 0.169375 | 0.775473 | 10.025 | — | | — |
| LAB247 | 28094.3 | — | | — | 1.98333 | 0.610919 | 2.6713 |
| LAB249 | 28603.3 | 0.155625 | 0.81699 | 1.0931 | — | | — |
| LAB249 | 28604.2 | 0.21 | 0.21907 | 36.4147 | 2.3875 | 0.011515 | 23.5938 |
| LAB249 | 28604.4 | 0.165625 | 0.827136 | 7.589 | — | | — |
| LAB249 | 28605.2 | 0.175625 | 0.514304 | 14.0849 | 2.26875 | 0.221221 | 17.4465 |
| LAB258 | 27441.4 | — | | — | 2.09375 | 0.590953 | 8.3873 |
| LAB258 | 27441.6 | 0.1725 | 0.068692 | 12.055 | — | | — |
| LAB258 | 27442.2 | 0.170625 | 0.36174 | 10.837 | 2.00625 | 0.463901 | 3.8576 |
| LAB258 | 27442.5 | 0.18375 | 0.378385 | 19.3629 | 2.39375 | 0.143259 | 23.9174 |
| LAB258 | 27444.4 | — | | — | 2.16875 | 0.61399 | 12.2698 |
| LAB294 | 28402.4 | — | | — | 1.9625 | 0.832088 | 1.5928 |
| LAB294 | 28404.1 | 0.15625 | 0.774367 | 1.4991 | — | | — |
| LAB70 | 28462.2 | 0.185625 | 0.000597 | 20.5809 | — | | — |
| LAB74 | 28451.3 | 0.178125 | 0.689567 | 15.7089 | 1.96875 | 0.940673 | 1.9164 |
| LAB74 | 28452.2 | 0.171875 | 0.778398 | 11.649 | — | | — |
| LAB74 | 28452.4 | 0.186875 | 0.292441 | 21.3929 | 2.23125 | 0.712972 | 15.5052 |
| LAB74 | 28454.1 | 0.18125 | 0.14561 | 17.7389 | 2.2 | 0.04327 | 13.8875 |
| LAB88 | 28191.3 | 0.169375 | 0.567371 | 10.025 | 2.175 | 0.019485 | 12.5933 |
| LAB88 | 28193.2 | 0.163125 | 0.702713 | 5.965 | 2.1375 | 0.762429 | 10.6521 |
| LAB88 | 28193.6 | 0.185 | 0.272476 | 20.1749 | 2.35625 | 0.111386 | 21.9761 |
| CONT | — | 0.153942 | — | 0 | 1.93173 | — | 0 |
| LAB108 | 28501.4 | 0.189911 | 0.105233 | 23.2109 | 1.93036 | 0.066396 | 16.5837 |
| LAB108 | 28502.2 | 0.160625 | 0.116057 | 4.2109 | 1.81875 | 0.001645 | 9.8432 |
| LAB108 | 28505.2 | 0.159375 | 0.709378 | 3.3999 | 1.7 | 0.661083 | 2.6713 |
| LAB108 | 28505.4 | 0.16875 | 0.554295 | 9.4822 | 1.74375 | 0.728702 | 5.3136 |
| LAB119 | 28411.1 | 0.155 | 0.900992 | 0.5614 | — | | — |
| LAB119 | 28412.1 | 0.16375 | 0.714735 | 6.2383 | 1.70625 | 0.744686 | 3.0488 |
| LAB119 | 28413.1 | 0.1575 | 0.905764 | 2.1834 | 1.8 | 0.14245 | 8.7108 |
| LAB119 | 28414.1 | 0.170625 | 0.299346 | 10.6987 | 1.725 | 0.677674 | 4.1812 |

TABLE 79-continued

Genes showing improved plant biomass production at standard growth conditions

| Gene Name | Event # | Dry Weight [gr] Ave. | P-Val. | % incr. | Fresh Weight [gr] Ave. | P-Val. | % incr. |
|---|---|---|---|---|---|---|---|
| LAB157 | 28142.3 | 0.185625 | 0.301603 | 20.4304 | 1.9375 | 0.222655 | 17.0151 |
| LAB157 | 28144.2 | 0.1625 | 0.716235 | 5.4273 | 1.81875 | 0.390491 | 9.8432 |
| LAB157 | 28145.2 | 0.156875 | 0.880965 | 1.7779 | 1.7125 | 0.334553 | 3.4262 |
| LAB157 | 28146.1 | 0.16375 | 0.06917 | 6.2383 | 1.8625 | 0.000019 | 12.4855 |
| LAB157 | 28146.2 | 0.161875 | 0.095022 | 5.0218 | 1.7 | 0.661083 | 2.6713 |
| LAB231 | 28581.3 | 0.1825 | 0.319492 | 18.403 | 1.86875 | 0.05059 | 12.863 |
| LAB231 | 28582.1 | 0.16625 | 0.170934 | 7.8603 | 1.6875 | 0.352368 | 1.9164 |
| LAB231 | 28583.1 | 0.194375 | 0.105255 | 26.1073 | 2.06875 | 0.013113 | 24.9419 |
| LAB231 | 28585.1 | 0.173125 | 0.011051 | 12.3206 | 1.98125 | 0.119845 | 19.6574 |
| LAB231 | 28585.3 | 0.164375 | 0.4584 | 6.6438 | 1.69375 | 0.756325 | 2.2938 |
| LAB238 | 28422.4 | 0.196875 | 0.022019 | 27.7293 | 1.91875 | 0.115924 | 15.8827 |
| LAB238 | 28422.5 | 0.1575 | 0.922637 | 2.1834 | — | | — |
| LAB238 | 28424.3 | 0.17125 | 0.420717 | 11.1042 | 1.78125 | 0.393681 | 7.5784 |
| LAB238 | 28425.5 | 0.165 | 0.412192 | 7.0493 | 1.86875 | 0.197752 | 12.863 |
| LAB240 | 28592.2 | 0.166875 | 0.268137 | 8.2658 | 1.79375 | 0.313405 | 8.3333 |
| LAB240 | 28592.6 | 0.1725 | 0.000404 | 11.9152 | 1.91875 | 0.115924 | 15.8827 |
| LAB240 | 28595.1 | 0.1725 | 0.194379 | 11.9152 | 1.7875 | 0.163196 | 7.9559 |
| LAB240 | 28595.3 | 0.16625 | 0.029962 | 7.8603 | 1.975 | 0.037751 | 19.2799 |
| LAB242 | 28081.2 | 0.178125 | 0.329703 | 15.5646 | 1.75 | 0.58645 | 5.6911 |
| LAB242 | 28081.3 | 0.175625 | 0.554309 | 13.9426 | 1.8 | 0.652235 | 8.7108 |
| LAB242 | 28083.1 | 0.155625 | 0.813895 | 0.9669 | 1.75 | 0.341733 | 5.6911 |
| LAB242 | 28085.1 | 0.163125 | 0.45183 | 5.8328 | 1.6625 | 0.951901 | 0.4065 |
| LAB242 | 28085.5 | 0.15875 | 0.650848 | 2.9944 | 1.73125 | 0.638431 | 4.5587 |
| LAB267 | 28381.2 | 0.169375 | 0.004264 | 9.8877 | 1.75 | 0.009096 | 5.6911 |
| LAB267 | 28383.2 | 0.173125 | 0.371202 | 12.3206 | 1.78125 | 0.133609 | 7.5784 |
| LAB267 | 28384.2 | — | | — | 1.7 | 0.762364 | 2.6713 |
| LAB267 | 28385.2 | 0.170625 | 0.067042 | 10.6987 | 1.80625 | 0.00033 | 9.0883 |
| LAB269 | 28341.3 | 0.164375 | 0.177301 | 6.6438 | 1.775 | 0.38609 | 7.2009 |
| LAB269 | 28343.4 | 0.159375 | 0.635529 | 3.3999 | 1.7625 | 0.30039 | 6.446 |
| LAB269 | 28345.2 | 0.173125 | 0.657681 | 12.3206 | 1.70625 | 0.863382 | 3.0488 |
| LAB279 | 28351.4 | 0.1725 | 0.454738 | 11.9152 | 1.8125 | 0.384702 | 9.4657 |
| LAB279 | 28353.2 | — | | — | 1.73125 | 0.638431 | 4.5587 |
| LAB279 | 28354.1 | 0.16875 | 0.529875 | 9.4822 | 1.8875 | 0.065936 | 13.9954 |
| LAB279 | 28355.4 | 0.15625 | 0.8303 | 1.3724 | — | | — |
| LAB283 | 28361.1 | 0.178125 | 0.467118 | 15.5646 | 1.825 | 0.427619 | 10.2207 |
| LAB283 | 28363.3 | 0.17375 | 0.541542 | 12.7261 | 1.8125 | 0.344973 | 9.4657 |
| LAB283 | 28364.3 | 0.1625 | 0.504389 | 5.4273 | 1.70625 | 0.319123 | 3.0488 |
| LAB283 | 28364.4 | 0.158125 | 0.795208 | 2.5889 | — | | — |
| LAB283 | 28365.1 | — | | — | 1.7875 | 0.163196 | 7.9559 |
| LAB298 | 29242.1 | 0.156875 | 0.916219 | 1.7779 | 1.65625 | 0.99852 | 0.029 |
| LAB298 | 29244.1 | — | | — | 1.6875 | 0.780431 | 1.9164 |
| LAB298 | 29245.2 | 0.1675 | 0.070243 | 8.6712 | 1.69375 | 0.438732 | 2.2938 |
| LAB298 | 29245.4 | 0.170625 | 0.416836 | 10.6987 | 1.83125 | 0.193654 | 10.5981 |
| LAB299 | 28061.1 | 0.158125 | 0.452526 | 2.5889 | 1.6625 | 0.840876 | 0.4065 |
| LAB299 | 28063.1 | 0.17125 | 0.154075 | 11.1042 | 1.75625 | 0.09145 | 6.0685 |
| LAB299 | 28064.1 | 0.17875 | 0.086684 | 15.9701 | 1.83125 | 0.244889 | 10.5981 |
| LAB302 | 28822.7 | 0.16625 | 0.316892 | 7.8603 | 1.79375 | 0.004396 | 8.3333 |
| LAB302 | 28823.4 | — | | — | 1.675 | 0.880281 | 1.1614 |
| LAB302 | 28825.2 | 0.16375 | 0.609505 | 6.2383 | 1.6875 | 0.805808 | 1.9164 |
| LAB336 | 28374.3 | 0.16 | 0.794708 | 3.8054 | — | | — |
| LAB336 | 28375.3 | 0.165625 | 0.567489 | 7.4548 | — | | — |
| LAB345 | 28491.1 | — | | — | 1.7 | 0.784228 | 2.6713 |
| LAB345 | 28494.1 | 0.165625 | 0.301978 | 7.4548 | 1.7875 | 0.477367 | 7.9559 |
| LAB58 | 28441.2 | 0.166875 | 0.873256 | 8.2658 | 1.85 | 0.78391 | 11.7305 |
| LAB58 | 28442.1 | — | | — | 1.68482 | 0.759924 | 1.7546 |
| CONT | | 0.154135 | | 0 | 1.65577 | | 0 |
| LAB133 | 28833.1 | 0.164375 | 0.805632 | 1.3487 | 2.13125 | 0.816821 | 4.8424 |
| LAB133 | 28833.2 | 0.183125 | 0.173573 | 12.9094 | 2.60625 | 0.000112 | 28.2091 |
| LAB162 | 29344.1 | — | | — | 2.10625 | 0.511248 | 3.6126 |
| LAB179 | 29304.2 | — | | — | 2.05625 | 0.901189 | 1.153 |
| LAB185 | 28174.2 | — | | — | 2.18125 | 0.712871 | 7.3021 |
| LAB185 | 28175.3 | 0.17375 | 0.756605 | 7.1291 | 2.33125 | 0.660543 | 14.681 |
| LAB210 | 28334.1 | — | | — | 2.0875 | 0.566999 | 2.6902 |
| LAB210 | 28335.3 | 0.1625 | 0.973801 | 0.1927 | 2.1375 | 0.611842 | 5.1499 |
| LAB293 | 29233.2 | 0.173125 | 0.338229 | 6.7437 | — | | — |
| LAB297 | 29272.5 | 0.16875 | 0.828481 | 4.0462 | 2.30625 | 0.487587 | 13.4512 |
| LAB297 | 29273.4 | 0.175625 | 0.14318 | 8.2852 | 2.23125 | 0.033812 | 9.7617 |
| LAB310 | 28182.3 | 0.209375 | 0.353219 | 29.0944 | 2.8 | 0.385473 | 37.7402 |
| LAB318 | 28103.2 | — | | — | 2.3 | 0.024685 | 13.1437 |
| LAB318 | 28104.3 | 0.16375 | 0.846191 | 0.9634 | 2.25 | 0.025788 | 10.6841 |
| LAB327 | 29221.6 | 0.18125 | 0.639489 | 11.7534 | 2.15625 | 0.391911 | 6.0723 |
| LAB327 | 29224.2 | 0.1675 | 0.076862 | 3.2755 | 2.16875 | 0.398411 | 6.6872 |
| LAB327 | 29225.3 | 0.1625 | 0.986774 | 0.1927 | 2.08125 | 0.783193 | 2.3828 |
| LAB335 | 27311.2 | 0.168125 | 0.377287 | 3.6609 | 2.225 | 0.455821 | 9.4543 |

TABLE 79-continued

Genes showing improved plant biomass production at standard growth conditions

| Gene Name | Event # | Dry Weight [gr] Ave. | P-Val. | % incr. | Fresh Weight [gr] Ave. | P-Val. | % incr. |
|---|---|---|---|---|---|---|---|
| LAB335 | 27312.1 | 0.16875 | 0.47389 | 4.0462 | 2.10625 | 0.625532 | 3.6126 |
| LAB335 | 27314.1 | 0.183125 | 0.075549 | 12.9094 | 2.3125 | 0.099712 | 13.7586 |
| LAB335 | 27314.2 | 0.17 | 0.694187 | 4.817 | 2.225 | 0.428418 | 9.4543 |
| LAB335 | 27315.4 | 0.190625 | 0.04754 | 17.5337 | 2.29375 | 0.020203 | 12.8363 |
| LAB54 | 28133.1 | 0.183125 | 0.350465 | 12.9094 | 2.075 | 0.889392 | 2.0753 |
| LAB54 | 28134.1 | 0.174375 | 0.450933 | 7.5145 | 2.05625 | 0.795758 | 1.153 |
| LAB54 | 28136.1 | 0.170625 | 0.147061 | 5.2023 | 2.125 | 0.279327 | 4.535 |
| LAB54 | 28136.2 | 0.18375 | 0.000028 | 13.2948 | 2.13125 | 0.745102 | 4.8424 |
| LAB68 | 29332.4 | 0.165 | 0.675673 | 1.7341 | — | — | — |
| LAB73 | 30151.1 | 0.1625 | 0.99205 | 0.1927 | 2.06875 | 0.742329 | 1.7679 |
| LAB73 | 30152.1 | 0.185625 | 0.394122 | 14.4509 | 2.29375 | 0.486788 | 12.8363 |
| LAB73 | 30152.2 | — | — | — | 2.05 | 0.89171 | 0.8455 |
| LAB73 | 30153.1 | 0.166875 | 0.617124 | 2.8902 | 2.15625 | 0.475862 | 6.0723 |
| LAB73 | 30154.3 | 0.17625 | 0.236322 | 8.6705 | 2.15625 | 0.242826 | 6.0723 |
| CONT | — | 0.162188 | — | 0 | 2.03281 | — | 0 |
| LAB102 | 30312.2 | 0.114375 | 0.418102 | 3.5248 | 1.425 | 0.06417 | 10.6796 |
| LAB126 | 30201.3 | 0.121875 | 0.144874 | 10.3133 | 1.48125 | 0.040365 | 15.0485 |
| LAB126 | 30202.3 | 0.124375 | 0.602294 | 12.5762 | 1.39375 | 0.562438 | 8.2524 |
| LAB126 | 30205.1 | 0.111875 | 0.831785 | 1.262 | 1.30625 | 0.66934 | 1.4563 |
| LAB165 | 30231.2 | 0.1225 | 0.315397 | 10.879 | 1.45 | 0.402235 | 12.6214 |
| LAB165 | 30232.1 | 0.134375 | 0.150154 | 21.6275 | 1.5 | 0.051804 | 16.5049 |
| LAB165 | 30233.1 | 0.126875 | 0.187331 | 14.839 | 1.40625 | 0.133089 | 9.2233 |
| LAB165 | 30235.1 | 0.1225 | 0.53738 | 10.879 | 1.4375 | 0.348208 | 11.6505 |
| LAB167 | 27321.2 | 0.12125 | 0.120989 | 9.7476 | 1.4875 | 0.335206 | 15.534 |
| LAB167 | 27321.3 | 0.116875 | 0.516013 | 5.7876 | 1.5125 | 0.227281 | 17.4757 |
| LAB167 | 27321.4 | 0.15875 | 0.396805 | 43.6902 | 1.79375 | 0.317552 | 39.3204 |
| LAB167 | 27321.6 | 0.13125 | 0.00037 | 18.799 | 1.6 | 0.184552 | 24.2718 |
| LAB220 | 30321.4 | 0.13375 | 0.466573 | 21.0618 | 1.45 | 0.563199 | 12.6214 |
| LAB220 | 30322.2 | 0.1625 | | 47.0844 | 1.5375 | | 19.4175 |
| LAB220 | 30322.3 | 0.11625 | 0.214943 | 5.2219 | 1.45 | 0.158513 | 12.6214 |
| LAB220 | 30323.1 | 0.120625 | 0.100276 | 9.1819 | 1.41875 | 0.045226 | 10.1942 |
| LAB220 | 30324.4 | 0.128125 | 0.223911 | 15.9704 | 1.46875 | 0.309327 | 14.0777 |
| LAB241 | 30211.3 | 0.135625 | 0.410696 | 22.7589 | 1.59375 | 0.283412 | 23.7864 |
| LAB241 | 30212.1 | 0.12375 | 0.215215 | 12.0104 | 1.4125 | 0.032038 | 9.7087 |
| LAB241 | 30212.2 | 0.143125 | 0.000675 | 29.5474 | 1.575 | 0.336299 | 22.3301 |
| LAB241 | 30213.1 | 0.120625 | 0.049793 | 9.1819 | 1.5 | 0.051804 | 16.5049 |
| LAB241 | 30213.4 | 0.11625 | 0.581382 | 5.2219 | 1.375 | 0.685381 | 6.7961 |
| LAB268 | 30391.4 | 0.14875 | 0.061108 | 34.6388 | 1.7 | 0.009582 | 32.0388 |
| LAB268 | 30392.1 | 0.123125 | 0.26539 | 11.4447 | 1.5375 | 0.236996 | 19.4175 |
| LAB268 | 30393.1 | 0.1175 | 0.67427 | 6.3534 | 1.3875 | 0.704817 | 7.767 |
| LAB268 | 30393.3 | — | — | — | 1.325 | 0.66676 | 2.9126 |
| LAB268 | 30395.1 | 0.163125 | 0.426176 | 47.6501 | 1.7375 | 0.301551 | 34.9515 |
| LAB280 | 30041.2 | 0.120625 | 0.34261 | 9.1819 | 1.325 | 0.66676 | 2.9126 |
| LAB280 | 30042.1 | 0.13125 | 0.105157 | 18.799 | 1.53125 | 0.420654 | 18.932 |
| LAB280 | 30044.1 | 0.1275 | 0.007333 | 15.4047 | 1.5375 | 0.000073 | 19.4175 |
| LAB280 | 30044.2 | — | — | — | 1.34375 | 0.414992 | 4.3689 |
| LAB280 | 30045.1 | 0.1725 | 0.143771 | 56.1358 | 1.9875 | 0.175926 | 54.3689 |
| LAB289 | 30371.4 | 0.12625 | 0.010957 | 14.2733 | 1.50625 | 0.290954 | 16.9903 |
| LAB289 | 30371.6 | 0.143125 | 0.008425 | 29.5474 | 1.6625 | 0.001659 | 29.1262 |
| LAB289 | 30373.1 | — | — | — | 1.4 | 0.190007 | 8.7379 |
| LAB289 | 30373.2 | 0.115 | 0.325765 | 4.0905 | 1.3 | 0.773245 | 0.9709 |
| LAB289 | 30375.2 | 0.13 | 0.375695 | 17.6675 | 1.5625 | 0.371833 | 21.3592 |
| LAB311 | 30221.4 | 0.1125 | 0.655701 | 1.8277 | 1.4125 | 0.014274 | 9.7087 |
| LAB311 | 30222.2 | 0.12125 | 0.354276 | 9.7476 | 1.3 | 0.912643 | 0.9709 |
| LAB311 | 30223.2 | 0.137946 | 0.000028 | 24.8601 | 1.52321 | 0.046123 | 18.3079 |
| LAB311 | 30223.4 | 0.129375 | 0.37002 | 17.1018 | 1.46875 | 0.415286 | 14.0777 |
| LAB311 | 30224.2 | 0.135 | 0.275217 | 22.1932 | 1.5 | 0.10109 | 16.5049 |
| LAB344 | 30092.3 | 0.11875 | 0.626326 | 7.4848 | 1.49375 | 0.515592 | 16.0194 |
| LAB344 | 30096.3 | 0.123125 | 0.328313 | 11.4447 | 1.39375 | 0.250311 | 8.2524 |
| LAB355 | 29281.3 | — | — | — | 1.3375 | 0.278576 | 3.8835 |
| LAB355 | 29282.1 | 0.113125 | 0.828965 | 2.3934 | 1.34375 | 0.562115 | 4.3689 |
| LAB355 | 29282.2 | — | — | — | 1.3375 | 0.796322 | 3.8835 |
| LAB355 | 29282.3 | 0.12625 | 0.003466 | 14.2733 | 1.325 | 0.39398 | 2.9126 |
| LAB355 | 29283.1 | 0.121875 | 0.300873 | 10.3133 | 1.4625 | 0.251911 | 13.5922 |
| LAB367 | 30173.1 | 0.12 | 0.66204 | 8.6162 | — | — | — |
| LAB381 | 30352.2 | 0.115625 | 0.45239 | 4.6562 | 1.36875 | 0.081506 | 6.3107 |
| LAB381 | 30352.4 | 0.115625 | 0.714844 | 4.6562 | 1.39375 | 0.166198 | 8.2524 |
| LAB381 | 30356.1 | 0.11375 | 0.591025 | 2.9591 | — | — | — |
| LAB383 | 28114.2 | 0.118125 | 0.449144 | 6.9191 | 1.5125 | 0.012666 | 17.4757 |
| LAB383 | 28115.2 | 0.121875 | 0.620392 | 10.3133 | 1.35625 | 0.693161 | 5.3398 |
| LAB64 | 30271.2 | 0.1225 | 0.16948 | 10.879 | 1.39375 | 0.166198 | 8.2524 |
| LAB64 | 30272.1 | 0.119375 | 0.550465 | 8.0505 | 1.325 | 0.845222 | 2.9126 |
| LAB64 | 30273.2 | 0.113125 | 0.689762 | 2.3934 | 1.30625 | 0.66934 | 1.4563 |
| LAB64 | 30274.2 | 0.12 | 0.085694 | 8.6162 | 1.48125 | 0.040365 | 15.0485 |

TABLE 79-continued

Genes showing improved plant biomass production at standard growth conditions

| Gene Name | Event # | Dry Weight [gr] | | | Fresh Weight [gr] | | |
|---|---|---|---|---|---|---|---|
| | | Ave. | P-Val. | % incr. | Ave. | P-Val. | % incr. |
| LAB65 | 30301.4 | 0.130625 | 0.084115 | 18.2332 | 1.49375 | 0.132823 | 16.0194 |
| LAB65 | 30302.1 | 0.114375 | 0.381316 | 3.5248 | — | — | — |
| LAB65 | 30303.4 | 0.11375 | 0.822452 | 2.9591 | — | — | — |
| LAB65 | 30304.3 | 0.1225 | 0.037642 | 10.879 | 1.59375 | 0.000028 | 23.7864 |
| LAB92 | 29321.2 | 0.110625 | 0.994179 | 0.1305 | — | — | — |
| LAB92 | 29323.2 | 0.118125 | 0.286864 | 6.9191 | — | — | — |
| CONT | — | 0.110481 | — | 0 | 1.2875 | — | 0 |
| LAB159 | 30702.4 | 0.128125 | 0.81001 | 1.7875 | 1.43125 | 0.78945 | 1.2378 |
| LAB159 | 30704.3 | 0.136875 | 0.270471 | 8.7388 | 1.45 | 0.73826 | 2.5641 |
| LAB161 | 30482.1 | 0.146875 | 0.196365 | 16.6832 | 1.46875 | 0.548768 | 3.8904 |
| LAB161 | 30482.2 | 0.12875 | 0.689432 | 2.284 | 1.5625 | 0.424701 | 10.5217 |
| LAB161 | 30483.1 | 0.133125 | 0.451328 | 5.7597 | 1.4625 | 0.615332 | 3.4483 |
| LAB161 | 30485.1 | 0.139375 | 0.189031 | 10.7249 | 1.525 | 0.658635 | 7.8691 |
| LAB170 | 30715.1 | 0.1325 | 0.718775 | 5.2632 | 1.575 | 0.60187 | 11.4058 |
| LAB170 | 30715.2 | 0.13125 | 0.453722 | 4.2701 | 1.49375 | 0.28639 | 5.6587 |
| LAB176 | 30142.1 | 0.1525 | 0.020341 | 21.1519 | 1.61875 | 0.551139 | 14.5004 |
| LAB176 | 30143.1 | 0.12625 | 0.990058 | 0.2979 | 1.45 | 0.917068 | 2.5641 |
| LAB176 | 30143.2 | 0.13875 | 0.136481 | 10.2284 | — | — | — |
| LAB188 | 30722.2 | 0.1275 | 0.854597 | 1.291 | 1.575 | 0.542248 | 11.4058 |
| LAB188 | 30723.3 | 0.14625 | 0.436767 | 16.1867 | 1.6125 | 0.239701 | 14.0584 |
| LAB188 | 30723.7 | 0.13 | 0.678787 | 3.2771 | 1.5625 | 0.054193 | 10.5217 |
| LAB188 | 30724.1 | 0.12875 | 0.920013 | 2.284 | — | — | — |
| LAB188 | 30724.2 | 0.131875 | 0.651248 | 4.7666 | — | — | — |
| LAB237 | 30281.4 | 0.1325 | 0.385882 | 5.2632 | 1.4875 | 0.304546 | 5.2166 |
| LAB237 | 30282.1 | 0.128125 | 0.771908 | 1.7875 | 1.4375 | 0.720968 | 1.6799 |
| LAB237 | 30283.2 | 0.135 | 0.378933 | 7.2493 | 1.4875 | 0.558208 | 5.2166 |
| LAB259 | 27112.12 | 0.14625 | 0.019208 | 16.1867 | 1.61875 | 0.330206 | 14.5004 |
| LAB259 | 27112.14 | — | — | — | 1.41875 | 0.950182 | 0.3537 |
| LAB259 | 27112.9 | 0.129375 | 0.679858 | 2.7805 | — | — | — |
| LAB270 | 30594.1 | 0.135625 | 0.704141 | 7.7458 | 1.58125 | 0.669648 | 11.8479 |
| LAB270 | 30594.3 | 0.151875 | 0.004279 | 20.6554 | 1.675 | 0.082737 | 18.4792 |
| LAB300 | 30062.2 | — | — | — | 1.56875 | 0.247471 | 10.9637 |
| LAB300 | 30063.1 | 0.1575 | 0.359476 | 25.1241 | 1.775 | 0.320951 | 25.5526 |
| LAB300 | 30064.3 | 0.145 | 0.105265 | 15.1936 | 1.6 | 0.021249 | 13.1742 |
| LAB306 | 30561.2 | 0.15 | 0.178191 | 19.1658 | 1.5125 | 0.217507 | 6.985 |
| LAB306 | 30564.2 | 0.146875 | 0.013619 | 16.6832 | 1.69375 | 0.127363 | 19.8055 |
| LAB306 | 30564.3 | 0.131875 | 0.732791 | 4.7666 | 1.56875 | 0.519326 | 10.9637 |
| LAB323 | 30381.4 | — | — | — | 1.425 | 0.862961 | 0.7958 |
| LAB323 | 30383.1 | — | — | — | 1.45 | 0.789302 | 2.5641 |
| LAB323 | 30383.2 | 0.133125 | 0.68296 | 5.7597 | 1.55625 | 0.161833 | 10.0796 |
| LAB347_H0 | 30441.1 | 0.130625 | 0.653233 | 3.7736 | 1.58125 | 0.362384 | 11.8479 |
| LAB347_H0 | 30442.4 | 0.12625 | 0.960076 | 0.2979 | 1.41875 | 0.945099 | 0.3537 |
| LAB347_H0 | 30443.4 | — | — | — | 1.5875 | 0.08105 | 12.29 |
| LAB347_H0 | 30444.1 | 0.12875 | 0.795011 | 2.284 | 1.59375 | 0.197666 | 12.7321 |
| LAB347_H0 | 30444.3 | 0.14125 | 0.051858 | 12.2145 | 1.6125 | 0.143312 | 14.0584 |
| LAB55 | 30022.3 | 0.1375 | 0.547416 | 9.2354 | 1.5875 | 0.182159 | 12.29 |
| LAB55 | 30023.1 | 0.151875 | 0.032873 | 20.6554 | 1.7 | 0.004854 | 20.2476 |
| LAB55 | 30023.3 | 0.136875 | 0.432771 | 8.7388 | — | — | — |
| LAB55 | 30025.3 | 0.12875 | 0.746551 | 2.284 | 1.54375 | 0.312533 | 9.1954 |
| LAB55 | 30025.4 | — | — | — | 1.45 | 0.671136 | 2.5641 |
| LAB83 | 30191.1 | 0.154375 | 0.048727 | 22.6415 | 1.7875 | 0.226573 | 26.4368 |
| LAB83 | 30191.3 | — | — | — | 1.425 | 0.939642 | 0.7958 |
| LAB83 | 30194.1 | 0.139375 | 0.189031 | 10.7249 | 1.65625 | 0.27611 | 17.153 |
| LAB83 | 30194.2 | 0.128125 | 0.927594 | 1.7875 | 1.4875 | 0.747941 | 5.2166 |
| LAB83 | 30194.3 | 0.141875 | 0.089145 | 12.711 | 1.53125 | 0.586088 | 8.3112 |
| LAB94 | 30681.4 | 0.135625 | 0.64507 | 7.7458 | 1.5625 | 0.233955 | 10.5217 |
| LAB94 | 30681.8 | 0.135625 | 0.431746 | 7.7458 | 1.7625 | 0.042969 | 24.6684 |
| LAB94 | 30682.2 | 0.14875 | 0.008873 | 18.1728 | 1.64375 | 0.009787 | 16.2688 |
| LAB94 | 30682.3 | 0.12875 | 0.815758 | 2.284 | 1.45625 | 0.712915 | 3.0062 |
| CONT | — | 0.125875 | — | 0 | 1.41375 | — | 0 |
| LAB138 | 30781.1 | 0.14625 | 0.000218 | 13.4349 | 1.55 | 0.29452 | 12.709 |
| LAB138 | 30781.2 | 0.130625 | 0.568847 | 1.3158 | — | — | — |
| LAB138 | 30781.5 | — | — | — | 1.4 | 0.87758 | 1.8017 |
| LAB138 | 30781.6 | 0.144375 | 0.005628 | 11.9806 | 1.6375 | 0.007623 | 19.0716 |
| LAB138 | 30783.2 | 0.131875 | 0.859696 | 2.2853 | 1.4 | 0.864974 | 1.8017 |
| LAB159 | 30701.6 | 0.134375 | 0.283801 | 4.2244 | 1.425 | 0.382234 | 3.6195 |
| LAB159 | 30702.3 | 0.153125 | 0.448101 | 18.7673 | 1.71875 | 0.402433 | 24.9797 |
| LAB159 | 30702.4 | 0.170625 | 0.058403 | 32.3407 | 1.89375 | 0.021918 | 37.7049 |
| LAB159 | 30704.3 | 0.148125 | 0.002625 | 14.8892 | 1.6125 | 0.001412 | 17.2537 |
| LAB159 | 30704.4 | 0.19375 | 0.057854 | 50.277 | 1.9875 | 0.022786 | 44.522 |
| LAB161 | 30482.1 | 0.17125 | 0.378961 | 32.8255 | 1.80625 | 0.319226 | 31.3423 |
| LAB161 | 30482.2 | 0.1775 | 0.287721 | 37.6731 | 1.86875 | 0.001651 | 35.887 |
| LAB161 | 30483.1 | 0.141875 | 0.502182 | 10.0416 | 1.6125 | 0.279889 | 17.2537 |
| LAB161 | 30485.1 | 0.143125 | 0.363239 | 11.0111 | 1.56875 | 0.192428 | 14.0724 |

TABLE 79-continued

Genes showing improved plant biomass production at standard growth conditions

| Gene Name | Event # | Dry Weight [gr] Ave. | P-Val. | % incr. | Fresh Weight [gr] Ave. | P-Val. | % incr. |
|---|---|---|---|---|---|---|---|
| LAB161 | 30486.1 | 0.185625 | 0 | 43.9751 | 1.94375 | 0.053961 | 41.3407 |
| LAB166 | 30242.1 | 0.150625 | 0.441354 | 16.8283 | 1.7125 | 0.131824 | 24.5252 |
| LAB166 | 30243.1 | 0.16875 | 0.000001 | 30.8864 | 1.9375 | 0.026687 | 40.8862 |
| LAB166 | 30244.3 | 0.165625 | 0.000246 | 28.4626 | 1.81875 | 0.149243 | 32.2513 |
| LAB166 | 30245.3 | 0.161964 | 0.186226 | 25.6233 | 1.86429 | 0.000328 | 35.5624 |
| LAB166 | 30245.4 | 0.180625 | 0.006028 | 40.097 | 2.01875 | 0.000022 | 46.7944 |
| LAB170 | 30712.1 | 0.181875 | 0.16305 | 41.0665 | 1.96875 | 0.032488 | 43.1586 |
| LAB170 | 30712.2 | 0.175625 | 0.050756 | 36.2188 | 1.89375 | 0.007955 | 37.7049 |
| LAB170 | 30713.2 | 0.160625 | 0.000423 | 24.5845 | 1.65 | 0.000569 | 19.9805 |
| LAB170 | 30715.1 | 0.1675 | 0.349864 | 29.9169 | 1.8625 | 0.199524 | 35.4326 |
| LAB170 | 30715.2 | 0.15875 | 0.314105 | 23.1302 | 1.76875 | 0.25787 | 28.6155 |
| LAB176 | 30141.4 | 0.145 | 0.152981 | 12.4654 | 1.68125 | 0.009299 | 22.2529 |
| LAB176 | 30142.1 | 0.171875 | 0.056306 | 33.3102 | 1.8125 | 0.006301 | 31.7968 |
| LAB176 | 30143.1 | 0.150625 | 0.211912 | 16.8283 | 1.66875 | 0.291607 | 21.3439 |
| LAB176 | 30143.2 | 0.169375 | 0.26497 | 31.3712 | 1.775 | 0.348496 | 29.07 |
| LAB176 | 30144.2 | 0.16875 | 0.002575 | 30.8864 | 1.775 | 0.223923 | 29.07 |
| LAB188 | 30722.2 | 0.135625 | 0.742307 | 5.1939 | 1.4375 | 0.498991 | 4.5285 |
| LAB188 | 30723.7 | 0.133125 | 0.696462 | 3.2548 | 1.4125 | 0.716812 | 2.7106 |
| LAB188 | 30724.1 | 0.139375 | 0.02053 | 8.1025 | 1.55625 | 0.155871 | 13.1634 |
| LAB188 | 30724.2 | 0.140625 | 0.465425 | 9.072 | 1.56875 | 0.139855 | 14.0724 |
| LAB237 | 30281.4 | 0.18 | 0.191653 | 39.6122 | 1.8875 | 0.003879 | 37.2504 |
| LAB237 | 30282.1 | 0.164375 | 0.012317 | 27.4931 | 1.7625 | 0.000131 | 28.161 |
| LAB237 | 30283.2 | 0.17125 | 0.229116 | 32.8255 | 1.8375 | 0.038234 | 33.6147 |
| LAB237 | 30283.4 | 0.173125 | 0.05434 | 34.2798 | 1.68125 | 0.368027 | 22.2529 |
| LAB237 | 30284.1 | 0.155625 | 0.000001 | 20.7064 | 1.85625 | 0.001818 | 34.9781 |
| LAB259 | 27112.12 | 0.18625 | 0.001045 | 44.4598 | 1.9875 | 0.000004 | 44.522 |
| LAB259 | 27112.14 | 0.183125 | 0.042173 | 42.036 | 2.0125 | 0.000002 | 46.3399 |
| LAB259 | 27112.3 | 0.150625 | 0.001692 | 16.8283 | 1.75 | 0.000072 | 27.2521 |
| LAB259 | 27112.7 | 0.156875 | 0.000673 | 21.6759 | 1.8 | 0.000044 | 30.8878 |
| LAB259 | 27112.9 | 0.17125 | 0.246017 | 32.8255 | 1.88125 | 0.064247 | 36.796 |
| LAB262 | 30611.4 | 0.144375 | 0.005628 | 11.9806 | 1.55625 | 0.099267 | 13.1634 |
| LAB262 | 30612.1 | 0.154375 | 0.064759 | 19.7368 | 1.63125 | 0.086086 | 18.6171 |
| LAB262 | 30612.4 | 0.161875 | 0.108734 | 25.554 | 1.80625 | 0.08145 | 31.3423 |
| LAB262 | 30614.1 | 0.19 | 0.092806 | 47.3684 | 2.03125 | 0.203751 | 47.7033 |
| LAB262 | 30614.2 | 0.164375 | 0.012317 | 27.4931 | 1.7625 | 0.080907 | 28.161 |
| LAB270 | 30591.2 | 0.156875 | 0.273608 | 21.6759 | 1.7125 | 0.288103 | 24.5252 |
| LAB270 | 30594.1 | 0.16 | 0.06665 | 24.0997 | 1.85 | 0.000013 | 34.5236 |
| LAB270 | 30594.3 | 0.161875 | 0.317364 | 25.554 | 1.64375 | 0.34245 | 19.5261 |
| LAB270 | 30595.1 | 0.160625 | 0.48859 | 24.5845 | 1.64375 | 0.497257 | 19.5261 |
| LAB270 | 30595.2 | 0.17 | 0.199533 | 31.856 | 1.8625 | 0.0005 | 35.4326 |
| LAB300 | 30061.2 | 0.155 | 0.501593 | 20.2216 | 1.7375 | 0.269005 | 26.3431 |
| LAB300 | 30062.2 | 0.134375 | 0.664452 | 4.2244 | 1.44375 | 0.635262 | 4.983 |
| LAB300 | 30064.1 | 0.144375 | 0.000076 | 11.9806 | — | — | — |
| LAB300 | 30064.3 | 0.143125 | 0.000137 | 11.0111 | 1.50625 | 0.181979 | 9.5277 |
| LAB306 | 30561.2 | 0.15625 | 0.038551 | 21.1911 | 1.5 | 0.161171 | 9.0732 |
| LAB306 | 30562.2 | 0.13125 | 0.809911 | 1.8006 | — | — | — |
| LAB306 | 30563.2 | 0.136786 | 0.624872 | 6.0942 | — | — | — |
| LAB306 | 30564.2 | 0.141875 | 0.624659 | 10.0416 | 1.4625 | 0.752344 | 6.3464 |
| LAB306 | 30564.3 | 0.159375 | 0.016393 | 23.615 | 1.825 | 0.00003 | 32.7057 |
| LAB323 | 30381.1 | 0.13625 | 0.80971 | 5.6787 | 1.59375 | 0.454896 | 15.8903 |
| LAB323 | 30381.4 | 0.150625 | 0.172632 | 16.8283 | 1.61875 | 0.019978 | 17.7082 |
| LAB323 | 30383.1 | 0.156875 | 0.095372 | 21.6759 | 1.5125 | 0.650542 | 9.9821 |
| LAB323 | 30383.2 | 0.133125 | 0.732299 | 3.2548 | 1.55625 | 0.155871 | 13.1634 |
| LAB347_H0 | 30442.4 | 0.14625 | 0.077908 | 13.4349 | 1.5625 | 0.009178 | 13.6179 |
| LAB347_H0 | 30444.1 | 0.148125 | 0.480364 | 14.8892 | 1.59375 | 0.207542 | 15.8903 |
| LAB55 | 30022.3 | 0.16 | 0.21228 | 24.0997 | 1.7125 | 0.002638 | 24.5252 |
| LAB55 | 30023.1 | 0.146518 | 0.382102 | 13.6427 | 1.55 | 0.44043 | 12.709 |
| LAB55 | 30025.4 | 0.13125 | 0.278126 | 1.8006 | 1.4375 | 0.646544 | 4.5285 |
| LAB83 | 30191.1 | 0.170625 | 0.106295 | 32.3407 | 1.7625 | 0.027146 | 28.161 |
| LAB83 | 30191.3 | 0.1625 | 0.120651 | 26.0388 | 1.8375 | 0.000016 | 33.6147 |
| LAB83 | 30194.1 | 0.139375 | 0.624335 | 8.1025 | 1.63125 | 0.242138 | 18.6171 |
| LAB83 | 30194.2 | 0.156875 | 0.273608 | 21.6759 | 1.65625 | 0.002345 | 20.435 |
| LAB83 | 30194.3 | 0.173125 | 0.05434 | 34.2798 | 1.95 | 0.043557 | 41.7952 |
| LAB94 | 30681.4 | 0.139375 | 0.570786 | 8.1025 | 1.575 | 0.365403 | 14.5269 |
| LAB94 | 30681.8 | 0.156875 | 0.095372 | 21.6759 | 1.75625 | 0.040544 | 27.7065 |
| LAB94 | 30682.2 | 0.1375 | 0.210092 | 6.6482 | 1.46875 | 0.374016 | 6.8008 |
| LAB94 | 30682.3 | 0.156875 | 0.095372 | 21.6759 | 1.60625 | 0.001732 | 16.7992 |
| LAB94 | 30684.2 | 0.1375 | 0.003391 | 6.6482 | 1.39375 | 0.754928 | 1.3472 |
| CONT | — | 0.128929 | — | 0 | 1.37522 | — | 0 |
| LAB182 | 30453.4 | 0.14875 | 0.68074 | 26.1357 | — | — | — |
| LAB182 | 30454.2 | 0.12 | 0.850037 | 1.7565 | — | — | — |
| LAB191 | 28152.1 | 0.121875 | 0.803405 | 3.3465 | — | — | — |
| LAB191 | 28156.2 | 0.135625 | 0.543241 | 15.0061 | 1.25 | 0.845649 | 2.8655 |
| LAB191 | 28156.4 | 0.135625 | 0.498506 | 15.0061 | — | — | — |

TABLE 79-continued

Genes showing improved plant biomass production at standard growth conditions

| Gene Name | Event # | Dry Weight [gr] Ave. | P-Val. | % incr. | Fresh Weight [gr] Ave. | P-Val. | % incr. |
|---|---|---|---|---|---|---|---|
| LAB221 | 30122.2 | 0.130625 | 0.422325 | 10.7662 | — | | — |
| LAB221 | 30124.4 | 0.12 | 0.965004 | 1.7565 | — | | — |
| LAB222 | 30474.1 | 0.13125 | 0.46465 | 11.2962 | — | | — |
| LAB222 | 30476.1 | 0.11875 | 0.911031 | 0.6965 | — | | — |
| LAB222 | 30476.2 | 0.124375 | 0.735627 | 5.4664 | — | | — |
| LAB225 | 30492.2 | 0.11875 | 0.95168 | 0.6965 | — | | — |
| LAB225 | 30493.2 | 0.126875 | 0.646474 | 7.5863 | — | | — |
| LAB232 | 30461.5 | 0.11875 | 0.91751 | 0.6965 | — | | — |
| LAB232 | 30462.4 | 0.15375 | 0.37591 | 30.3755 | 1.25 | 0.745085 | 2.8655 |
| LAB232 | 30463.2 | 0.118125 | 0.992211 | 0.1666 | — | | — |
| LAB260 | 30073.2 | 0.13125 | 0.425471 | 11.2962 | — | | — |
| LAB260 | 30073.4 | 0.14 | 0.49915 | 18.7159 | 1.2625 | 0.774567 | 3.8942 |
| LAB260 | 30074.3 | 0.148125 | 0.001519 | 25.6057 | 1.25 | 0.638692 | 2.8655 |
| LAB264 | 30131.1 | 0.12 | 0.938925 | 1.7565 | — | | — |
| LAB264 | 30133.2 | 0.13375 | 0.361205 | 13.4161 | — | | — |
| LAB264 | 30134.4 | 0.12875 | 0.539786 | 9.1763 | — | | — |
| LAB264 | 30135.2 | 0.1325 | 0.46708 | 12.3561 | — | | — |
| LAB265 | 30731.3 | 0.151875 | 0.574175 | 28.7856 | — | | — |
| LAB265 | 30732.2 | 0.121696 | 0.681017 | 3.195 | — | | — |
| LAB265 | 30734.4 | 0.120625 | 0.69853 | 2.2865 | — | | — |
| LAB290_H0 | 30661.2 | 0.124375 | 0.863165 | 5.4664 | — | | — |
| LAB307 | 30763.3 | 0.13625 | 0.21607 | 15.536 | 1.24375 | 0.746594 | 2.3512 |
| LAB308 | 30931.4 | 0.138125 | 0.039985 | 17.126 | 1.275 | 0.356258 | 4.9229 |
| LAB308 | 30932.3 | 0.135625 | 0.027292 | 15.0061 | — | | — |
| LAB308 | 30934.4 | 0.126875 | 0.301389 | 7.5863 | — | | — |
| LAB319 | 30771.5 | 0.1425 | 0.13287 | 20.8359 | 1.28125 | 0.572562 | 5.4372 |
| LAB319 | 30774.1 | 0.13 | 0.154046 | 10.2362 | — | | — |
| LAB319 | 30775.4 | 0.119375 | 0.849367 | 1.2265 | — | | — |
| LAB320 | 30601.2 | 0.1225 | 0.900215 | 3.8764 | — | | — |
| LAB320 | 30602.2 | 0.128125 | 0.35696 | 8.6463 | — | | — |
| LAB343 | 30622.2 | 0.12125 | 0.787181 | 2.8165 | — | | — |
| LAB343 | 30622.4 | 0.125 | 0.615125 | 5.9964 | — | | — |
| LAB348 | 30506.2 | 0.128125 | 0.576616 | 8.6463 | — | | — |
| LAB353 | 30553.1 | 0.133125 | 0.468315 | 12.8861 | — | | — |
| LAB353 | 30554.2 | 0.119375 | 0.932827 | 1.2265 | — | | — |
| LAB353 | 30554.3 | 0.12375 | 0.435644 | 4.9364 | — | | — |
| CONT | — | 0.117929 | — | 0 | 1.21518 | — | 0 |
| LAB182 | 30451.3 | 0.165 | 0.012397 | 10.4247 | 1.80625 | 0.149288 | 11.6825 |
| LAB182 | 30453.1 | 0.1525 | 0.494207 | 2.0592 | 1.63125 | 0.803843 | 0.8621 |
| LAB182 | 30453.4 | 0.150625 | 0.936927 | 0.8044 | 1.725 | 0.462239 | 6.6587 |
| LAB191 | 28156.4 | 0.175 | 0.562159 | 17.1171 | 1.86875 | 0.093575 | 15.547 |
| LAB221 | 30122.2 | 0.151875 | 0.925056 | 1.6409 | — | | — |
| LAB221 | 30124.3 | 0.15 | 0.973657 | 0.3861 | 1.65625 | 0.81822 | 2.4078 |
| LAB221 | 30124.4 | 0.161875 | 0.50932 | 8.3333 | 1.7 | 0.654614 | 5.113 |
| LAB222 | 30472.1 | 0.16375 | 0.018656 | 9.5882 | 1.86875 | 0.215909 | 15.547 |
| LAB222 | 30472.2 | — | | — | 1.69375 | 0.600379 | 4.7265 |
| LAB222 | 30473.1 | 0.153125 | 0.826785 | 2.4775 | 1.7125 | 0.717324 | 5.8859 |
| LAB222 | 30476.1 | — | | — | 1.66875 | 0.643441 | 3.1807 |
| LAB222 | 30476.2 | 0.163125 | 0.09682 | 9.1699 | 1.85625 | 0.057068 | 14.7741 |
| LAB225 | 30491.4 | 0.180625 | 0.000027 | 20.8816 | 2.00625 | 0.000217 | 24.0488 |
| LAB225 | 30492.1 | — | | — | 1.64375 | 0.875036 | 1.635 |
| LAB225 | 30492.2 | 0.160625 | 0.601762 | 7.4968 | 1.75625 | 0.655002 | 8.591 |
| LAB225 | 30493.2 | 0.1625 | 0.508934 | 8.7516 | 1.8625 | 0.075345 | 15.1605 |
| LAB232 | 30462.4 | 0.1625 | 0.074307 | 8.7516 | 1.80625 | 0.001921 | 11.6825 |
| LAB260 | 30071.4 | 0.153125 | 0.734057 | 2.4775 | 1.78125 | 0.122132 | 10.1367 |
| LAB260 | 30072.2 | 0.15625 | 0.778343 | 4.5689 | 1.65625 | 0.888308 | 2.4078 |
| LAB260 | 30073.4 | — | | — | 1.75 | 0.213622 | 8.2045 |
| LAB260 | 30074.3 | — | | — | 1.675 | 0.629614 | 3.5672 |
| LAB264 | 30131.1 | 0.165625 | 0.298492 | 10.843 | 1.74375 | 0.63077 | 7.8181 |
| LAB264 | 30133.2 | 0.16125 | 0.472345 | 7.9151 | 1.91875 | 0.174368 | 18.6385 |
| LAB264 | 30135.2 | 0.179375 | 0.375923 | 20.045 | 1.925 | 0.000158 | 19.025 |
| LAB265 | 30731.3 | 0.16375 | 0.255861 | 9.5882 | 1.75 | 0.012356 | 8.2045 |
| LAB290_H0 | 30662.3 | 0.16125 | 0.173976 | 7.9151 | 1.75625 | 0.348758 | 8.591 |
| LAB290_H0 | 30663.7 | 0.16375 | 0.362644 | 9.5882 | 1.8875 | 0.000052 | 16.7063 |
| LAB307 | 30764.4 | 0.158125 | 0.67622 | 5.8237 | 1.675 | 0.699696 | 3.5672 |
| LAB308 | 30931.4 | — | | — | 1.65625 | 0.881746 | 2.4078 |
| LAB308 | 30932.3 | 0.176875 | 0.382602 | 18.3719 | 1.96875 | 0.000009 | 21.7301 |
| LAB308 | 30933.3 | 0.155 | 0.827529 | 3.7323 | — | | — |
| LAB308 | 30934.4 | 0.155625 | 0.583062 | 4.1506 | 1.65 | 0.746763 | 2.0214 |
| LAB319 | 30771.5 | 0.179375 | 0.069648 | 20.045 | 2.0125 | 0.186062 | 24.4352 |
| LAB319 | 30774.1 | 0.17 | 0.415567 | 13.7709 | 1.75625 | 0.503846 | 8.591 |
| LAB319 | 30775.1 | 0.190625 | 0.000001 | 27.574 | 1.7625 | 0.007303 | 8.9774 |
| LAB319 | 30775.4 | 0.161875 | 0.055541 | 8.3333 | 1.74375 | 0.263974 | 7.8181 |
| LAB320 | 30601.2 | 0.1675 | 0.131252 | 12.0978 | 1.675 | 0.668079 | 3.5672 |

TABLE 79-continued

Genes showing improved plant biomass production at standard growth conditions

| Gene Name | Event # | Dry Weight [gr] Ave. | P-Val. | % incr. | Fresh Weight [gr] Ave. | P-Val. | % incr. |
|---|---|---|---|---|---|---|---|
| LAB320 | 30601.3 | 0.156875 | 0.568011 | 4.9871 | 1.73125 | 0.363827 | 7.0452 |
| LAB320 | 30601.4 | 0.198125 | 0.587447 | 32.5933 | 1.875 | 0.625999 | 15.9334 |
| LAB320 | 30602.2 | 0.17375 | 0.488933 | 16.2806 | 1.89375 | 0.2847 | 17.0927 |
| LAB320 | 30603.1 | 0.153125 | 0.734057 | 2.4775 | 1.6875 | 0.721973 | 4.3401 |
| LAB320 | 30605.1 | 0.150982 | 0.835667 | 1.0434 | 1.80893 | 0.134149 | 11.8481 |
| LAB343 | 30623.4 | — | — | — | 1.6625 | 0.700609 | 2.7943 |
| LAB353 | 30554.3 | — | — | — | 1.63125 | 0.959674 | 0.8621 |
| CONT | — | 0.149423 | — | 0 | 1.61731 | — | 0 |
| LAB108 | 28501.4 | 0.100625 | 0.540565 | 7.4766 | 1.20625 | 0.521445 | 5.2345 |
| LAB108 | 28504.1 | 0.09625 | 0.790619 | 2.8037 | — | — | — |
| LAB108 | 28505.2 | 0.1175 | 0.288525 | 25.5007 | 1.4625 | 0.39869 | 27.59 |
| LAB108 | 28505.4 | 0.125625 | 0.173728 | 34.1789 | 1.5125 | 0.016362 | 31.952 |
| LAB119 | 28411.1 | 0.114375 | 0.000258 | 22.1629 | 1.375 | 0.066709 | 19.9564 |
| LAB119 | 28412.1 | 0.098125 | 0.393521 | 4.8064 | 1.175 | 0.814009 | 2.5082 |
| LAB119 | 28413.1 | 0.10125 | 0.53679 | 8.1442 | 1.23125 | 0.635263 | 7.4155 |
| LAB119 | 28414.1 | 0.101875 | 0.575863 | 8.8117 | 1.28125 | 0.351626 | 11.7775 |
| LAB119 | 28415.2 | 0.106875 | 0.111674 | 14.1522 | 1.33125 | 0.05292 | 16.1396 |
| LAB157 | 28142.3 | 0.118125 | 0.028437 | 26.1682 | 1.4375 | 0.013969 | 25.4089 |
| LAB157 | 28144.2 | 0.111875 | 0.271811 | 19.4927 | 1.3125 | 0.343513 | 14.5038 |
| LAB157 | 28145.2 | 0.105 | 0.514623 | 12.1495 | 1.24286 | 0.695375 | 8.4281 |
| LAB157 | 28146.1 | 0.108036 | 0.003141 | 15.392 | 1.36071 | 0.250818 | 18.7101 |
| LAB157 | 28146.2 | 0.0975 | 0.587795 | 4.1389 | 1.2 | 0.697181 | 4.6892 |
| LAB231 | 28581.3 | 0.1 | 0.481153 | 6.8091 | 1.2625 | 0.384524 | 10.1418 |
| LAB231 | 28582.1 | 0.1125 | 0.079658 | 20.1602 | 1.5125 | 0.062365 | 31.952 |
| LAB231 | 28583.1 | 0.10625 | 0.162981 | 13.4846 | 1.24375 | 0.478199 | 8.506 |
| LAB231 | 28585.1 | 0.119375 | 0.000153 | 27.5033 | 1.5125 | 0.121455 | 31.952 |
| LAB231 | 28585.3 | 0.126875 | 0.105602 | 35.514 | 1.66875 | 0.141477 | 45.5834 |
| LAB238 | 28422.4 | 0.123125 | 0.04952 | 31.5087 | 1.54375 | 0.263002 | 34.6783 |
| LAB238 | 28422.5 | 0.112679 | 0.00051 | 20.3509 | 1.38839 | 0.006634 | 21.1248 |
| LAB238 | 28424.4 | 0.10875 | 0.350962 | 16.1549 | 1.34375 | 0.262248 | 17.2301 |
| LAB238 | 28425.5 | 0.11125 | 0.00097 | 18.8251 | 1.28125 | 0.077048 | 11.7775 |
| LAB240 | 28592.2 | 0.1075 | 0.066703 | 14.8198 | 1.33125 | 0.188225 | 16.1396 |
| LAB240 | 28592.6 | 0.109375 | 0.00179 | 16.8224 | 1.3625 | 0.077214 | 18.8659 |
| LAB240 | 28595.1 | 0.09375 | 0.978175 | 0.1335 | 1.23125 | 0.230199 | 7.4155 |
| LAB240 | 28595.3 | 0.098125 | 0.877932 | 4.8064 | 1.29792 | 0.668156 | 13.2316 |
| LAB242 | 28081.2 | 0.124375 | 0.01622 | 32.8438 | 1.63125 | 0.000081 | 42.3119 |
| LAB267 | 28383.2 | 0.103125 | 0.566589 | 10.1469 | 1.2375 | 0.525143 | 7.9607 |
| LAB267 | 28384.2 | 0.099375 | 0.393223 | 6.1415 | 1.19375 | 0.608608 | 4.1439 |
| LAB269 | 28341.3 | 0.104375 | 0.164938 | 11.482 | 1.34375 | 0.016343 | 17.2301 |
| LAB269 | 28342.3 | — | — | — | 1.21875 | 0.79763 | 6.325 |
| LAB269 | 28343.4 | 0.125625 | 0.000029 | 34.1789 | 1.56875 | 0.001182 | 36.8593 |
| LAB269 | 28345.2 | 0.113125 | 0.011541 | 20.8278 | 1.5125 | 0.000323 | 31.952 |
| LAB269 | 28345.3 | 0.094286 | 0.914205 | 0.7057 | — | — | — |
| LAB279 | 28351.1 | — | — | — | 1.16875 | 0.861158 | 1.9629 |
| LAB279 | 28351.4 | 0.095625 | 0.793592 | 2.1362 | — | — | — |
| LAB279 | 28353.2 | 0.09875 | 0.209997 | 5.474 | 1.1625 | 0.835463 | 1.4177 |
| LAB279 | 28354.1 | 0.115625 | 0.222145 | 23.498 | 1.4875 | 0.020575 | 29.771 |
| LAB279 | 28355.4 | 0.11 | 0.001612 | 17.49 | 1.3375 | 0.035204 | 16.6848 |
| LAB283 | 28361.1 | 0.095 | 0.868639 | 1.4686 | — | — | — |
| LAB283 | 28363.3 | 0.101875 | 0.150488 | 8.8117 | 1.31875 | 0.027947 | 15.0491 |
| LAB283 | 28364.3 | 0.105982 | 0.408128 | 13.1986 | 1.29018 | 0.509437 | 12.5565 |
| LAB283 | 28364.4 | 0.108125 | 0.519698 | 15.4873 | 1.30625 | 0.643676 | 13.9586 |
| LAB283 | 28365.1 | 0.123482 | 0.000155 | 31.8901 | 1.56071 | 0.000128 | 36.1583 |
| LAB298 | 29242.1 | — | — | — | 1.2 | 0.872248 | 4.6892 |
| LAB298 | 29245.2 | 0.105 | 0.013968 | 12.1495 | 1.25625 | 0.323329 | 9.5965 |
| LAB299 | 28063.2 | 0.113839 | 0.002563 | 21.5907 | 1.34821 | 0.016034 | 17.6196 |
| LAB299 | 28066.1 | 0.09375 | 0.993024 | 0.1335 | 1.15625 | 0.963112 | 0.8724 |
| LAB302 | 28822.7 | 0.09625 | 0.869388 | 2.8037 | — | — | — |
| LAB302 | 28825.1 | 0.095625 | 0.750295 | 2.1362 | 1.225 | 0.435589 | 6.8702 |
| LAB336 | 28374.1 | 0.1 | 0.637648 | 6.8091 | 1.35625 | 0.063541 | 18.3206 |
| LAB336 | 28374.3 | 0.10375 | 0.136356 | 10.8144 | 1.225 | 0.289757 | 6.8702 |
| LAB336 | 28375.1 | 0.098125 | 0.298559 | 4.8064 | — | — | — |
| LAB336 | 28375.3 | 0.096875 | 0.445923 | 3.4713 | 1.23125 | 0.242828 | 7.4155 |
| LAB339 | 27272.2 | — | — | — | 1.19375 | 0.84878 | 4.1439 |
| LAB339 | 27272.4 | 0.10375 | 0.48628 | 10.8144 | 1.5 | 0.000531 | 30.8615 |
| LAB339 | 27272.7 | 0.09875 | 0.840729 | 5.474 | 1.29375 | 0.637334 | 12.868 |
| LAB339 | 27272.8 | 0.09375 | 0.973174 | 0.1335 | 1.1625 | 0.866807 | 1.4177 |
| LAB345 | 28491.1 | 0.10375 | 0.48628 | 10.8144 | 1.325 | 0.393967 | 15.5943 |
| LAB345 | 28492.2 | 0.09625 | 0.905654 | 2.8037 | 1.18125 | 0.894265 | 3.0534 |
| LAB345 | 28494.1 | 0.096161 | 0.872859 | 2.7084 | 1.18661 | 0.87425 | 3.5208 |
| LAB345 | 28495.4 | 0.09625 | 0.83877 | 2.8037 | 1.19375 | 0.742453 | 4.1439 |
| LAB58 | 28441.2 | 0.106875 | 0.617086 | 14.1522 | 1.44375 | 0.348105 | 25.9542 |
| LAB58 | 28442.1 | 0.098125 | 0.632738 | 4.8064 | 1.25625 | 0.476511 | 9.5965 |
| LAB58 | 28442.4 | 0.111875 | 0.000657 | 19.4927 | 1.525 | 0.000251 | 33.0425 |

TABLE 79-continued

Genes showing improved plant biomass production at standard growth conditions

| Gene | | Dry Weight [gr] | | | Fresh Weight [gr] | | |
|---|---|---|---|---|---|---|---|
| Name | Event # | Ave. | P-Val. | % incr. | Ave. | P-Val. | % incr. |
| LAB58 | 28443.4 | 0.108125 | 0.519698 | 15.4873 | 1.375 | 0.487355 | 19.9564 |
| LAB58 | 28445.2 | 0.105625 | 0.488947 | 12.8171 | 1.4125 | 0.436495 | 23.2279 |
| CONT | — | 0.093625 | — | 0 | 1.14625 | — | 0 |
| LAB130 | 30541.3 | 0.113839 | 0.998946 | 0.0262 | — | | |
| LAB130 | 30544.2 | 0.118125 | 0.819094 | 3.7918 | — | | |
| LAB130 | 30545.1 | 0.120625 | 0.391549 | 5.9885 | 1.575 | 0.395083 | 10.1429 |
| LAB130 | 30545.2 | 0.114375 | 0.938581 | 0.4969 | — | | |
| LAB163 | 30831.3 | 0.125625 | 0.298863 | 10.3818 | 1.48125 | 0.565918 | 3.5868 |
| LAB163 | 30832.2 | 0.1225 | 0.300166 | 7.636 | — | | |
| LAB163 | 30833.1 | 0.1175 | 0.611338 | 3.2427 | — | | |
| LAB163 | 30833.2 | 0.13 | 0.054359 | 14.2259 | 1.45 | 0.749472 | 1.4014 |
| LAB163 | 30834.2 | 0.13375 | 0.189222 | 17.5209 | 1.60625 | 0.304411 | 12.3283 |
| LAB164 | 30523.3 | 0.13 | 0.490235 | 14.2259 | — | | |
| LAB164 | 30524.1 | 0.12125 | 0.316882 | 6.5377 | 1.49375 | 0.480616 | 4.4609 |
| LAB164 | 30525.2 | 0.114375 | 0.951803 | 0.4969 | — | | |
| LAB171 | 30841.3 | 0.125 | 0.560641 | 9.8326 | 1.4875 | 0.799674 | 4.0239 |
| LAB171 | 30841.4 | 0.118125 | 0.682919 | 3.7918 | 1.60625 | 0.448224 | 12.3283 |
| LAB171 | 30842.3 | 0.121875 | 0.287926 | 7.0868 | 1.46875 | 0.761255 | 2.7126 |
| LAB171 | 30843.2 | 0.1475 | 0.274109 | 29.6025 | 1.5375 | 0.356506 | 7.5205 |
| LAB172 | 30854.1 | 0.1175 | 0.740139 | 3.2427 | — | | |
| LAB172 | 30855.3 | 0.14 | 0.399556 | 23.0126 | 1.4375 | 0.968731 | 0.5273 |
| LAB175 | 30513.4 | 0.123125 | 0.575496 | 8.1851 | — | | |
| LAB175 | 30514.4 | 0.1275 | 0.415393 | 12.0293 | — | | |
| LAB175 | 30516.1 | 0.115982 | 0.760479 | 1.909 | — | | |
| LAB204 | 30864.1 | — | | — | 1.5 | 0.471445 | 4.898 |
| LAB263 | 30891.6 | 0.133125 | 0.442048 | 16.9718 | — | | |
| LAB263 | 30892.2 | 0.11875 | 0.622397 | 4.341 | 1.475 | 0.588986 | 3.1497 |
| LAB263 | 30892.3 | 0.130625 | 0.043267 | 14.7751 | 1.475 | 0.634728 | 3.1497 |
| LAB263 | 30892.4 | 0.116875 | 0.846465 | 2.6935 | — | | |
| LAB263 | 30893.3 | 0.1225 | 0.242259 | 7.636 | — | | |
| LAB271 | 30901.3 | 0.11625 | 0.73206 | 2.1444 | 1.50625 | 0.519254 | 5.3351 |
| LAB271 | 30903.1 | 0.141875 | 0.194649 | 24.66 | 1.4875 | 0.597303 | 4.0239 |
| LAB271 | 30905.4 | 0.128571 | 0.111488 | 12.9707 | 1.56429 | 0.350186 | 9.3936 |
| LAB272 | 31121.1 | 0.114375 | 0.938581 | 0.4969 | — | | |
| LAB272 | 31123.6 | 0.116875 | 0.668918 | 2.6935 | — | | |
| LAB272 | 31125.4 | 0.1225 | 0.347796 | 7.636 | — | | |
| LAB272 | 31125.5 | 0.130625 | 0.040537 | 14.7751 | — | | |
| LAB284 | 30911.3 | 0.120625 | 0.364744 | 5.9885 | 1.5625 | 0.152953 | 9.2688 |
| LAB284 | 30912.2 | 0.134375 | 0.0174 | 18.0701 | 1.48125 | 0.613848 | 3.5868 |
| LAB284 | 30913.1 | 0.1325 | 0.031075 | 16.4226 | 1.51875 | 0.188335 | 6.2092 |
| LAB284 | 30913.3 | 0.128125 | 0.757068 | 12.5785 | — | | |
| LAB286 | 30921.1 | 0.1325 | 0.044637 | 16.4226 | 1.53125 | 0.285565 | 7.0834 |
| LAB286 | 30922.1 | 0.12625 | 0.19575 | 10.931 | 1.675 | 0.004347 | 17.1361 |
| LAB286 | 30922.4 | 0.128125 | 0.091952 | 12.5785 | 1.58125 | 0.594535 | 10.58 |
| LAB286 | 30923.3 | 0.125 | 0.191715 | 9.8326 | 1.45 | 0.880602 | 1.4014 |
| LAB286 | 30924.2 | 0.13375 | 0.023491 | 17.5209 | 1.49375 | 0.316576 | 4.4609 |
| LAB329 | 30102.2 | 0.116875 | 0.831514 | 2.6935 | — | | |
| LAB329 | 30103.1 | 0.115625 | 0.804924 | 1.5952 | 1.4375 | 0.904113 | 0.5273 |
| LAB329 | 30103.2 | 0.124375 | 0.399636 | 9.2835 | 1.45 | 0.849867 | 1.4014 |
| LAB329 | 30104.1 | 0.13 | 0.206556 | 14.2259 | 1.58125 | 0.199185 | 10.58 |
| LAB329 | 30104.2 | 0.14125 | 0.018962 | 24.1109 | 1.63125 | 0.260996 | 14.0766 |
| CONT | — | 0.11381 | — | 0 | 1.42996 | — | 0 |
| LAB107 | 30532.3 | — | | — | 1.9875 | 0.806582 | 2.8651 |
| LAB107 | 30533.4 | 0.18875 | 0.431503 | 6.6599 | 2.05 | 0.620938 | 6.0998 |
| LAB107 | 30535.2 | 0.179375 | 0.615701 | 1.3623 | — | | |
| LAB121 | 30801.4 | 0.205625 | 0.079815 | 16.1958 | 2.275 | 0.177405 | 17.7449 |
| LAB121 | 30802.1 | 0.191875 | 0.011695 | 8.4258 | 1.975 | 0.597212 | 2.2181 |
| LAB121 | 30802.2 | 0.20125 | 0.002213 | 13.7235 | 2.05625 | 0.067154 | 6.4233 |
| LAB121 | 30804.1 | 0.1875 | 0.047826 | 5.9536 | 1.95625 | 0.747702 | 1.2477 |
| LAB129 | 30825.1 | 0.191875 | 0.580351 | 8.4258 | 2.13125 | 0.505515 | 10.305 |
| LAB130 | 30544.2 | 0.189375 | 0.030595 | 7.0131 | 2.1625 | 0.204854 | 11.9224 |
| LAB130 | 30545.1 | 0.1925 | 0.009771 | 8.779 | 2.21875 | 0.133539 | 14.8336 |
| LAB130 | 30545.2 | 0.178125 | 0.881986 | 0.6559 | — | | |
| LAB163 | 30833.2 | — | | — | 1.94196 | 0.972968 | 0.5083 |
| LAB164 | 30524.1 | 0.193125 | 0.008148 | 9.1322 | 2.05625 | 0.142543 | 6.4233 |
| LAB164 | 30525.2 | 0.205 | 0.209771 | 15.8426 | 2.11875 | 0.089856 | 9.658 |
| LAB164 | 30525.3 | 0.186607 | 0.796571 | 5.449 | 1.97768 | 0.892238 | 2.3567 |
| LAB171 | 30841.3 | 0.181875 | 0.695357 | 2.775 | 2.05625 | 0.269679 | 6.4233 |
| LAB171 | 30842.3 | — | | — | 1.98125 | 0.874102 | 2.5416 |
| LAB171 | 30842.4 | 0.224375 | 0.000023 | 26.7911 | 2.4125 | 0.000482 | 24.8614 |
| LAB171 | 30843.2 | 0.22375 | 0.136299 | 26.4379 | 2.48125 | 0.372141 | 28.4196 |
| LAB171 | 30845.1 | 0.21375 | 0.09702 | 20.7871 | 2.34375 | 0.345127 | 21.3031 |
| LAB172 | 30853.4 | 0.178125 | 0.959553 | 0.6559 | — | | |
| LAB175 | 30514.4 | — | | — | 2.01875 | 0.468707 | 4.4824 |

TABLE 79-continued

Genes showing improved plant biomass production at standard growth conditions

| Gene Name | Event # | Dry Weight [gr] Ave. | P-Val. | % incr. | Fresh Weight [gr] Ave. | P-Val. | % incr. |
|---|---|---|---|---|---|---|---|
| LAB204 | 30863.1 | 0.1825 | 0.595527 | 3.1282 | 2.10625 | 0.390188 | 9.0111 |
| LAB204 | 30865.4 | 0.17875 | 0.766627 | 1.0091 | — | | — |
| LAB261 | 31074.2 | 0.188125 | 0.309901 | 6.3068 | 2.16875 | 0.021994 | 12.2458 |
| LAB261 | 31074.4 | 0.2175 | 0.031657 | 22.9062 | 2.33125 | 0.000341 | 20.6562 |
| LAB261 | 31075.1 | 0.208125 | 0.434332 | 17.6085 | 2.275 | 0.526715 | 17.7449 |
| LAB261 | 31075.3 | 0.195625 | 0.049209 | 10.5449 | 2.15 | 0.018972 | 11.2754 |
| LAB263 | 30891.6 | 0.1775 | 0.983043 | 0.3027 | — | | — |
| LAB263 | 30892.2 | 0.20125 | 0.082323 | 13.7235 | 2.33125 | 0.000341 | 20.6562 |
| LAB263 | 30892.3 | 0.209375 | 0.192217 | 18.3148 | 2.38125 | 0.0417 | 23.244 |
| LAB263 | 30892.4 | 0.19625 | 0.068766 | 10.8981 | 2.2125 | 0.382209 | 14.5102 |
| LAB263 | 30893.3 | 0.203125 | 0.209471 | 14.783 | 2.19375 | 0.291443 | 13.5397 |
| LAB271 | 30901.4 | — | | — | 2.16696 | 0.580174 | 12.1534 |
| LAB271 | 30905.4 | — | | — | 1.99375 | 0.368398 | 3.1885 |
| LAB271 | 30905.6 | 0.19 | 0.021194 | 7.3663 | 2.1875 | 0.009895 | 13.2163 |
| LAB271 | 30905.7 | 0.178125 | 0.9664 | 0.6559 | 2.11875 | 0.581826 | 9.658 |
| LAB272 | 31121.1 | 0.20875 | 0.050308 | 17.9617 | 2.25625 | 0.001782 | 16.7745 |
| LAB272 | 31123.6 | — | | — | 2.125 | 0.030074 | 9.9815 |
| LAB272 | 31125.4 | 0.18375 | 0.165849 | 3.8345 | 2.04375 | 0.575741 | 5.7763 |
| LAB284 | 30913.1 | — | | — | 2.0875 | 0.808354 | 8.0407 |
| LAB284 | 30913.3 | 0.180625 | 0.647696 | 2.0686 | — | | — |
| LAB286 | 30923.3 | 0.2075 | 0.023628 | 17.2553 | 2.13125 | 0.175619 | 10.305 |
| LAB286 | 30924.3 | 0.19 | 0.081073 | 7.3663 | 2.18125 | 0.361634 | 12.8928 |
| LAB329 | 30102.2 | 0.179375 | 0.860545 | 1.3623 | 1.99554 | 0.525457 | 3.281 |
| LAB329 | 30102.3 | 0.18125 | 0.625601 | 2.4218 | 2 | 0.352664 | 3.512 |
| CONT | — | 0.176964 | — | 0 | 1.93214 | — | 0 |
| LAB116 | 31442.4 | — | — | — | 2.10625 | 0.74767 | 8.4943 |
| LAB120 | 31115.1 | — | — | — | 1.975 | 0.822349 | 1.7335 |
| LAB122 | 31161.1 | — | — | — | 1.9625 | 0.937549 | 1.0896 |
| LAB137 | 31315.2 | — | — | — | 1.95625 | 0.978678 | 0.7677 |
| LAB154 | 30693.2 | — | — | — | 2.375 | 0.069644 | 22.3378 |
| LAB178 | 30632.1 | — | — | — | 2.30625 | 0.078936 | 18.7964 |
| LAB178 | 30633.4 | — | — | — | 1.9875 | 0.591347 | 2.3774 |
| LAB255 | 31215.1 | — | — | — | 1.96875 | 0.83064 | 1.4116 |
| LAB312 | 30943.1 | — | — | — | 1.99375 | 0.91042 | 2.6994 |
| LAB342 | 31705.4 | — | — | — | 2.00625 | 0.768605 | 3.3432 |
| LAB54 | 28133.1 | — | — | — | 2.04375 | 0.787027 | 5.2749 |
| LAB54 | 28134.1 | — | — | — | 1.98393 | 0.896927 | 2.1934 |
| LAB56 | 31451.3 | — | — | — | 2.15 | 0.49872 | 10.7479 |
| LAB98 | 31011.2 | — | — | — | 2.00625 | 0.711601 | 3.3432 |
| CONT | — | — | — | — | 1.94135 | — | 0 |

Table 79.
"CONT."—Control;
"Ave."—Average;
"% incr." = % increment;
"p-val."—p-value.

TABLE 80

Genes showing improved plant biomass production at standard growth conditions

| Gene Name | Event # | Rosette Diameter [cm] Ave. | P-Val. | % incr. | Rosette Area [cm 2] Ave. | P-Val. | % incr. | Plot Coverage [%] Ave. | P-Val. | % incr. |
|---|---|---|---|---|---|---|---|---|---|---|
| LAB113 | 28545.3 | 5.16 | 0.62 | 1 | — | — | — | — | — | — |
| LAB131 | 28291.1 | 5.51 | 0.01 | 8 | 10.21 | 0.01 | 16 | 81.65 | 0.01 | 16 |
| LAB131 | 28292.3 | 5.52 | 0.02 | 8 | 9.72 | 0.05 | 10 | 77.79 | 0.05 | 10 |
| LAB131 | 28294.2 | 5.48 | 0.05 | 7 | 10.27 | 0.26 | 16 | 82.17 | 0.26 | 16 |
| LAB131 | 28295.3 | 5.45 | 0.07 | 7 | 10.29 | 0.04 | 17 | 82.32 | 0.04 | 17 |
| LAB145 | 28551.1 | 5.54 | 0.58 | 9 | 10.23 | 0.57 | 16 | 81.82 | 0.57 | 16 |
| LAB145 | 28551.3 | 5.88 | 0.21 | 15 | 11.40 | 0.23 | 29 | 91.17 | 0.23 | 29 |
| LAB145 | 28553.2 | 5.73 | 0.04 | 12 | 10.95 | 0.06 | 24 | 87.59 | 0.06 | 24 |
| LAB145 | 28553.3 | 5.88 | 0.23 | 15 | 12.01 | 0.14 | 36 | 96.07 | 0.14 | 36 |
| LAB145 | 28555.1 | 5.63 | 0.14 | 11 | 9.84 | 0.21 | 12 | 78.72 | 0.21 | 12 |
| LAB152 | 28471.1 | — | — | — | 9.19 | 0.38 | 4 | 73.49 | 0.38 | 4 |
| LAB152 | 28472.3 | 5.29 | 0.16 | 4 | 9.95 | 0.02 | 13 | 74.63 | 0.59 | 6 |
| LAB152 | 28473.2 | 5.33 | 0.09 | 5 | 9.44 | 0.15 | 7 | 75.56 | 0.15 | 7 |
| LAB152 | 28473.3 | 5.49 | 0.01 | 8 | 10.01 | 0.01 | 13 | 80.08 | 0.01 | 13 |
| LAB152 | 28474.4 | 5.14 | 0.91 | 1 | 8.89 | 0.96 | 1 | 71.13 | 0.96 | 1 |

TABLE 80-continued

Genes showing improved plant biomass production at standard growth conditions

| Gene Name | Event # | Rosette Diameter [cm] | | | Rosette Area [cm 2] | | | Plot Coverage [%] | | |
|---|---|---|---|---|---|---|---|---|---|---|
| | | Ave. | P-Val. | % incr. | Ave. | P-Val. | % incr. | Ave. | P-Val. | % incr. |
| LAB153 | 28302.2 | 5.68 | 0.01 | 11 | 10.73 | 0.05 | 22 | 85.86 | 0.05 | 22 |
| LAB153 | 28303.1 | 5.13 | 0.78 | 1 | 9.10 | 0.50 | 3 | 72.84 | 0.50 | 3 |
| LAB153 | 28304.1 | 5.95 | 0.03 | 17 | 11.75 | 0.00 | 33 | 94.00 | 0.00 | 33 |
| LAB153 | 28305.3 | 5.49 | 0.38 | 8 | 10.35 | 0.28 | 17 | 82.82 | 0.28 | 17 |
| LAB169 | 28391.4 | 5.56 | 0.04 | 9 | 10.31 | 0.01 | 17 | 82.48 | 0.01 | 17 |
| LAB169 | 28392.1 | 5.28 | 0.30 | 4 | 9.62 | 0.26 | 9 | 76.95 | 0.26 | 9 |
| LAB169 | 28394.3 | 5.87 | 0.00 | 15 | 11.38 | 0.01 | 29 | 91.06 | 0.01 | 29 |
| LAB181 | 28481.1 | 5.28 | 0.69 | 4 | 9.79 | 0.58 | 11 | 78.31 | 0.58 | 11 |
| LAB181 | 28482.2 | 5.53 | 0.27 | 8 | 10.49 | 0.26 | 19 | 83.92 | 0.26 | 19 |
| LAB181 | 28484.3 | 5.51 | 0.01 | 8 | 10.24 | 0.07 | 16 | 81.94 | 0.07 | 16 |
| LAB187 | 28431.3 | 5.34 | 0.42 | 5 | 9.66 | 0.18 | 9 | 77.25 | 0.18 | 9 |
| LAB187 | 28431.5 | 5.52 | 0.01 | 8 | 9.51 | 0.12 | 8 | 76.07 | 0.12 | 8 |
| LAB187 | 28434.1 | 6.08 | 0.28 | 19 | 12.69 | 0.23 | 44 | 101.53 | 0.23 | 44 |
| LAB213 | 28561.2 | 5.49 | 0.01 | 8 | 10.59 | 0.00 | 20 | 84.69 | 0.00 | 20 |
| LAB213 | 28562.6 | 5.54 | 0.30 | 9 | 10.26 | 0.35 | 16 | 82.07 | 0.35 | 16 |
| LAB213 | 28565.2 | 5.27 | 0.21 | 3 | 8.98 | 0.73 | 2 | 71.80 | 0.73 | 2 |
| LAB230 | 28572.3 | 5.11 | 0.96 | 0 | 8.88 | 0.93 | 1 | 71.00 | 0.93 | 1 |
| LAB247 | 28091.4 | 5.44 | 0.05 | 7 | 9.52 | 0.15 | 8 | 76.14 | 0.15 | 8 |
| LAB247 | 28093.2 | 5.39 | 0.17 | 6 | 9.36 | 0.42 | 6 | 74.90 | 0.42 | 6 |
| LAB247 | 28094.1 | 5.41 | 0.33 | 6 | 9.96 | 0.20 | 13 | 79.70 | 0.20 | 13 |
| LAB247 | 28094.3 | 5.84 | 0.00 | 15 | 11.40 | 0.01 | 29 | 91.23 | 0.01 | 29 |
| LAB247 | 28095.4 | 5.19 | 0.89 | 2 | — | | — | — | | — |
| LAB249 | 28602.1 | 5.64 | 0.27 | 11 | 10.36 | 0.41 | 17 | 82.88 | 0.41 | 17 |
| LAB249 | 28603.3 | 5.55 | 0.16 | 9 | 9.73 | 0.17 | 10 | 77.82 | 0.17 | 10 |
| LAB249 | 28604.2 | 5.63 | 0.07 | 10 | 10.71 | 0.01 | 21 | 85.64 | 0.01 | 21 |
| LAB249 | 28604.4 | 5.20 | 0.43 | 2 | 9.01 | 0.65 | 2 | 72.08 | 0.65 | 2 |
| LAB249 | 28605.2 | 5.14 | 0.73 | 1 | — | | — | — | | — |
| LAB258 | 27441.4 | 5.61 | 0.21 | 10 | 10.77 | 0.22 | 22 | 86.14 | 0.22 | 22 |
| LAB258 | 27442.2 | 6.19 | 0.01 | 22 | 12.27 | 0.07 | 39 | 98.19 | 0.07 | 39 |
| LAB258 | 27442.5 | 5.24 | 0.67 | 3 | 9.19 | 0.81 | 4 | 73.48 | 0.81 | 4 |
| LAB258 | 27444.4 | 5.33 | 0.23 | 5 | 9.63 | 0.17 | 9 | 77.07 | 0.17 | 9 |
| LAB294 | 28401.3 | 5.11 | 0.96 | 0 | — | | — | — | | — |
| LAB294 | 28402.5 | 5.28 | 0.72 | 4 | 9.26 | 0.79 | 5 | 74.10 | 0.79 | 5 |
| LAB294 | 28404.3 | 5.49 | 0.58 | 8 | 9.69 | 0.61 | 10 | 77.49 | 0.61 | 10 |
| LAB74 | 28451.3 | 5.48 | 0.09 | 7 | 9.71 | 0.04 | 10 | 77.66 | 0.04 | 10 |
| LAB74 | 28452.4 | 5.40 | 0.11 | 6 | 9.61 | 0.45 | 9 | 76.91 | 0.45 | 9 |
| LAB74 | 28453.5 | 5.39 | 0.49 | 6 | 9.64 | 0.47 | 9 | 77.09 | 0.47 | 9 |
| LAB74 | 28454.1 | 5.61 | 0.01 | 10 | 10.61 | 0.00 | 20 | 84.86 | 0.00 | 20 |
| LAB81 | 28531.1 | 5.45 | 0.02 | 7 | 9.77 | 0.06 | 11 | 78.20 | 0.06 | 11 |
| LAB88 | 28192.6 | 5.56 | 0.24 | 9 | 10.15 | 0.32 | 15 | 81.17 | 0.32 | 15 |
| LAB88 | 28193.6 | 5.23 | 0.75 | 3 | 9.62 | 0.56 | 9 | 76.94 | 0.56 | 9 |
| cont | — | 5.10 | — | 0 | 8.82 | — | 0 | 70.58 | — | 0 |
| LAB113 | 28545.3 | 5.04 | 0.13 | 10 | 8.43 | 0.06 | 18 | 67.46 | 0.06 | 18 |
| LAB131 | 28291.1 | 4.77 | 0.24 | 4 | 7.35 | 0.58 | 3 | 58.79 | 0.58 | 3 |
| LAB131 | 28292.3 | 5.14 | 0.04 | 12 | 8.57 | 0.04 | 20 | 68.54 | 0.04 | 20 |
| LAB131 | 28294.2 | 4.83 | 0.64 | 5 | 7.59 | 0.74 | 7 | 60.73 | 0.74 | 7 |
| LAB131 | 28295.3 | 5.74 | 0.04 | 25 | 10.28 | 0.00 | 44 | 82.25 | 0.00 | 44 |
| LAB145 | 28551.1 | 4.67 | 0.49 | 2 | — | | — | — | | — |
| LAB145 | 28551.3 | 4.77 | 0.52 | 4 | 7.24 | 0.90 | 2 | 57.94 | 0.90 | 2 |
| LAB145 | 28553.2 | 5.35 | 0.29 | 17 | 8.79 | 0.37 | 23 | 70.29 | 0.37 | 23 |
| LAB145 | 28553.3 | 5.53 | 0.05 | 21 | 10.21 | 0.04 | 43 | 81.68 | 0.04 | 43 |
| LAB145 | 28555.1 | 5.52 | 0.00 | 21 | 9.92 | 0.00 | 39 | 79.38 | 0.00 | 39 |
| LAB152 | 28471.1 | 4.75 | 0.82 | 4 | 7.84 | 0.74 | 10 | 57.93 | 0.93 | 2 |
| LAB152 | 28472.3 | 4.64 | 0.71 | 1 | — | | — | — | | — |
| LAB152 | 28473.2 | 5.23 | 0.06 | 14 | 8.65 | 0.18 | 22 | 69.23 | 0.18 | 22 |
| LAB152 | 28473.3 | 5.28 | 0.39 | 15 | 9.20 | 0.40 | 29 | 73.63 | 0.40 | 29 |
| LAB153 | 28301.2 | — | | — | 7.29 | 0.85 | 2 | 58.31 | 0.85 | 2 |
| LAB153 | 28302.2 | 4.73 | 0.31 | 3 | — | | — | — | | — |
| LAB153 | 28303.1 | 4.66 | 0.69 | 2 | 7.45 | 0.66 | 5 | 59.56 | 0.66 | 5 |
| LAB153 | 28304.1 | 4.95 | 0.01 | 8 | 8.27 | 0.09 | 16 | 66.20 | 0.09 | 16 |
| LAB153 | 28305.3 | 5.18 | 0.03 | 13 | 8.81 | 0.01 | 24 | 70.50 | 0.01 | 24 |
| LAB169 | 28391.1 | 5.86 | 0.09 | 28 | 11.03 | 0.05 | 55 | 88.23 | 0.05 | 55 |
| LAB169 | 28391.4 | 4.98 | 0.39 | 9 | 8.06 | 0.53 | 13 | 64.49 | 0.53 | 13 |
| LAB169 | 28392.1 | 5.61 | 0.00 | 22 | 10.35 | 0.00 | 45 | 82.78 | 0.00 | 45 |
| LAB169 | 28393.2 | 5.18 | 0.12 | 13 | 9.04 | 0.10 | 27 | 72.29 | 0.10 | 27 |
| LAB169 | 28394.3 | 5.89 | 0.10 | 29 | 11.07 | 0.03 | 55 | 88.57 | 0.03 | 55 |
| LAB181 | 28481.1 | 5.06 | 0.01 | 11 | 8.47 | 0.06 | 19 | 67.72 | 0.06 | 19 |
| LAB181 | 28482.2 | 4.76 | 0.65 | 4 | 7.18 | 0.96 | 1 | 57.41 | 0.96 | 1 |
| LAB181 | 28482.3 | 4.73 | 0.81 | 3 | 7.31 | 0.91 | 3 | 58.48 | 0.91 | 3 |
| LAB181 | 28483.2 | 4.82 | 0.07 | 5 | 7.59 | 0.23 | 7 | 60.74 | 0.23 | 7 |
| LAB181 | 28484.3 | 4.99 | 0.04 | 9 | 7.94 | 0.27 | 11 | 63.50 | 0.27 | 11 |
| LAB187 | 28433.3 | 4.94 | 0.43 | 8 | 8.10 | 0.49 | 14 | 64.78 | 0.49 | 14 |

TABLE 80-continued

Genes showing improved plant biomass production at standard growth conditions

| Gene Name | Event # | Rosette Diameter [cm] | | | Rosette Area [cm 2] | | | Plot Coverage [%] | | |
|---|---|---|---|---|---|---|---|---|---|---|
| | | Ave. | P-Val. | % incr. | Ave. | P-Val. | % incr. | Ave. | P-Val. | % incr. |
| LAB187 | 28434.1 | 5.39 | 0.36 | 18 | 9.77 | 0.40 | 37 | 78.15 | 0.40 | 37 |
| LAB187 | 28435.3 | 4.62 | 0.76 | 1 | — | — | — | — | — | — |
| LAB187 | 28435.4 | 5.05 | 0.13 | 10 | 8.79 | 0.00 | 23 | 70.31 | 0.00 | 23 |
| LAB213 | 28561.2 | 4.80 | 0.24 | 5 | 7.44 | 0.64 | 5 | 59.54 | 0.64 | 5 |
| LAB213 | 28562.6 | 4.89 | 0.45 | 7 | 7.98 | 0.48 | 12 | 63.85 | 0.48 | 12 |
| LAB213 | 28565.2 | 5.06 | 0.27 | 11 | 8.23 | 0.35 | 16 | 65.86 | 0.35 | 16 |
| LAB230 | 28572.2 | 4.63 | 0.78 | 1 | — | — | — | — | — | — |
| LAB230 | 28572.3 | 4.70 | 0.81 | 3 | — | — | — | — | — | — |
| LAB230 | 28574.2 | — | — | — | 7.13 | 0.99 | 0 | 57.03 | 0.99 | 0 |
| LAB247 | 28091.4 | 4.78 | 0.56 | 4 | 7.89 | 0.25 | 11 | 63.10 | 0.25 | 11 |
| LAB247 | 28094.3 | 4.62 | 0.79 | 1 | — | — | — | — | — | — |
| LAB249 | 28604.2 | 5.08 | 0.13 | 11 | 8.99 | 0.03 | 26 | 71.93 | 0.03 | 26 |
| LAB249 | 28605.2 | 5.38 | 0.31 | 18 | 9.28 | 0.35 | 30 | 74.24 | 0.35 | 30 |
| LAB258 | 27441.4 | 4.98 | 0.11 | 9 | 8.03 | 0.24 | 13 | 64.26 | 0.24 | 13 |
| LAB258 | 27442.5 | 5.71 | 0.00 | 25 | 10.27 | 0.00 | 44 | 82.18 | 0.00 | 44 |
| LAB258 | 27444.4 | 5.06 | 0.53 | 11 | 8.02 | 0.64 | 13 | 64.17 | 0.64 | 13 |
| LAB294 | 28402.4 | 4.82 | 0.55 | 5 | 7.43 | 0.73 | 4 | 59.47 | 0.73 | 4 |
| LAB294 | 28404.1 | 4.62 | 0.91 | 1 | — | — | — | — | — | — |
| LAB70 | 28463.1 | 4.67 | 0.83 | 2 | — | — | — | — | — | — |
| LAB74 | 28451.3 | 5.18 | 0.01 | 13 | 9.04 | 0.00 | 27 | 72.34 | 0.00 | 27 |
| LAB74 | 28452.4 | 5.65 | 0.38 | 23 | 10.21 | 0.46 | 43 | 81.66 | 0.46 | 43 |
| LAB74 | 28453.5 | 4.58 | | 0 | — | — | — | — | — | — |
| LAB74 | 28454.1 | 4.93 | 0.02 | 8 | 7.74 | 0.22 | 9 | 61.91 | 0.22 | 9 |
| LAB81 | 28531.1 | 4.63 | 0.77 | 1 | 7.48 | 0.44 | 5 | 59.80 | 0.44 | 5 |
| LAB88 | 28191.3 | 4.66 | 0.55 | 2 | 7.32 | 0.78 | 3 | 58.59 | 0.78 | 3 |
| LAB88 | 28193.2 | 5.19 | 0.46 | 13 | 9.38 | 0.49 | 32 | 75.06 | 0.49 | 32 |
| LAB88 | 28193.6 | 5.10 | 0.12 | 11 | 8.42 | 0.24 | 18 | 67.33 | 0.24 | 18 |
| cont | — | 4.58 | — | 0 | 7.12 | — | 0 | 56.97 | — | 0 |
| LAB108 | 28501.4 | 6.03 | 0.13 | 9 | 12.23 | 0.07 | 21 | 91.96 | 0.46 | 14 |
| LAB108 | 28502.2 | 5.65 | 0.84 | 2 | 10.96 | 0.73 | 8 | 87.66 | 0.73 | 8 |
| LAB108 | 28504.1 | 5.55 | 0.93 | 0 | — | — | — | — | — | — |
| LAB108 | 28505.2 | 5.74 | 0.51 | 4 | 11.02 | 0.43 | 9 | 88.13 | 0.43 | 9 |
| LAB108 | 28505.4 | 5.61 | 0.77 | 2 | 11.13 | 0.51 | 10 | 89.07 | 0.51 | 10 |
| LAB119 | 28412.1 | 5.74 | 0.52 | 4 | 10.55 | 0.67 | 4 | 84.37 | 0.67 | 4 |
| LAB119 | 28413.1 | 5.78 | 0.43 | 5 | 10.98 | 0.46 | 9 | 87.85 | 0.46 | 9 |
| LAB119 | 28414.1 | 5.57 | 0.90 | 1 | 10.23 | 0.91 | 1 | 81.80 | 0.91 | 1 |
| LAB157 | 28142.3 | 5.92 | 0.40 | 7 | 11.98 | 0.17 | 18 | 95.86 | 0.17 | 18 |
| LAB157 | 28144.2 | 5.81 | 0.37 | 5 | 10.44 | 0.55 | 3 | 83.48 | 0.55 | 3 |
| LAB157 | 28146.1 | 5.91 | 0.49 | 7 | 11.94 | 0.49 | 18 | 95.52 | 0.49 | 18 |
| LAB157 | 28146.2 | 5.60 | 0.82 | 1 | 10.34 | 0.89 | 2 | 82.75 | 0.89 | 2 |
| LAB231 | 28581.3 | 5.57 | 0.77 | 1 | — | — | — | — | — | — |
| LAB231 | 28582.1 | 5.63 | 0.59 | 2 | — | — | — | — | — | — |
| LAB231 | 28583.1 | 6.58 | 0.12 | 19 | 14.52 | 0.10 | 43 | 116.17 | 0.10 | 43 |
| LAB231 | 28585.1 | 5.73 | 0.78 | 4 | 11.39 | 0.65 | 13 | 91.08 | 0.65 | 13 |
| LAB238 | 28422.4 | 5.86 | 0.44 | 6 | 11.34 | 0.44 | 12 | 90.73 | 0.44 | 12 |
| LAB238 | 28424.3 | 5.53 | 0.98 | 0 | 10.12 | 1.00 | 0 | 80.98 | 1.00 | 0 |
| LAB238 | 28425.5 | 5.91 | 0.69 | 7 | 11.88 | 0.61 | 17 | 95.03 | 0.61 | 17 |
| LAB240 | 28592.2 | 5.94 | 0.54 | 7 | 11.61 | 0.57 | 15 | 92.91 | 0.57 | 15 |
| LAB240 | 28592.6 | 6.20 | 0.01 | 12 | 12.60 | 0.00 | 24 | 100.79 | 0.00 | 24 |
| LAB240 | 28595.1 | 5.72 | 0.58 | 4 | 10.96 | 0.16 | 8 | 87.68 | 0.16 | 8 |
| LAB240 | 28595.3 | 6.71 | 0.06 | 21 | 13.63 | 0.09 | 35 | 109.04 | 0.09 | 35 |
| LAB242 | 28081.2 | — | — | — | 10.33 | 0.72 | 2 | 82.67 | 0.72 | 2 |
| LAB242 | 28081.3 | 5.53 | 0.99 | 0 | 10.86 | 0.67 | 7 | 86.87 | 0.67 | 7 |
| LAB242 | 28083.1 | 5.75 | 0.62 | 4 | 11.01 | 0.56 | 9 | 88.09 | 0.56 | 9 |
| LAB242 | 28085.1 | 5.68 | 0.65 | 3 | — | — | — | — | — | — |
| LAB242 | 28085.5 | 5.76 | 0.71 | 4 | 10.80 | 0.74 | 7 | 86.39 | 0.74 | 7 |
| LAB267 | 28381.2 | 5.57 | 0.83 | 1 | 10.37 | 0.73 | 2 | 82.98 | 0.73 | 2 |
| LAB267 | 28384.2 | 5.79 | 0.59 | 5 | 10.74 | 0.72 | 6 | 85.91 | 0.72 | 6 |
| LAB269 | 28343.4 | 5.66 | 0.75 | 2 | — | — | — | — | — | — |
| LAB269 | 28345.3 | 5.66 | 0.78 | 3 | 10.34 | 0.90 | 2 | 82.76 | 0.90 | 2 |
| LAB279 | 28351.4 | — | — | — | 10.32 | 0.61 | 2 | 82.60 | 0.61 | 2 |
| LAB279 | 28353.2 | 5.62 | 0.90 | 2 | — | — | — | — | — | — |
| LAB279 | 28354.1 | 6.10 | 0.05 | 10 | 11.30 | 0.22 | 12 | 90.38 | 0.22 | 12 |
| LAB283 | 28363.3 | 5.90 | 0.18 | 7 | 11.93 | 0.00 | 18 | 95.45 | 0.00 | 18 |
| LAB283 | 28364.3 | 5.60 | 0.81 | 1 | 10.22 | 0.93 | 1 | 81.73 | 0.93 | 1 |
| LAB283 | 28365.1 | 6.21 | 0.11 | 12 | 12.05 | 0.21 | 19 | 96.41 | 0.21 | 19 |
| LAB298 | 29245.3 | 5.59 | 0.89 | 1 | 10.58 | 0.81 | 5 | 84.64 | 0.81 | 5 |
| LAB298 | 29245.4 | 5.96 | 0.31 | 8 | 11.06 | 0.63 | 9 | 88.51 | 0.63 | 9 |
| LAB299 | 28061.1 | 5.73 | 0.54 | 4 | 10.59 | 0.57 | 5 | 84.76 | 0.57 | 5 |
| LAB299 | 28063.1 | 5.71 | 0.62 | 3 | 10.83 | 0.61 | 7 | 86.67 | 0.61 | 7 |
| LAB299 | 28063.2 | — | — | — | 10.17 | 0.96 | 0 | 81.34 | 0.96 | 0 |
| LAB299 | 28064.1 | 5.84 | 0.49 | 6 | 11.08 | 0.19 | 9 | 88.63 | 0.19 | 9 |

TABLE 80-continued

Genes showing improved plant biomass production at standard growth conditions

| Gene Name | Event # | Rosette Diameter [cm] | | | Rosette Area [cm 2] | | | Plot Coverage [%] | | |
|---|---|---|---|---|---|---|---|---|---|---|
| | | Ave. | P-Val. | % incr. | Ave. | P-Val. | % incr. | Ave. | P-Val. | % incr. |
| LAB302 | 28822.7 | 5.77 | 0.27 | 4 | 11.03 | 0.39 | 9 | 88.26 | 0.39 | 9 |
| LAB302 | 28823.4 | 5.73 | 0.80 | 4 | 10.76 | 0.81 | 6 | 86.05 | 0.81 | 6 |
| LAB302 | 28825.1 | 5.60 | 0.73 | 1 | — | — | — | — | — | — |
| LAB302 | 28825.2 | 5.89 | 0.01 | 7 | 11.25 | 0.02 | 11 | 90.03 | 0.02 | 11 |
| LAB339 | 27272.7 | 5.57 | 0.70 | 1 | 10.52 | 0.33 | 4 | 84.13 | 0.33 | 4 |
| LAB345 | 28491.1 | 5.77 | 0.74 | 4 | 10.46 | 0.87 | 3 | 83.66 | 0.87 | 3 |
| LAB345 | 28494.1 | 5.74 | 0.65 | 4 | 10.92 | 0.60 | 8 | 87.33 | 0.60 | 8 |
| LAB345 | 28495.1 | 5.73 | 0.60 | 4 | 10.71 | 0.68 | 6 | 85.72 | 0.68 | 6 |
| LAB58 | 28442.1 | 5.85 | 0.44 | 6 | 10.85 | 0.50 | 7 | 81.00 | 0.99 | 0 |
| LAB58 | 28443.2 | 5.52 | 1.00 | 0 | 10.23 | 0.92 | 1 | 81.87 | 0.92 | 1 |
| cont | — | 5.52 | — | 0 | 10.12 | — | 0 | 80.96 | — | 0 |
| LAB133 | 28833.2 | 5.58 | 0.06 | 5 | 10.68 | 0.04 | 10 | 85.42 | 0.03 | 13 |
| LAB162 | 29341.2 | — | — | — | — | — | — | 75.51 | 0.99 | 0 |
| LAB210 | 28332.1 | — | — | — | 9.97 | 0.74 | 2 | 79.79 | 0.48 | 6 |
| LAB293 | 29233.2 | 5.67 | 0.60 | 7 | 11.15 | 0.50 | 14 | 89.19 | 0.43 | 18 |
| LAB297 | 29272.5 | 5.41 | 0.88 | 2 | 10.57 | 0.61 | 9 | 84.56 | 0.51 | 12 |
| LAB297 | 29273.4 | — | — | — | — | — | — | 76.08 | 0.92 | 1 |
| LAB310 | 28182.2 | — | — | — | 10.78 | 0.68 | 11 | 79.89 | 0.69 | 6 |
| LAB310 | 28182.3 | 6.20 | 0.40 | 17 | 13.22 | 0.41 | 36 | 105.72 | 0.38 | 40 |
| LAB318 | 28103.2 | — | — | — | — | — | — | 77.10 | 0.68 | 2 |
| LAB327 | 29221.6 | 5.32 | 0.95 | 0 | 10.03 | 0.83 | 3 | 80.23 | 0.66 | 6 |
| LAB327 | 29224.2 | 5.63 | 0.06 | 6 | 10.11 | 0.78 | 4 | 80.84 | 0.62 | 7 |
| LAB335 | 27311.2 | 5.34 | 0.85 | 1 | — | — | — | — | — | — |
| LAB335 | 27314.1 | 5.46 | 0.25 | 3 | 10.54 | 0.37 | 8 | 84.33 | 0.25 | 12 |
| LAB335 | 27314.2 | 5.89 | 0.20 | 11 | 11.46 | 0.02 | 18 | 91.67 | 0.01 | 22 |
| LAB335 | 27315.4 | 5.99 | 0.22 | 13 | 11.81 | 0.17 | 21 | 94.47 | 0.12 | 25 |
| LAB54 | 28131.1 | 5.55 | 0.67 | 5 | 9.82 | 0.94 | 1 | 78.58 | 0.72 | 4 |
| LAB54 | 28133.1 | 5.81 | 0.31 | 10 | 10.97 | 0.38 | 13 | 87.74 | 0.30 | 16 |
| LAB54 | 28134.1 | 5.66 | 0.16 | 7 | 10.80 | 0.41 | 11 | 86.39 | 0.31 | 15 |
| LAB54 | 28136.1 | 5.81 | 0.25 | 10 | 10.36 | 0.62 | 6 | 82.86 | 0.48 | 10 |
| LAB54 | 28136.2 | 5.75 | 0.60 | 8 | 12.35 | 0.47 | 27 | 98.77 | 0.44 | 31 |
| LAB73 | 30152.1 | 5.43 | 0.79 | 2 | 10.28 | 0.72 | 6 | 82.26 | 0.59 | 9 |
| cont | — | 5.30 | — | 0 | 9.74 | — | 0 | 75.41 | — | 0 |
| LAB102 | 30312.2 | 5.41 | 0.21 | 3 | — | — | — | — | — | — |
| LAB126 | 30201.3 | 5.39 | 0.57 | 2 | — | — | — | — | — | — |
| LAB126 | 30202.3 | 5.42 | 0.65 | 3 | — | — | — | — | — | — |
| LAB126 | 30205.1 | 5.34 | 0.60 | 1 | — | — | — | — | — | — |
| LAB165 | 30231.2 | 5.45 | 0.31 | 3 | 9.29 | 0.78 | 2 | 74.30 | 0.78 | 2 |
| LAB165 | 30232.1 | 5.54 | 0.14 | 5 | 9.64 | 0.17 | 5 | 77.15 | 0.17 | 5 |
| LAB165 | 30233.1 | 5.29 | 0.89 | 0 | — | — | — | — | — | — |
| LAB165 | 30235.1 | 5.51 | 0.43 | 5 | 9.32 | 0.85 | 2 | 74.57 | 0.85 | 2 |
| LAB167 | 27321.2 | 5.89 | 0.16 | 12 | 10.70 | 0.26 | 17 | 85.60 | 0.26 | 17 |
| LAB167 | 27321.3 | 5.66 | 0.46 | 7 | 9.75 | 0.61 | 7 | 77.98 | 0.61 | 7 |
| LAB167 | 27321.4 | 5.82 | 0.31 | 10 | 10.41 | 0.48 | 14 | 83.26 | 0.48 | 14 |
| LAB167 | 27321.6 | 5.73 | 0.18 | 9 | 9.93 | 0.48 | 9 | 79.42 | 0.48 | 9 |
| LAB220 | 30321.4 | 5.73 | 0.33 | 9 | 9.52 | 0.66 | 4 | 76.12 | 0.66 | 4 |
| LAB220 | 30322.2 | 5.39 | 0.68 | 2 | 9.51 | 0.66 | 4 | 76.06 | 0.66 | 4 |
| LAB220 | 30322.3 | 5.40 | 0.60 | 2 | — | — | — | — | — | — |
| LAB220 | 30323.1 | 5.53 | 0.22 | 5 | 9.76 | 0.37 | 7 | 78.04 | 0.37 | 7 |
| LAB220 | 30324.4 | 5.59 | 0.38 | 6 | 9.62 | 0.60 | 5 | 76.99 | 0.60 | 5 |
| LAB241 | 30211.3 | 5.80 | 0.09 | 10 | 10.43 | 0.32 | 14 | 83.43 | 0.32 | 14 |
| LAB241 | 30212.1 | 5.34 | 0.63 | 1 | — | — | — | — | — | — |
| LAB241 | 30212.2 | 5.61 | 0.59 | 6 | 9.71 | 0.76 | 6 | 77.64 | 0.76 | 6 |
| LAB241 | 30213.1 | 5.37 | 0.35 | 2 | — | — | — | — | — | — |
| LAB241 | 30213.4 | 5.49 | 0.74 | 4 | 9.52 | 0.84 | 4 | 76.14 | 0.84 | 4 |
| LAB268 | 30391.4 | 5.90 | 0.00 | 12 | 11.05 | 0.08 | 21 | 88.39 | 0.08 | 21 |
| LAB268 | 30392.1 | 5.44 | 0.31 | 3 | — | — | — | — | — | — |
| LAB268 | 30393.1 | 5.33 | 0.88 | 1 | 9.28 | 0.93 | 1 | 74.21 | 0.93 | 1 |
| LAB268 | 30393.3 | 5.31 | 0.72 | 1 | 9.25 | 0.76 | 1 | 74.01 | 0.76 | 1 |
| LAB268 | 30395.1 | 5.90 | 0.33 | 12 | 10.53 | 0.40 | 15 | 84.24 | 0.40 | 15 |
| LAB280 | 30042.1 | 5.64 | 0.46 | 7 | 10.13 | 0.59 | 11 | 81.04 | 0.59 | 11 |
| LAB280 | 30044.1 | 5.75 | 0.10 | 9 | 11.14 | 0.00 | 22 | 89.10 | 0.00 | 22 |
| LAB280 | 30045.1 | 6.45 | 0.10 | 22 | 12.57 | 0.23 | 37 | 100.54 | 0.23 | 37 |
| LAB289 | 30371.4 | 5.53 | 0.56 | 5 | 9.96 | 0.30 | 9 | 79.69 | 0.30 | 9 |
| LAB289 | 30371.6 | 5.92 | 0.00 | 12 | 11.01 | 0.00 | 20 | 88.05 | 0.00 | 20 |
| LAB289 | 30373.1 | 5.38 | 0.68 | 2 | 9.21 | 0.93 | 1 | 73.68 | 0.93 | 1 |
| LAB289 | 30375.2 | 5.60 | 0.60 | 6 | 9.48 | 0.83 | 4 | 75.88 | 0.83 | 4 |
| LAB311 | 30221.4 | 5.60 | 0.03 | 6 | 10.11 | 0.01 | 11 | 80.85 | 0.01 | 11 |
| LAB311 | 30223.2 | 5.36 | 0.76 | 2 | — | — | — | — | — | — |
| LAB311 | 30223.4 | 5.52 | 0.37 | 5 | 9.69 | 0.22 | 6 | 77.51 | 0.22 | 6 |
| LAB311 | 30224.2 | 5.67 | 0.03 | 7 | 9.45 | 0.71 | 3 | 75.60 | 0.71 | 3 |
| LAB344 | 30092.3 | 5.30 | 0.96 | 1 | — | — | — | — | — | — |

TABLE 80-continued

Genes showing improved plant biomass production at standard growth conditions

| Gene Name | Event # | Rosette Diameter [cm] | | | Rosette Area [cm 2] | | | Plot Coverage [%] | | |
|---|---|---|---|---|---|---|---|---|---|---|
| | | Ave. | P-Val. | % incr. | Ave. | P-Val. | % incr. | Ave. | P-Val. | % incr. |
| LAB344 | 30096.3 | 5.36 | 0.64 | 2 | — | — | — | — | — | — |
| LAB355 | 29281.3 | 5.34 | 0.86 | 1 | — | — | — | — | — | — |
| LAB355 | 29282.1 | 5.35 | 0.70 | 1 | — | — | — | — | — | — |
| LAB355 | 29282.2 | 5.33 | 0.88 | 1 | 9.20 | 0.94 | 1 | 73.62 | 0.94 | 1 |
| LAB355 | 29282.3 | 5.31 | 0.72 | 1 | — | — | — | — | — | — |
| LAB355 | 29283.1 | 5.52 | 0.05 | 5 | 10.21 | 0.15 | 12 | 81.66 | 0.15 | 12 |
| LAB381 | 30352.4 | 5.56 | 0.11 | 5 | 9.58 | 0.40 | 5 | 76.66 | 0.40 | 5 |
| LAB383 | 28114.2 | 5.79 | 0.00 | 10 | 11.08 | 0.00 | 21 | 88.67 | 0.00 | 21 |
| LAB383 | 28115.2 | 5.66 | 0.36 | 7 | 10.55 | 0.28 | 15 | 84.42 | 0.28 | 15 |
| LAB64 | 30271.2 | 5.53 | 0.28 | 5 | 9.91 | 0.49 | 8 | 79.30 | 0.49 | 8 |
| LAB64 | 30272.1 | 5.42 | 0.77 | 3 | 9.31 | 0.87 | 2 | 74.47 | 0.87 | 2 |
| LAB64 | 30273.2 | — | — | — | 9.15 | 1.00 | 0 | 73.16 | 1.00 | 0 |
| LAB64 | 30274.2 | 5.87 | 0.22 | 11 | 10.52 | 0.18 | 15 | 84.19 | 0.18 | 15 |
| LAB64 | 30274.3 | 5.29 | 0.98 | 0 | — | — | — | — | — | — |
| LAB65 | 30301.4 | 5.75 | 0.09 | 9 | 10.52 | 0.00 | 15 | 84.16 | 0.00 | 15 |
| LAB65 | 30302.1 | 5.28 | 0.98 | 0 | 9.28 | 0.89 | 1 | 74.20 | 0.89 | 1 |
| LAB65 | 30304.3 | 6.07 | 0.00 | 15 | 11.65 | 0.00 | 27 | 93.18 | 0.00 | 27 |
| cont | — | 5.28 | — | 0 | 9.14 | — | 0 | 73.15 | — | 0 |
| LAB159 | 30702.4 | 5.76 | 0.27 | 4 | 10.82 | 0.32 | 6 | 86.57 | 0.32 | 6 |
| LAB159 | 30704.3 | 6.05 | 0.00 | 9 | 11.69 | 0.11 | 14 | 93.55 | 0.11 | 14 |
| LAB159 | 30704.4 | 5.66 | 0.36 | 2 | 11.26 | 0.09 | 10 | 90.07 | 0.09 | 10 |
| LAB161 | 30482.1 | 5.71 | 0.40 | 3 | 11.29 | 0.20 | 10 | 84.90 | 0.80 | 4 |
| LAB161 | 30482.2 | 5.99 | 0.34 | 8 | 11.32 | 0.19 | 11 | 90.58 | 0.19 | 11 |
| LAB161 | 30483.1 | 5.61 | 0.74 | 1 | 10.59 | 0.77 | 3 | 84.76 | 0.77 | 3 |
| LAB161 | 30485.1 | 5.98 | 0.20 | 8 | 11.46 | 0.49 | 12 | 91.66 | 0.49 | 12 |
| LAB166 | 30242.1 | 5.70 | 0.68 | 3 | 10.88 | 0.72 | 6 | 87.05 | 0.72 | 6 |
| LAB166 | 30243.1 | 5.54 | 0.98 | 0 | 10.49 | 0.87 | 2 | 83.89 | 0.87 | 2 |
| LAB166 | 30244.3 | — | — | — | 10.52 | 0.68 | 3 | 84.19 | 0.68 | 3 |
| LAB170 | 30712.2 | 5.54 | 0.92 | 0 | 10.28 | 0.94 | 0 | 82.22 | 0.94 | 0 |
| LAB170 | 30715.1 | 5.77 | 0.38 | 4 | 10.73 | 0.47 | 5 | 85.85 | 0.47 | 5 |
| LAB170 | 30715.2 | 5.58 | 0.90 | 1 | 10.31 | 0.95 | 1 | 82.51 | 0.95 | 1 |
| LAB176 | 30142.1 | 5.73 | 0.24 | 4 | 10.92 | 0.55 | 7 | 87.33 | 0.55 | 7 |
| LAB176 | 30143.2 | 5.53 | 0.99 | 0 | — | — | — | — | — | — |
| LAB188 | 30722.2 | 5.65 | 0.39 | 2 | 10.40 | 0.78 | 2 | 83.17 | 0.78 | 2 |
| LAB188 | 30723.3 | 5.79 | 0.09 | 5 | 10.35 | 0.86 | 1 | 82.81 | 0.86 | 1 |
| LAB188 | 30723.7 | 5.58 | 0.75 | 1 | 10.25 | 0.98 | 0 | 82.00 | 0.98 | 0 |
| LAB188 | 30724.2 | 5.76 | 0.25 | 4 | 10.95 | 0.26 | 7 | 87.56 | 0.26 | 7 |
| LAB237 | 30281.4 | 5.99 | 0.29 | 8 | 11.22 | 0.14 | 10 | 89.76 | 0.14 | 10 |
| LAB237 | 30282.1 | 5.75 | 0.14 | 4 | 10.45 | 0.71 | 2 | 83.60 | 0.71 | 2 |
| LAB237 | 30283.2 | 5.69 | 0.53 | 3 | — | — | — | — | — | — |
| LAB259 | 27112.1 | 5.78 | 0.40 | 5 | 11.09 | 0.68 | 8 | 88.69 | 0.68 | 8 |
| LAB259 | 27112.9 | — | — | — | 10.31 | 0.92 | 1 | 82.45 | 0.92 | 1 |
| LAB262 | 30611.4 | 5.74 | 0.48 | 4 | 11.19 | 0.15 | 9 | 89.51 | 0.15 | 9 |
| LAB262 | 30614.2 | 5.63 | 0.91 | 2 | 11.17 | 0.79 | 9 | 89.38 | 0.79 | 9 |
| LAB270 | 30591.2 | 5.83 | 0.43 | 6 | 11.03 | 0.33 | 8 | 88.25 | 0.33 | 8 |
| LAB270 | 30594.1 | 6.06 | 0.24 | 10 | 12.29 | 0.02 | 20 | 98.28 | 0.02 | 20 |
| LAB270 | 30594.3 | 6.30 | 0.00 | 14 | 13.12 | 0.00 | 28 | 104.99 | 0.00 | 28 |
| LAB300 | 30061.2 | 5.64 | 0.67 | 2 | 11.51 | 0.08 | 12 | 92.11 | 0.08 | 12 |
| LAB300 | 30062.2 | 5.83 | 0.48 | 5 | 10.84 | 0.57 | 6 | 86.76 | 0.57 | 6 |
| LAB300 | 30063.1 | 6.24 | 0.00 | 13 | 12.60 | 0.01 | 23 | 100.78 | 0.01 | 23 |
| LAB300 | 30064.3 | 6.18 | 0.02 | 12 | 12.63 | 0.03 | 23 | 101.04 | 0.03 | 23 |
| LAB306 | 30561.2 | 5.59 | 0.83 | 1 | 10.51 | 0.79 | 3 | 84.05 | 0.79 | 3 |
| LAB306 | 30562.2 | 5.72 | 0.31 | 3 | — | — | — | — | — | — |
| LAB306 | 30564.2 | 5.91 | 0.18 | 7 | 11.86 | 0.05 | 16 | 94.86 | 0.05 | 16 |
| LAB306 | 30564.3 | 5.65 | 0.52 | 2 | 10.39 | 0.92 | 1 | 83.12 | 0.92 | 1 |
| LAB323 | 30381.4 | 5.77 | 0.69 | 4 | 10.62 | 0.85 | 4 | 84.98 | 0.85 | 4 |
| LAB323 | 30383.2 | 5.89 | 0.03 | 6 | 11.18 | 0.29 | 9 | 89.46 | 0.29 | 9 |
| LAB347_H0 | 30441.1 | 5.71 | 0.68 | 3 | 11.84 | 0.41 | 16 | 94.75 | 0.41 | 16 |
| LAB347_H0 | 30442.4 | 5.93 | 0.09 | 7 | 11.16 | 0.13 | 9 | 89.32 | 0.13 | 9 |
| LAB347_H0 | 30443.4 | 5.85 | 0.59 | 6 | 11.09 | 0.61 | 8 | 88.71 | 0.61 | 8 |
| LAB347_H0 | 30444.1 | 5.81 | 0.09 | 5 | 11.47 | 0.05 | 12 | 91.72 | 0.05 | 12 |
| LAB347_H0 | 30444.3 | 5.58 | 0.89 | 1 | — | — | — | — | — | — |
| LAB55 | 30022.3 | 5.77 | 0.11 | 4 | 11.51 | 0.18 | 12 | 92.06 | 0.18 | 12 |
| LAB55 | 30023.1 | 5.63 | 0.66 | 2 | 10.88 | 0.47 | 6 | 87.00 | 0.47 | 6 |
| LAB55 | 30025.3 | 5.84 | 0.41 | 6 | 11.46 | 0.50 | 12 | 91.70 | 0.50 | 12 |
| LAB83 | 30191.1 | 6.16 | 0.38 | 11 | 12.38 | 0.09 | 21 | 99.05 | 0.09 | 21 |
| LAB83 | 30194.1 | 5.85 | 0.08 | 6 | 11.18 | 0.31 | 9 | 89.47 | 0.31 | 9 |
| LAB83 | 30194.2 | 5.81 | 0.66 | 5 | 10.93 | 0.57 | 7 | 87.48 | 0.57 | 7 |
| LAB83 | 30194.3 | 5.65 | 0.43 | 2 | 10.75 | 0.37 | 5 | 86.01 | 0.37 | 5 |
| LAB94 | 30681.4 | 5.56 | 0.86 | 1 | 10.39 | 0.80 | 2 | 83.15 | 0.80 | 2 |
| LAB94 | 30681.8 | 6.18 | 0.00 | 12 | 12.35 | 0.06 | 21 | 98.79 | 0.06 | 21 |
| LAB94 | 30682.2 | 5.83 | 0.55 | 5 | 11.45 | 0.51 | 12 | 91.61 | 0.51 | 12 |

TABLE 80-continued

Genes showing improved plant biomass production at standard growth conditions

| Gene Name | Event # | Rosette Diameter [cm] | | | Rosette Area [cm 2] | | | Plot Coverage [%] | | |
|---|---|---|---|---|---|---|---|---|---|---|
| | | Ave. | P-Val. | % incr. | Ave. | P-Val. | % incr. | Ave. | P-Val. | % incr. |
| LAB94 | 30682.3 | 5.56 | 0.94 | 1 | 10.73 | 0.76 | 5 | 85.83 | 0.76 | 5 |
| cont | — | 5.53 | — | 0 | 10.24 | — | 0 | 81.91 | — | 0 |
| LAB138 | 30781.2 | 4.16 | 0.84 | 2 | — | | — | — | | — |
| LAB159 | 30701.6 | 4.19 | 0.83 | 2 | — | | — | — | | — |
| LAB159 | 30702.3 | 4.63 | 0.18 | 13 | 7.19 | 0.24 | 22 | 57.49 | 0.22 | 24 |
| LAB159 | 30702.4 | 4.67 | 0.01 | 14 | 7.04 | 0.06 | 19 | 56.35 | 0.03 | 21 |
| LAB159 | 30704.3 | 4.47 | 0.05 | 9 | 6.47 | 0.36 | 9 | 51.76 | 0.26 | 12 |
| LAB159 | 30704.4 | 4.56 | 0.03 | 11 | 6.97 | 0.11 | 18 | 55.80 | 0.08 | 20 |
| LAB161 | 30482.1 | 4.55 | 0.21 | 11 | 6.72 | 0.39 | 14 | 53.74 | 0.34 | 16 |
| LAB161 | 30482.2 | 4.59 | 0.02 | 12 | 6.59 | 0.19 | 11 | 52.68 | 0.11 | 14 |
| LAB161 | 30483.1 | 4.42 | 0.09 | 8 | 6.33 | 0.49 | 7 | 50.68 | 0.37 | 9 |
| LAB161 | 30485.1 | 4.30 | 0.32 | 5 | 5.97 | 0.92 | 1 | 47.76 | 0.76 | 3 |
| LAB161 | 30486.1 | 4.40 | 0.10 | 7 | 6.50 | 0.28 | 10 | 52.03 | 0.18 | 12 |
| LAB166 | 30242.1 | 4.33 | 0.24 | 6 | 6.23 | 0.53 | 5 | 49.84 | 0.37 | 7 |
| LAB166 | 30243.1 | 4.51 | 0.12 | 10 | 6.75 | 0.24 | 14 | 54.04 | 0.19 | 16 |
| LAB166 | 30244.3 | 4.12 | 0.96 | 1 | 6.16 | 0.76 | 4 | 49.27 | 0.65 | 6 |
| LAB166 | 30245.3 | 4.47 | 0.34 | 9 | 6.93 | 0.34 | 17 | 55.47 | 0.30 | 20 |
| LAB166 | 30245.4 | 4.86 | 0.09 | 19 | 8.00 | 0.00 | 35 | 63.97 | 0.00 | 38 |
| LAB170 | 30712.1 | 4.90 | 0.00 | 20 | 8.13 | 0.00 | 37 | 65.01 | 0.00 | 40 |
| LAB170 | 30712.2 | 4.70 | 0.01 | 15 | 7.03 | 0.05 | 19 | 56.25 | 0.02 | 21 |
| LAB170 | 30713.2 | 4.62 | 0.01 | 13 | 6.75 | 0.13 | 14 | 53.98 | 0.07 | 16 |
| LAB170 | 30715.1 | 4.61 | 0.12 | 13 | 7.08 | 0.29 | 20 | 56.62 | 0.26 | 22 |
| LAB170 | 30715.2 | 4.42 | 0.43 | 8 | 6.44 | 0.59 | 9 | 51.49 | 0.52 | 11 |
| LAB176 | 30141.4 | 4.42 | 0.14 | 8 | 6.65 | 0.21 | 12 | 53.18 | 0.14 | 15 |
| LAB176 | 30142.1 | 4.46 | 0.13 | 9 | 6.75 | 0.11 | 14 | 53.99 | 0.06 | 16 |
| LAB176 | 30143.1 | 4.64 | 0.20 | 13 | 6.65 | 0.30 | 12 | 53.22 | 0.24 | 15 |
| LAB176 | 30143.2 | 4.57 | 0.27 | 11 | 6.97 | 0.21 | 18 | 55.77 | 0.17 | 20 |
| LAB176 | 30144.2 | 4.39 | 0.11 | 7 | 6.80 | 0.13 | 15 | 54.38 | 0.08 | 17 |
| LAB188 | 30724.1 | 4.14 | 0.85 | 1 | 6.05 | 0.84 | 2 | 48.43 | 0.71 | 4 |
| LAB188 | 30724.2 | 4.14 | 0.89 | 1 | 5.99 | 0.94 | 1 | 47.89 | 0.84 | 3 |
| LAB237 | 30281.4 | 4.86 | 0.07 | 19 | 7.88 | 0.06 | 33 | 63.05 | 0.06 | 36 |
| LAB237 | 30282.1 | 4.33 | 0.26 | 6 | 6.55 | 0.21 | 11 | 52.43 | 0.12 | 13 |
| LAB237 | 30283.2 | 4.41 | 0.22 | 7 | 6.81 | 0.09 | 15 | 54.46 | 0.05 | 17 |
| LAB237 | 30284.1 | 4.33 | 0.19 | 6 | 6.22 | 0.53 | 5 | 49.77 | 0.37 | 7 |
| LAB259 | 27112.1 | 4.65 | 0.13 | 13 | 7.05 | 0.09 | 19 | 56.41 | 0.06 | 22 |
| LAB259 | 27112.1 | 4.92 | 0.03 | 20 | 7.59 | 0.05 | 28 | 60.72 | 0.04 | 31 |
| LAB259 | 27112.3 | 4.43 | 0.22 | 8 | 6.55 | 0.25 | 11 | 52.43 | 0.17 | 13 |
| LAB259 | 27112.7 | 4.74 | 0.01 | 16 | 6.93 | 0.10 | 17 | 55.43 | 0.06 | 19 |
| LAB259 | 27112.9 | 4.86 | 0.00 | 19 | 7.84 | 0.00 | 33 | 62.75 | 0.00 | 35 |
| LAB262 | 30612.1 | — | | — | — | | — | 46.87 | 0.93 | 1 |
| LAB262 | 30612.4 | — | | — | — | | — | 47.19 | 0.92 | 2 |
| LAB262 | 30614.1 | 4.48 | 0.23 | 9 | 7.25 | 0.33 | 23 | 58.01 | 0.30 | 25 |
| LAB262 | 30614.2 | 4.47 | 0.27 | 9 | 6.96 | 0.19 | 18 | 55.67 | 0.15 | 20 |
| LAB270 | 30591.2 | 4.20 | 0.80 | 2 | 5.93 | 0.99 | 0 | 47.44 | 0.89 | 2 |
| LAB270 | 30594.1 | 4.53 | 0.09 | 10 | 6.75 | 0.20 | 14 | 54.04 | 0.15 | 16 |
| LAB270 | 30595.2 | 4.49 | 0.30 | 10 | 6.81 | 0.37 | 15 | 54.49 | 0.33 | 17 |
| LAB300 | 30061.2 | 4.49 | 0.12 | 10 | 6.69 | 0.18 | 13 | 53.53 | 0.12 | 15 |
| LAB300 | 30064.3 | 5.00 | 0.21 | 22 | 8.05 | 0.30 | 36 | 64.42 | 0.29 | 39 |
| LAB306 | 30561.2 | 4.39 | 0.16 | 7 | 6.28 | 0.54 | 6 | 50.28 | 0.42 | 8 |
| LAB306 | 30562.2 | 4.44 | 0.08 | 8 | 5.99 | 0.88 | 1 | 47.94 | 0.69 | 3 |
| LAB306 | 30563.2 | 4.18 | 0.76 | 2 | — | | — | 46.75 | 0.94 | 1 |
| LAB306 | 30564.2 | 4.29 | 0.27 | 5 | 6.07 | 0.74 | 3 | 48.57 | 0.55 | 5 |
| LAB306 | 30564.3 | 4.76 | 0.00 | 16 | 7.62 | 0.15 | 29 | 60.95 | 0.14 | 31 |
| LAB323 | 30381.1 | 4.28 | 0.31 | 4 | — | | — | — | | — |
| LAB323 | 30381.4 | 4.37 | 0.13 | 7 | 6.18 | 0.59 | 4 | 49.41 | 0.42 | 6 |
| LAB323 | 30383.1 | 4.17 | 0.82 | 2 | — | | — | — | | — |
| LAB323 | 30383.2 | 4.20 | 0.80 | 3 | 5.99 | 0.93 | 1 | 47.94 | 0.84 | 3 |
| LAB83 | 30191.1 | 4.45 | 0.09 | 9 | 6.83 | 0.16 | 15 | 54.61 | 0.12 | 18 |
| LAB83 | 30191.3 | 4.15 | 0.79 | 1 | 5.94 | 0.96 | 1 | 47.56 | 0.83 | 2 |
| LAB83 | 30194.2 | 4.10 | 0.98 | 0 | — | | — | — | | — |
| LAB83 | 30194.3 | 4.17 | 0.74 | 2 | — | | — | — | | — |
| LAB94 | 30681.8 | 4.63 | 0.16 | 13 | 7.23 | 0.13 | 22 | 57.81 | 0.11 | 25 |
| LAB94 | 30682.2 | 4.21 | 0.55 | 3 | 5.96 | 0.93 | 1 | 47.70 | 0.77 | 3 |
| LAB94 | 30682.3 | 4.24 | 0.49 | 4 | 6.07 | 0.80 | 3 | 48.59 | 0.66 | 5 |
| cont | — | 4.10 | — | 0 | 5.91 | — | 0 | 46.41 | — | 0 |
| LAB182 | 30451.3 | 4.61 | 0.83 | 2 | 7.35 | 0.82 | 3 | 58.82 | 0.82 | 3 |
| LAB182 | 30453.4 | 4.56 | 0.92 | 1 | 7.33 | 0.79 | 3 | 58.64 | 0.79 | 3 |
| LAB182 | 30454.2 | 4.86 | 0.62 | 7 | 8.12 | 0.54 | 14 | 64.94 | 0.54 | 14 |
| LAB191 | 28152.1 | 4.61 | 0.87 | 2 | 7.14 | 0.98 | 1 | 57.16 | 0.98 | 1 |
| LAB191 | 28153.2 | 4.79 | 0.42 | 6 | 7.60 | 0.64 | 7 | 60.82 | 0.64 | 7 |
| LAB191 | 28156.2 | 5.10 | 0.13 | 13 | 8.39 | 0.03 | 18 | 67.12 | 0.03 | 18 |
| LAB221 | 30122.2 | 4.92 | 0.04 | 9 | 8.19 | 0.12 | 15 | 65.51 | 0.12 | 15 |

TABLE 80-continued

Genes showing improved plant biomass production at standard growth conditions

| Gene Name | Event # | Rosette Diameter [cm] | | | Rosette Area [cm 2] | | | Plot Coverage [%] | | |
|---|---|---|---|---|---|---|---|---|---|---|
| | | Ave. | P-Val. | % incr. | Ave. | P-Val. | % incr. | Ave. | P-Val. | % incr. |
| LAB221 | 30124.4 | 4.92 | 0.56 | 9 | 8.07 | 0.57 | 14 | 64.59 | 0.57 | 14 |
| LAB221 | 30125.2 | 4.97 | 0.57 | 10 | 8.54 | 0.54 | 20 | 68.34 | 0.54 | 20 |
| LAB222 | 30472.2 | 4.80 | 0.18 | 6 | 7.62 | 0.46 | 7 | 60.92 | 0.46 | 7 |
| LAB222 | 30473.1 | 5.00 | 0.54 | 10 | 8.47 | 0.45 | 19 | 67.73 | 0.45 | 19 |
| LAB222 | 30474.1 | 5.09 | 0.47 | 12 | 8.87 | 0.46 | 25 | 70.98 | 0.46 | 25 |
| LAB222 | 30476.1 | 4.77 | 0.15 | 5 | 7.97 | 0.14 | 12 | 63.78 | 0.14 | 12 |
| LAB222 | 30476.2 | 4.59 | 0.72 | 1 | 7.16 | 0.92 | 1 | 57.28 | 0.92 | 1 |
| LAB225 | 30492.2 | 4.82 | 0.09 | 6 | 7.86 | 0.16 | 11 | 62.87 | 0.16 | 11 |
| LAB225 | 30493.1 | 5.09 | 0.28 | 12 | 8.97 | 0.36 | 26 | 71.77 | 0.36 | 26 |
| LAB225 | 30493.2 | 4.86 | 0.46 | 7 | 8.24 | 0.44 | 16 | 65.88 | 0.44 | 16 |
| LAB232 | 30462.4 | 5.13 | 0.01 | 13 | 9.48 | 0.00 | 33 | 75.84 | 0.00 | 33 |
| LAB260 | 30071.4 | 4.99 | 0.59 | 10 | 8.15 | 0.70 | 15 | 65.23 | 0.70 | 15 |
| LAB260 | 30073.2 | 4.80 | 0.32 | 6 | 7.85 | 0.38 | 10 | 62.80 | 0.38 | 10 |
| LAB260 | 30073.4 | 4.87 | 0.07 | 8 | 8.06 | 0.09 | 13 | 64.45 | 0.09 | 13 |
| LAB260 | 30074.3 | 4.58 | 0.87 | 1 | 7.15 | 0.95 | 1 | 57.23 | 0.95 | 1 |
| LAB264 | 30131.1 | 4.60 | 0.88 | 2 | 7.44 | 0.83 | 5 | 59.54 | 0.83 | 5 |
| LAB264 | 30133.2 | 5.01 | 0.17 | 11 | 8.33 | 0.09 | 17 | 66.64 | 0.09 | 17 |
| LAB264 | 30134.4 | 4.83 | 0.16 | 7 | 7.99 | 0.25 | 12 | 63.89 | 0.25 | 12 |
| LAB264 | 30135.2 | 4.64 | 0.69 | 3 | 7.63 | 0.43 | 7 | 61.01 | 0.43 | 7 |
| LAB265 | 30733.4 | 4.57 | 0.91 | 1 | 7.17 | 0.94 | 1 | 57.36 | 0.94 | 1 |
| LAB307 | 30763.3 | 4.86 | 0.09 | 7 | 7.83 | 0.22 | 10 | 62.64 | 0.22 | 10 |
| LAB308 | 30931.4 | 4.92 | 0.03 | 9 | 8.43 | 0.07 | 19 | 67.44 | 0.07 | 19 |
| LAB308 | 30932.3 | 4.91 | 0.53 | 8 | 8.09 | 0.62 | 14 | 64.70 | 0.62 | 14 |
| LAB319 | 30775.4 | 4.96 | 0.28 | 10 | 8.09 | 0.37 | 14 | 64.75 | 0.37 | 14 |
| LAB320 | 30601.2 | 4.88 | 0.55 | 8 | 7.68 | 0.49 | 8 | 61.45 | 0.49 | 8 |
| LAB320 | 30602.2 | 4.77 | 0.59 | 5 | 8.01 | 0.56 | 13 | 64.08 | 0.56 | 13 |
| LAB343 | 30622.2 | 4.70 | 0.66 | 4 | 7.31 | 0.86 | 3 | 58.47 | 0.86 | 3 |
| LAB343 | 30622.4 | 4.64 | 0.58 | 3 | 7.32 | 0.70 | 3 | 58.55 | 0.70 | 3 |
| LAB343 | 30623.3 | 4.64 | 0.83 | 2 | 7.55 | 0.81 | 6 | 60.41 | 0.81 | 6 |
| LAB353 | 30553.1 | 4.56 | 0.85 | 1 | 7.24 | 0.82 | 2 | 57.91 | 0.82 | 2 |
| LAB353 | 30554.2 | 4.69 | 0.32 | 4 | 7.66 | 0.28 | 8 | 61.31 | 0.28 | 8 |
| LAB353 | 30554.3 | 5.05 | 0.24 | 11 | 8.90 | 0.26 | 25 | 71.19 | 0.26 | 25 |
| cont | — | 4.53 | — | 0 | 7.11 | — | 0 | 56.85 | — | 0 |
| LAB182 | 30451.3 | 6.02 | 0.04 | 4 | 12.51 | 0.03 | 8 | 100.09 | 0.03 | 8 |
| LAB182 | 30453.4 | 6.01 | 0.42 | 3 | 11.89 | 0.52 | 3 | 95.08 | 0.52 | 3 |
| LAB191 | 28156.4 | 6.09 | 0.36 | 5 | 12.30 | 0.09 | 6 | 98.41 | 0.09 | 6 |
| LAB221 | 30122.2 | 5.81 | 1.00 | 0 | — | — | — | — | — | — |
| LAB221 | 30124.3 | 5.83 | 0.94 | 0 | — | — | — | — | — | — |
| LAB221 | 30124.4 | 5.90 | 0.84 | 2 | — | — | — | — | — | — |
| LAB222 | 30472.1 | 6.10 | 0.54 | 5 | 12.33 | 0.70 | 6 | 98.62 | 0.70 | 6 |
| LAB222 | 30472.2 | 6.00 | 0.51 | 3 | 12.04 | 0.79 | 4 | 96.32 | 0.79 | 4 |
| LAB222 | 30473.1 | 5.94 | 0.70 | 2 | 12.24 | 0.50 | 6 | 97.89 | 0.50 | 6 |
| LAB222 | 30476.1 | 6.24 | 0.44 | 7 | 12.03 | 0.38 | 4 | 96.22 | 0.38 | 4 |
| LAB222 | 30476.2 | 6.39 | 0.00 | 10 | 13.12 | 0.00 | 13 | 104.95 | 0.00 | 13 |
| LAB225 | 30491.4 | 6.18 | 0.16 | 6 | 13.62 | 0.02 | 18 | 109.00 | 0.02 | 18 |
| LAB225 | 30492.2 | 5.95 | 0.72 | 2 | 11.88 | 0.83 | 3 | 95.03 | 0.83 | 3 |
| LAB225 | 30493.2 | 6.25 | 0.00 | 8 | 12.86 | 0.27 | 11 | 102.88 | 0.27 | 11 |
| LAB232 | 30462.4 | 6.37 | 0.12 | 10 | 13.42 | 0.01 | 16 | 107.34 | 0.01 | 16 |
| LAB260 | 30071.4 | 6.28 | 0.00 | 8 | 12.89 | 0.11 | 11 | 103.09 | 0.11 | 11 |
| LAB260 | 30072.2 | 5.83 | 0.95 | 0 | — | — | — | — | — | — |
| LAB260 | 30073.4 | 6.28 | 0.00 | 8 | 12.93 | 0.00 | 12 | 103.46 | 0.00 | 12 |
| LAB260 | 30074.3 | 5.89 | 0.79 | 1 | — | — | — | — | — | — |
| LAB264 | 30131.1 | — | — | — | 11.83 | 0.84 | 2 | 94.68 | 0.84 | 2 |
| LAB264 | 30131.2 | 5.81 | 0.99 | 0 | — | — | — | — | — | — |
| LAB264 | 30133.2 | 6.21 | 0.34 | 7 | 12.62 | 0.64 | 9 | 100.92 | 0.64 | 9 |
| LAB264 | 30135.2 | 6.36 | 0.45 | 9 | 14.29 | 0.26 | 23 | 114.32 | 0.26 | 23 |
| LAB265 | 30731.3 | 6.10 | 0.01 | 5 | 12.39 | 0.20 | 7 | 99.12 | 0.20 | 7 |
| LAB265 | 30734.4 | 5.84 | 0.82 | 1 | — | — | — | — | — | — |
| LAB290_H0 | 30662.3 | 5.82 | 0.98 | 0 | — | — | — | — | — | — |
| LAB290_H0 | 30663.3 | — | — | — | 11.72 | 0.91 | 1 | 93.77 | 0.91 | 1 |
| LAB290_H0 | 30663.7 | 6.44 | 0.00 | 11 | 13.42 | 0.00 | 16 | 107.33 | 0.00 | 16 |
| LAB308 | 30931.4 | 5.90 | 0.79 | 2 | 12.24 | 0.79 | 6 | 97.89 | 0.79 | 6 |
| LAB308 | 30932.3 | 6.30 | 0.28 | 8 | 13.37 | 0.01 | 15 | 106.98 | 0.01 | 15 |
| LAB319 | 30771.5 | 6.26 | 0.33 | 8 | 12.80 | 0.42 | 11 | 102.44 | 0.42 | 11 |
| LAB319 | 30774.1 | 5.90 | 0.80 | 2 | 11.87 | 0.82 | 2 | 94.93 | 0.82 | 2 |
| LAB319 | 30775.1 | — | — | — | 11.85 | 0.52 | 2 | 94.78 | 0.52 | 2 |
| LAB319 | 30775.4 | 6.15 | 0.02 | 6 | 12.39 | 0.11 | 7 | 99.16 | 0.11 | 7 |
| LAB320 | 30601.3 | 6.09 | 0.11 | 5 | 12.64 | 0.41 | 9 | 101.08 | 0.41 | 9 |
| LAB320 | 30601.4 | 5.85 | 0.83 | 1 | 12.05 | 0.77 | 4 | 96.37 | 0.77 | 4 |
| LAB320 | 30602.2 | 5.84 | 0.77 | 0 | 12.26 | 0.26 | 6 | 98.08 | 0.26 | 6 |

TABLE 80-continued

Genes showing improved plant biomass production at standard growth conditions

| Gene Name | Event # | Rosette Diameter [cm] | | | Rosette Area [cm 2] | | | Plot Coverage [%] | | |
|---|---|---|---|---|---|---|---|---|---|---|
| | | Ave. | P-Val. | % incr. | Ave. | P-Val. | % incr. | Ave. | P-Val. | % incr. |
| LAB320 | 30603.1 | 5.93 | 0.34 | 2 | 11.95 | 0.48 | 3 | 95.62 | 0.48 | 3 |
| LAB320 | 30605.1 | 6.11 | 0.27 | 5 | 12.29 | 0.64 | 6 | 92.77 | 1.00 | 0 |
| LAB343 | 30623.3 | 5.82 | 0.98 | 0 | — | — | — | — | — | — |
| LAB343 | 30623.4 | 6.08 | 0.57 | 5 | 11.65 | 0.95 | 1 | 93.23 | 0.95 | 1 |
| LAB348 | 30506.2 | — | — | — | 11.86 | 0.73 | 2 | 94.89 | 0.73 | 2 |
| LAB353 | 30554.3 | 5.96 | 0.79 | 3 | 11.77 | 0.90 | 2 | 94.17 | 0.90 | 2 |
| cont | — | 5.81 | — | 0 | 11.59 | — | 0 | 92.70 | — | 0 |
| LAB108 | 28504.1 | 5.33 | 0.90 | 0 | — | — | — | — | — | — |
| LAB108 | 28505.2 | — | — | — | 9.01 | 0.64 | 5 | 72.04 | 0.64 | 5 |
| LAB108 | 28505.4 | 5.38 | 0.41 | 1 | 8.84 | 0.55 | 3 | 70.71 | 0.55 | 3 |
| LAB119 | 28411.1 | 5.46 | 0.22 | 3 | — | — | — | — | — | — |
| LAB157 | 28142.3 | 5.36 | 0.88 | 1 | 9.18 | 0.47 | 7 | 73.45 | 0.47 | 7 |
| LAB157 | 28144.2 | 5.34 | 0.73 | 0 | — | — | — | — | — | — |
| LAB157 | 28146.1 | 5.32 | 0.99 | 0 | 8.64 | 0.96 | 1 | — | — | — |
| LAB231 | 28582.1 | 5.55 | 0.72 | 4 | 8.82 | 0.87 | 3 | 70.55 | 0.87 | 3 |
| LAB231 | 28583.1 | — | — | — | 8.66 | 0.97 | 1 | 69.25 | 0.97 | 1 |
| LAB231 | 28585.1 | 5.43 | 0.77 | 2 | — | — | — | — | — | — |
| LAB231 | 28585.3 | 5.63 | 0.25 | 6 | 9.29 | 0.02 | 8 | 74.35 | 0.02 | 8 |
| LAB238 | 28425.5 | 5.42 | 0.48 | 2 | 8.94 | 0.74 | 4 | 71.52 | 0.74 | 4 |
| LAB240 | 28592.2 | — | — | — | 8.76 | 0.63 | 2 | 70.04 | 0.63 | 2 |
| LAB242 | 28081.2 | 5.36 | 0.51 | 1 | — | — | — | — | — | — |
| LAB267 | 28383.2 | 5.42 | 0.68 | 2 | 8.77 | 0.84 | 2 | 70.20 | 0.84 | 2 |
| LAB269 | 28343.4 | 5.57 | 0.46 | 5 | 9.12 | 0.50 | 6 | 72.98 | 0.50 | 6 |
| LAB279 | 28354.1 | 5.47 | 0.53 | 3 | — | — | — | — | — | — |
| LAB283 | 28363.3 | 5.43 | 0.90 | 2 | 8.85 | 0.93 | 3 | 70.84 | 0.93 | 3 |
| LAB283 | 28365.1 | 5.46 | 0.41 | 3 | 8.73 | 0.60 | 2 | 69.83 | 0.60 | 2 |
| LAB299 | 28061.1 | 5.44 | 0.87 | 2 | 8.72 | 0.95 | 2 | 69.79 | 0.95 | 2 |
| LAB299 | 28066.1 | 5.36 | 0.88 | 1 | 8.95 | 0.73 | 4 | 71.62 | 0.73 | 4 |
| LAB339 | 27272.4 | 5.60 | 0.45 | 5 | 8.87 | 0.70 | 3 | 70.94 | 0.70 | 3 |
| LAB58 | 28443.4 | 5.39 | 0.79 | 1 | 8.94 | 0.76 | 4 | 71.50 | 0.76 | 4 |
| cont | — | 5.31 | — | 0 | 8.57 | — | 0 | 68.58 | — | 0 |
| LAB129 | 30825.5 | — | — | — | — | — | — | 91.61 | 0.81 | 4 |
| LAB130 | 30544.2 | 6.21 | 0.11 | 3 | 12.99 | 0.01 | 9 | 103.91 | 0.03 | 18 |
| LAB130 | 30545.1 | 6.10 | 0.45 | 2 | 12.37 | 0.31 | 4 | 98.94 | 0.14 | 12 |
| LAB130 | 30545.2 | — | — | — | 11.97 | 0.91 | 1 | 95.75 | 0.42 | 8 |
| LAB163 | 30831.3 | 6.20 | 0.52 | 3 | 12.69 | 0.42 | 7 | 101.53 | 0.18 | 15 |
| LAB163 | 30833.1 | 6.39 | 0.05 | 6 | 12.32 | 0.24 | 4 | 98.52 | 0.14 | 11 |
| LAB163 | 30833.2 | 6.33 | 0.46 | 5 | 13.69 | 0.53 | 15 | — | — | — |
| LAB163 | 30834.2 | 6.78 | 0.05 | 13 | 14.08 | 0.22 | 19 | 112.65 | 0.09 | 27 |
| LAB164 | 30522.4 | 6.05 | 0.78 | 1 | 12.30 | 0.56 | 4 | 98.44 | 0.22 | 11 |
| LAB164 | 30523.3 | — | — | — | — | — | — | 92.86 | 0.61 | 5 |
| LAB164 | 30524.1 | 6.42 | 0.08 | 7 | 14.26 | 0.14 | 20 | 114.11 | 0.04 | 29 |
| LAB164 | 30525.2 | 6.14 | 0.31 | 2 | 13.07 | 0.12 | 10 | 104.54 | 0.05 | 18 |
| LAB164 | 30525.3 | 6.14 | 0.42 | 2 | 12.12 | 0.80 | 2 | 96.97 | 0.39 | 10 |
| LAB171 | 30841.3 | 6.25 | 0.30 | 4 | 13.21 | 0.06 | 11 | 105.66 | 0.03 | 20 |
| LAB171 | 30841.4 | 6.18 | 0.58 | 3 | 13.00 | 0.41 | 10 | 103.99 | 0.21 | 18 |
| LAB171 | 30842.3 | 6.62 | 0.27 | 10 | 14.89 | 0.23 | 26 | 119.14 | 0.13 | 35 |
| LAB171 | 30843.2 | 6.20 | 0.20 | 3 | 12.60 | 0.53 | 6 | 100.77 | 0.26 | 14 |
| LAB172 | 30852.3 | — | — | — | — | — | — | 88.52 | 0.99 | 0 |
| LAB175 | 30513.4 | 6.06 | 0.65 | 1 | — | — | — | — | — | — |
| LAB175 | 30514.3 | — | — | — | 12.05 | 0.64 | 2 | 96.42 | 0.23 | 9 |
| LAB175 | 30514.4 | — | — | — | — | — | — | 91.27 | 0.65 | 3 |
| LAB204 | 30863.1 | 6.09 | 0.61 | 1 | 12.63 | 0.41 | 6 | — | — | — |
| LAB204 | 30864.1 | — | — | — | 12.04 | 0.89 | 1 | 96.31 | 0.50 | 9 |
| LAB261 | 31073.1 | 6.19 | 0.51 | 3 | 12.65 | 0.08 | 7 | — | — | — |
| LAB261 | 31074.4 | — | — | — | — | — | — | 92.22 | 0.72 | 4 |
| LAB261 | 31075.1 | — | — | — | — | — | — | 89.37 | 0.90 | 1 |
| LAB263 | 30891.6 | 6.16 | 0.43 | 2 | 12.96 | 0.34 | 9 | — | — | — |
| LAB263 | 30892.2 | 6.28 | 0.10 | 4 | 13.67 | 0.01 | 15 | 109.39 | 0.01 | 24 |
| LAB263 | 30892.3 | 6.08 | 0.57 | 1 | 12.77 | 0.21 | 8 | 102.18 | 0.08 | 16 |
| LAB263 | 30892.4 | 6.23 | 0.13 | 4 | 12.42 | 0.15 | 5 | 99.37 | 0.11 | 12 |
| LAB271 | 30901.3 | 6.19 | 0.48 | 3 | 12.44 | 0.53 | 5 | 99.50 | 0.23 | 13 |
| LAB272 | 31125.4 | — | — | — | — | — | — | 93.95 | 0.40 | 6 |
| LAB272 | 31125.5 | 6.33 | 0.21 | 5 | 12.50 | 0.57 | 5 | 100.01 | 0.28 | 13 |
| LAB284 | 30911.3 | 6.75 | 0.33 | 12 | 15.23 | 0.20 | 28 | 93.84 | 0.91 | 6 |
| LAB284 | 30912.2 | 6.03 | 0.98 | 0 | 12.10 | 0.85 | 2 | 96.80 | 0.46 | 9 |
| LAB284 | 30913.1 | 6.23 | 0.43 | 4 | 13.31 | 0.06 | 12 | 106.44 | 0.03 | 20 |
| LAB284 | 30913.3 | 6.03 | 0.95 | 0 | 11.88 | 0.99 | 0 | 95.07 | 0.63 | 8 |
| LAB284 | 30914.3 | 6.41 | 0.48 | 7 | 13.31 | 0.49 | 12 | 106.45 | 0.32 | 20 |
| LAB286 | 30921.1 | 6.05 | 0.85 | 1 | — | — | — | 91.31 | 0.77 | 3 |
| LAB286 | 30922.1 | 7.19 | 0.00 | 20 | 16.49 | 0.00 | 39 | 131.89 | 0.00 | 49 |
| LAB286 | 30922.4 | 6.42 | 0.52 | 7 | 13.34 | 0.37 | 12 | 106.75 | 0.20 | 21 |

TABLE 80-continued

Genes showing improved plant biomass production at standard growth conditions

| Gene Name | Event # | Rosette Diameter [cm] | | | Rosette Area [cm 2] | | | Plot Coverage [%] | | |
|---|---|---|---|---|---|---|---|---|---|---|
| | | Ave. | P-Val. | % incr. | Ave. | P-Val. | % incr. | Ave. | P-Val. | % incr. |
| LAB286 | 30923.3 | 6.48 | 0.05 | 8 | 12.62 | 0.41 | 6 | 100.99 | 0.17 | 14 |
| LAB329 | 30102.2 | — | — | — | — | — | — | 90.18 | 0.85 | 2 |
| LAB329 | 30103.1 | 6.60 | 0.01 | 10 | 13.70 | 0.20 | 15 | 109.57 | 0.07 | 24 |
| LAB329 | 30103.2 | 6.06 | 0.88 | 1 | 12.45 | 0.68 | 5 | 99.61 | 0.39 | 13 |
| LAB329 | 30104.1 | 6.34 | 0.32 | 5 | 13.15 | 0.02 | 11 | 105.22 | 0.03 | 19 |
| LAB329 | 30104.2 | 6.47 | 0.00 | 8 | 13.25 | 0.11 | 12 | 106.04 | 0.04 | 20 |
| cont | — | 6.01 | — | 0 | 11.86 | — | 0 | 88.41 | — | 0 |
| LAB107 | 30533.4 | 5.45 | 0.62 | 6 | 9.34 | 0.57 | 14 | 74.71 | 0.57 | 14 |
| LAB107 | 30535.2 | 5.22 | 0.48 | 2 | 8.51 | 0.43 | 4 | 68.10 | 0.43 | 4 |
| LAB121 | 30801.4 | 5.43 | 0.08 | 6 | 9.23 | 0.02 | 13 | 73.85 | 0.02 | 13 |
| LAB121 | 30802.1 | 5.23 | 0.71 | 2 | 8.31 | 0.83 | 1 | 66.48 | 0.83 | 1 |
| LAB121 | 30802.2 | 5.32 | 0.15 | 4 | 8.97 | 0.05 | 9 | 71.75 | 0.05 | 9 |
| LAB121 | 30804.1 | 5.37 | 0.13 | 5 | 9.01 | 0.07 | 10 | 72.06 | 0.07 | 10 |
| LAB129 | 30824.2 | 5.36 | 0.71 | 4 | 8.87 | 0.70 | 8 | 70.97 | 0.70 | 8 |
| LAB129 | 30825.1 | 5.43 | 0.43 | 6 | 9.59 | 0.37 | 17 | 76.71 | 0.37 | 17 |
| LAB130 | 30544.2 | 5.54 | 0.27 | 8 | 9.38 | 0.16 | 14 | 70.56 | 0.65 | 8 |
| LAB130 | 30545.1 | 5.71 | 0.20 | 11 | 9.81 | 0.05 | 20 | 78.50 | 0.05 | 20 |
| LAB130 | 30545.2 | — | — | — | 8.53 | 0.59 | 4 | 68.22 | 0.59 | 4 |
| LAB163 | 30831.3 | 5.19 | 0.70 | 1 | — | — | — | — | — | — |
| LAB163 | 30833.2 | 5.21 | 0.77 | 2 | 8.95 | 0.18 | 9 | 71.58 | 0.18 | 9 |
| LAB163 | 30834.2 | 5.24 | 0.56 | 2 | — | — | — | — | — | — |
| LAB164 | 30524.1 | 5.36 | 0.09 | 4 | 8.98 | 0.05 | 9 | 71.84 | 0.05 | 9 |
| LAB164 | 30525.2 | 5.48 | 0.02 | 7 | 9.71 | 0.16 | 18 | 77.67 | 0.16 | 18 |
| LAB171 | 30841.3 | 5.22 | 0.50 | 2 | 8.32 | 0.84 | 1 | 66.52 | 0.84 | 1 |
| LAB171 | 30842.4 | 5.56 | 0.05 | 8 | 9.49 | 0.32 | 16 | 75.89 | 0.32 | 16 |
| LAB171 | 30843.2 | 5.41 | 0.28 | 5 | 9.24 | 0.03 | 13 | 73.88 | 0.03 | 13 |
| LAB171 | 30845.1 | 5.59 | 0.01 | 9 | 10.00 | 0.22 | 22 | 80.00 | 0.22 | 22 |
| LAB172 | 30852.3 | 5.14 | 0.95 | 0 | — | — | — | — | — | — |
| LAB172 | 30853.4 | 5.17 | 0.74 | 1 | — | — | — | — | — | — |
| LAB175 | 30514.4 | 5.22 | 0.56 | 2 | 8.55 | 0.45 | 4 | 68.40 | 0.45 | 4 |
| LAB204 | 30862.3 | 5.23 | 0.76 | 2 | 8.58 | 0.73 | 5 | 68.64 | 0.73 | 5 |
| LAB204 | 30863.1 | 5.42 | 0.13 | 6 | 9.38 | 0.38 | 14 | 75.04 | 0.38 | 14 |
| LAB204 | 30865.4 | 5.34 | 0.37 | 4 | 8.42 | 0.82 | 3 | 67.34 | 0.82 | 3 |
| LAB261 | 31074.2 | 5.30 | 0.19 | 3 | 8.92 | 0.06 | 9 | 71.33 | 0.06 | 9 |
| LAB261 | 31074.4 | 5.41 | 0.05 | 5 | 9.18 | 0.02 | 12 | 73.45 | 0.02 | 12 |
| LAB261 | 31075.1 | 5.69 | 0.31 | 11 | 9.77 | 0.39 | 19 | 78.18 | 0.39 | 19 |
| LAB261 | 31075.3 | 5.53 | 0.01 | 8 | 9.60 | 0.00 | 17 | 76.77 | 0.00 | 17 |
| LAB263 | 30891.6 | 5.68 | 0.10 | 11 | 9.60 | 0.39 | 17 | 76.83 | 0.39 | 17 |
| LAB263 | 30892.2 | 5.63 | 0.10 | 10 | 9.82 | 0.00 | 20 | 78.58 | 0.00 | 20 |
| LAB263 | 30892.3 | 5.72 | 0.00 | 12 | 10.12 | 0.00 | 23 | 80.92 | 0.00 | 23 |
| LAB263 | 30892.4 | 5.61 | 0.07 | 9 | 9.50 | 0.01 | 16 | 76.02 | 0.01 | 16 |
| LAB263 | 30893.3 | 5.47 | 0.16 | 7 | 9.31 | 0.10 | 13 | 74.45 | 0.10 | 13 |
| LAB271 | 30905.6 | — | — | — | 8.28 | 0.84 | 1 | 66.25 | 0.84 | 1 |
| LAB271 | 30905.7 | — | — | — | 8.55 | 0.65 | 4 | 68.40 | 0.65 | 4 |
| LAB272 | 31121.1 | 5.77 | 0.02 | 13 | 10.63 | 0.00 | 30 | 85.01 | 0.00 | 30 |
| LAB272 | 31123.6 | 5.25 | 0.36 | 2 | 8.66 | 0.33 | 6 | 69.29 | 0.33 | 6 |
| LAB272 | 31125.4 | 5.32 | 0.20 | 4 | 9.19 | 0.27 | 12 | 73.51 | 0.27 | 12 |
| LAB286 | 30922.1 | 5.16 | 0.89 | 1 | — | — | — | — | — | — |
| LAB286 | 30923.3 | 5.50 | 0.14 | 7 | 9.53 | 0.23 | 16 | 76.22 | 0.23 | 16 |
| LAB286 | 30924.3 | 5.44 | 0.17 | 6 | 9.34 | 0.16 | 14 | 74.75 | 0.16 | 14 |
| LAB329 | 30102.3 | — | — | — | 8.25 | 0.92 | 1 | 65.97 | 0.92 | 1 |
| cont | — | 5.13 | — | 0 | 8.20 | — | 0 | 65.61 | — | 0 |
| LAB312 | 30943.1 | 5.82 | 0.94 | 1 | — | — | — | — | — | — |
| LAB342 | 31705.6 | 6.15 | | 7 | 12.95 | | 10 | 103.56 | | 10 |
| LAB56 | 31451.3 | 5.85 | 0.87 | 2 | 12.03 | 0.91 | 3 | 96.20 | 0.91 | 3 |
| LAB56 | 31455.1 | 6.18 | | 7 | 13.23 | | 13 | 105.81 | | 13 |
| LAB97 | 31306.4 | 5.83 | 0.52 | 1 | 12.22 | 0.38 | 4 | 97.73 | 0.38 | 4 |
| cont | — | 5.76 | — | 0 | 11.73 | — | 0 | 93.81 | — | 0 |

Table 80.
"CONT."—Control;
"Ave."—Average;
"% incr." = % increment;
"p-val."—p-value.

TABLE 81

Genes showing improved photosynthetic capacity at standard growth conditions

| Gene Name | Event # | Leaf Blade Area [cm2] Ave. | P-Val. | % incr. | Leaf Petiole Length Ave. | P-Val. | % incr. |
|---|---|---|---|---|---|---|---|
| LAB113 | 28543.1 | — | | — | 0.96 | 0.65 | 4 |
| LAB113 | 28543.2 | — | | — | 0.97 | 0.22 | 5 |
| LAB113 | 28543.5 | — | | — | 0.99 | 0.16 | 7 |
| LAB113 | 28545.2 | — | | — | 0.96 | 0.42 | 3 |
| LAB113 | 28545.3 | 1.20 | 0.90 | 1 | 0.94 | 0.84 | 2 |
| LAB131 | 28291.1 | 1.36 | 0.00 | 15 | 1.03 | 0.05 | 11 |
| LAB131 | 28292.3 | 1.28 | 0.09 | 8 | 1.09 | 0.08 | 18 |
| LAB131 | 28294.2 | 1.34 | 0.11 | 13 | 0.96 | 0.74 | 4 |
| LAB131 | 28295.3 | 1.34 | 0.01 | 13 | 1.02 | 0.03 | 11 |
| LAB145 | 28551.1 | 1.34 | 0.62 | 13 | 1.13 | 0.33 | 22 |
| LAB145 | 28551.3 | 1.45 | 0.41 | 22 | 1.15 | 0.11 | 24 |
| LAB145 | 28553.2 | 1.45 | 0.03 | 22 | 1.14 | 0.08 | 23 |
| LAB145 | 28553.3 | 1.59 | 0.17 | 34 | 1.09 | 0.26 | 18 |
| LAB145 | 28555.1 | 1.28 | 0.29 | 8 | 1.13 | 0.26 | 22 |
| LAB152 | 28471.1 | 1.23 | 0.47 | 4 | 0.95 | 0.51 | 3 |
| LAB152 | 28472.3 | 1.33 | 0.12 | 12 | 1.00 | 0.05 | 8 |
| LAB152 | 28473.2 | 1.29 | 0.19 | 8 | 0.94 | 0.85 | 1 |
| LAB152 | 28473.3 | 1.30 | 0.05 | 9 | 1.05 | 0.09 | 13 |
| LAB152 | 28474.4 | 1.22 | 0.81 | 3 | 1.02 | 0.45 | 10 |
| LAB153 | 28302.2 | 1.43 | 0.12 | 21 | 0.98 | 0.43 | 6 |
| LAB153 | 28303.1 | 1.27 | 0.27 | 7 | 0.96 | 0.31 | 4 |
| LAB153 | 28304.1 | 1.53 | 0.05 | 29 | 1.08 | 0.01 | 16 |
| LAB153 | 28305.3 | 1.35 | 0.30 | 13 | 1.02 | 0.47 | 10 |
| LAB169 | 28391.1 | — | | — | 0.99 | 0.10 | 7 |
| LAB169 | 28391.4 | 1.39 | 0.01 | 17 | 1.06 | 0.00 | 15 |
| LAB169 | 28392.1 | 1.30 | 0.05 | 9 | 1.02 | 0.15 | 11 |
| LAB169 | 28394.3 | 1.45 | 0.00 | 22 | 1.15 | 0.00 | 25 |
| LAB181 | 28481.1 | 1.30 | 0.63 | 9 | 0.94 | 0.86 | 2 |
| LAB181 | 28482.2 | 1.34 | 0.39 | 13 | 1.05 | 0.40 | 13 |
| LAB181 | 28482.3 | — | | — | 0.93 | 0.80 | 1 |
| LAB181 | 28484.3 | 1.36 | 0.03 | 15 | 1.06 | 0.16 | 14 |
| LAB187 | 28431.3 | 1.32 | 0.15 | 12 | 1.00 | 0.31 | 8 |
| LAB187 | 28431.5 | 1.20 | 0.79 | 1 | 1.11 | 0.06 | 20 |
| LAB187 | 28434.1 | 1.73 | 0.25 | 45 | 1.13 | 0.32 | 22 |
| LAB187 | 28435.3 | 1.23 | 0.77 | 4 | — | | — |
| LAB213 | 28561.2 | 1.36 | 0.02 | 15 | 1.01 | 0.02 | 9 |
| LAB213 | 28562.6 | 1.37 | 0.38 | 15 | 0.98 | 0.67 | 6 |
| LAB213 | 28565.2 | — | | — | 0.94 | 0.89 | 1 |
| LAB230 | 28571.6 | — | | — | 0.97 | 0.24 | 4 |
| LAB230 | 28572.3 | 1.25 | 0.37 | 5 | 1.01 | 0.38 | 9 |
| LAB230 | 28574.2 | — | | — | 1.00 | 0.34 | 8 |
| LAB247 | 28091.4 | 1.27 | 0.27 | 7 | 1.06 | 0.30 | 14 |
| LAB247 | 28093.2 | 1.26 | 0.47 | 6 | 1.06 | 0.01 | 14 |
| LAB247 | 28094.1 | 1.39 | 0.18 | 17 | 0.97 | 0.26 | 5 |
| LAB247 | 28094.3 | 1.59 | 0.01 | 34 | 1.10 | 0.00 | 18 |
| LAB247 | 28095.4 | 1.24 | 0.76 | 4 | 0.93 | 0.79 | 1 |
| LAB249 | 28602.1 | 1.43 | 0.31 | 20 | 1.09 | 0.34 | 18 |
| LAB249 | 28603.3 | 1.36 | 0.25 | 15 | 1.08 | 0.02 | 17 |
| LAB249 | 28604.2 | 1.44 | 0.00 | 21 | 1.02 | 0.07 | 11 |
| LAB249 | 28604.4 | 1.28 | 0.09 | 8 | 0.94 | 0.87 | 1 |
| LAB249 | 28605.2 | — | | — | 1.04 | 0.01 | 12 |
| LAB258 | 27441.4 | 1.41 | 0.30 | 19 | 1.10 | 0.04 | 19 |
| LAB258 | 27442.2 | 1.64 | 0.07 | 38 | 1.13 | 0.01 | 22 |
| LAB258 | 27442.5 | 1.26 | 0.74 | 6 | 0.93 | 0.87 | 1 |
| LAB258 | 27444.4 | 1.27 | 0.18 | 7 | 1.02 | 0.30 | 10 |
| LAB294 | 28401.3 | — | | — | 0.99 | 0.10 | 7 |
| LAB294 | 28402.5 | 1.27 | 0.75 | 7 | 1.08 | 0.19 | 16 |
| LAB294 | 28404.1 | — | | — | 0.93 | 0.92 | 0 |
| LAB294 | 28404.3 | 1.36 | 0.45 | 14 | 1.09 | 0.30 | 18 |
| LAB70 | 28463.1 | — | | — | 1.06 | 0.00 | 14 |
| LAB70 | 28463.3 | — | | — | 1.03 | 0.49 | 11 |
| LAB70 | 28464.3 | — | | — | 0.93 | 1.00 | 0 |
| LAB74 | 28451.3 | 1.31 | 0.12 | 11 | 1.14 | 0.09 | 24 |
| LAB74 | 28452.2 | — | | — | 1.05 | 0.54 | 13 |
| LAB74 | 28452.4 | 1.25 | 0.61 | 5 | 1.06 | 0.05 | 14 |
| LAB74 | 28453.5 | 1.32 | 0.38 | 11 | 1.03 | 0.49 | 11 |
| LAB74 | 28454.1 | 1.37 | 0.00 | 15 | 1.05 | 0.00 | 13 |
| LAB81 | 28531.1 | 1.25 | 0.22 | 5 | 1.12 | 0.00 | 20 |
| LAB81 | 28531.2 | — | | — | 0.98 | 0.23 | 6 |
| LAB88 | 28191.3 | — | | — | 0.95 | 0.53 | 2 |
| LAB88 | 28192.6 | 1.36 | 0.14 | 14 | 1.07 | 0.29 | 15 |
| LAB88 | 28193.6 | 1.27 | 0.71 | 7 | 1.03 | 0.44 | 11 |
| cont | | 1.19 | — | 0 | 0.93 | — | 0 |
| LAB113 | 28545.3 | 1.17 | 0.01 | 17 | 0.97 | 0.31 | 9 |
| LAB131 | 28291.1 | 1.04 | 0.64 | 4 | — | | — |
| LAB131 | 28292.3 | 1.16 | 0.01 | 16 | 1.05 | 0.07 | 19 |
| LAB131 | 28294.2 | 1.05 | 0.83 | 5 | 0.95 | 0.62 | 7 |
| LAB131 | 28295.3 | 1.44 | 0.03 | 44 | 1.22 | 0.17 | 37 |
| LAB145 | 28551.1 | 1.01 | 0.87 | 1 | — | | — |
| LAB145 | 28551.3 | 1.02 | 0.90 | 2 | 0.94 | 0.43 | 6 |
| LAB145 | 28553.2 | 1.20 | 0.30 | 20 | 1.06 | 0.09 | 20 |
| LAB145 | 28553.3 | 1.41 | 0.06 | 41 | 1.04 | 0.00 | 17 |
| LAB145 | 28555.1 | 1.39 | 0.01 | 39 | 1.03 | 0.11 | 16 |
| LAB152 | 28471.1 | 1.20 | 0.58 | 20 | — | | — |
| LAB152 | 28472.3 | 1.13 | 0.03 | 13 | 0.92 | 0.18 | 4 |
| LAB152 | 28473.2 | 1.26 | 0.07 | 26 | 1.11 | 0.26 | 26 |
| LAB152 | 28473.3 | 1.32 | 0.34 | 31 | 1.09 | 0.41 | 23 |
| LAB153 | 28301.2 | 1.06 | 0.70 | 6 | — | | — |
| LAB153 | 28302.2 | 1.01 | 0.86 | 1 | 0.92 | 0.30 | 4 |
| LAB153 | 28303.1 | 1.03 | 0.77 | 3 | 0.91 | 0.78 | 2 |
| LAB153 | 28304.1 | 1.15 | 0.01 | 15 | 0.96 | 0.24 | 8 |
| LAB153 | 28305.3 | 1.28 | 0.00 | 28 | 0.97 | 0.22 | 10 |
| LAB169 | 28391.1 | 1.61 | 0.07 | 61 | 1.12 | 0.31 | 26 |
| LAB169 | 28391.4 | 1.24 | 0.27 | 24 | — | | — |
| LAB169 | 28392.1 | 1.43 | 0.11 | 43 | 1.10 | 0.00 | 24 |
| LAB169 | 28393.2 | 1.34 | 0.05 | 33 | 1.05 | 0.05 | 18 |
| LAB169 | 28394.3 | 1.58 | 0.01 | 58 | 1.09 | 0.01 | 23 |
| LAB181 | 28481.1 | 1.24 | 0.00 | 24 | 1.00 | 0.40 | 12 |
| LAB181 | 28482.2 | 1.10 | 0.59 | 10 | 0.90 | 0.83 | 2 |
| LAB181 | 28482.3 | 1.07 | 0.81 | 7 | 0.91 | 0.90 | 2 |
| LAB181 | 28483.2 | 1.11 | 0.06 | 11 | 0.91 | 0.47 | 2 |
| LAB181 | 28484.3 | 1.10 | 0.23 | 10 | 0.96 | 0.01 | 8 |
| LAB187 | 28433.3 | 1.17 | 0.34 | 17 | 0.98 | 0.53 | 10 |
| LAB187 | 28434.1 | 1.41 | 0.36 | 41 | 0.96 | 0.54 | 8 |
| LAB187 | 28435.3 | 1.06 | 0.25 | 6 | 0.91 | 0.68 | 2 |
| LAB187 | 28435.4 | 1.23 | 0.00 | 23 | 1.02 | 0.01 | 15 |
| LAB213 | 28561.2 | 1.06 | 0.60 | 6 | 1.01 | 0.39 | 14 |
| LAB213 | 28562.6 | 1.21 | 0.37 | 21 | 0.90 | 0.92 | 1 |
| LAB213 | 28565.2 | 1.17 | 0.19 | 17 | 1.06 | 0.38 | 20 |
| LAB230 | 28572.2 | 1.04 | 0.56 | 3 | 0.91 | 0.36 | 3 |
| LAB230 | 28572.3 | 1.06 | 0.77 | 6 | — | | — |
| LAB230 | 28574.2 | 1.04 | 0.73 | 3 | 0.92 | 0.83 | 4 |
| LAB247 | 28091.4 | 1.09 | 0.37 | 9 | — | | — |
| LAB247 | 28094.3 | 1.03 | 0.63 | 3 | — | | — |
| LAB249 | 28604.2 | 1.25 | 0.12 | 25 | 0.93 | 0.08 | 5 |
| LAB249 | 28605.2 | 1.27 | 0.40 | 27 | 1.08 | 0.37 | 22 |
| LAB258 | 27441.4 | 1.18 | 0.18 | 18 | 1.01 | 0.45 | 14 |
| LAB258 | 27442.2 | 1.02 | 0.82 | 1 | — | | — |
| LAB258 | 27442.5 | 1.37 | 0.00 | 37 | 1.18 | 0.01 | 33 |
| LAB258 | 27444.4 | 1.20 | 0.51 | 20 | 1.01 | 0.55 | 14 |
| LAB294 | 28402.4 | 1.07 | 0.69 | 7 | 0.94 | 0.44 | 6 |
| LAB294 | 28404.1 | — | | — | 0.94 | 0.52 | 6 |
| LAB70 | 28463.1 | — | | — | 0.99 | 0.63 | 11 |
| LAB70 | 28463.3 | — | | — | 0.90 | 0.78 | 2 |
| LAB74 | 28451.3 | 1.23 | 0.04 | 23 | 1.05 | 0.04 | 19 |
| LAB74 | 28452.4 | 1.34 | 0.52 | 33 | 1.11 | 0.42 | 25 |
| LAB74 | 28454.1 | 1.08 | 0.38 | 8 | 0.95 | 0.13 | 7 |
| LAB81 | 28531.1 | 1.02 | 0.91 | 1 | — | | — |
| LAB88 | 28191.3 | — | | — | 0.90 | 0.65 | 1 |
| LAB88 | 28193.2 | 1.27 | 0.50 | 27 | 0.98 | 0.61 | 11 |
| LAB88 | 28193.6 | 1.15 | 0.22 | 15 | 0.99 | 0.02 | 12 |
| cont | | 1.00 | — | 0 | 0.89 | — | 0 |
| LAB108 | 28501.4 | 1.79 | 0.07 | 22 | 1.22 | 0.00 | 14 |
| LAB108 | 28502.2 | 1.57 | 0.76 | 7 | 1.15 | 0.77 | 8 |
| LAB108 | 28504.1 | 1.50 | 0.87 | 2 | 1.11 | 0.76 | 4 |
| LAB108 | 28505.2 | 1.67 | 0.19 | 14 | 1.14 | 0.42 | 6 |
| LAB108 | 28505.4 | 1.64 | 0.30 | 12 | 1.17 | 0.43 | 9 |
| LAB119 | 28412.1 | 1.59 | 0.33 | 8 | 1.10 | 0.75 | 2 |
| LAB119 | 28413.1 | 1.67 | 0.34 | 14 | 1.13 | 0.77 | 5 |
| LAB119 | 28414.1 | 1.47 | 0.95 | 1 | — | | — |
| LAB157 | 28142.3 | 1.75 | 0.17 | 19 | 1.18 | 0.01 | 10 |
| LAB157 | 28144.2 | 1.51 | 0.56 | 3 | — | | — |

TABLE 81-continued

Genes showing improved photosynthetic capacity at standard growth conditions

| Gene Name | Event # | Leaf Blade Area [cm2] | | | Leaf Petiole Length | | |
|---|---|---|---|---|---|---|---|
| | | Ave. | P-Val. | % incr. | Ave. | P-Val. | % incr. |
| LAB157 | 28146.1 | 1.64 | 0.55 | 12 | 1.14 | 0.69 | 6 |
| LAB157 | 28146.2 | 1.57 | 0.61 | 7 | 1.12 | 0.59 | 5 |
| LAB231 | 28581.3 | 1.48 | 0.85 | 1 | — | — | — |
| LAB231 | 28582.1 | 1.51 | 0.45 | 3 | — | — | — |
| LAB231 | 28583.1 | 2.06 | 0.12 | 41 | 1.26 | 0.30 | 18 |
| LAB231 | 28585.1 | 1.60 | 0.70 | 9 | 1.19 | 0.71 | 11 |
| LAB238 | 28422.4 | 1.62 | 0.39 | 11 | 1.17 | 0.37 | 10 |
| LAB238 | 28424.3 | — | — | — | 1.08 | 0.84 | 1 |
| LAB238 | 28425.5 | 1.66 | 0.67 | 13 | 1.17 | 0.78 | 9 |
| LAB240 | 28592.2 | 1.59 | 0.71 | 8 | 1.13 | 0.69 | 6 |
| LAB240 | 28592.6 | 1.77 | 0.12 | 20 | 1.23 | 0.00 | 15 |
| LAB240 | 28595.1 | 1.54 | 0.24 | 5 | — | — | — |
| LAB240 | 28595.3 | 2.04 | 0.09 | 39 | 1.35 | 0.12 | 26 |
| LAB242 | 28081.2 | 1.51 | 0.46 | 3 | — | — | — |
| LAB242 | 28081.3 | 1.59 | 0.59 | 9 | — | — | — |
| LAB242 | 28083.1 | 1.60 | 0.57 | 9 | 1.10 | 0.77 | 3 |
| LAB242 | 28085.1 | 1.52 | 0.67 | 4 | 1.10 | 0.71 | 3 |
| LAB242 | 28085.5 | 1.58 | 0.71 | 8 | 1.12 | 0.72 | 5 |
| LAB267 | 28381.2 | — | — | — | 1.13 | 0.17 | 6 |
| LAB267 | 28384.2 | 1.56 | 0.74 | 6 | 1.20 | 0.40 | 13 |
| LAB269 | 28342.3 | 1.47 | 0.99 | 0 | 1.07 | 0.98 | 0 |
| LAB269 | 28343.4 | 1.58 | 0.65 | 8 | 1.11 | 0.34 | 3 |
| LAB269 | 28345.2 | — | — | — | 1.08 | 0.90 | 1 |
| LAB269 | 28345.3 | 1.52 | 0.81 | 4 | 1.09 | 0.79 | 2 |
| LAB279 | 28351.1 | — | — | — | 1.11 | 0.86 | 4 |
| LAB279 | 28351.4 | 1.52 | 0.49 | 4 | — | — | — |
| LAB279 | 28353.2 | 1.48 | 0.97 | 1 | 1.12 | 0.83 | 5 |
| LAB279 | 28354.1 | 1.62 | 0.25 | 11 | 1.21 | 0.31 | 13 |
| LAB283 | 28363.3 | 1.75 | 0.00 | 19 | 1.20 | 0.32 | 12 |
| LAB283 | 28364.3 | 1.53 | 0.66 | 5 | 1.13 | 0.16 | 5 |
| LAB283 | 28365.1 | 1.77 | 0.07 | 21 | 1.25 | 0.18 | 17 |
| LAB298 | 29245.2 | — | — | — | 1.08 | 0.86 | 1 |
| LAB298 | 29245.3 | 1.53 | 0.78 | 4 | — | — | — |
| LAB298 | 29245.4 | 1.58 | 0.64 | 8 | 1.21 | 0.25 | 13 |
| LAB299 | 28061.1 | 1.53 | 0.41 | 5 | 1.18 | 0.09 | 10 |
| LAB299 | 28063.1 | 1.56 | 0.69 | 7 | 1.14 | 0.62 | 6 |
| LAB299 | 28063.2 | 1.48 | 0.94 | 1 | — | — | — |
| LAB299 | 28064.1 | 1.56 | 0.48 | 6 | 1.12 | 0.36 | 4 |
| LAB302 | 28822.6 | 1.48 | 0.97 | 1 | 1.07 | 0.99 | 0 |
| LAB302 | 28822.7 | 1.61 | 0.32 | 10 | 1.13 | 0.49 | 6 |
| LAB302 | 28823.4 | 1.49 | 0.94 | 2 | 1.15 | 0.73 | 7 |
| LAB302 | 28825.1 | — | — | — | 1.07 | 1.00 | 0 |
| LAB302 | 28825.2 | 1.62 | 0.01 | 11 | 1.16 | 0.02 | 8 |
| LAB336 | 28373.5 | — | — | — | 1.08 | 0.95 | 1 |
| LAB339 | 27271.5 | — | — | — | 1.07 | 0.96 | 0 |
| LAB339 | 27272.2 | 1.56 | 0.81 | 7 | — | — | — |
| LAB339 | 27272.7 | 1.51 | 0.51 | 3 | — | — | — |
| LAB345 | 28491.1 | 1.56 | 0.74 | 6 | 1.12 | 0.81 | 5 |
| LAB345 | 28492.2 | — | — | — | 1.12 | 0.25 | 4 |
| LAB345 | 28494.1 | 1.62 | 0.36 | 10 | 1.17 | 0.54 | 9 |
| LAB345 | 28495.1 | 1.50 | 0.87 | 2 | 1.15 | 0.68 | 7 |
| LAB345 | 28495.4 | — | — | — | 1.16 | 0.71 | 8 |
| LAB58 | 28442.1 | 1.58 | 0.50 | 8 | 1.18 | 0.46 | 10 |
| LAB58 | 28443.2 | 1.47 | 0.97 | 1 | 1.09 | 0.82 | 2 |
| cont | — | 1.47 | — | 0 | 1.07 | — | 0 |
| LAB133 | 28833.1 | 3.91 | 0.94 | 1 | — | — | — |
| LAB133 | 28833.2 | 4.55 | 0.14 | 17 | — | — | — |
| LAB133 | 28835.1 | 4.04 | 0.76 | 4 | — | — | — |
| LAB160 | 29315.2 | — | — | — | 0.80 | 0.79 | 11 |
| LAB160 | 29315.3 | — | — | — | 0.80 | 0.77 | 12 |
| LAB162 | 29341.2 | 3.93 | 0.94 | 1 | — | — | — |
| LAB162 | 29344.1 | 4.22 | 0.66 | 9 | — | — | — |
| LAB177 | 29424.3 | — | — | — | 0.73 | 0.96 | 2 |
| LAB177 | 29424.4 | 3.99 | 0.86 | 3 | — | — | — |
| LAB179 | 29304.3 | 4.09 | 0.70 | 6 | — | — | — |
| LAB185 | 28172.4 | — | — | — | 0.84 | 0.67 | 17 |
| LAB185 | 28174.2 | 3.91 | 0.93 | 1 | — | — | — |
| LAB210 | 28332.1 | 4.58 | 0.11 | 18 | — | — | — |
| LAB210 | 28334.1 | 4.04 | 0.69 | 4 | — | — | — |
| LAB210 | 28335.3 | 3.99 | 0.78 | 3 | — | — | — |
| LAB254 | 28812.1 | 4.02 | 0.81 | 4 | — | — | — |
| LAB293 | 29233.2 | 4.81 | 0.20 | 24 | 0.77 | 0.71 | 6 |
| LAB297 | 29272.5 | 4.49 | 0.42 | 16 | — | — | — |
| LAB297 | 29273.4 | 4.46 | 0.39 | 15 | — | — | — |
| LAB310 | 28182.2 | — | — | — | 0.82 | 0.59 | 14 |
| LAB310 | 28182.3 | 5.53 | 0.41 | 43 | 0.78 | 0.55 | 8 |
| LAB318 | 28101.5 | 4.11 | 0.57 | 6 | — | — | — |
| LAB318 | 28103.2 | 4.21 | 0.45 | 8 | — | — | — |
| LAB318 | 28104.3 | — | — | — | 0.89 | 0.61 | 24 |
| LAB327 | 29221.6 | 4.21 | 0.53 | 8 | — | — | — |
| LAB327 | 29224.2 | — | — | — | 0.88 | 0.43 | 22 |
| LAB327 | 29225.2 | — | — | — | 0.78 | 0.81 | 8 |
| LAB327 | 29225.3 | — | — | — | 0.85 | 0.49 | 17 |
| LAB335 | 27311.2 | 4.32 | 0.37 | 11 | — | — | — |
| LAB335 | 27314.1 | 4.46 | 0.38 | 15 | — | — | — |
| LAB335 | 27314.2 | 5.13 | 0.01 | 32 | 0.74 | 0.78 | 3 |
| LAB335 | 27315.4 | 4.89 | 0.18 | 26 | 0.78 | 0.43 | 8 |
| LAB54 | 28131.1 | — | — | — | 0.88 | 0.63 | 22 |
| LAB54 | 28133.1 | — | — | — | 0.92 | 0.58 | 27 |
| LAB54 | 28134.1 | 5.11 | 0.03 | 32 | — | — | — |
| LAB54 | 28136.1 | — | — | — | 1.16 | 0.01 | 60 |
| LAB54 | 28136.2 | 5.18 | 0.33 | 34 | 0.73 | 0.97 | 1 |
| LAB68 | 29332.4 | — | — | — | 0.91 | 0.54 | 26 |
| LAB73 | 30151.1 | — | — | — | 0.86 | 0.60 | 19 |
| LAB73 | 30152.1 | 4.36 | 0.51 | 12 | — | — | — |
| LAB73 | 30153.1 | 3.91 | 0.94 | 1 | — | — | — |
| cont | — | 3.88 | — | 0 | 0.72 | — | 0 |
| LAB102 | 30312.2 | 3.83 | 0.20 | 12 | — | — | — |
| LAB126 | 30201.3 | 3.74 | 0.46 | 9 | — | — | — |
| LAB126 | 30202.3 | 3.80 | 0.30 | 11 | — | — | — |
| LAB126 | 30205.1 | — | — | — | 0.89 | 0.62 | 20 |
| LAB126 | 30205.3 | — | — | — | 0.81 | 0.72 | 9 |
| LAB165 | 30231.1 | 3.52 | 0.77 | 3 | — | — | — |
| LAB165 | 30231.2 | — | — | — | 0.95 | 0.56 | 29 |
| LAB165 | 30232.1 | — | — | — | 0.95 | 0.53 | 29 |
| LAB165 | 30233.1 | 3.61 | 0.54 | 5 | — | — | — |
| LAB165 | 30235.1 | — | — | — | 0.91 | 0.47 | 23 |
| LAB167 | 27321.2 | 4.18 | 0.15 | 22 | 0.79 | 0.54 | 7 |
| LAB167 | 27321.3 | — | — | — | 0.99 | 0.41 | 34 |
| LAB167 | 27321.4 | — | — | — | 0.97 | 0.38 | 32 |
| LAB167 | 27321.6 | — | — | — | 0.94 | 0.50 | 28 |
| LAB220 | 30321.4 | 4.11 | 0.05 | 20 | — | — | — |
| LAB220 | 30322.2 | 4.05 | 0.05 | 18 | — | — | — |
| LAB220 | 30322.3 | — | — | — | 0.86 | 0.66 | 17 |
| LAB220 | 30323.1 | 4.03 | 0.06 | 17 | — | — | — |
| LAB220 | 30324.4 | 3.96 | 0.10 | 16 | — | — | — |
| LAB241 | 30211.3 | — | — | — | 0.96 | 0.46 | 30 |
| LAB241 | 30212.1 | 3.75 | 0.32 | 9 | — | — | — |
| LAB241 | 30212.2 | — | — | — | 0.99 | 0.38 | 34 |
| LAB241 | 30213.1 | — | — | — | 1.18 | 0.00 | 60 |
| LAB241 | 30213.4 | 3.99 | 0.18 | 16 | — | — | — |
| LAB268 | 30391.4 | 4.44 | 0.01 | 30 | — | — | — |
| LAB268 | 30392.1 | 3.93 | 0.16 | 15 | — | — | — |
| LAB268 | 30393.1 | 3.72 | 0.49 | 9 | — | — | — |
| LAB268 | 30393.3 | 3.75 | 0.27 | 9 | — | — | — |
| LAB268 | 30395.1 | — | — | — | 1.02 | 0.44 | 38 |
| LAB280 | 30041.2 | 3.55 | 0.69 | 4 | — | — | — |
| LAB280 | 30042.1 | 3.96 | 0.39 | 15 | — | — | — |
| LAB280 | 30044.1 | 4.37 | 0.01 | 27 | 0.75 | 0.81 | 2 |
| LAB280 | 30044.2 | 3.56 | 0.64 | 4 | — | — | — |
| LAB280 | 30045.1 | 3.66 | 0.93 | 7 | 1.08 | 0.33 | 46 |
| LAB289 | 30371.4 | 4.18 | 0.03 | 22 | — | — | — |
| LAB289 | 30371.6 | 4.41 | 0.00 | 29 | 0.76 | 0.74 | 3 |
| LAB289 | 30373.1 | 3.99 | 0.08 | 16 | — | — | — |
| LAB289 | 30373.2 | 3.72 | 0.31 | 9 | — | — | — |
| LAB289 | 30375.2 | — | — | — | 0.95 | 0.37 | 29 |
| LAB311 | 30221.4 | 4.02 | 0.06 | 17 | — | — | — |
| LAB311 | 30222.2 | 3.60 | 0.56 | 5 | — | — | — |
| LAB311 | 30223.2 | 3.69 | 0.50 | 8 | — | — | — |
| LAB311 | 30223.4 | 4.02 | 0.09 | 17 | — | — | — |
| LAB311 | 30224.2 | — | — | — | 1.10 | 0.34 | 49 |
| LAB344 | 30092.3 | — | — | — | 0.92 | 0.69 | 25 |

TABLE 81-continued

Genes showing improved photosynthetic capacity at standard growth conditions

| Gene Name | Event # | Leaf Blade Area [cm2] Ave. | P-Val. | % incr. | Leaf Petiole Length Ave. | P-Val. | % incr. |
|---|---|---|---|---|---|---|---|
| LAB344 | 30096.3 | — | | — | 0.87 | 0.67 | 18 |
| LAB355 | 29281.3 | 3.53 | 0.82 | 3 | — | | — |
| LAB355 | 29282.1 | — | | — | 1.00 | 0.54 | 36 |
| LAB355 | 29282.2 | 3.80 | 0.35 | 11 | — | | — |
| LAB355 | 29282.3 | 3.74 | 0.29 | 9 | — | | — |
| LAB355 | 29283.1 | 4.06 | 0.05 | 18 | — | | — |
| LAB367 | 30171.3 | 3.45 | 0.95 | 1 | — | | — |
| LAB367 | 30172.3 | 3.56 | 0.73 | 4 | — | | — |
| LAB367 | 30173.1 | 3.78 | 0.48 | 10 | — | | — |
| LAB367 | 30173.3 | 3.68 | 0.65 | 7 | — | | — |
| LAB367 | 30174.1 | — | | — | 0.86 | 0.70 | 17 |
| LAB381 | 30351.4 | 3.43 | 0.99 | 0 | — | | — |
| LAB381 | 30352.2 | 3.64 | 0.51 | 6 | — | | — |
| LAB381 | 30352.4 | 4.04 | 0.09 | 18 | — | | — |
| LAB381 | 30354.2 | 3.71 | 0.46 | 8 | — | | — |
| LAB381 | 30356.1 | — | | — | 0.81 | 0.71 | 10 |
| LAB383 | 28111.3 | 3.57 | 0.63 | 4 | — | | — |
| LAB383 | 28114.2 | — | | — | 0.98 | 0.42 | 33 |
| LAB383 | 28115.1 | — | | — | 0.85 | 0.71 | 16 |
| LAB383 | 28115.2 | — | | — | 0.98 | 0.54 | 33 |
| LAB64 | 30271.2 | 4.05 | 0.16 | 18 | — | | — |
| LAB64 | 30272.1 | 3.95 | 0.18 | 15 | — | | — |
| LAB64 | 30273.2 | 3.82 | 0.24 | 11 | — | | — |
| LAB64 | 30274.2 | 4.28 | 0.01 | 25 | 0.75 | 0.84 | 2 |
| LAB64 | 30274.3 | — | | — | 0.89 | 0.55 | 21 |
| LAB65 | 30301.4 | — | | — | 0.92 | 0.53 | 25 |
| LAB65 | 30302.1 | 4.02 | 0.11 | 17 | — | | — |
| LAB65 | 30303.4 | 3.79 | 0.22 | 11 | — | | — |
| LAB65 | 30304.3 | 4.77 | 0.00 | 39 | 0.74 | 0.94 | 1 |
| LAB92 | 29321.2 | 3.66 | 0.53 | 7 | — | | — |
| LAB92 | 29323.2 | 3.72 | 0.57 | 8 | — | | — |
| cont | — | 3.43 | — | 0 | 0.74 | — | 0 |
| LAB138 | 30781.1 | 3.85 | 0.51 | 14 | — | | — |
| LAB138 | 30781.2 | — | | — | 0.85 | 0.77 | 7 |
| LAB138 | 30781.5 | 3.48 | 0.86 | 3 | — | | — |
| LAB138 | 30781.6 | 3.89 | 0.35 | 15 | — | | — |
| LAB138 | 30783.2 | 3.60 | 0.72 | 6 | — | | — |
| LAB159 | 30701.6 | — | | — | 0.96 | 0.70 | 21 |
| LAB159 | 30702.3 | 3.87 | 0.40 | 14 | — | | — |
| LAB159 | 30702.4 | 4.49 | 0.05 | 33 | — | | — |
| LAB159 | 30704.3 | — | | — | 1.03 | 0.53 | 29 |
| LAB159 | 30704.4 | 4.38 | 0.08 | 29 | — | | — |
| LAB161 | 30482.1 | 4.69 | 0.03 | 38 | — | | — |
| LAB161 | 30482.2 | — | | — | 1.07 | 0.55 | 35 |
| LAB161 | 30483.1 | 4.25 | 0.22 | 25 | — | | — |
| LAB161 | 30485.1 | — | | — | 1.09 | 0.49 | 38 |
| LAB161 | 30486.1 | — | | — | 0.90 | 0.67 | 13 |
| LAB166 | 30242.1 | — | | — | 0.92 | 0.46 | 16 |
| LAB166 | 30243.1 | — | | — | 0.98 | 0.64 | 23 |
| LAB166 | 30244.3 | 4.18 | 0.17 | 23 | — | | — |
| LAB166 | 30245.3 | 3.82 | 0.41 | 13 | — | | — |
| LAB166 | 30245.4 | 3.96 | 0.34 | 17 | — | | — |
| LAB170 | 30712.1 | — | | — | 0.87 | 0.77 | 10 |
| LAB170 | 30712.2 | 4.06 | 0.21 | 20 | — | | — |
| LAB170 | 30713.2 | 3.64 | 0.64 | 8 | — | | — |
| LAB170 | 30715.1 | 4.25 | 0.15 | 25 | — | | — |
| LAB170 | 30715.2 | 4.41 | 0.16 | 30 | — | | — |
| LAB176 | 30141.4 | 3.70 | 0.55 | 9 | — | | — |
| LAB176 | 30142.1 | 4.07 | 0.21 | 20 | — | | — |
| LAB176 | 30143.1 | 4.14 | 0.41 | 22 | — | | — |
| LAB176 | 30143.2 | 4.17 | 0.28 | 23 | — | | — |
| LAB188 | 30722.2 | — | | — | 0.96 | 0.60 | 21 |
| LAB188 | 30723.3 | — | | — | 1.32 | 0.03 | 66 |
| LAB188 | 30723.7 | — | | — | 1.01 | 0.57 | 27 |
| LAB188 | 30724.1 | 4.05 | 0.40 | 20 | — | | — |
| LAB188 | 30724.2 | 4.47 | 0.06 | 32 | — | | — |
| LAB237 | 30281.4 | — | | — | 1.01 | 0.61 | 28 |
| LAB237 | 30282.1 | 4.32 | 0.09 | 28 | — | | — |
| LAB237 | 30283.2 | — | | — | 0.98 | 0.62 | 23 |
| LAB237 | 30284.1 | 3.41 | 0.96 | 1 | — | | — |
| LAB259 | 27112.1 | — | | — | 1.00 | 0.45 | 27 |
| LAB259 | 27112.1 | 3.90 | 0.40 | 15 | — | | — |
| LAB259 | 27112.3 | 3.54 | 0.76 | 5 | — | | — |
| LAB259 | 27112.7 | — | | — | 0.93 | 0.62 | 17 |
| LAB259 | 27112.9 | — | | — | 0.94 | 0.68 | 18 |
| LAB262 | 30611.4 | 4.17 | 0.15 | 23 | — | | — |
| LAB262 | 30612.1 | 3.78 | 0.54 | 12 | — | | — |
| LAB262 | 30612.4 | — | | — | 0.89 | 0.72 | 13 |
| LAB262 | 30614.1 | 3.94 | 0.29 | 16 | — | | — |
| LAB262 | 30614.2 | 4.55 | 0.42 | 34 | — | | — |
| LAB270 | 30591.2 | — | | — | 1.08 | 0.55 | 36 |
| LAB270 | 30594.1 | 4.94 | 0.05 | 46 | 0.81 | 0.80 | 3 |
| LAB270 | 30594.3 | 5.06 | 0.01 | 50 | 0.80 | 0.90 | 1 |
| LAB270 | 30595.1 | — | | — | 0.80 | 0.98 | 1 |
| LAB270 | 30595.2 | 3.89 | 0.35 | 15 | — | | — |
| LAB300 | 30061.2 | 4.35 | 0.08 | 28 | — | | — |
| LAB300 | 30062.2 | — | | — | 1.27 | 0.12 | 60 |
| LAB300 | 30063.1 | 5.12 | 0.01 | 51 | 0.81 | 0.80 | 2 |
| LAB300 | 30064.1 | 4.06 | 0.21 | 20 | — | | — |
| LAB300 | 30064.3 | 4.91 | 0.01 | 45 | 0.81 | 0.73 | 3 |
| LAB306 | 30561.2 | 4.22 | 0.13 | 25 | — | | — |
| LAB306 | 30562.2 | 4.33 | 0.09 | 28 | — | | — |
| LAB306 | 30563.2 | 4.08 | 0.19 | 21 | — | | — |
| LAB306 | 30564.2 | 4.42 | 0.06 | 31 | — | | — |
| LAB306 | 30564.3 | 4.09 | 0.42 | 21 | — | | — |
| LAB323 | 30381.1 | 3.49 | 0.84 | 3 | — | | — |
| LAB323 | 30381.4 | — | | — | 0.88 | 0.41 | 11 |
| LAB323 | 30383.1 | 4.35 | 0.15 | 29 | — | | — |
| LAB323 | 30383.2 | — | | — | 0.92 | 0.51 | 16 |
| LAB323 | 30385.1 | 3.98 | 0.39 | 18 | — | | — |
| LAB347_H0 | 30441.1 | 4.80 | 0.10 | 42 | — | | — |
| LAB347_H0 | 30442.4 | 4.60 | 0.04 | 36 | — | | — |
| LAB347_H0 | 30443.4 | 4.38 | 0.19 | 29 | — | | — |
| LAB347_H0 | 30444.1 | 4.68 | 0.03 | 38 | — | | — |
| LAB347_H0 | 30444.3 | — | | — | 0.96 | 0.60 | 21 |
| LAB55 | 30022.3 | — | | — | 0.90 | 0.60 | 14 |
| LAB55 | 30023.1 | 4.25 | 0.16 | 25 | — | | — |
| LAB55 | 30023.3 | — | | — | 0.93 | 0.64 | 17 |
| LAB55 | 30025.3 | 4.72 | 0.20 | 39 | — | | — |
| LAB55 | 30025.4 | 3.77 | 0.48 | 11 | — | | — |
| LAB83 | 30191.1 | — | | — | 1.06 | 0.54 | 33 |
| LAB83 | 30191.3 | 4.06 | 0.24 | 20 | — | | — |
| LAB83 | 30194.1 | 4.54 | 0.04 | 34 | — | | — |
| LAB83 | 30194.2 | — | | — | 0.94 | 0.68 | 18 |
| LAB83 | 30194.3 | 4.40 | 0.07 | 30 | — | | — |
| LAB94 | 30681.4 | 4.06 | 0.23 | 20 | — | | — |
| LAB94 | 30681.8 | 4.88 | 0.02 | 44 | — | | — |
| LAB94 | 30682.2 | 4.67 | 0.16 | 38 | — | | — |
| LAB94 | 30682.3 | 4.29 | 0.23 | 27 | — | | — |
| LAB94 | 30684.2 | 3.49 | 0.87 | 3 | — | | — |
| cont | — | 3.39 | — | 0 | 0.79 | — | 0 |
| LAB138 | 30781.1 | 2.67 | 0.44 | 10 | — | | — |
| LAB138 | 30781.2 | 2.55 | 0.75 | 5 | — | | — |
| LAB138 | 30781.6 | 2.68 | 0.37 | 10 | — | | — |
| LAB138 | 30783.2 | 2.50 | 0.80 | 3 | — | | — |
| LAB159 | 30701.6 | 2.73 | 0.54 | 13 | — | | — |
| LAB159 | 30702.3 | 3.15 | 0.13 | 29 | 0.59 | 0.66 | 6 |
| LAB159 | 30702.4 | 3.42 | 0.03 | 41 | — | | — |
| LAB159 | 30704.3 | 3.00 | 0.08 | 24 | — | | — |
| LAB159 | 30704.4 | 3.24 | 0.05 | 33 | 0.58 | 0.69 | 4 |
| LAB161 | 30482.1 | 3.20 | 0.07 | 32 | — | | — |
| LAB161 | 30482.2 | 3.05 | 0.05 | 25 | 0.58 | 0.76 | 3 |
| LAB161 | 30483.1 | 2.83 | 0.18 | 16 | — | | — |
| LAB161 | 30485.1 | 2.90 | 0.14 | 19 | — | | — |
| LAB161 | 30486.1 | 3.16 | 0.03 | 30 | — | | — |
| LAB166 | 30242.1 | 2.92 | 0.11 | 20 | — | | — |
| LAB166 | 30243.1 | 3.20 | 0.07 | 32 | — | | — |
| LAB166 | 30244.3 | 2.96 | 0.12 | 22 | — | | — |
| LAB166 | 30245.3 | 3.20 | 0.28 | 32 | — | | — |
| LAB166 | 30245.4 | — | | — | 0.72 | 0.48 | 29 |
| LAB170 | 30712.1 | 3.68 | 0.00 | 51 | 0.58 | 0.67 | 5 |
| LAB170 | 30712.2 | 3.27 | 0.02 | 35 | — | | — |

TABLE 81-continued

Genes showing improved photosynthetic capacity at standard growth conditions

| Gene Name | Event # | Leaf Blade Area [cm2] Ave. | P-Val. | % incr. | Leaf Petiole Length Ave. | P-Val. | % incr. |
|---|---|---|---|---|---|---|---|
| LAB170 | 30713.2 | 3.11 | 0.04 | 28 | — | — | — |
| LAB170 | 30715.1 | 3.33 | 0.03 | 37 | 0.60 | 0.60 | 8 |
| LAB170 | 30715.2 | 3.07 | 0.25 | 26 | — | — | — |
| LAB176 | 30141.4 | 3.01 | 0.11 | 24 | — | — | — |
| LAB176 | 30142.1 | — | — | — | 0.90 | 0.06 | 61 |
| LAB176 | 30143.1 | — | — | — | 0.72 | 0.57 | 28 |
| LAB176 | 30143.2 | 3.00 | 0.22 | 23 | 0.56 | 0.93 | 1 |
| LAB176 | 30144.2 | 3.00 | 0.07 | 23 | — | — | — |
| LAB188 | 30722.2 | 2.56 | 0.63 | 6 | — | — | — |
| LAB188 | 30724.1 | 2.72 | 0.32 | 12 | — | — | — |
| LAB188 | 30724.2 | 2.76 | 0.40 | 14 | — | — | — |
| LAB237 | 30281.4 | 3.53 | 0.01 | 45 | 0.59 | 0.59 | 6 |
| LAB237 | 30282.1 | 3.01 | 0.06 | 24 | — | — | — |
| LAB237 | 30283.2 | 3.19 | 0.02 | 31 | — | — | — |
| LAB237 | 30283.4 | 2.55 | 0.72 | 5 | — | — | — |
| LAB237 | 30284.1 | 2.87 | 0.16 | 18 | — | — | — |
| LAB259 | 27112.1 | 3.24 | 0.08 | 33 | 0.57 | 0.86 | 2 |
| LAB259 | 27112.1 | — | — | — | 0.82 | 0.48 | 47 |
| LAB259 | 27112.3 | 2.83 | 0.19 | 16 | 0.56 | 0.95 | 1 |
| LAB259 | 27112.7 | — | — | — | 0.70 | 0.43 | 26 |
| LAB259 | 27112.9 | 3.52 | 0.00 | 45 | 0.61 | 0.41 | 10 |
| LAB262 | 30611.4 | 2.58 | 0.60 | 6 | — | — | — |
| LAB262 | 30612.1 | 2.63 | 0.53 | 8 | — | — | — |
| LAB262 | 30612.4 | 2.72 | 0.56 | 12 | — | — | — |
| LAB262 | 30614.1 | 3.30 | 0.08 | 36 | — | — | — |
| LAB262 | 30614.2 | 3.18 | 0.05 | 31 | — | — | — |
| LAB270 | 30591.2 | 2.77 | 0.45 | 14 | — | — | — |
| LAB270 | 30594.1 | — | — | — | 0.70 | 0.47 | 26 |
| LAB270 | 30594.3 | 2.51 | 0.84 | 3 | — | — | — |
| LAB270 | 30595.1 | 2.52 | 0.86 | 4 | — | — | — |
| LAB270 | 30595.2 | 3.11 | 0.14 | 28 | — | — | — |
| LAB300 | 30061.2 | 3.15 | 0.13 | 30 | — | — | — |
| LAB300 | 30062.2 | — | — | — | 0.62 | 0.72 | 10 |
| LAB300 | 30064.1 | 2.57 | 0.63 | 6 | — | — | — |
| LAB300 | 30064.3 | 3.43 | 0.22 | 41 | 0.64 | 0.38 | 14 |
| LAB306 | 30561.2 | 3.01 | 0.14 | 24 | — | — | — |
| LAB306 | 30562.2 | 2.84 | 0.16 | 17 | — | — | — |
| LAB306 | 30563.2 | 2.70 | 0.43 | 11 | — | — | — |
| LAB306 | 30564.2 | 2.65 | 0.46 | 9 | — | — | — |
| LAB306 | 30564.3 | 3.37 | 0.01 | 39 | 0.58 | 0.65 | 5 |
| LAB323 | 30381.1 | 2.56 | 0.69 | 5 | — | — | — |
| LAB323 | 30381.4 | 2.81 | 0.19 | 16 | — | — | — |
| LAB323 | 30383.1 | 2.83 | 0.26 | 17 | — | — | — |
| LAB323 | 30383.2 | 2.72 | 0.44 | 12 | — | — | — |
| LAB347_H0 | 30442.4 | 2.49 | 0.82 | 3 | — | — | — |
| LAB55 | 30022.3 | 2.45 | 0.95 | 1 | — | — | — |
| LAB83 | 30191.1 | 3.16 | 0.03 | 30 | — | — | — |
| LAB83 | 30191.3 | 2.77 | 0.26 | 14 | — | — | — |
| LAB83 | 30194.1 | 2.44 | 0.98 | 0 | — | — | — |
| LAB83 | 30194.2 | 2.60 | 0.58 | 7 | — | — | — |
| LAB83 | 30194.3 | — | — | — | 0.65 | 0.65 | 17 |
| LAB94 | 30681.4 | 2.53 | 0.73 | 4 | — | — | — |
| LAB94 | 30681.8 | 3.14 | 0.04 | 29 | 0.60 | 0.50 | 8 |
| LAB94 | 30682.2 | 2.69 | 0.37 | 11 | — | — | — |
| LAB94 | 30682.3 | 2.82 | 0.20 | 16 | — | — | — |
| LAB94 | 30684.2 | 2.57 | 0.74 | 6 | — | — | — |
| cont | — | 2.43 | — | 0 | 0.56 | — | 0 |
| LAB182 | 30451.3 | 3.27 | 0.84 | 2 | 0.60 | 0.62 | 4 |
| LAB182 | 30453.4 | 3.46 | 0.56 | 8 | — | — | — |
| LAB182 | 30454.2 | 3.50 | 0.63 | 9 | 0.62 | 0.63 | 8 |
| LAB182 | 30455.2 | — | — | — | 0.74 | 0.58 | 30 |
| LAB191 | 28152.1 | — | — | — | 0.60 | 0.75 | 4 |
| LAB191 | 28153.2 | — | — | — | 0.61 | 0.51 | 6 |
| LAB191 | 28156.2 | 3.77 | 0.02 | 18 | 0.63 | 0.26 | 10 |
| LAB221 | 30122.2 | 3.63 | 0.14 | 13 | 0.63 | 0.25 | 10 |
| LAB221 | 30124.2 | 3.57 | 0.66 | 12 | 0.65 | 0.25 | 14 |
| LAB221 | 30125.2 | 3.70 | 0.50 | 16 | 0.64 | 0.58 | 12 |
| LAB222 | 30472.2 | 3.50 | 0.34 | 9 | 0.60 | 0.31 | 5 |
| LAB222 | 30473.1 | — | — | — | 0.85 | 0.49 | 48 |
| LAB222 | 30474.1 | — | — | — | 0.88 | 0.47 | 55 |
| LAB222 | 30476.1 | — | — | — | 0.75 | 0.46 | 31 |
| LAB222 | 30476.2 | 3.29 | 0.62 | 3 | 0.60 | 0.25 | 6 |
| LAB225 | 30492.2 | 3.47 | 0.17 | 9 | 0.61 | 0.21 | 6 |
| LAB225 | 30493.1 | 3.80 | 0.09 | 19 | 0.66 | 0.30 | 15 |
| LAB225 | 30493.2 | 3.49 | 0.32 | 9 | 0.64 | 0.40 | 12 |
| LAB232 | 30461.5 | 3.25 | 0.89 | 2 | — | — | — |
| LAB232 | 30462.4 | 3.82 | 0.01 | 19 | 0.66 | 0.01 | 16 |
| LAB232 | 30463.2 | 3.22 | 0.97 | 1 | — | — | — |
| LAB260 | 30071.4 | 3.52 | 0.69 | 10 | 0.64 | 0.56 | 12 |
| LAB260 | 30073.2 | 3.55 | 0.32 | 11 | 0.61 | 0.14 | 7 |
| LAB260 | 30073.4 | 3.62 | 0.05 | 13 | 0.62 | 0.13 | 9 |
| LAB260 | 30074.3 | 3.41 | 0.41 | 6 | — | — | — |
| LAB264 | 30131.1 | — | — | — | 0.74 | 0.57 | 29 |
| LAB264 | 30133.2 | 3.77 | 0.15 | 18 | 0.64 | 0.03 | 11 |
| LAB264 | 30134.4 | 3.56 | 0.37 | 11 | 0.58 | 0.70 | 2 |
| LAB264 | 30135.2 | — | — | — | 0.63 | 0.22 | 10 |
| LAB290_H0 | 30661.2 | — | — | — | 0.67 | 0.39 | 18 |
| LAB303 | 30421.3 | 3.32 | 0.74 | 4 | — | — | — |
| LAB307 | 30761.1 | 3.20 | 0.99 | 0 | — | — | — |
| LAB307 | 30763.3 | 3.73 | 0.04 | 17 | 0.58 | 0.65 | 2 |
| LAB307 | 30764.1 | 3.34 | 0.72 | 5 | — | — | — |
| LAB308 | 30931.4 | 3.65 | 0.03 | 14 | 0.60 | 0.43 | 5 |
| LAB308 | 30932.3 | 3.50 | 0.61 | 9 | 0.63 | 0.52 | 11 |
| LAB308 | 30933.3 | — | — | — | 0.58 | 0.93 | 1 |
| LAB319 | 30775.4 | 3.52 | 0.48 | 10 | 0.65 | 0.05 | 14 |
| LAB320 | 30601.2 | — | — | — | 0.85 | 0.49 | 48 |
| LAB320 | 30602.2 | 3.49 | 0.50 | 9 | 0.61 | 0.67 | 6 |
| LAB320 | 30605.1 | — | — | — | 0.61 | 0.86 | 6 |
| LAB343 | 30622.2 | — | — | — | 0.59 | 0.77 | 3 |
| LAB343 | 30622.4 | 3.33 | 0.62 | 4 | 0.58 | 0.84 | 1 |
| LAB343 | 30623.3 | — | — | — | 0.63 | 0.59 | 10 |
| LAB343 | 30623.5 | — | — | — | 0.73 | 0.62 | 28 |
| LAB353 | 30554.2 | 3.44 | 0.19 | 8 | — | — | — |
| LAB353 | 30554.3 | 3.58 | 0.36 | 12 | 0.63 | 0.48 | 10 |
| cont | — | 3.20 | — | 0 | 0.57 | — | 0 |
| LAB182 | 30451.3 | 5.32 | 0.02 | 22 | — | — | — |
| LAB182 | 30453.1 | 4.65 | 0.53 | 7 | 0.80 | 0.65 | 2 |
| LAB182 | 30453.4 | — | — | — | 0.90 | 0.71 | 15 |
| LAB182 | 30454.2 | — | — | — | 0.83 | 0.82 | 7 |
| LAB191 | 28153.1 | 4.53 | 0.66 | 4 | — | — | — |
| LAB191 | 28156.2 | 4.46 | 0.78 | 2 | — | — | — |
| LAB191 | 28156.4 | — | — | — | 0.98 | 0.53 | 25 |
| LAB221 | 30122.2 | 4.90 | 0.17 | 13 | — | — | — |
| LAB221 | 30123.2 | 4.54 | 0.68 | 4 | — | — | — |
| LAB221 | 30124.3 | — | — | — | 1.04 | 0.12 | 33 |
| LAB221 | 30124.4 | — | — | — | 0.95 | 0.64 | 21 |
| LAB221 | 30125.2 | 4.58 | 0.81 | 5 | — | — | — |
| LAB222 | 30472.1 | — | — | — | 0.91 | 0.37 | 16 |
| LAB222 | 30472.2 | 5.00 | 0.18 | 15 | — | — | — |
| LAB222 | 30473.1 | 5.04 | 0.19 | 16 | — | — | — |
| LAB222 | 30474.1 | 4.57 | 0.57 | 5 | — | — | — |
| LAB222 | 30476.1 | — | — | — | 1.01 | 0.58 | 29 |
| LAB222 | 30476.2 | — | — | — | 1.01 | 0.48 | 29 |
| LAB225 | 30491.4 | 5.39 | 0.02 | 24 | 0.79 | 0.80 | 1 |
| LAB225 | 30492.1 | 4.70 | 0.61 | 8 | — | — | — |
| LAB225 | 30492.2 | 5.23 | 0.13 | 20 | — | — | — |
| LAB225 | 30493.2 | — | — | — | 0.94 | 0.42 | 20 |
| LAB232 | 30462.4 | 4.36 | 0.98 | 0 | 0.86 | 0.39 | 10 |
| LAB232 | 30462.5 | — | — | — | — | — | — |
| LAB260 | 30071.4 | 5.28 | 0.03 | 21 | 0.81 | 0.30 | 4 |
| LAB260 | 30072.2 | 4.71 | 0.38 | 8 | — | — | — |
| LAB260 | 30073.2 | 4.59 | 0.53 | 6 | 0.78 | 0.97 | 0 |
| LAB260 | 30073.4 | 4.95 | 0.18 | 14 | 0.82 | 0.34 | 5 |
| LAB260 | 30074.3 | — | — | — | 0.95 | 0.42 | 21 |
| LAB264 | 30131.1 | 4.81 | 0.39 | 11 | — | — | — |
| LAB264 | 30131.2 | — | — | — | 0.90 | 0.63 | 15 |
| LAB264 | 30133.2 | — | — | — | 0.99 | 0.40 | 27 |
| LAB264 | 30135.2 | 5.54 | 0.02 | 27 | 0.84 | 0.66 | 7 |
| LAB265 | 30731.3 | — | — | — | 0.99 | 0.41 | 27 |
| LAB265 | 30732.2 | — | — | — | 0.80 | 0.93 | 2 |
| LAB265 | 30732.3 | 4.74 | 0.48 | 9 | — | — | — |
| LAB265 | 30733.4 | — | — | — | 0.90 | 0.57 | 15 |

TABLE 81-continued

Genes showing improved photosynthetic capacity at standard growth conditions

| Gene Name | Event # | Leaf Blade Area [cm2] | | | Leaf Petiole Length | | |
|---|---|---|---|---|---|---|---|
| | | Ave. | P-Val. | % incr. | Ave. | P-Val. | % incr. |
| LAB265 | 30734.1 | — | | — | 0.92 | 0.69 | 18 |
| LAB265 | 30734.4 | — | | — | 0.91 | 0.56 | 17 |
| LAB290_H0 | 30661.2 | 4.57 | 0.60 | 5 | — | | — |
| LAB290_H0 | 30662.3 | — | | — | 0.90 | 0.65 | 15 |
| LAB290_H0 | 30663.1 | 4.41 | 0.88 | 1 | — | | — |
| LAB290_H0 | 30663.3 | 5.35 | 0.03 | 23 | — | | — |
| LAB290_H0 | 30663.7 | — | | — | 1.09 | 0.42 | 39 |
| LAB307 | 30761.5 | 4.91 | 0.19 | 13 | — | | — |
| LAB307 | 30763.3 | 4.56 | 0.65 | 5 | — | | — |
| LAB307 | 30764.1 | 4.63 | 0.49 | 6 | — | | — |
| LAB307 | 30764.4 | — | | — | 0.88 | 0.65 | 12 |
| LAB308 | 30931.4 | 4.92 | 0.53 | 13 | — | | — |
| LAB308 | 30932.3 | 5.56 | 0.07 | 28 | — | | — |
| LAB308 | 30933.2 | 4.49 | 0.83 | 3 | — | | — |
| LAB308 | 30933.3 | 4.43 | 0.87 | 2 | — | | — |
| LAB308 | 30934.4 | 4.79 | 0.31 | 10 | — | | — |
| LAB319 | 30771.5 | 5.30 | 0.18 | 22 | — | | — |
| LAB319 | 30774.1 | 4.92 | 0.35 | 13 | — | | — |
| LAB319 | 30774.3 | 4.48 | 0.74 | 3 | — | | — |
| LAB319 | 30775.1 | 4.74 | 0.32 | 9 | — | | — |
| LAB319 | 30775.2 | — | | — | 0.93 | 0.68 | 18 |
| LAB319 | 30775.4 | — | | — | 0.97 | 0.42 | 24 |
| LAB320 | 30601.2 | 4.62 | 0.75 | 6 | — | | — |
| LAB320 | 30601.3 | — | | — | 0.90 | 0.55 | 15 |
| LAB320 | 30601.4 | 4.87 | 0.26 | 12 | — | | — |
| LAB320 | 30602.2 | — | | — | 0.90 | 0.64 | 14 |
| LAB320 | 30603.1 | 4.93 | 0.17 | 13 | — | | — |
| LAB320 | 30605.1 | — | | — | 0.99 | 0.39 | 27 |
| LAB343 | 30622.4 | — | | — | 0.97 | 0.20 | 24 |
| LAB343 | 30623.3 | — | | — | 0.92 | 0.72 | 17 |
| LAB343 | 30623.4 | — | | — | 0.98 | 0.58 | 24 |
| LAB343 | 30623.5 | 4.50 | 0.69 | 3 | — | | — |
| LAB348 | 30503.1 | 4.48 | 0.73 | 3 | — | | — |
| LAB348 | 30504.2 | 4.41 | 0.90 | 1 | — | | — |
| LAB348 | 30506.2 | 5.01 | 0.26 | 15 | — | | — |
| LAB353 | 30553.1 | 4.44 | 0.82 | 2 | — | | — |
| LAB353 | 30554.2 | 4.44 | 0.81 | 2 | — | | — |
| LAB353 | 30554.3 | — | | — | 1.01 | 0.60 | 28 |
| cont | — | 4.35 | — | 0 | 0.78 | — | 0 |
| LAB108 | 28501.4 | — | | — | 0.83 | 0.73 | 14 |
| LAB108 | 28504.1 | — | | — | 0.74 | 0.80 | 2 |
| LAB108 | 28505.2 | — | | — | 0.85 | 0.67 | 17 |
| LAB108 | 28505.4 | 3.86 | 0.18 | 12 | — | | — |
| LAB119 | 28411.1 | 3.76 | 0.28 | 9 | — | | — |
| LAB119 | 28415.2 | 3.52 | 0.86 | 2 | — | | — |
| LAB157 | 28142.3 | 3.74 | 0.36 | 8 | — | | — |
| LAB157 | 28144.2 | 3.54 | 0.78 | 2 | — | | — |
| LAB157 | 28146.1 | 3.65 | 0.64 | 5 | — | | — |
| LAB231 | 28582.1 | 3.54 | 0.85 | 2 | — | | — |
| LAB231 | 28583.1 | 3.62 | 0.83 | 5 | — | | — |
| LAB231 | 28585.1 | 3.55 | 0.82 | 3 | — | | — |
| LAB231 | 28585.3 | 3.96 | 0.09 | 14 | — | | — |
| LAB238 | 28422.4 | — | | — | 0.88 | 0.60 | 21 |
| LAB238 | 28422.5 | 3.50 | 0.91 | 1 | — | | — |
| LAB238 | 28424.3 | 3.48 | 0.97 | 1 | — | | — |
| LAB238 | 28424.4 | — | | — | 0.90 | 0.62 | 23 |
| LAB238 | 28425.5 | 3.69 | 0.50 | 7 | — | | — |
| LAB240 | 28592.2 | 3.83 | 0.20 | 11 | — | | — |
| LAB240 | 28592.6 | — | | — | 0.85 | 0.68 | 17 |
| LAB240 | 28595.1 | — | | — | 0.86 | 0.56 | 19 |
| LAB242 | 28081.2 | — | | — | 0.91 | 0.56 | 25 |
| LAB242 | 28083.1 | 3.47 | 0.99 | 0 | — | | — |
| LAB267 | 28383.2 | 3.52 | 0.89 | 2 | 0.73 | 0.95 | 0 |
| LAB267 | 28384.2 | 3.66 | 0.66 | 6 | — | | — |
| LAB269 | 28341.3 | 3.49 | 0.91 | 1 | — | | — |
| LAB269 | 28342.3 | 3.46 | 1.00 | 0 | — | | — |
| LAB269 | 28343.4 | 4.03 | 0.17 | 16 | 0.76 | 0.59 | 5 |
| LAB269 | 28345.2 | — | | — | 0.73 | 0.99 | 0 |
| LAB279 | 28354.1 | 3.66 | 0.48 | 6 | — | | — |
| LAB283 | 28361.1 | 3.47 | 0.98 | 0 | — | | — |
| LAB283 | 28363.3 | 3.75 | 0.76 | 8 | — | | — |
| LAB283 | 28364.3 | — | | — | 0.78 | 0.86 | 7 |
| LAB283 | 28365.1 | 3.86 | 0.17 | 12 | — | | — |
| LAB298 | 29245.2 | 3.46 | 0.99 | 0 | — | | — |
| LAB299 | 28061.1 | 3.53 | 0.92 | 2 | 0.73 | 0.98 | 0 |
| LAB299 | 28063.2 | — | | — | 0.78 | 0.78 | 7 |
| LAB299 | 28064.1 | — | | — | 0.86 | 0.63 | 18 |
| LAB299 | 28066.1 | 3.73 | 0.64 | 8 | — | | — |
| LAB336 | 28374.1 | — | | — | 0.73 | 0.92 | 1 |
| LAB339 | 27272.4 | — | | — | 0.93 | 0.63 | 28 |
| LAB345 | 28491.1 | — | | — | 0.82 | 0.77 | 13 |
| LAB58 | 28443.4 | 3.85 | 0.42 | 11 | — | | — |
| cont | — | 3.46 | — | 0 | 0.73 | — | 0 |
| LAB107 | 30533.4 | 4.46 | 0.90 | 1 | — | | — |
| LAB129 | 30824.1 | — | | — | 0.83 | 0.91 | 2 |
| LAB129 | 30825.1 | — | | — | 0.83 | 0.92 | 2 |
| LAB129 | 30825.5 | 4.56 | 0.80 | 4 | — | | — |
| LAB130 | 30541.3 | 4.96 | 0.43 | 13 | — | | — |
| LAB130 | 30542.1 | 4.53 | 0.84 | 3 | — | | — |
| LAB130 | 30544.2 | 5.28 | 0.14 | 20 | — | | — |
| LAB130 | 30545.1 | 5.52 | 0.07 | 26 | — | | — |
| LAB130 | 30545.2 | 5.01 | 0.27 | 14 | — | | — |
| LAB163 | 30831.3 | — | | — | 0.99 | 0.50 | 22 |
| LAB163 | 30832.2 | 4.78 | 0.57 | 9 | — | | — |
| LAB163 | 30833.1 | 5.20 | 0.23 | 18 | 0.84 | 0.64 | 3 |
| LAB163 | 30833.2 | — | | — | 1.00 | 0.39 | 22 |
| LAB163 | 30834.2 | — | | — | 1.27 | 0.00 | 55 |
| LAB164 | 30522.4 | — | | — | 0.93 | 0.60 | 14 |
| LAB164 | 30523.3 | 4.79 | 0.56 | 9 | — | | — |
| LAB164 | 30524.1 | 6.21 | 0.03 | 41 | — | | — |
| LAB164 | 30525.2 | — | | — | 0.91 | 0.62 | 12 |
| LAB164 | 30525.3 | — | | — | 0.90 | 0.65 | 10 |
| LAB171 | 30841.3 | — | | — | 0.95 | 0.63 | 17 |
| LAB171 | 30841.4 | 5.65 | 0.06 | 29 | — | | — |
| LAB171 | 30842.3 | — | | — | 1.09 | 0.24 | 34 |
| LAB171 | 30843.2 | — | | — | 1.12 | 0.00 | 38 |
| LAB171 | 30845.1 | — | | — | 0.93 | 0.62 | 15 |
| LAB172 | 30852.3 | 4.59 | 0.72 | 4 | — | | — |
| LAB172 | 30852.4 | — | | — | 0.83 | 0.97 | 1 |
| LAB172 | 30853.4 | — | | — | 0.85 | 0.77 | 4 |
| LAB172 | 30854.4 | 4.74 | 0.60 | 8 | — | | — |
| LAB172 | 30855.5 | 4.99 | 0.31 | 14 | — | | — |
| LAB175 | 30512.3 | — | | — | 0.94 | 0.70 | 16 |
| LAB175 | 30513.4 | — | | — | 0.83 | 0.91 | 2 |
| LAB175 | 30514.3 | 5.21 | 0.15 | 19 | — | | — |
| LAB175 | 30514.4 | 4.83 | 0.43 | 10 | — | | — |
| LAB204 | 30863.1 | 5.59 | 0.05 | 27 | — | | — |
| LAB204 | 30863.2 | 4.65 | 0.71 | 6 | — | | — |
| LAB204 | 30864.1 | 5.02 | 0.30 | 14 | — | | — |
| LAB204 | 30865.4 | — | | — | 0.89 | 0.83 | 9 |
| LAB261 | 31073.1 | 5.21 | 0.17 | 19 | — | | — |
| LAB261 | 31074.4 | — | | — | 0.93 | 0.50 | 14 |
| LAB261 | 31075.1 | 4.73 | 0.54 | 8 | — | | — |
| LAB261 | 31075.3 | 4.62 | 0.68 | 5 | — | | — |
| LAB263 | 30891.6 | 5.22 | 0.16 | 19 | — | | — |
| LAB263 | 30892.2 | 5.58 | 0.06 | 27 | — | | — |
| LAB263 | 30892.3 | 5.36 | 0.10 | 22 | — | | — |
| LAB263 | 30892.4 | — | | — | 0.94 | 0.65 | 16 |
| LAB263 | 30893.3 | — | | — | 0.82 | 0.99 | 0 |
| LAB271 | 30901.3 | 5.60 | 0.06 | 27 | — | | — |
| LAB271 | 30903.1 | 4.65 | 0.63 | 6 | — | | — |
| LAB271 | 30905.4 | 4.59 | 0.73 | 5 | — | | — |
| LAB271 | 30905.6 | 4.95 | 0.32 | 13 | — | | — |
| LAB271 | 30905.7 | 5.06 | 0.28 | 15 | — | | — |
| LAB272 | 31121.1 | — | | — | 0.87 | 0.78 | 7 |
| LAB272 | 31123.1 | — | | — | 0.99 | 0.60 | 21 |
| LAB272 | 31123.5 | 4.67 | 0.72 | 6 | — | | — |
| LAB272 | 31123.6 | 4.45 | 0.92 | 1 | — | | — |
| LAB272 | 31125.4 | 5.05 | 0.23 | 15 | — | | — |
| LAB272 | 31125.5 | — | | — | 1.12 | 0.09 | 38 |
| LAB284 | 30911.3 | — | | — | 1.07 | 0.37 | 32 |
| LAB284 | 30912.2 | — | | — | 0.93 | 0.69 | 14 |

TABLE 81-continued

Genes showing improved photosynthetic capacity at standard growth conditions

| Gene Name | Event # | Leaf Blade Area [cm2] Ave. | P-Val. | % incr. | Leaf Petiole Length Ave. | P-Val. | % incr. |
|---|---|---|---|---|---|---|---|
| LAB284 | 30913.1 | — | | — | 0.86 | 0.77 | 5 |
| LAB284 | 30913.3 | 5.13 | 0.34 | 17 | — | | — |
| LAB284 | 30914.3 | — | | — | 1.06 | 0.24 | 30 |
| LAB286 | 30921.1 | — | | — | 0.89 | 0.73 | 9 |
| LAB286 | 30922.1 | — | | — | 1.30 | 0.09 | 59 |
| LAB286 | 30922.4 | 5.57 | 0.35 | 27 | 0.83 | 0.82 | 2 |
| LAB286 | 30923.3 | — | | — | 1.04 | 0.00 | 28 |
| LAB286 | 30924.2 | — | | — | 0.86 | 0.82 | 6 |
| LAB329 | 30102.2 | — | | — | 0.90 | 0.67 | 11 |
| LAB329 | 30103.1 | — | | — | 1.03 | 0.57 | 27 |
| LAB329 | 30103.2 | 5.03 | 0.30 | 15 | — | | — |
| LAB329 | 30104.1 | — | | — | 0.97 | 0.50 | 19 |
| LAB329 | 30104.2 | — | | — | 1.21 | 0.00 | 48 |
| cont | — | 4.39 | — | 0 | 0.82 | — | 0 |
| LAB107 | 30533.1 | — | | — | 0.80 | 0.57 | 21 |
| LAB107 | 30533.4 | 4.02 | 0.55 | 10 | 0.71 | 0.63 | 7 |
| LAB107 | 30534.3 | — | | — | 0.87 | 0.32 | 30 |
| LAB107 | 30535.2 | — | | — | 0.90 | 0.50 | 35 |
| LAB121 | 30801.4 | 4.03 | 0.02 | 11 | 0.70 | 0.27 | 5 |
| LAB121 | 30802.1 | 3.81 | 0.15 | 5 | — | | — |
| LAB121 | 30802.2 | 3.96 | 0.38 | 9 | 0.69 | 0.29 | 4 |
| LAB121 | 30804.1 | 4.03 | 0.02 | 11 | 0.69 | 0.60 | 4 |
| LAB129 | 30824.2 | 3.90 | 0.33 | 7 | 0.69 | 0.81 | 4 |
| LAB129 | 30825.1 | 3.97 | 0.40 | 9 | 0.73 | 0.53 | 9 |
| LAB130 | 30541.3 | 3.69 | 0.79 | 1 | — | | — |
| LAB130 | 30544.2 | — | | — | 1.11 | 0.18 | 67 |
| LAB130 | 30545.1 | — | | — | 0.99 | 0.41 | 49 |
| LAB130 | 30545.2 | 3.80 | 0.24 | 4 | — | | — |
| LAB163 | 30831.3 | 3.66 | 0.91 | 1 | — | | — |
| LAB163 | 30833.2 | 3.89 | 0.23 | 7 | 0.69 | 0.73 | 3 |
| LAB163 | 30834.2 | — | | — | 0.71 | 0.59 | 6 |
| LAB164 | 30522.4 | 3.69 | 0.65 | 1 | — | | — |
| LAB164 | 30524.1 | 4.04 | 0.09 | 11 | 0.69 | 0.28 | 4 |
| LAB164 | 30525.2 | 4.27 | 0.00 | 17 | 0.70 | 0.16 | 6 |
| LAB164 | 30525.3 | — | | — | 0.67 | 0.96 | 1 |
| LAB171 | 30841.3 | — | | — | 0.88 | 0.48 | 32 |
| LAB171 | 30842.4 | 4.29 | 0.25 | 18 | 0.75 | 0.01 | 13 |
| LAB171 | 30843.2 | 4.21 | 0.09 | 16 | 0.68 | 0.52 | 2 |
| LAB171 | 30845.1 | 4.28 | 0.04 | 18 | 0.74 | 0.03 | 11 |
| LAB172 | 30852.3 | — | | — | 0.68 | 0.80 | 2 |
| LAB172 | 30853.4 | — | | — | 0.69 | 0.47 | 3 |
| LAB175 | 30513.4 | — | | — | 0.86 | 0.60 | 28 |
| LAB175 | 30514.4 | 3.91 | 0.05 | 7 | — | | — |
| LAB204 | 30862.3 | — | | — | 0.82 | 0.37 | 24 |
| LAB204 | 30863.1 | 4.16 | 0.22 | 14 | 0.70 | 0.28 | 5 |
| LAB204 | 30864.1 | — | | — | 0.76 | 0.04 | 14 |
| LAB204 | 30865.4 | 3.64 | 0.98 | 0 | 0.72 | 0.54 | 8 |
| LAB261 | 31074.2 | — | | — | 0.85 | 0.49 | 28 |
| LAB261 | 31074.4 | — | | — | 0.90 | 0.45 | 35 |
| LAB261 | 31075.1 | — | | — | 0.94 | 0.46 | 42 |
| LAB261 | 31075.3 | — | | — | 0.92 | 0.40 | 38 |
| LAB263 | 30891.6 | 4.19 | 0.29 | 15 | 0.76 | 0.05 | 15 |
| LAB263 | 30892.2 | 4.36 | 0.10 | 20 | 0.74 | 0.02 | 12 |
| LAB263 | 30892.3 | 4.42 | 0.01 | 21 | 0.77 | 0.01 | 15 |
| LAB263 | 30892.4 | — | | — | 0.97 | 0.48 | 46 |
| LAB263 | 30893.3 | 4.05 | 0.10 | 11 | 0.70 | 0.35 | 5 |
| LAB271 | 30901.3 | 3.65 | 0.98 | 0 | — | | — |
| LAB271 | 30901.4 | 3.68 | 0.68 | 1 | — | | — |
| LAB271 | 30905.4 | — | | — | 1.05 | 0.01 | 58 |
| LAB271 | 30905.6 | — | | — | 0.83 | 0.51 | 24 |
| LAB271 | 30905.7 | 4.12 | 0.01 | 13 | — | | — |
| LAB272 | 31121.1 | 4.44 | 0.03 | 22 | 0.76 | 0.07 | 14 |
| LAB272 | 31123.1 | — | | — | 0.67 | 0.95 | 0 |
| LAB272 | 31123.6 | — | | — | 0.88 | 0.42 | 32 |
| LAB272 | 31125.4 | 4.11 | 0.06 | 13 | 0.70 | 0.18 | 6 |
| LAB284 | 30912.2 | — | | — | 0.93 | 0.35 | 40 |
| LAB284 | 30913.1 | 3.64 | 1.00 | 0 | — | | — |
| LAB284 | 30913.3 | 3.71 | 0.50 | 2 | — | | — |
| LAB286 | 30921.1 | — | | — | 0.83 | 0.66 | 24 |
| LAB286 | 30922.1 | — | | — | 0.67 | 0.88 | 1 |
| LAB286 | 30923.3 | — | | — | 0.92 | 0.48 | 39 |
| LAB286 | 30924.3 | 4.20 | 0.34 | 15 | 0.69 | 0.42 | 3 |
| LAB329 | 30102.3 | 3.87 | 0.09 | 6 | — | | — |
| LAB329 | 30103.2 | — | | — | 0.73 | 0.41 | 9 |
| cont | — | 3.64 | — | 0 | 0.67 | — | 0 |
| LAB235 | 31324.1 | — | | — | 0.75 | 0.68 | 2 |
| LAB342 | 31705.6 | 5.06 | | 7 | 0.76 | | 4 |
| LAB56 | 31451.3 | 4.88 | 0.90 | 3 | 0.74 | 0.90 | 1 |
| LAB56 | 31455.1 | 5.63 | | 19 | 0.74 | | 0 |
| LAB97 | 31306.4 | 4.76 | 0.96 | 0 | — | | — |
| cont | — | 4.75 | — | 0 | 0.74 | — | 0 |

Table 81.
"CONT."—Control;
"Ave."—Average;
"% Incr." = % increment;
"p-val."—p-value.

TABLE 82

Genes showing improved plant photosynthetic capacity at standard growth conditions

| Gene Name | Event # | Petiole Relative Area [%] Ave. | P-Val. | % Iincr. |
|---|---|---|---|---|
| LAB113 | 28543.2 | 7.98062 | 0.278957 | 13.9043 |
| LAB113 | 28543.5 | 7.45111 | 0.10366 | 6.3468 |
| LAB113 | 28543.1 | 7.14967 | 0.456996 | 2.0445 |
| LAB113 | 28545.3 | 7.02741 | 0.942192 | 0.2995 |
| LAB131 | 28292.3 | 7.6813 | 0.359033 | 9.6323 |
| LAB131 | 28291.1 | 7.4516 | 0.066786 | 6.3539 |
| LAB131 | 28293.3 | 7.25934 | 0.669977 | 3.6098 |
| LAB145 | 28555.1 | 8.51246 | 0.128034 | 21.4951 |
| LAB145 | 28553.2 | 8.37815 | 0.292131 | 19.5782 |
| LAB145 | 28551.3 | 7.70377 | 0.477319 | 9.953 |
| LAB145 | 28551.1 | 7.49337 | 0.074499 | 6.95 |
| LAB152 | 28473.3 | 8.05143 | 0.017053 | 14.9151 |
| LAB152 | 28474.4 | 7.00754 | 0.99875 | 0.016 |
| LAB153 | 28304.1 | 7.35801 | 0.317319 | 5.0181 |
| LAB153 | 28303.1 | 7.33803 | 0.189909 | 4.7329 |
| LAB153 | 28301.2 | 7.23765 | 0.640757 | 3.3002 |
| LAB169 | 28394.3 | 7.31563 | 0.337051 | 4.4132 |
| LAB169 | 28392.1 | 7.08658 | 0.715911 | 1.1441 |
| LAB169 | 28391.1 | 7.07968 | 0.756695 | 1.0456 |
| LAB181 | 28484.3 | 7.44245 | 0.694823 | 6.2233 |
| LAB181 | 28482.2 | 7.27612 | 0.206427 | 3.8493 |
| LAB187 | 28431.5 | 8.23133 | 0.021545 | 17.4826 |
| LAB187 | 28435.3 | 7.26708 | 0.601566 | 3.7203 |
| LAB187 | 28434.1 | 7.0069 | 0.999476 | 0.0068 |
| LAB213 | 28565.2 | 7.30354 | 0.421587 | 4.2407 |
| LAB230 | 28571.6 | 8.20812 | 0.077672 | 17.1514 |
| LAB247 | 28091.4 | 7.90287 | 0.425192 | 12.7946 |
| LAB247 | 28093.2 | 7.82055 | 0.097038 | 11.6198 |
| LAB247 | 28095.4 | 7.26388 | 0.761933 | 3.6746 |
| LAB249 | 28605.2 | 7.71662 | 0.008597 | 10.1364 |
| LAB249 | 28602.1 | 7.48074 | 0.442254 | 6.7698 |
| LAB249 | 28603.3 | 7.07599 | 0.737593 | 0.9929 |
| LAB258 | 27442.2 | 7.10788 | 0.608239 | 1.4481 |
| LAB258 | 27442.5 | 7.10455 | 0.763681 | 1.4005 |
| LAB258 | 27441.4 | 7.1009 | 0.823418 | 1.3485 |
| LAB258 | 27444.4 | 7.07091 | 0.8456 | 0.9205 |
| LAB294 | 28402.5 | 8.02805 | 0.204684 | 14.5814 |
| LAB294 | 28401.3 | 7.99793 | 0.613786 | 14.1514 |
| LAB294 | 28404.3 | 7.73641 | 0.328497 | 10.4188 |
| LAB294 | 28405.1 | 7.28718 | 0.66179 | 4.0072 |
| LAB70 | 28463.1 | 8.49517 | 0.256065 | 21.2484 |
| LAB70 | 28463.3 | 8.36234 | 0.255145 | 19.3525 |
| LAB70 | 28461.2 | 7.38144 | 0.511757 | 5.3525 |

TABLE 82-continued

Genes showing improved plant photosynthetic capacity at standard growth conditions

| Gene Name | Event # | Petiole Relative Area [%] | | |
|---|---|---|---|---|
| | | Ave. | P-Val. | % Iincr. |
| LAB70 | 28464.3 | 7.26474 | 0.81677 | 3.6869 |
| LAB74 | 28451.3 | 8.00424 | 0.298348 | 14.2415 |
| LAB74 | 28452.4 | 7.74765 | 0.439369 | 10.5793 |
| LAB74 | 28453.5 | 7.16176 | 0.844307 | 2.2171 |
| LAB74 | 28452.2 | 7.11501 | 0.781213 | 1.5498 |
| LAB81 | 28531.1 | 8.5585 | 0.199179 | 22.1522 |
| LAB81 | 28534.4 | 7.83313 | 0.022119 | 11.7993 |
| LAB81 | 28531.2 | 7.41755 | 0.060135 | 5.8679 |
| LAB88 | 28191.3 | 7.60969 | 0.140552 | 8.6102 |
| LAB88 | 28193.6 | 7.44446 | 0.43856 | 6.252 |
| LAB88 | 28192.6 | 7.20735 | 0.313326 | 2.8678 |
| control | — | 7.00642 | — | 0 |
| LAB113 | 28545.3 | 7.46166 | 0.590319 | 9.8478 |
| LAB113 | 28543.2 | 7.37697 | 0.463747 | 8.6009 |
| LAB113 | 28545.2 | 7.0642 | 0.301909 | 3.9965 |
| LAB113 | 28543.5 | 7.06034 | 0.56472 | 3.9397 |
| LAB131 | 28295.3 | 8.11143 | 0.244834 | 19.4135 |
| LAB131 | 28292.3 | 7.55083 | 0.327997 | 11.1604 |
| LAB131 | 28293.3 | 7.38951 | 0.000123 | 8.7856 |
| LAB131 | 28294.2 | 6.83141 | 0.913128 | 0.5695 |
| LAB145 | 28553.2 | 7.90418 | 0.188336 | 16.3623 |
| LAB145 | 28551.3 | 7.36087 | 0.314075 | 8.3639 |
| LAB145 | 28551.1 | 7.28191 | 0.314991 | 7.2015 |
| LAB145 | 28553.3 | 7.03393 | 0.597888 | 3.5508 |
| LAB152 | 28473.3 | 7.4451 | 0.339272 | 9.604 |
| LAB152 | 28473.2 | 7.24908 | 0.460332 | 6.7183 |
| LAB153 | 28303.1 | 7.05993 | 0.427412 | 3.9336 |
| LAB153 | 28302.2 | 7.00446 | 0.512166 | 3.117 |
| LAB153 | 28305.3 | 6.96256 | 0.802207 | 2.5001 |
| LAB169 | 28392.1 | 7.87538 | 0.001157 | 15.9384 |
| LAB169 | 28391.1 | 7.11697 | 0.755109 | 4.7733 |
| LAB169 | 28393.2 | 7.09577 | 0.235786 | 4.4612 |
| LAB169 | 28394.3 | 6.86018 | 0.848285 | 0.9929 |
| LAB181 | 28484.3 | 7.83845 | 0.455213 | 15.3948 |
| LAB181 | 28482.3 | 7.42948 | 0.121445 | 9.3741 |
| LAB187 | 28435.4 | 6.98279 | 0.823903 | 2.798 |
| LAB187 | 28435.3 | 6.96662 | 0.14054 | 2.56 |
| LAB187 | 28433.3 | 6.79637 | 0.994087 | 0.0536 |
| LAB213 | 28565.2 | 8.03905 | 0.363448 | 18.3479 |
| LAB213 | 28561.2 | 7.36834 | 0.000185 | 8.474 |
| LAB213 | 28562.6 | 7.10328 | 0.39058 | 4.5718 |
| LAB230 | 28574.3 | 7.45403 | 0.314253 | 9.7354 |
| LAB230 | 28572.2 | 7.41814 | 0.000079 | 9.2072 |
| LAB230 | 28574.2 | 6.98884 | 0.833048 | 2.8871 |
| LAB230 | 28571.6 | 6.84734 | 0.924674 | 0.804 |
| LAB247 | 28093.2 | 7.0748 | 0.650774 | 4.1526 |
| LAB247 | 28094.3 | 6.84085 | 0.842416 | 0.7084 |
| LAB249 | 28605.2 | 7.92741 | 0.348775 | 16.7043 |
| LAB249 | 28602.1 | 7.77099 | 0.52817 | 14.4016 |
| LAB249 | 28603.3 | 7.2535 | 0.384643 | 6.7833 |
| LAB258 | 27442.5 | 8.33578 | 0.000004 | 22.7162 |
| LAB258 | 27444.4 | 7.51 | 0.646589 | 10.5595 |
| LAB258 | 27441.6 | 7.16839 | 0.378713 | 5.5304 |
| LAB294 | 28402.4 | 7.24055 | 0.190173 | 6.5926 |
| LAB294 | 28405.1 | 7.17649 | 0.205259 | 5.6495 |
| LAB294 | 28404.1 | 7.06991 | 0.580217 | 4.0806 |
| LAB70 | 28463.1 | 8.51786 | 0.24367 | 25.3968 |
| LAB70 | 28463.3 | 7.83492 | 0.037298 | 15.3427 |
| LAB70 | 28464.3 | 6.85344 | 0.845549 | 0.8937 |
| LAB74 | 28452.3 | 8.12914 | 0.000794 | 19.6742 |
| LAB74 | 28454.1 | 7.0589 | 0.667342 | 3.9184 |
| LAB74 | 28451.3 | 6.88129 | 0.914628 | 1.3038 |
| LAB74 | 28453.5 | 6.96605 | | 2.5515 |
| LAB81 | 28531.3 | 8.12476 | 0.226209 | 19.6096 |
| LAB81 | 28534.4 | 7.15545 | 0.455244 | 5.3398 |
| LAB81 | 28533.4 | 6.91277 | 0.532147 | 1.7672 |
| LAB88 | 28193.6 | 7.99327 | 0 | 17.674 |
| LAB88 | 28192.3 | 7.98408 | 0.023291 | 17.5386 |
| LAB88 | 28191.3 | 7.53339 | 0.000016 | 10.9038 |
| LAB88 | 28192.4 | 7.08744 | 0.018188 | 4.3386 |
| control | — | 6.79273 | — | 0 |
| LAB108 | 28502.2 | 7.54765 | 0.09214 | 10.0517 |
| LAB108 | 28501.4 | 6.91828 | 0.91909 | 0.8749 |
| LAB108 | 28505.4 | 6.91589 | 0.905983 | 0.84 |
| LAB119 | 28415.2 | 7.46446 | 0.46074 | 8.8387 |
| LAB119 | 28413.1 | 7.25301 | 0.030132 | 5.7555 |
| LAB119 | 28414.1 | 6.97971 | 0.453147 | 1.7706 |
| LAB157 | 28142.3 | 7.93742 | 0.247455 | 15.7348 |
| LAB157 | 28144.2 | 7.84112 | 0.198286 | 14.3308 |
| LAB157 | 28146.2 | 7.56316 | 0.172555 | 10.2777 |
| LAB157 | 28146.1 | 7.11808 | 0.750659 | 3.7881 |
| LAB231 | 28582.1 | 7.71157 | 0.024068 | 12.4417 |
| LAB231 | 28583.1 | 7.42706 | 0.318636 | 8.2933 |
| LAB231 | 28585.1 | 7.24339 | 0.779202 | 5.6153 |
| LAB231 | 28585.3 | 7.24041 | 0.415884 | 5.5718 |
| LAB238 | 28425.5 | 7.19562 | 0.803531 | 4.9188 |
| LAB238 | 28424.4 | 7.06921 | 0.433806 | 3.0755 |
| LAB238 | 28422.4 | 6.88583 | 0.954895 | 0.4017 |
| LAB240 | 28592.6 | 8.31363 | 0.170199 | 21.2204 |
| LAB240 | 28595.3 | 7.98081 | 0.278811 | 16.3675 |
| LAB240 | 28592.3 | 7.32441 | 0.122222 | 6.7966 |
| LAB240 | 28595.1 | 7.04299 | 0.607475 | 2.6932 |
| LAB242 | 28083.1 | 6.93176 | 0.943638 | 1.0714 |
| LAB242 | 28085.1 | 6.86726 | 0.956176 | 0.1309 |
| LAB267 | 28384.2 | 7.93731 | 0.061102 | 15.7333 |
| LAB267 | 28381.2 | 7.02544 | 0.778374 | 2.4373 |
| LAB269 | 28343.4 | 7.99616 | 0.501317 | 16.5913 |
| LAB269 | 28345.2 | 7.60379 | 0.391967 | 10.8703 |
| LAB269 | 28345.3 | 7.29771 | 0.532066 | 6.4073 |
| LAB279 | 28355.4 | 8.4187 | 0.455988 | 22.7523 |
| LAB279 | 28351.1 | 8.127 | 0.232728 | 18.4991 |
| LAB279 | 28354.1 | 7.93888 | 0.212976 | 15.7562 |
| LAB279 | 28351.4 | 7.76775 | 0.589044 | 13.2608 |
| LAB279 | 28353.2 | 7.29016 | 0.262344 | 6.2972 |
| LAB283 | 28365.1 | 7.99612 | 0.192906 | 16.5908 |
| LAB283 | 28364.3 | 7.36556 | 0.357434 | 7.3966 |
| LAB283 | 28363.3 | 7.03719 | 0.77743 | 2.6086 |
| LAB298 | 29245.4 | 7.89226 | 0.184975 | 15.0763 |
| LAB299 | 28061.1 | 7.50033 | 0.10347 | 9.3617 |
| LAB299 | 28063.1 | 7.19332 | 0.650359 | 4.8853 |
| LAB299 | 28064.1 | 6.99018 | 0.830888 | 1.9232 |
| LAB299 | 28063.2 | 6.94913 | 0.614042 | 1.3246 |
| LAB302 | 28822.7 | 7.30391 | 0.430813 | 6.4977 |
| LAB302 | 28825.2 | 7.23081 | 0.567208 | 5.4318 |
| LAB302 | 28825.1 | 7.10885 | 0.772829 | 3.6536 |
| LAB302 | 28822.6 | 6.86727 | 0.955226 | 0.1311 |
| LAB336 | 28373.5 | 7.73367 | 0.137226 | 12.764 |
| LAB336 | 28374.1 | 7.44779 | 0.410843 | 8.5956 |
| LAB336 | 28374.3 | 7.16931 | 0.183279 | 4.5351 |
| LAB336 | 28375.1 | 6.86384 | 0.993397 | 0.081 |
| LAB339 | 27271.5 | 7.66287 | 0.03073 | 11.7317 |
| LAB345 | 28491.1 | 7.6385 | 0.538249 | 11.3763 |
| LAB345 | 28495.1 | 7.63124 | 0.257073 | 11.2705 |
| LAB345 | 28495.4 | 7.51299 | 0.582663 | 9.5462 |
| LAB345 | 28494.1 | 7.36186 | 0.69296 | 7.3427 |
| LAB345 | 28492.2 | 7.3612 | 0.017478 | 7.3331 |
| LAB58 | 28443.2 | 7.86518 | 0.163986 | 14.6816 |
| LAB58 | 28441.2 | 7.43972 | 0.265129 | 8.4779 |
| LAB58 | 28442.1 | 6.925 | 0.911354 | 0.9728 |
| control | — | 6.85828 | — | 0 |
| LAB133 | 28833.2 | 9.58822 | 0.537517 | 10.3724 |
| LAB133 | 28832.1 | 9.41595 | 0.781979 | 8.3894 |
| LAB160 | 29315.3 | 10.284 | 0.155604 | 18.3815 |
| LAB162 | 29341.2 | 10.6965 | 0.012427 | 23.1296 |
| LAB162 | 29342.6 | 10.3737 | 0.451784 | 19.4142 |
| LAB185 | 28174.2 | 10.4955 | 0.33613 | 20.8166 |
| LAB185 | 28175.3 | 9.68648 | 0.126732 | 11.5036 |
| LAB293 | 29235.1 | 10.8784 | 0.370018 | 25.2237 |
| LAB293 | 29233.2 | 10.2808 | 0.515484 | 18.3445 |
| LAB293 | 29235.4 | 8.83379 | 0.899578 | 1.688 |
| LAB310 | 28182.3 | 9.56875 | 0.721038 | 10.1483 |
| LAB310 | 28181.3 | 9.00286 | 0.875122 | 3.6342 |
| LAB318 | 28104.3 | 10.2771 | 0.026328 | 18.3021 |
| LAB327 | 29225.2 | 10.9802 | 0.001004 | 26.3961 |
| LAB327 | 29221.6 | 9.9744 | 0.057057 | 14.8178 |
| LAB327 | 29225.3 | 9.72807 | 0.427578 | 11.9823 |

TABLE 82-continued

Genes showing improved plant photosynthetic capacity at standard growth conditions

| Gene Name | Event # | Petiole Relative Area [%] Ave. | P-Val. | % Iincr. |
|---|---|---|---|---|
| LAB327 | 29224.2 | 9.42856 | 0.647012 | 8.5346 |
| LAB335 | 27315.4 | 13.2348 | 0.085929 | 52.3492 |
| LAB335 | 27314.2 | 9.22394 | 0.873537 | 6.1791 |
| LAB335 | 27314.1 | 9.05315 | 0.889643 | 4.2131 |
| LAB54 | 28133.1 | 10.7429 | 0.239276 | 23.6646 |
| LAB54 | 28136.1 | 9.5965 | 0.449421 | 10.4677 |
| LAB68 | 29335.1 | 11.475 | 0.004708 | 32.0913 |
| LAB68 | 29332.3 | 9.55039 | 0.413777 | 9.9369 |
| LAB68 | 29332.4 | 9.46768 | 0.434927 | 8.9848 |
| LAB68 | 29331.6 | 8.97118 | 0.545456 | 3.2695 |
| LAB73 | 30152.2 | 11.8137 | 0.00027 | 35.9901 |
| LAB73 | 30153.1 | 10.7351 | 0.165875 | 23.5747 |
| LAB73 | 30151.1 | 9.02288 | 0.819217 | 3.8646 |
| control | — | 8.68715 | — | 0 |
| LAB102 | 30313.3 | 12.1096 | 0.685163 | 9.222 |
| LAB102 | 30312.2 | 12.0623 | 0.076608 | 8.7958 |
| LAB102 | 30313.1 | 11.7956 | 0.304634 | 6.3903 |
| LAB102 | 30314.3 | 11.3871 | 0.855008 | 2.7057 |
| LAB126 | 30201.3 | 11.6537 | 0.765412 | 5.1101 |
| LAB165 | 30233.1 | 11.6553 | 0.47978 | 5.1249 |
| LAB165 | 30232.1 | 11.1768 | 0.960804 | 0.8088 |
| LAB167 | 27321.2 | 13.3278 | 0.000847 | 20.2097 |
| LAB167 | 27321.4 | 12.5689 | 0.755601 | 13.3653 |
| LAB167 | 27324.1 | 11.1389 | 0.934309 | 0.467 |
| LAB220 | 30323.1 | 13.0676 | 0.29219 | 17.8633 |
| LAB220 | 30321.4 | 12.6513 | 0.172951 | 14.1086 |
| LAB220 | 30324.4 | 12.0724 | 0.201449 | 8.8865 |
| LAB220 | 30322.2 | 11.5985 | 0.770699 | 4.6124 |
| LAB241 | 30212.1 | 12.52 | 0.555519 | 12.9243 |
| LAB268 | 30393.1 | 12.0864 | 0.627391 | 9.0129 |
| LAB268 | 30391.4 | 12.0659 | 0.095853 | 8.8286 |
| LAB268 | 30395.1 | 11.5543 | 0.885137 | 4.2141 |
| LAB268 | 30392.1 | 11.4034 | 0.54907 | 2.8529 |
| LAB280 | 30042.1 | 13.8739 | 0.034441 | 25.1358 |
| LAB280 | 30044.1 | 12.1454 | 0.270401 | 9.5449 |
| LAB280 | 30045.1 | 11.601 | 0.810246 | 4.6348 |
| LAB280 | 30041.2 | 11.1311 | 0.948844 | 0.397 |
| LAB289 | 30371.6 | 13.7125 | 0.042999 | 23.6796 |
| LAB289 | 30373.1 | 12.5 | 0.644712 | 12.7432 |
| LAB289 | 30373.2 | 11.9043 | 0.41115 | 7.371 |
| LAB289 | 30371.4 | 11.4087 | 0.794748 | 2.9008 |
| LAB311 | 30223.4 | 14.1456 | 0.000055 | 27.5859 |
| LAB311 | 30221.4 | 12.9939 | 0.239111 | 17.1984 |
| LAB311 | 30223.2 | 12.5326 | 0.016209 | 13.0379 |
| LAB311 | 30222.2 | 12.4277 | 0.434404 | 12.0916 |
| LAB311 | 30224.2 | 12.0906 | 0.740848 | 9.0515 |
| LAB344 | 30096.1 | 12.2401 | 0.140402 | 10.3995 |
| LAB355 | 29281.3 | 14.7051 | 0.128284 | 32.6324 |
| LAB355 | 29283.1 | 13.3238 | 0.020384 | 20.1736 |
| LAB355 | 29282.3 | 12.0076 | 0.109145 | 8.3027 |
| LAB355 | 29282.1 | 11.0889 | 0.999363 | 0.0158 |
| LAB367 | 30171.3 | 12.4216 | 0.021132 | 12.0366 |
| LAB367 | 30173.1 | 11.5633 | 0.635994 | 4.2947 |
| LAB367 | 30173.3 | 11.5359 | 0.587105 | 4.0479 |
| LAB367 | 30172.3 | 11.1908 | 0.851612 | 0.9357 |
| LAB381 | 30352.4 | 12.7297 | 0.399202 | 14.8157 |
| LAB381 | 30351.4 | 11.6619 | 0.458782 | 5.1847 |
| LAB383 | 28115.1 | 12.1477 | 0.79668 | 9.5662 |
| LAB383 | 28115.2 | 11.713 | 0.858197 | 5.6453 |
| LAB383 | 28111.4 | 11.438 | 0.660641 | 3.1649 |
| LAB64 | 30271.2 | 13.0866 | 0.153358 | 18.0349 |
| LAB64 | 30274.2 | 11.8343 | 0.550596 | 6.7397 |
| LAB64 | 30273.2 | 11.7842 | 0.748365 | 6.2877 |
| LAB64 | 30272.1 | 11.1814 | 0.858126 | 0.8509 |
| LAB65 | 30304.3 | 13.192 | 0.001263 | 18.9848 |
| LAB65 | 30303.4 | 12.2696 | 0.179344 | 10.6657 |
| control | — | 11.0871 | — | 0 |
| LAB138 | 30781.1 | 11.5462 | 0.006045 | 14.7066 |
| LAB138 | 30783.2 | 11.3944 | 0.109005 | 13.1985 |
| LAB138 | 30781.5 | 11.3793 | 0.407334 | 13.048 |
| LAB159 | 30702.4 | 12.0711 | 0.019773 | 19.9204 |
| LAB159 | 30704.4 | 10.1666 | 0.914431 | 1.0006 |
| LAB161 | 30482.2 | 12.1902 | 0.172321 | 21.1039 |
| LAB161 | 30485.1 | 12.1555 | 0.29444 | 20.7598 |
| LAB161 | 30486.1 | 10.4297 | 0.475648 | 3.614 |
| LAB161 | 30483.1 | 10.3924 | 0.499107 | 3.2434 |
| LAB166 | 30243.1 | 11.559 | 0.56325 | 14.8331 |
| LAB166 | 30245.3 | 11.1425 | 0.290704 | 10.6958 |
| LAB170 | 30713.2 | 13.531 | 0.239103 | 34.4241 |
| LAB170 | 30715.1 | 13.3016 | 0.132577 | 32.145 |
| LAB170 | 30712.2 | 11.3409 | 0.127311 | 12.6671 |
| LAB170 | 30712.1 | 10.4582 | 0.899836 | 3.8979 |
| LAB176 | 30142.1 | 12.9879 | 0.000064 | 29.0292 |
| LAB176 | 30141.4 | 11.5498 | 0.589522 | 14.7425 |
| LAB176 | 30143.1 | 10.4412 | 0.770084 | 3.7286 |
| LAB188 | 30722.2 | 10.7732 | 0.817207 | 7.0269 |
| LAB188 | 30724.1 | 10.6352 | 0.821024 | 5.6564 |
| LAB188 | 30724.2 | 10.3425 | 0.878745 | 2.748 |
| LAB188 | 30723.7 | 10.2226 | 0.883254 | 1.5569 |
| LAB237 | 30282.1 | 11.5203 | 0.445153 | 14.4488 |
| LAB237 | 30283.4 | 11.5165 | 0.556658 | 14.4108 |
| LAB237 | 30283.2 | 10.5673 | 0.613656 | 4.9817 |
| LAB237 | 30281.4 | 10.5223 | 0.732498 | 4.5344 |
| LAB259 | 27112.12 | 10.8421 | 0.784701 | 7.7112 |
| LAB259 | 27112.3 | 10.5324 | 0.734278 | 4.6351 |
| LAB259 | 27112.14 | 10.4897 | 0.805308 | 4.2107 |
| LAB259 | 27112.9 | 10.2868 | 0.798326 | 2.1945 |
| LAB259 | 27112.7 | 10.2082 | 0.904995 | 1.4143 |
| LAB262 | 30611.4 | 14.187 | 0.004993 | 40.9415 |
| LAB262 | 30614.2 | 11.8035 | 0.569138 | 17.2624 |
| LAB262 | 30612.1 | 11.2713 | 0.141824 | 11.9754 |
| LAB270 | 30594.1 | 11.872 | 0.001823 | 17.9432 |
| LAB270 | 30594.3 | 11.8335 | 0.296003 | 17.5606 |
| LAB270 | 30591.2 | 10.8086 | 0.242854 | 7.3784 |
| LAB270 | 30595.2 | 10.0715 | 0.989624 | 0.0562 |
| LAB300 | 30064.3 | 12.6824 | 0.242757 | 25.9939 |
| LAB300 | 30063.1 | 11.1136 | 0.036683 | 10.4084 |
| LAB300 | 30061.2 | 10.81 | 0.665351 | 7.3921 |
| LAB306 | 30562.2 | 12.2756 | 0.010759 | 21.9522 |
| LAB306 | 30564.2 | 12.1682 | 0.093141 | 20.8854 |
| LAB306 | 30564.3 | 11.4845 | 0.353803 | 14.0934 |
| LAB306 | 30563.2 | 11.0949 | 0.723007 | 10.2229 |
| LAB306 | 30561.2 | 10.7509 | 0.639598 | 6.8053 |
| LAB323 | 30383.2 | 12.9328 | 0.523061 | 28.482 |
| LAB323 | 30381.1 | 12.3284 | 0.077365 | 22.4773 |
| LAB323 | 30385.1 | 11.8686 | 0.001842 | 17.9095 |
| LAB347_H0 | 30442.4 | 13.4102 | 0.006774 | 33.2243 |
| LAB347_H0 | 30443.4 | 13.2567 | 0.300127 | 31.6996 |
| LAB347_H0 | 30444.3 | 10.6848 | 0.73393 | 6.1484 |
| LAB55 | 30023.1 | 11.889 | 0.058403 | 18.1119 |
| LAB55 | 30023.3 | 11.7623 | 0.595424 | 16.8536 |
| LAB55 | 30025.3 | 11.0449 | 0.37108 | 9.7256 |
| LAB55 | 30025.4 | 10.617 | 0.577641 | 5.4754 |
| LAB83 | 30191.1 | 10.9243 | 0.112327 | 8.5276 |
| LAB83 | 30194.2 | 10.8163 | 0.471899 | 7.455 |
| LAB83 | 30194.3 | 10.5866 | 0.273943 | 5.1735 |
| LAB83 | 30191.3 | 10.2621 | 0.919525 | 1.9497 |
| LAB94 | 30681.8 | 14.1214 | 0.002776 | 40.2897 |
| LAB94 | 30681.4 | 13.3677 | 0.042748 | 32.8018 |
| LAB94 | 30682.3 | 11.9298 | 0.412086 | 18.5177 |
| LAB94 | 30684.2 | 11.114 | 0.781493 | 10.4125 |
| LAB94 | 30682.2 | 10.9003 | 0.452577 | 8.2898 |
| control | — | 10.0659 | — | 0 |
| LAB138 | 30781.2 | 9.27171 | 0.219156 | 10.0306 |
| LAB138 | 30781.1 | 8.49058 | 0.939073 | 0.7607 |
| LAB159 | 30702.4 | 9.17079 | 0.165064 | 8.8329 |
| LAB161 | 30482.2 | 8.87924 | 0.809875 | 5.373 |
| LAB161 | 30483.1 | 8.84074 | 0.680697 | 4.9162 |
| LAB166 | 30243.1 | 8.89122 | 0.776564 | 5.5152 |
| LAB170 | 30713.2 | 10.5571 | 0.506274 | 25.2848 |
| LAB170 | 30712.2 | 9.5511 | 0.457488 | 13.3462 |
| LAB170 | 30715.1 | 9.5147 | 0.427602 | 12.9142 |
| LAB170 | 30712.1 | 8.99178 | 0.718961 | 6.7086 |
| LAB176 | 30143.2 | 9.10305 | 0.633193 | 8.029 |
| LAB176 | 30141.4 | 8.45359 | 0.952598 | 0.3217 |
| LAB237 | 30284.1 | 9.14499 | 0.388392 | 8.5268 |

TABLE 82-continued

Genes showing improved plant photosynthetic capacity at standard growth conditions

| Gene Name | Event # | Petiole Relative Area [%] Ave. | P-Val. | % Iincr. |
|---|---|---|---|---|
| LAB237 | 30282.1 | 8.60062 | 0.713161 | 2.0666 |
| LAB259 | 27112.3 | 9.67733 | 0.736957 | 14.8443 |
| LAB270 | 30595.2 | 9.5103 | 0.044656 | 12.862 |
| LAB270 | 30594.1 | 8.59933 | 0.936594 | 2.0512 |
| LAB300 | 30064.3 | 10.6107 | 0.001258 | 25.9207 |
| LAB300 | 30063.1 | 9.09633 | 0.287201 | 7.9494 |
| LAB306 | 30562.2 | 9.46658 | 0.519281 | 12.3432 |
| LAB306 | 30564.3 | 9.18874 | 0.653644 | 9.046 |
| LAB306 | 30564.2 | 8.61249 | 0.943437 | 2.2074 |
| LAB323 | 30381.4 | 8.91063 | 0.618619 | 5.7456 |
| LAB323 | 30383.2 | 8.60988 | 0.839241 | 2.1765 |
| LAB323 | 30381.1 | 8.60075 | 0.821009 | 2.0681 |
| LAB323 | 30385.1 | 8.55443 | 0.938303 | 1.5184 |
| LAB347_H0 | 30444.3 | 9.38036 | 0.091776 | 11.32 |
| LAB347_H0 | 30444.1 | 8.65871 | 0.787737 | 2.7559 |
| LAB55 | 30022.3 | 9.57195 | 0.030705 | 13.5937 |
| LAB83 | 30194.2 | 9.41746 | 0.406716 | 11.7602 |
| LAB83 | 30191.1 | 8.94368 | 0.798365 | 6.1378 |
| LAB83 | 30194.1 | 8.85117 | 0.571527 | 5.0399 |
| LAB83 | 30191.3 | 8.43071 | 0.997468 | 0.0502 |
| LAB94 | 30681.8 | 9.3956 | 0.079121 | 11.5008 |
| LAB94 | 30682.3 | 8.81913 | 0.670417 | 4.6598 |
| LAB94 | 30682.2 | 8.80358 | 0.821831 | 4.4751 |
| LAB94 | 30684.2 | 8.54125 | 0.822764 | 1.362 |
| control | — | 8.42648 | — | 0 |
| LAB182 | 30451.3 | 8.88755 | 0.729031 | 7.1105 |
| LAB182 | 30454.2 | 8.49655 | 0.859064 | 2.3983 |
| LAB191 | 28153.2 | 10.8567 | 0.001327 | 30.8425 |
| LAB191 | 28152.1 | 10.0261 | 0.518557 | 20.8319 |
| LAB221 | 30125.2 | 9.8005 | 0.683525 | 18.1132 |
| LAB221 | 30124.3 | 9.45507 | 0.152564 | 13.9501 |
| LAB221 | 30123.2 | 9.15942 | 0.259829 | 10.3871 |
| LAB221 | 30124.4 | 8.55053 | 0.669273 | 3.0488 |
| LAB221 | 30122.2 | 8.43027 | 0.832983 | 1.5995 |
| LAB222 | 30473.1 | 8.3116 | 0.984148 | 0.1693 |
| LAB225 | 30493.1 | 10.2674 | 0.458389 | 23.7397 |
| LAB225 | 30493.2 | 9.77915 | 0.725217 | 17.8559 |
| LAB225 | 30491.4 | 8.45826 | 0.899612 | 1.9368 |
| LAB232 | 30462.3 | 9.09076 | 0.564819 | 9.5569 |
| LAB232 | 30462.4 | 9.04128 | 0.218856 | 8.9632 |
| LAB232 | 30463.2 | 8.88717 | 0.755054 | 7.106 |
| LAB232 | 30462.5 | 8.84478 | 0.477954 | 6.5951 |
| LAB260 | 30071.4 | 9.52259 | 0.634837 | 14.7639 |
| LAB264 | 30135.2 | 9.78196 | 0.479636 | 17.8897 |
| LAB264 | 30134.4 | 8.66465 | 0.805561 | 4.4242 |
| LAB264 | 30133.2 | 8.5859 | 0.618648 | 3.4751 |
| LAB265 | 30733.4 | 9.42104 | 0.622411 | 13.54 |
| LAB303 | 30424.3 | 11.6468 | 0.018295 | 40.3642 |
| LAB303 | 30423.4 | 8.77045 | 0.693913 | 5.6992 |
| LAB307 | 30761.1 | 8.44087 | 0.952616 | 1.7272 |
| LAB308 | 30932.3 | 9.04154 | 0.738508 | 8.9664 |
| LAB308 | 30931.4 | 8.39636 | 0.865226 | 1.1908 |
| LAB308 | 30933.2 | 8.3555 | 0.971359 | 0.6984 |
| LAB319 | 30775.4 | 10.3957 | 0.097379 | 25.2869 |
| LAB343 | 30623.3 | 9.73534 | 0.560093 | 17.3279 |
| LAB343 | 30622.2 | 9.3966 | 0.48868 | 13.2455 |
| LAB353 | 30554.3 | 9.59167 | 0.304518 | 15.5964 |
| LAB353 | 30551.3 | 8.91026 | 0.808313 | 7.3842 |
| LAB353 | 30553.1 | 8.7657 | 0.722098 | 5.642 |
| control | — | 8.29755 | — | 0 |
| LAB182 | 30453.1 | 12.4666 | 0.000914 | 31.405 |
| LAB182 | 30454.2 | 9.86965 | 0.704949 | 4.0319 |
| LAB182 | 30451.3 | 9.50438 | 0.976539 | 0.1817 |
| LAB191 | 28152.1 | 10.8079 | 0.574838 | 13.9221 |
| LAB191 | 28156.2 | 10.5985 | 0.06337 | 11.7141 |
| LAB221 | 30125.2 | 10.9027 | 0.007973 | 14.9213 |
| LAB221 | 30123.2 | 10.8248 | 0.569446 | 14.0999 |
| LAB221 | 30122.2 | 9.88085 | 0.842127 | 4.15 |
| LAB222 | 30472.2 | 10.1211 | 0.212039 | 6.6824 |
| LAB222 | 30473.1 | 9.58468 | 0.955228 | 1.0281 |
| LAB232 | 30463.2 | 11.6059 | 0.294926 | 22.3334 |
| LAB260 | 30073.4 | 12.5666 | 0.137056 | 32.4599 |
| LAB260 | 30073.2 | 11.7889 | 0.318133 | 24.262 |
| LAB260 | 30072.2 | 9.60438 | 0.918965 | 1.2358 |
| LAB260 | 30074.3 | 9.53683 | 0.987505 | 0.5238 |
| LAB264 | 30135.2 | 12.2635 | 0.529972 | 29.265 |
| LAB264 | 30131.1 | 11.5985 | 0.075514 | 22.255 |
| LAB264 | 30134.4 | 11.3925 | 0.429682 | 20.084 |
| LAB265 | 30734.4 | 10.2985 | 0.748691 | 8.5523 |
| LAB290_H0 | 30663.7 | 10.5578 | 0.328333 | 11.2858 |
| LAB308 | 30933.2 | 12.3646 | 0.418544 | 30.3304 |
| LAB308 | 30932.3 | 10.1198 | 0.168937 | 6.6683 |
| LAB319 | 30771.5 | 9.72625 | 0.58849 | 2.5203 |
| LAB320 | 30601.4 | 9.93854 | 0.750565 | 4.758 |
| LAB320 | 30603.1 | 9.58751 | 0.922803 | 1.058 |
| LAB343 | 30623.5 | 11.7798 | 0.273087 | 24.1664 |
| LAB343 | 30623.3 | 10.2588 | 0.704607 | 8.1339 |
| LAB353 | 30551.3 | 13.736 | 0.372082 | 44.7855 |
| control | — | 9.48714 | — | 0 |
| LAB108 | 28504.1 | 14.2845 | 0.097715 | 25.8949 |
| LAB108 | 28502.2 | 12.0934 | 0.217696 | 6.5838 |
| LAB119 | 28411.1 | 13.036 | 0.03989 | 14.8914 |
| LAB119 | 28413.1 | 12.8333 | 0.735872 | 13.1054 |
| LAB119 | 28412.1 | 11.9978 | 0.467761 | 5.7419 |
| LAB157 | 28142.3 | 12.7321 | 0.549019 | 12.2134 |
| LAB157 | 28144.2 | 12.6578 | 0.099834 | 11.5586 |
| LAB157 | 28146.2 | 12.4116 | 0.032745 | 9.389 |
| LAB231 | 28582.1 | 15.2058 | 0.167486 | 34.0151 |
| LAB231 | 28585.2 | 12.1171 | 0.1813 | 6.7929 |
| LAB231 | 28585.1 | 12.1163 | 0.565637 | 6.7857 |
| LAB231 | 28583.1 | 11.9344 | 0.561319 | 5.1827 |
| LAB238 | 28424.3 | 13.3902 | 0.043799 | 18.0136 |
| LAB238 | 28425.5 | 12.2273 | 0.660922 | 7.7645 |
| LAB240 | 28592.5 | 13.321 | 0.373508 | 17.4037 |
| LAB240 | 28595.3 | 12.0606 | 0.782914 | 6.2951 |
| LAB242 | 28085.1 | 13.7271 | 0.289912 | 20.9826 |
| LAB242 | 28083.1 | 11.5335 | 0.881316 | 1.6498 |
| LAB267 | 28383.2 | 13.4278 | 0.070513 | 18.345 |
| LAB267 | 28381.2 | 13.2508 | 0.157766 | 16.7845 |
| LAB267 | 28384.5 | 12.4831 | 0.479899 | 10.0192 |
| LAB269 | 28345.2 | 14.8978 | 0.528067 | 31.3007 |
| LAB269 | 28342.3 | 14.3488 | 0.092612 | 26.4617 |
| LAB269 | 28343.4 | 13.4174 | 0.122836 | 18.2529 |
| LAB269 | 28345.3 | 12.872 | 0.384407 | 13.4466 |
| LAB279 | 28351.1 | 12.5399 | 0.145476 | 10.5197 |
| LAB283 | 28365.1 | 12.1102 | 0.276597 | 6.7324 |
| LAB298 | 29244.1 | 12.9685 | 0.05848 | 14.2971 |
| LAB298 | 29245.3 | 12.6057 | 0.627661 | 11.0997 |
| LAB298 | 29242.1 | 12.5553 | 0.693599 | 10.6548 |
| LAB298 | 29245.4 | 12.3495 | 0.370196 | 8.8413 |
| LAB299 | 28061.1 | 12.9688 | 0.233938 | 14.2995 |
| LAB302 | 28822.6 | 12.6219 | 0.005973 | 11.2422 |
| LAB336 | 28374.1 | 15.7785 | 0.238476 | 39.0622 |
| LAB336 | 28374.3 | 13.9975 | 0.154562 | 23.3658 |
| LAB336 | 28375.3 | 11.3704 | 0.973816 | 0.2122 |
| LAB339 | 27271.5 | 12.2864 | 0.486541 | 8.2854 |
| LAB339 | 27272.8 | 11.9861 | 0.742217 | 5.6381 |
| LAB345 | 28495.1 | 12.8967 | 0.405316 | 13.6638 |
| LAB345 | 28492.2 | 12.759 | 0.006442 | 12.4507 |
| LAB345 | 28494.1 | 11.7503 | 0.666362 | 3.5603 |
| LAB58 | 28443.4 | 12.3593 | 0.156656 | 8.9275 |
| control | — | 11.3463 | — | 0 |
| LAB129 | 30825.5 | 11.3885 | 0.646 | 7.616 |
| LAB130 | 30545.2 | 11.8041 | 0.171349 | 11.5434 |
| LAB130 | 30541.3 | 10.9814 | 0.706588 | 3.7689 |
| LAB163 | 30833.1 | 15.4837 | 0.016311 | 46.3136 |
| LAB163 | 30832.1 | 13.578 | 0.583905 | 28.3055 |
| LAB164 | 30523.1 | 11.7825 | 0.112624 | 11.3393 |
| LAB164 | 30524.1 | 11.6841 | 0.603911 | 10.4095 |
| LAB171 | 30841.4 | 11.5162 | 0.3272 | 8.8225 |
| LAB172 | 30854.4 | 12.2301 | 0.245162 | 15.5691 |
| LAB172 | 30855.3 | 10.7597 | 0.805885 | 1.6746 |
| LAB175 | 30514.3 | 10.727 | 0.844957 | 1.3653 |
| LAB204 | 30864.1 | 12.7256 | 0.012544 | 20.2515 |
| LAB204 | 30862.3 | 12.5497 | 0.435571 | 18.5894 |
| LAB204 | 30863.1 | 12.0786 | 0.649935 | 14.1371 |

TABLE 82-continued

Genes showing improved plant photosynthetic capacity at standard growth conditions

| | | Petiole Relative Area [%] | | |
|---|---|---|---|---|
| Gene Name | Event # | Ave. | P-Val. | % Iincr. |
| LAB261 | 31075.3 | 12.7703 | 0.028381 | 20.6731 |
| LAB261 | 31075.1 | 12.2521 | 0.045239 | 15.7771 |
| LAB261 | 31074.4 | 11.5027 | 0.852184 | 8.6956 |
| LAB261 | 31074.2 | 11.4695 | 0.222332 | 8.3819 |
| LAB263 | 30891.6 | 11.2727 | 0.350848 | 6.5218 |
| LAB263 | 30893.3 | 10.7839 | 0.956134 | 1.9028 |
| LAB263 | 30892.3 | 10.7652 | 0.799933 | 1.7266 |
| LAB263 | 30892.2 | 10.6753 | 0.962084 | 0.8768 |
| LAB271 | 30905.4 | 11.6925 | 0.239759 | 10.4885 |
| LAB272 | 31123.6 | 11.7339 | 0.197402 | 10.8801 |
| LAB272 | 31123.5 | 11.5788 | 0.571309 | 9.4142 |
| LAB272 | 31125.4 | 11.5388 | 0.315529 | 9.0367 |
| LAB272 | 31123.1 | 10.9177 | 0.882925 | 3.167 |
| LAB272 | 31121.1 | 10.8732 | 0.906883 | 2.7471 |
| LAB284 | 30913.3 | 12.4727 | 0.30656 | 17.8617 |
| LAB286 | 30922.4 | 13.3287 | 0.464849 | 25.9504 |
| LAB286 | 30924.2 | 10.6195 | 0.981128 | 0.3497 |
| LAB329 | 30102.2 | 10.65 | 0.979661 | 0.6377 |
| control | | 10.5825 | — | 0 |
| LAB101 | 30644.2 | 10.9769 | 0.659017 | 4.8455 |
| LAB107 | 30533.4 | 10.5742 | 0.956725 | 0.9994 |
| LAB121 | 30804.1 | 10.8109 | 0.69463 | 3.26 |
| LAB121 | 30801.1 | 10.5737 | 0.939711 | 0.9944 |
| LAB129 | 30825.1 | 11.1245 | 0.813004 | 6.2556 |
| LAB129 | 30824.2 | 10.9051 | 0.922675 | 4.1599 |
| LAB130 | 30545.2 | 10.7416 | 0.623162 | 2.5978 |
| LAB163 | 30833.1 | 14.8299 | 0.0815 | 41.6474 |
| LAB163 | 30834.2 | 12.5557 | 0.460469 | 19.9257 |
| LAB163 | 30832.2 | 11.3378 | 0.075391 | 8.2922 |
| LAB163 | 30833.2 | 10.6995 | 0.905558 | 2.1957 |
| LAB164 | 30522.1 | 11.9186 | 0.241717 | 13.8405 |
| LAB164 | 30524.1 | 11.1511 | 0.84294 | 6.5093 |
| LAB164 | 30525.2 | 11.1362 | 0.228313 | 6.3674 |
| LAB164 | 30525.3 | 10.9843 | 0.460746 | 4.9157 |
| LAB164 | 30522.4 | 10.7214 | 0.819606 | 2.4055 |
| LAB171 | 30845.1 | 11.0856 | 0.199999 | 5.8836 |
| LAB171 | 30841.3 | 10.8568 | 0.875317 | 3.6985 |
| LAB172 | 30853.4 | 12.3083 | 0.335239 | 17.5625 |
| LAB172 | 30852.3 | 11.834 | 0.743743 | 13.0323 |
| LAB172 | 30853.3 | 11.314 | 0.080168 | 8.065 |
| LAB172 | 30854.1 | 10.7144 | 0.937603 | 2.3384 |
| LAB172 | 30854.4 | 10.7109 | 0.87382 | 2.3052 |
| LAB175 | 30514.3 | 10.7933 | 0.836338 | 3.0921 |
| LAB204 | 30865.4 | 12.9615 | 0.204171 | 23.8008 |
| LAB204 | 30863.2 | 11.4263 | 0.574798 | 9.138 |
| LAB204 | 30862.3 | 10.9217 | 0.910881 | 4.3184 |
| LAB261 | 31075.3 | 11.4275 | 0.80793 | 9.1496 |
| LAB261 | 31075.1 | 10.5624 | 0.95679 | 0.8862 |
| LAB263 | 30891.6 | 13.9257 | 0.005112 | 33.011 |
| LAB263 | 30893.3 | 12.6757 | 0.002161 | 21.0713 |
| LAB263 | 30892.2 | 11.796 | 0.571877 | 12.6689 |
| LAB263 | 30892.3 | 11.3412 | 0.311896 | 8.3252 |
| LAB271 | 30903.1 | 10.478 | 0.997461 | 0.0801 |
| LAB272 | 31123.1 | 13.0476 | 0.323397 | 24.6237 |
| LAB272 | 31121.1 | 11.7566 | 0.109882 | 12.2931 |
| LAB272 | 31123.5 | 11.7532 | 0.242721 | 12.2601 |
| LAB272 | 31123.6 | 11.6109 | 0.708032 | 10.9011 |
| LAB284 | 30911.3 | 12.1827 | 0.342897 | 16.3628 |
| LAB284 | 30914.3 | 10.8305 | 0.577055 | 3.4471 |
| LAB286 | 30922.1 | 12.9866 | 0.414376 | 24.041 |
| LAB286 | 30923.3 | 11.4675 | 0.674167 | 9.5314 |
| control | | 10.4696 | — | 0 |
| LAB116 | 31441.1 | 12.8645 | 0.250112 | 21.5745 |
| LAB116 | 31441.4 | 11.5899 | 0.604192 | 9.5289 |
| LAB122 | 31161.1 | 10.6446 | | 0.5956 |
| LAB137 | 31312.2 | 11.0851 | 0.877823 | 4.7588 |
| LAB154 | 30693.2 | 11.0014 | | 3.9673 |
| LAB178 | 30632.1 | 10.8841 | 0.909441 | 2.8593 |
| LAB235 | 31324.1 | 12.699 | 0.003172 | 20.0105 |
| LAB235 | 31323.1 | 11.755 | 0.577826 | 11.0896 |
| LAB292 | 31221.4 | 11.0317 | 0.802863 | 4.254 |
| LAB292 | 31226.1 | 10.7454 | 0.838315 | 1.5478 |
| LAB292 | 31224.3 | 10.6999 | 0.963241 | 1.1177 |
| LAB312 | 30943.1 | 12.3241 | 0.435812 | 16.4673 |
| LAB56 | 31451.2 | 10.7335 | | 1.4355 |
| LAB97 | 31302.4 | 11.4595 | 0.623005 | 8.2963 |
| LAB97 | 31301.2 | 10.7372 | 0.933684 | 1.4704 |
| control | | 10.5816 | — | 0 |

Table 82.
"CONT."—Control;
"Ave."—Average;
"% Incr." = % increment;
"p-val."—p-value.

TABLE 83

Genes showing improved rosette growth performance at standard growth conditions

| | | RGR Of Rosette Area | | | RGR Of Rosette Diameter | | | RGR Of Plot Coverage | | |
|---|---|---|---|---|---|---|---|---|---|---|
| Gene Name | Event # | Ave. | P-Val. | % incr. | Ave. | P-Val. | % incr. | Ave. | P-Val. | % incr. |
| LAB113 | 28543.1 | — | | — | 0.47 | 0.84 | 2 | — | | — |
| LAB113 | 28543.2 | — | | — | 0.48 | 0.75 | 3 | — | | — |
| LAB113 | 28545.3 | — | | — | 0.48 | 0.67 | 5 | — | | — |
| LAB131 | 28291.1 | 1.27 | 0.31 | 16 | 0.51 | 0.39 | 10 | 10.20 | 0.31 | 16 |
| LAB131 | 28292.3 | 1.21 | 0.53 | 10 | 0.51 | 0.31 | 11 | 9.66 | 0.53 | 10 |
| LAB131 | 28294.2 | 1.28 | 0.29 | 16 | 0.51 | 0.33 | 11 | 10.26 | 0.29 | 16 |
| LAB131 | 28295.3 | 1.28 | 0.30 | 16 | 0.51 | 0.29 | 12 | 10.22 | 0.30 | 16 |
| LAB145 | 28551.1 | 1.28 | 0.32 | 16 | 0.50 | 0.50 | 8 | 10.23 | 0.32 | 16 |
| LAB145 | 28551.3 | 1.43 | 0.06 | 30 | 0.54 | 0.12 | 17 | 11.44 | 0.06 | 30 |
| LAB145 | 28553.2 | 1.37 | 0.12 | 24 | 0.53 | 0.16 | 16 | 10.94 | 0.12 | 24 |
| LAB145 | 28553.3 | 1.50 | 0.03 | 36 | 0.53 | 0.19 | 15 | 11.99 | 0.03 | 36 |
| LAB145 | 28555.1 | 1.24 | 0.43 | 12 | 0.53 | 0.22 | 14 | 9.88 | 0.43 | 12 |
| LAB152 | 28471.1 | 1.12 | 0.90 | 2 | 0.46 | 0.95 | 1 | 8.98 | 0.90 | 2 |
| LAB152 | 28472.3 | 1.23 | 0.44 | 12 | 0.48 | 0.76 | 3 | 9.21 | 0.77 | 5 |
| LAB152 | 28473.2 | 1.18 | 0.64 | 7 | 0.50 | 0.47 | 8 | 9.42 | 0.64 | 7 |
| LAB152 | 28473.3 | 1.25 | 0.39 | 13 | 0.52 | 0.22 | 14 | 9.98 | 0.39 | 13 |
| LAB152 | 28474.4 | 1.10 | 0.99 | 0 | 0.49 | 0.51 | 7 | 8.83 | 0.99 | 0 |
| LAB153 | 28302.2 | 1.34 | 0.16 | 22 | 0.54 | 0.14 | 16 | 10.76 | 0.16 | 22 |

TABLE 83-continued

Genes showing improved rosette growth performance at standard growth conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % incr. | Ave. | P-Val. | % incr. | Ave. | P-Val. | % incr. |
| LAB153 | 28303.1 | 1.15 | 0.76 | 5 | 0.48 | 0.66 | 5 | 9.22 | 0.76 | 5 |
| LAB153 | 28304.1 | 1.45 | 0.05 | 32 | 0.55 | 0.10 | 18 | 11.59 | 0.05 | 32 |
| LAB153 | 28305.3 | 1.29 | 0.27 | 17 | 0.51 | 0.30 | 12 | 10.34 | 0.27 | 17 |
| LAB169 | 28391.1 | — | | — | 0.48 | 0.75 | 4 | — | | — |
| LAB169 | 28391.4 | 1.29 | 0.28 | 17 | 0.50 | 0.42 | 9 | 10.28 | 0.28 | 17 |
| LAB169 | 28392.1 | 1.20 | 0.58 | 9 | 0.50 | 0.48 | 8 | 9.57 | 0.58 | 9 |
| LAB169 | 28394.3 | 1.41 | 0.07 | 28 | 0.52 | 0.25 | 13 | 11.31 | 0.07 | 28 |
| LAB181 | 28481.1 | 1.20 | 0.57 | 9 | 0.47 | 0.83 | 2 | 9.61 | 0.57 | 9 |
| LAB181 | 28482.2 | 1.30 | 0.27 | 18 | 0.50 | 0.47 | 8 | 10.36 | 0.27 | 18 |
| LAB181 | 28482.3 | — | | — | 0.49 | 0.58 | 6 | — | | — |
| LAB181 | 28484.3 | 1.27 | 0.31 | 16 | 0.51 | 0.35 | 10 | 10.18 | 0.31 | 16 |
| LAB187 | 28431.3 | 1.20 | 0.55 | 9 | 0.50 | 0.44 | 8 | 9.62 | 0.55 | 9 |
| LAB187 | 28431.5 | 1.18 | 0.62 | 8 | 0.49 | 0.51 | 7 | 9.47 | 0.62 | 8 |
| LAB187 | 28434.1 | 1.61 | 0.01 | 46 | 0.59 | 0.02 | 27 | 12.85 | 0.01 | 46 |
| LAB187 | 28435.3 | — | | — | 0.48 | 0.78 | 3 | — | | — |
| LAB213 | 28561.2 | 1.31 | 0.21 | 19 | 0.51 | 0.37 | 10 | 10.52 | 0.21 | 19 |
| LAB213 | 28562.6 | 1.28 | 0.32 | 16 | 0.53 | 0.20 | 14 | 10.22 | 0.32 | 16 |
| LAB213 | 28565.2 | 1.12 | 0.92 | 2 | 0.49 | 0.61 | 6 | 8.94 | 0.92 | 2 |
| LAB230 | 28571.6 | — | | — | 0.47 | 0.91 | 1 | — | | — |
| LAB230 | 28572.3 | 1.12 | 0.91 | 2 | 0.49 | 0.62 | 5 | 8.96 | 0.91 | 2 |
| LAB230 | 28574.2 | — | | — | 0.49 | 0.62 | 6 | — | | — |
| LAB247 | 28091.4 | 1.20 | 0.57 | 9 | 0.51 | 0.34 | 11 | 9.58 | 0.57 | 9 |
| LAB247 | 28093.2 | 1.18 | 0.62 | 8 | 0.51 | 0.30 | 12 | 9.48 | 0.62 | 8 |
| LAB247 | 28094.1 | 1.25 | 0.38 | 14 | 0.51 | 0.31 | 11 | 10.00 | 0.38 | 14 |
| LAB247 | 28094.3 | 1.42 | 0.07 | 29 | 0.56 | 0.05 | 22 | 11.37 | 0.07 | 29 |
| LAB247 | 28095.4 | — | | — | 0.50 | 0.47 | 8 | — | | — |
| LAB249 | 28602.1 | 1.32 | 0.22 | 20 | 0.56 | 0.06 | 21 | 10.54 | 0.22 | 20 |
| LAB249 | 28603.3 | 1.23 | 0.46 | 12 | 0.54 | 0.11 | 18 | 9.83 | 0.46 | 12 |
| LAB249 | 28604.2 | 1.35 | 0.15 | 22 | 0.55 | 0.10 | 19 | 10.79 | 0.15 | 22 |
| LAB249 | 28604.4 | 1.13 | 0.84 | 3 | 0.49 | 0.53 | 7 | 9.07 | 0.84 | 3 |
| LAB249 | 28605.2 | — | | — | 0.47 | 0.91 | 1 | — | | — |
| LAB258 | 27441.4 | 1.36 | 0.14 | 23 | 0.53 | 0.20 | 14 | 10.86 | 0.14 | 23 |
| LAB258 | 27442.2 | 1.55 | 0.01 | 41 | 0.59 | 0.02 | 27 | 12.43 | 0.01 | 41 |
| LAB258 | 27442.5 | 1.13 | 0.84 | 3 | 0.47 | 0.93 | 1 | 9.08 | 0.84 | 3 |
| LAB258 | 27444.4 | 1.21 | 0.54 | 9 | 0.50 | 0.45 | 8 | 9.64 | 0.54 | 9 |
| LAB294 | 28401.3 | — | | — | 0.46 | 0.94 | 1 | — | | — |
| LAB294 | 28402.5 | 1.17 | 0.68 | 6 | 0.49 | 0.59 | 6 | 9.38 | 0.68 | 6 |
| LAB294 | 28404.3 | 1.22 | 0.48 | 11 | 0.53 | 0.20 | 15 | 9.79 | 0.48 | 11 |
| LAB70 | 28463.1 | — | | — | 0.47 | 0.81 | 3 | — | | — |
| LAB74 | 28451.3 | 1.21 | 0.50 | 10 | 0.51 | 0.32 | 11 | 9.71 | 0.50 | 10 |
| LAB74 | 28452.2 | — | | — | 0.47 | 0.82 | 3 | — | | — |
| LAB74 | 28452.4 | 1.19 | 0.59 | 8 | 0.52 | 0.26 | 12 | 9.55 | 0.59 | 8 |
| LAB74 | 28453.5 | 1.20 | 0.57 | 9 | 0.51 | 0.37 | 10 | 9.59 | 0.57 | 9 |
| LAB74 | 28454.1 | 1.32 | 0.20 | 20 | 0.53 | 0.17 | 15 | 10.58 | 0.20 | 20 |
| LAB81 | 28531.1 | 1.23 | 0.44 | 12 | 0.51 | 0.36 | 10 | 9.85 | 0.44 | 12 |
| LAB81 | 28531.2 | — | | — | 0.47 | 0.84 | 2 | — | | — |
| LAB88 | 28192.6 | 1.27 | 0.33 | 15 | 0.52 | 0.24 | 13 | 10.17 | 0.33 | 15 |
| LAB88 | 28193.6 | 1.20 | 0.56 | 9 | 0.48 | 0.73 | 4 | 9.60 | 0.56 | 9 |
| cont | — | 1.10 | — | 0 | 0.46 | — | 0 | 8.81 | — | 0 |
| LAB113 | 28545.2 | — | | — | 0.42 | 0.83 | 2 | — | | — |
| LAB113 | 28545.3 | 1.09 | 0.20 | 20 | 0.46 | 0.26 | 13 | 8.71 | 0.20 | 20 |
| LAB131 | 28291.1 | 0.94 | 0.81 | 4 | 0.43 | 0.59 | 6 | 7.54 | 0.81 | 4 |
| LAB131 | 28292.3 | 1.11 | 0.17 | 22 | 0.48 | 0.12 | 18 | 8.85 | 0.17 | 22 |
| LAB131 | 28293.3 | — | | — | 0.41 | 0.96 | 1 | — | | — |
| LAB131 | 28294.2 | 0.96 | 0.72 | 6 | 0.41 | 0.91 | 1 | 7.67 | 0.72 | 6 |
| LAB131 | 28295.3 | 1.35 | 0.00 | 48 | 0.55 | 0.00 | 36 | 10.76 | 0.00 | 48 |
| LAB145 | 28551.1 | — | | — | 0.42 | 0.86 | 2 | — | | — |
| LAB145 | 28551.3 | 0.92 | 0.92 | 2 | 0.44 | 0.48 | 8 | 7.38 | 0.92 | 2 |
| LAB145 | 28553.2 | 1.13 | 0.14 | 25 | 0.51 | 0.04 | 25 | 9.05 | 0.14 | 25 |
| LAB145 | 28553.3 | 1.33 | 0.01 | 47 | 0.52 | 0.02 | 28 | 10.64 | 0.01 | 47 |
| LAB145 | 28555.1 | 1.30 | 0.01 | 44 | 0.52 | 0.02 | 26 | 10.43 | 0.01 | 44 |
| LAB152 | 28471.1 | 1.02 | 0.44 | 13 | 0.44 | 0.55 | 7 | 7.57 | 0.79 | 4 |
| LAB152 | 28472.3 | 0.91 | 0.98 | 0 | 0.45 | 0.33 | 11 | 7.29 | 0.98 | 0 |
| LAB152 | 28473.2 | 1.12 | 0.16 | 23 | 0.50 | 0.07 | 21 | 8.92 | 0.16 | 23 |
| LAB152 | 28473.3 | 1.20 | 0.06 | 32 | 0.49 | 0.09 | 21 | 9.60 | 0.06 | 32 |
| LAB153 | 28301.2 | 0.95 | 0.77 | 5 | 0.43 | 0.66 | 5 | 7.60 | 0.77 | 5 |
| LAB153 | 28302.2 | — | | — | 0.43 | 0.57 | 6 | — | | — |
| LAB153 | 28303.1 | 0.96 | 0.72 | 6 | 0.42 | 0.81 | 3 | 7.68 | 0.72 | 6 |
| LAB153 | 28304.1 | 1.07 | 0.25 | 18 | 0.47 | 0.18 | 15 | 8.59 | 0.25 | 18 |
| LAB153 | 28305.3 | 1.16 | 0.08 | 27 | 0.50 | 0.05 | 22 | 9.26 | 0.08 | 27 |
| LAB169 | 28391.1 | 1.43 | 0.00 | 57 | 0.57 | 0.00 | 39 | 11.42 | 0.00 | 57 |
| LAB169 | 28391.4 | 1.05 | 0.33 | 15 | 0.48 | 0.11 | 18 | 8.39 | 0.33 | 15 |

TABLE 83-continued

Genes showing improved rosette growth performance at standard growth conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % incr. | Ave. | P-Val. | % incr. | Ave. | P-Val. | % incr. |
| LAB169 | 28392.1 | 1.33 | 0.01 | 47 | 0.52 | 0.02 | 26 | 10.64 | 0.01 | 47 |
| LAB169 | 28393.2 | 1.20 | 0.05 | 32 | 0.50 | 0.06 | 22 | 9.57 | 0.05 | 32 |
| LAB169 | 28394.3 | 1.43 | 0.00 | 58 | 0.57 | 0.00 | 39 | 11.46 | 0.00 | 58 |
| LAB181 | 28481.1 | 1.10 | 0.18 | 21 | 0.48 | 0.13 | 18 | 8.81 | 0.18 | 21 |
| LAB181 | 28482.2 | 0.93 | 0.89 | 2 | 0.46 | 0.26 | 13 | 7.42 | 0.89 | 2 |
| LAB181 | 28482.3 | 0.97 | 0.69 | 6 | 0.47 | 0.23 | 15 | 7.73 | 0.69 | 6 |
| LAB181 | 28483.2 | 0.98 | 0.63 | 8 | 0.45 | 0.37 | 10 | 7.82 | 0.63 | 8 |
| LAB181 | 28484.3 | 1.03 | 0.40 | 13 | 0.46 | 0.22 | 14 | 8.22 | 0.40 | 13 |
| LAB187 | 28433.3 | 1.06 | 0.31 | 16 | 0.48 | 0.15 | 17 | 8.45 | 0.31 | 16 |
| LAB187 | 28434.1 | 1.26 | 0.03 | 39 | 0.51 | 0.05 | 24 | 10.09 | 0.03 | 39 |
| LAB187 | 28435.3 | 0.91 | 0.98 | 0 | 0.44 | 0.55 | 7 | 7.29 | 0.98 | 0 |
| LAB187 | 28435.4 | 1.16 | 0.09 | 27 | 0.48 | 0.12 | 17 | 9.25 | 0.09 | 27 |
| LAB213 | 28561.2 | 0.95 | 0.79 | 4 | 0.44 | 0.50 | 8 | 7.57 | 0.79 | 4 |
| LAB213 | 28562.6 | 1.07 | 0.27 | 18 | 0.50 | 0.06 | 21 | 8.54 | 0.27 | 18 |
| LAB213 | 28565.2 | 1.08 | 0.25 | 19 | 0.50 | 0.06 | 22 | 8.61 | 0.25 | 19 |
| LAB230 | 28572.2 | — | | — | 0.43 | 0.59 | 6 | — | | — |
| LAB230 | 28572.3 | — | | — | 0.45 | 0.36 | 11 | — | | — |
| LAB230 | 28574.2 | 0.93 | 0.90 | 2 | 0.43 | 0.72 | 4 | 7.41 | 0.90 | 2 |
| LAB247 | 28091.4 | 1.01 | 0.46 | 11 | 0.44 | 0.46 | 8 | 8.09 | 0.46 | 11 |
| LAB247 | 28094.1 | — | | — | 0.41 | 0.89 | 2 | — | | — |
| LAB247 | 28094.3 | — | | — | 0.43 | 0.59 | 5 | — | | — |
| LAB249 | 28604.2 | 1.19 | 0.06 | 31 | 0.49 | 0.07 | 21 | 9.49 | 0.06 | 31 |
| LAB249 | 28605.2 | 1.21 | 0.05 | 33 | 0.50 | 0.06 | 22 | 9.65 | 0.05 | 33 |
| LAB258 | 27441.4 | 1.05 | 0.34 | 15 | 0.49 | 0.10 | 19 | 8.37 | 0.34 | 15 |
| LAB258 | 27442.2 | — | | — | 0.41 | 0.93 | 1 | — | | — |
| LAB258 | 27442.5 | 1.34 | 0.00 | 47 | 0.53 | 0.01 | 29 | 10.70 | 0.00 | 47 |
| LAB258 | 27444.4 | 1.05 | 0.34 | 16 | 0.49 | 0.10 | 21 | 8.40 | 0.34 | 16 |
| LAB294 | 28402.4 | 0.96 | 0.71 | 6 | 0.43 | 0.65 | 5 | 7.69 | 0.71 | 6 |
| LAB70 | 28463.1 | — | | — | 0.45 | 0.41 | 9 | — | | — |
| LAB74 | 28451.3 | 1.15 | 0.10 | 26 | 0.46 | 0.29 | 12 | 9.18 | 0.10 | 26 |
| LAB74 | 28452.4 | 1.31 | 0.02 | 44 | 0.53 | 0.03 | 29 | 10.49 | 0.02 | 44 |
| LAB74 | 28454.1 | 0.99 | 0.57 | 9 | 0.46 | 0.31 | 12 | 7.91 | 0.57 | 9 |
| LAB81 | 28531.1 | 0.96 | 0.74 | 5 | 0.42 | 0.88 | 2 | 7.65 | 0.74 | 5 |
| LAB81 | 28533.4 | — | | — | 0.42 | 0.82 | 3 | — | | — |
| LAB88 | 28191.3 | 0.94 | 0.80 | 4 | 0.44 | 0.52 | 7 | 7.55 | 0.80 | 4 |
| LAB88 | 28193.2 | 1.20 | 0.07 | 32 | 0.46 | 0.31 | 12 | 9.60 | 0.07 | 32 |
| LAB88 | 28193.6 | 1.06 | 0.31 | 16 | 0.46 | 0.27 | 13 | 8.46 | 0.31 | 16 |
| cont | | 0.91 | — | 0 | 0.41 | — | 0 | 7.26 | — | 0 |
| LAB108 | 28501.4 | 1.64 | 0.13 | 22 | 0.62 | 0.33 | 8 | 12.37 | 0.32 | 14 |
| LAB108 | 28502.2 | 1.47 | 0.54 | 9 | 0.57 | 0.96 | 0 | 11.78 | 0.54 | 9 |
| LAB108 | 28504.1 | — | | — | 0.58 | 0.84 | 2 | — | | — |
| LAB108 | 28505.2 | 1.49 | 0.49 | 10 | 0.60 | 0.53 | 5 | 11.89 | 0.49 | 10 |
| LAB108 | 28505.4 | 1.51 | 0.41 | 12 | 0.60 | 0.53 | 6 | 12.10 | 0.41 | 12 |
| LAB119 | 28412.1 | 1.43 | 0.70 | 5 | 0.61 | 0.46 | 6 | 11.40 | 0.70 | 5 |
| LAB119 | 28413.1 | 1.47 | 0.55 | 8 | 0.59 | 0.66 | 4 | 11.73 | 0.55 | 8 |
| LAB119 | 28414.1 | 1.37 | 0.93 | 1 | 0.57 | 0.97 | 0 | 10.96 | 0.93 | 1 |
| LAB157 | 28142.3 | 1.60 | 0.20 | 18 | 0.60 | 0.52 | 6 | 12.80 | 0.20 | 18 |
| LAB157 | 28144.2 | 1.40 | 0.82 | 3 | 0.60 | 0.55 | 5 | 11.17 | 0.82 | 3 |
| LAB157 | 28146.1 | 1.60 | 0.23 | 18 | 0.61 | 0.46 | 7 | 12.76 | 0.23 | 18 |
| LAB157 | 28146.2 | 1.40 | 0.81 | 3 | 0.58 | 0.82 | 2 | 11.20 | 0.81 | 3 |
| LAB231 | 28581.3 | 1.36 | 0.99 | 0 | 0.57 | 0.93 | 1 | 10.85 | 0.99 | 0 |
| LAB231 | 28582.1 | — | | — | 0.57 | 0.93 | 1 | — | | — |
| LAB231 | 28583.1 | 1.95 | 0.00 | 44 | 0.68 | 0.03 | 19 | 15.57 | 0.00 | 44 |
| LAB231 | 28585.1 | 1.53 | 0.37 | 13 | 0.60 | 0.57 | 5 | 12.28 | 0.37 | 13 |
| LAB238 | 28422.4 | 1.53 | 0.37 | 13 | 0.62 | 0.33 | 9 | 12.20 | 0.37 | 13 |
| LAB238 | 28424.3 | 1.35 | 1.00 | 0 | — | | — | 10.83 | 1.00 | 0 |
| LAB238 | 28425.5 | 1.60 | 0.24 | 18 | 0.61 | 0.41 | 8 | 12.76 | 0.24 | 18 |
| LAB240 | 28592.2 | 1.56 | 0.30 | 15 | 0.62 | 0.32 | 9 | 12.48 | 0.30 | 15 |
| LAB240 | 28592.6 | 1.68 | 0.09 | 24 | 0.63 | 0.20 | 11 | 13.42 | 0.09 | 24 |
| LAB240 | 28595.1 | 1.48 | 0.51 | 9 | 0.60 | 0.54 | 5 | 11.84 | 0.51 | 9 |
| LAB240 | 28595.3 | 1.85 | 0.01 | 37 | 0.71 | 0.01 | 25 | 14.84 | 0.01 | 37 |
| LAB242 | 28081.2 | 1.39 | 0.84 | 3 | — | | — | 11.14 | 0.84 | 3 |
| LAB242 | 28081.3 | 1.45 | 0.62 | 7 | — | | — | 11.58 | 0.62 | 7 |
| LAB242 | 28083.1 | 1.48 | 0.50 | 10 | 0.60 | 0.56 | 5 | 11.86 | 0.50 | 10 |
| LAB242 | 28085.1 | — | | — | 0.60 | 0.53 | 6 | — | | — |
| LAB242 | 28085.5 | 1.46 | 0.58 | 8 | 0.60 | 0.57 | 5 | 11.69 | 0.58 | 8 |
| LAB267 | 28381.2 | 1.39 | 0.83 | 3 | 0.58 | 0.79 | 2 | 11.15 | 0.83 | 3 |
| LAB267 | 28384.2 | 1.45 | 0.61 | 7 | 0.61 | 0.39 | 8 | 11.62 | 0.61 | 7 |
| LAB269 | 28342.3 | — | | — | 0.57 | 0.93 | 1 | — | | — |
| LAB269 | 28343.4 | 1.36 | 0.95 | 1 | 0.59 | 0.62 | 4 | 10.92 | 0.95 | 1 |
| LAB269 | 28345.2 | — | | — | 0.57 | 1.00 | 0 | — | | — |
| LAB269 | 28345.3 | 1.39 | 0.85 | 3 | 0.58 | 0.78 | 2 | 11.12 | 0.85 | 3 |

TABLE 83-continued

Genes showing improved rosette growth performance at standard growth conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % incr. | Ave. | P-Val. | % incr. | Ave. | P-Val. | % incr. |
| LAB279 | 28351.4 | 1.39 | 0.86 | 2 | — | | — | 11.08 | 0.86 | 2 |
| LAB279 | 28353.2 | 1.37 | 0.93 | 1 | 0.60 | 0.58 | 5 | 10.97 | 0.93 | 1 |
| LAB279 | 28354.1 | 1.52 | 0.38 | 12 | 0.64 | 0.13 | 13 | 12.17 | 0.38 | 12 |
| LAB283 | 28363.3 | 1.62 | 0.17 | 20 | 0.62 | 0.33 | 8 | 12.94 | 0.17 | 20 |
| LAB283 | 28364.3 | 1.37 | 0.92 | 1 | — | | — | 10.98 | 0.92 | 1 |
| LAB283 | 28365.1 | 1.63 | 0.16 | 20 | 0.67 | 0.05 | 17 | 13.01 | 0.16 | 20 |
| LAB298 | 29245.3 | 1.43 | 0.71 | 5 | 0.59 | 0.71 | 3 | 11.41 | 0.71 | 5 |
| LAB298 | 29245.4 | 1.48 | 0.49 | 10 | 0.63 | 0.23 | 10 | 11.88 | 0.49 | 10 |
| LAB299 | 28061.1 | 1.42 | 0.73 | 5 | 0.60 | 0.57 | 5 | 11.34 | 0.73 | 5 |
| LAB299 | 28063.1 | 1.45 | 0.60 | 7 | 0.58 | 0.76 | 3 | 11.63 | 0.60 | 7 |
| LAB299 | 28063.2 | 1.37 | 0.94 | 1 | 0.57 | 1.00 | 0 | 10.93 | 0.94 | 1 |
| LAB299 | 28064.1 | 1.49 | 0.48 | 10 | 0.61 | 0.47 | 6 | 11.90 | 0.48 | 10 |
| LAB302 | 28822.7 | 1.48 | 0.52 | 9 | 0.59 | 0.62 | 4 | 11.81 | 0.52 | 9 |
| LAB302 | 28823.4 | 1.42 | 0.73 | 5 | 0.58 | 0.84 | 2 | 11.37 | 0.73 | 5 |
| LAB302 | 28825.1 | 1.36 | 0.98 | 0 | 0.60 | 0.59 | 5 | 10.86 | 0.98 | 0 |
| LAB302 | 28825.2 | 1.50 | 0.43 | 11 | 0.60 | 0.50 | 6 | 12.02 | 0.43 | 11 |
| LAB339 | 27272.7 | 1.41 | 0.75 | 4 | 0.57 | 0.96 | 0 | 11.30 | 0.75 | 4 |
| LAB345 | 28491.1 | 1.40 | 0.82 | 3 | 0.59 | 0.76 | 3 | 11.18 | 0.82 | 3 |
| LAB345 | 28494.1 | 1.47 | 0.56 | 8 | 0.59 | 0.66 | 4 | 11.72 | 0.56 | 8 |
| LAB345 | 28495.1 | 1.44 | 0.67 | 6 | 0.59 | 0.68 | 4 | 11.48 | 0.67 | 6 |
| LAB58 | 28442.1 | 1.45 | 0.60 | 7 | 0.61 | 0.41 | 7 | 10.85 | 0.99 | 0 |
| LAB58 | 28443.2 | 1.35 | 0.99 | 0 | — | | — | 10.83 | 0.99 | 0 |
| cont | — | 1.35 | — | 0 | 0.57 | — | 0 | 10.82 | — | 0 |
| LAB133 | 28833.1 | — | | — | 0.51 | 0.93 | 1 | — | | — |
| LAB133 | 28833.2 | 1.43 | 0.46 | 11 | 0.56 | 0.31 | 10 | 11.43 | 0.34 | 15 |
| LAB162 | 29341.2 | — | | — | 0.52 | 0.82 | 2 | 10.07 | 0.93 | 1 |
| LAB185 | 28174.2 | — | | — | 0.52 | 0.73 | 3 | — | | — |
| LAB185 | 28175.3 | — | | — | 0.51 | 1.00 | 0 | — | | — |
| LAB210 | 28332.1 | 1.32 | 0.86 | 3 | — | | — | 10.57 | 0.68 | 6 |
| LAB293 | 29233.2 | 1.49 | 0.32 | 16 | 0.55 | 0.42 | 8 | 11.89 | 0.22 | 20 |
| LAB297 | 29272.5 | 1.41 | 0.52 | 10 | 0.52 | 0.76 | 3 | 11.31 | 0.38 | 14 |
| LAB297 | 29273.4 | — | | — | — | | — | 10.13 | 0.89 | 2 |
| LAB310 | 28182.2 | 1.41 | 0.55 | 9 | — | | — | 10.38 | 0.77 | 5 |
| LAB310 | 28182.3 | 1.76 | 0.04 | 36 | 0.60 | 0.09 | 19 | 14.04 | 0.02 | 41 |
| LAB318 | 28103.2 | — | | — | — | | — | 10.26 | 0.83 | 3 |
| LAB327 | 29221.6 | 1.33 | 0.84 | 3 | — | | — | 10.61 | 0.66 | 7 |
| LAB327 | 29224.2 | 1.34 | 0.76 | 4 | 0.54 | 0.52 | 6 | 10.75 | 0.59 | 8 |
| LAB327 | 29225.3 | — | | — | 0.51 | 0.94 | 1 | — | | — |
| LAB335 | 27311.2 | — | | — | 0.52 | 0.84 | 2 | 9.96 | 0.98 | 0 |
| LAB335 | 27314.1 | 1.40 | 0.54 | 9 | 0.52 | 0.71 | 4 | 11.23 | 0.40 | 13 |
| LAB335 | 27314.2 | 1.53 | 0.22 | 19 | 0.57 | 0.19 | 13 | 12.22 | 0.15 | 23 |
| LAB335 | 27315.4 | 1.57 | 0.15 | 22 | 0.57 | 0.17 | 13 | 12.54 | 0.10 | 26 |
| LAB54 | 28131.1 | 1.30 | 0.93 | 1 | 0.56 | 0.33 | 10 | 10.42 | 0.74 | 5 |
| LAB54 | 28133.1 | 1.44 | 0.43 | 12 | 0.56 | 0.33 | 10 | 11.50 | 0.31 | 16 |
| LAB54 | 28134.1 | 1.42 | 0.48 | 11 | 0.55 | 0.41 | 8 | 11.38 | 0.35 | 15 |
| LAB54 | 28136.1 | 1.34 | 0.77 | 4 | 0.53 | 0.57 | 5 | 10.73 | 0.59 | 8 |
| LAB54 | 28136.2 | 1.63 | 0.12 | 27 | 0.53 | 0.69 | 4 | 13.06 | 0.08 | 32 |
| LAB73 | 30152.1 | 1.35 | 0.73 | 5 | 0.51 | 0.95 | 1 | 10.83 | 0.57 | 9 |
| LAB73 | 30153.1 | — | | — | 0.53 | 0.63 | 5 | — | | — |
| cont | | 1.29 | — | 0 | 0.51 | — | 0 | 9.93 | — | 0 |
| LAB102 | 30312.2 | 1.19 | 0.99 | 0 | 0.50 | 0.66 | 4 | 9.51 | 0.99 | 0 |
| LAB126 | 30201.3 | — | | — | 0.51 | 0.55 | 5 | — | | — |
| LAB126 | 30202.3 | 1.19 | 1.00 | 0 | 0.50 | 0.60 | 5 | 9.50 | 1.00 | 0 |
| LAB126 | 30205.1 | — | | — | 0.50 | 0.58 | 5 | — | | — |
| LAB126 | 30205.3 | — | | — | 0.49 | 0.78 | 3 | — | | — |
| LAB165 | 30231.2 | 1.20 | 0.90 | 1 | 0.50 | 0.71 | 3 | 9.63 | 0.90 | 1 |
| LAB165 | 30232.1 | 1.25 | 0.66 | 5 | 0.51 | 0.55 | 5 | 10.00 | 0.66 | 5 |
| LAB165 | 30233.1 | — | | — | 0.49 | 0.80 | 2 | — | | — |
| LAB165 | 30235.1 | 1.22 | 0.82 | 3 | 0.51 | 0.52 | 6 | 9.75 | 0.82 | 3 |
| LAB167 | 27321.2 | 1.38 | 0.18 | 17 | 0.52 | 0.39 | 7 | 11.07 | 0.18 | 17 |
| LAB167 | 27321.3 | 1.28 | 0.53 | 8 | 0.53 | 0.26 | 10 | 10.24 | 0.53 | 8 |
| LAB167 | 27321.4 | 1.35 | 0.26 | 14 | 0.53 | 0.26 | 10 | 10.81 | 0.26 | 14 |
| LAB167 | 27321.6 | 1.28 | 0.51 | 8 | 0.52 | 0.34 | 8 | 10.25 | 0.51 | 8 |
| LAB220 | 30321.4 | 1.24 | 0.69 | 5 | 0.54 | 0.19 | 11 | 9.95 | 0.69 | 5 |
| LAB220 | 30322.2 | 1.22 | 0.81 | 3 | — | | — | 9.77 | 0.81 | 3 |
| LAB220 | 30322.3 | — | | — | 0.50 | 0.69 | 3 | — | | — |
| LAB220 | 30323.1 | 1.28 | 0.51 | 8 | 0.51 | 0.47 | 6 | 10.26 | 0.51 | 8 |
| LAB220 | 30324.4 | 1.26 | 0.63 | 6 | 0.51 | 0.45 | 7 | 10.05 | 0.63 | 6 |
| LAB241 | 30211.3 | 1.35 | 0.26 | 14 | 0.54 | 0.15 | 13 | 10.83 | 0.26 | 14 |
| LAB241 | 30212.1 | — | | — | 0.49 | 0.85 | 2 | — | | — |
| LAB241 | 30212.2 | 1.27 | 0.58 | 7 | 0.53 | 0.30 | 10 | 10.16 | 0.58 | 7 |
| LAB241 | 30213.1 | — | | — | 0.49 | 0.87 | 1 | — | | — |

TABLE 83-continued

Genes showing improved rosette growth performance at standard growth conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % incr. | Ave. | P-Val. | % incr. | Ave. | P-Val. | % incr. |
| LAB241 | 30213.4 | 1.25 | 0.67 | 5 | 0.52 | 0.38 | 8 | 10.00 | 0.67 | 5 |
| LAB268 | 30391.4 | 1.44 | 0.08 | 21 | 0.56 | 0.07 | 15 | 11.53 | 0.08 | 21 |
| LAB268 | 30392.1 | — | | — | 0.50 | 0.65 | 4 | — | | — |
| LAB268 | 30393.1 | 1.21 | 0.86 | 2 | 0.51 | 0.58 | 5 | 9.70 | 0.86 | 2 |
| LAB268 | 30393.3 | 1.20 | 0.95 | 1 | — | | — | 9.56 | 0.95 | 1 |
| LAB268 | 30395.1 | 1.37 | 0.21 | 16 | 0.56 | 0.09 | 15 | 10.99 | 0.21 | 16 |
| LAB280 | 30042.1 | 1.32 | 0.38 | 11 | 0.52 | 0.41 | 7 | 10.54 | 0.38 | 11 |
| LAB280 | 30044.1 | 1.45 | 0.08 | 22 | 0.52 | 0.33 | 9 | 11.56 | 0.08 | 22 |
| LAB280 | 30045.1 | 1.64 | 0.00 | 38 | 0.60 | 0.01 | 25 | 13.14 | 0.00 | 38 |
| LAB289 | 30371.4 | 1.30 | 0.43 | 10 | 0.53 | 0.25 | 10 | 10.43 | 0.43 | 10 |
| LAB289 | 30371.6 | 1.46 | 0.07 | 23 | 0.56 | 0.06 | 16 | 11.66 | 0.07 | 23 |
| LAB289 | 30373.1 | 1.22 | 0.80 | 3 | 0.52 | 0.40 | 7 | 9.79 | 0.80 | 3 |
| LAB289 | 30373.2 | — | | — | 0.49 | 0.91 | 1 | — | | — |
| LAB289 | 30375.2 | 1.23 | 0.77 | 4 | 0.50 | 0.65 | 4 | 9.84 | 0.77 | 4 |
| LAB311 | 30221.4 | 1.32 | 0.37 | 11 | 0.50 | 0.60 | 4 | 10.54 | 0.37 | 11 |
| LAB311 | 30223.2 | 1.19 | 0.99 | 0 | 0.51 | 0.56 | 5 | 9.51 | 0.99 | 0 |
| LAB311 | 30223.4 | 1.27 | 0.55 | 7 | 0.52 | 0.39 | 7 | 10.19 | 0.55 | 7 |
| LAB311 | 30224.2 | 1.24 | 0.71 | 4 | 0.54 | 0.17 | 12 | 9.92 | 0.71 | 4 |
| LAB344 | 30092.3 | — | | — | 0.53 | 0.30 | 10 | — | | — |
| LAB344 | 30096.3 | — | | — | 0.50 | 0.71 | 3 | — | | — |
| LAB355 | 29281.3 | — | | — | 0.53 | 0.31 | 9 | — | | — |
| LAB355 | 29282.1 | — | | — | 0.50 | 0.62 | 4 | — | | — |
| LAB355 | 29282.2 | 1.19 | 0.97 | 0 | — | | — | 9.53 | 0.97 | 0 |
| LAB355 | 29282.3 | — | | — | 0.51 | 0.55 | 5 | — | | — |
| LAB355 | 29283.1 | 1.33 | 0.32 | 12 | 0.50 | 0.61 | 4 | 10.64 | 0.32 | 12 |
| LAB381 | 30352.2 | — | | — | 0.49 | 0.88 | 1 | — | | — |
| LAB381 | 30352.4 | 1.25 | 0.66 | 5 | 0.52 | 0.32 | 8 | 10.00 | 0.66 | 5 |
| LAB383 | 28114.2 | 1.44 | 0.09 | 21 | 0.53 | 0.25 | 10 | 11.51 | 0.09 | 21 |
| LAB383 | 28115.2 | 1.38 | 0.20 | 16 | 0.51 | 0.52 | 6 | 11.00 | 0.20 | 16 |
| LAB64 | 30271.2 | 1.30 | 0.43 | 10 | 0.53 | 0.28 | 9 | 10.41 | 0.43 | 10 |
| LAB64 | 30272.1 | 1.20 | 0.90 | 2 | 0.50 | 0.70 | 3 | 9.64 | 0.90 | 2 |
| LAB64 | 30273.2 | 1.19 | 0.97 | 0 | — | | — | 9.54 | 0.97 | 0 |
| LAB64 | 30274.2 | 1.35 | 0.30 | 13 | 0.53 | 0.24 | 11 | 10.76 | 0.30 | 13 |
| LAB64 | 30274.3 | — | | — | 0.49 | 0.81 | 2 | — | | — |
| LAB65 | 30301.4 | 1.37 | 0.20 | 16 | 0.55 | 0.12 | 13 | 10.98 | 0.20 | 16 |
| LAB65 | 30302.1 | 1.21 | 0.85 | 2 | 0.49 | 0.78 | 2 | 9.71 | 0.85 | 2 |
| LAB65 | 30303.4 | 1.19 | 0.97 | 0 | 0.49 | 0.87 | 1 | 9.54 | 0.97 | 0 |
| LAB65 | 30304.3 | 1.54 | 0.02 | 30 | 0.61 | 0.04 | 27 | 12.35 | 0.02 | 30 |
| cont | — | 1.19 | — | 0 | 0.48 | — | 0 | 9.50 | — | 0 |
| LAB159 | 30701.6 | 1.34 | 0.95 | 1 | 0.51 | 0.90 | 1 | 10.70 | 0.95 | 1 |
| LAB159 | 30702.4 | 1.43 | 0.56 | 8 | 0.55 | 0.36 | 8 | 11.45 | 0.56 | 8 |
| LAB159 | 30704.3 | 1.55 | 0.20 | 17 | 0.59 | 0.09 | 16 | 12.43 | 0.20 | 17 |
| LAB159 | 30704.4 | 1.48 | 0.39 | 12 | 0.53 | 0.69 | 4 | 11.85 | 0.39 | 12 |
| LAB161 | 30482.1 | 1.50 | 0.34 | 13 | 0.55 | 0.33 | 9 | 11.24 | 0.66 | 6 |
| LAB161 | 30482.2 | 1.49 | 0.35 | 13 | 0.58 | 0.16 | 13 | 11.96 | 0.35 | 13 |
| LAB161 | 30483.1 | 1.39 | 0.72 | 5 | 0.52 | 0.87 | 1 | 11.12 | 0.72 | 5 |
| LAB161 | 30485.1 | 1.50 | 0.33 | 13 | 0.56 | 0.29 | 10 | 12.03 | 0.33 | 13 |
| LAB166 | 30242.1 | 1.42 | 0.62 | 7 | 0.53 | 0.64 | 4 | 11.33 | 0.62 | 7 |
| LAB166 | 30243.1 | 1.37 | 0.79 | 4 | 0.52 | 0.86 | 2 | 10.99 | 0.79 | 4 |
| LAB166 | 30244.3 | 1.38 | 0.77 | 4 | — | | — | 11.01 | 0.77 | 4 |
| LAB170 | 30712.2 | 1.34 | 0.92 | 1 | — | | — | 10.75 | 0.92 | 1 |
| LAB170 | 30715.1 | 1.42 | 0.60 | 7 | 0.57 | 0.23 | 11 | 11.35 | 0.60 | 7 |
| LAB170 | 30715.2 | 1.36 | 0.85 | 3 | 0.54 | 0.52 | 6 | 10.87 | 0.85 | 3 |
| LAB176 | 30142.1 | 1.43 | 0.57 | 8 | 0.55 | 0.40 | 8 | 11.44 | 0.57 | 8 |
| LAB176 | 30143.2 | — | | — | 0.53 | 0.63 | 4 | — | | — |
| LAB188 | 30722.2 | 1.37 | 0.80 | 3 | 0.54 | 0.46 | 7 | 10.97 | 0.80 | 3 |
| LAB188 | 30723.3 | 1.37 | 0.78 | 4 | 0.56 | 0.26 | 10 | 10.99 | 0.78 | 4 |
| LAB188 | 30723.7 | 1.35 | 0.87 | 2 | 0.54 | 0.51 | 6 | 10.83 | 0.87 | 2 |
| LAB188 | 30724.1 | — | | — | 0.53 | 0.74 | 3 | — | | — |
| LAB188 | 30724.2 | 1.43 | 0.56 | 8 | 0.54 | 0.56 | 5 | 11.45 | 0.56 | 8 |
| LAB237 | 30281.4 | 1.48 | 0.40 | 12 | 0.59 | 0.11 | 16 | 11.83 | 0.40 | 12 |
| LAB237 | 30282.1 | 1.36 | 0.83 | 3 | 0.54 | 0.44 | 7 | 10.92 | 0.83 | 3 |
| LAB237 | 30283.2 | 1.34 | 0.94 | 1 | 0.54 | 0.57 | 5 | 10.71 | 0.94 | 1 |
| LAB259 | 27112.12 | 1.44 | 0.53 | 9 | 0.54 | 0.47 | 7 | 11.53 | 0.53 | 9 |
| LAB259 | 27112.9 | 1.36 | 0.85 | 3 | 0.52 | 0.76 | 3 | 10.87 | 0.85 | 3 |
| LAB262 | 30611.4 | 1.47 | 0.42 | 11 | 0.54 | 0.52 | 6 | 11.77 | 0.42 | 11 |
| LAB262 | 30614.2 | 1.47 | 0.47 | 11 | 0.53 | 0.72 | 4 | 11.78 | 0.47 | 11 |
| LAB270 | 30591.2 | 1.47 | 0.43 | 11 | 0.56 | 0.29 | 10 | 11.73 | 0.43 | 11 |
| LAB270 | 30594.1 | 1.62 | 0.11 | 23 | 0.58 | 0.12 | 15 | 13.00 | 0.11 | 23 |
| LAB270 | 30594.3 | 1.74 | 0.03 | 32 | 0.60 | 0.05 | 18 | 13.95 | 0.03 | 32 |
| LAB300 | 30061.2 | 1.51 | 0.31 | 14 | 0.52 | 0.77 | 3 | 12.07 | 0.31 | 14 |
| LAB300 | 30062.2 | 1.42 | 0.60 | 7 | 0.55 | 0.45 | 7 | 11.36 | 0.60 | 7 |

TABLE 83-continued

Genes showing improved rosette growth performance at standard growth conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % incr. | Ave. | P-Val. | % incr. | Ave. | P-Val. | % incr. |
| LAB300 | 30063.1 | 1.66 | 0.07 | 25 | 0.59 | 0.10 | 15 | 13.24 | 0.07 | 25 |
| LAB300 | 30064.3 | 1.66 | 0.08 | 25 | 0.59 | 0.09 | 15 | 13.25 | 0.08 | 25 |
| LAB306 | 30561.2 | 1.39 | 0.73 | 5 | 0.54 | 0.56 | 5 | 11.10 | 0.73 | 5 |
| LAB306 | 30562.2 | 1.33 | 0.97 | 0 | 0.54 | 0.48 | 6 | 10.65 | 0.97 | 0 |
| LAB306 | 30563.2 | — | | — | 0.51 | 0.99 | 0 | — | | — |
| LAB306 | 30564.2 | 1.53 | 0.25 | 16 | 0.54 | 0.47 | 7 | 12.28 | 0.25 | 16 |
| LAB306 | 30564.3 | 1.35 | 0.88 | 2 | 0.52 | 0.79 | 2 | 10.83 | 0.88 | 2 |
| LAB323 | 30381.4 | 1.38 | 0.75 | 4 | 0.54 | 0.52 | 6 | 11.07 | 0.75 | 4 |
| LAB323 | 30383.2 | 1.47 | 0.44 | 11 | 0.55 | 0.32 | 9 | 11.72 | 0.44 | 11 |
| LAB323 | 30385.1 | 1.33 | 0.97 | 1 | 0.51 | 0.93 | 1 | 10.67 | 0.97 | 1 |
| LAB347_H0 | 30441.1 | 1.54 | 0.26 | 16 | 0.52 | 0.77 | 3 | 12.35 | 0.26 | 16 |
| LAB347_H0 | 30442.4 | 1.46 | 0.45 | 10 | 0.57 | 0.19 | 12 | 11.71 | 0.45 | 10 |
| LAB347_H0 | 30443.4 | 1.44 | 0.52 | 9 | 0.55 | 0.43 | 8 | 11.55 | 0.52 | 9 |
| LAB347_H0 | 30444.1 | 1.50 | 0.34 | 13 | 0.55 | 0.43 | 7 | 12.02 | 0.34 | 13 |
| LAB55 | 30022.3 | 1.50 | 0.34 | 13 | 0.53 | 0.71 | 3 | 11.99 | 0.34 | 13 |
| LAB55 | 30023.1 | 1.41 | 0.64 | 6 | — | | — | 11.28 | 0.64 | 6 |
| LAB55 | 30023.3 | — | | — | 0.51 | 0.96 | 0 | — | | — |
| LAB55 | 30025.3 | 1.49 | 0.38 | 12 | 0.53 | 0.59 | 5 | 11.91 | 0.38 | 12 |
| LAB83 | 30191.1 | 1.63 | 0.10 | 23 | 0.57 | 0.17 | 13 | 13.01 | 0.10 | 23 |
| LAB83 | 30191.3 | — | | — | 0.52 | 0.87 | 2 | — | | — |
| LAB83 | 30194.1 | 1.46 | 0.47 | 10 | 0.53 | 0.66 | 4 | 11.65 | 0.47 | 10 |
| LAB83 | 30194.2 | 1.43 | 0.58 | 8 | 0.54 | 0.52 | 6 | 11.42 | 0.58 | 8 |
| LAB83 | 30194.3 | 1.41 | 0.65 | 6 | 0.52 | 0.73 | 3 | 11.26 | 0.65 | 6 |
| LAB94 | 30681.4 | 1.36 | 0.83 | 3 | — | | — | 10.92 | 0.83 | 3 |
| LAB94 | 30681.8 | 1.62 | 0.11 | 22 | 0.59 | 0.10 | 15 | 12.96 | 0.11 | 22 |
| LAB94 | 30682.2 | 1.49 | 0.38 | 12 | 0.54 | 0.52 | 6 | 11.93 | 0.38 | 12 |
| LAB94 | 30682.3 | 1.41 | 0.66 | 6 | 0.53 | 0.73 | 3 | 11.27 | 0.66 | 6 |
| cont | — | 1.33 | — | 0 | 0.51 | — | 0 | 10.61 | — | 0 |
| LAB138 | 30781.1 | — | | — | 0.42 | 0.86 | 2 | — | | — |
| LAB138 | 30781.2 | — | | — | 0.41 | 0.96 | 1 | — | | — |
| LAB159 | 30701.6 | — | | — | 0.42 | 0.80 | 3 | — | | — |
| LAB159 | 30702.3 | 0.96 | 0.24 | 21 | 0.45 | 0.38 | 11 | 7.72 | 0.19 | 24 |
| LAB159 | 30702.4 | 0.94 | 0.30 | 19 | 0.48 | 0.18 | 16 | 7.56 | 0.24 | 21 |
| LAB159 | 30704.3 | 0.86 | 0.63 | 9 | 0.44 | 0.49 | 8 | 6.90 | 0.54 | 10 |
| LAB159 | 30704.4 | 0.94 | 0.31 | 18 | 0.46 | 0.29 | 13 | 7.52 | 0.25 | 20 |
| LAB161 | 30482.1 | 0.91 | 0.43 | 14 | 0.47 | 0.21 | 16 | 7.26 | 0.36 | 16 |
| LAB161 | 30482.2 | 0.88 | 0.54 | 11 | 0.46 | 0.28 | 13 | 7.06 | 0.45 | 13 |
| LAB161 | 30483.1 | 0.85 | 0.69 | 7 | 0.45 | 0.43 | 10 | 6.81 | 0.61 | 9 |
| LAB161 | 30485.1 | 0.80 | 0.97 | 1 | 0.43 | 0.66 | 5 | 6.39 | 0.89 | 2 |
| LAB161 | 30486.1 | 0.88 | 0.57 | 10 | 0.45 | 0.43 | 9 | 7.00 | 0.49 | 12 |
| LAB166 | 30242.1 | 0.84 | 0.76 | 5 | 0.45 | 0.39 | 10 | 6.71 | 0.67 | 7 |
| LAB166 | 30243.1 | 0.91 | 0.44 | 14 | 0.45 | 0.43 | 10 | 7.24 | 0.36 | 16 |
| LAB166 | 30244.3 | 0.83 | 0.78 | 5 | — | | — | 6.67 | 0.69 | 7 |
| LAB166 | 30245.3 | 0.93 | 0.35 | 17 | 0.45 | 0.45 | 9 | 7.45 | 0.29 | 19 |
| LAB166 | 30245.4 | 1.07 | 0.06 | 35 | 0.48 | 0.17 | 17 | 8.56 | 0.04 | 37 |
| LAB170 | 30712.1 | 1.10 | 0.04 | 38 | 0.50 | 0.08 | 21 | 8.79 | 0.03 | 41 |
| LAB170 | 30712.2 | 0.95 | 0.28 | 20 | 0.48 | 0.17 | 17 | 7.61 | 0.22 | 22 |
| LAB170 | 30713.2 | 0.90 | 0.44 | 14 | 0.46 | 0.32 | 12 | 7.23 | 0.37 | 16 |
| LAB170 | 30715.1 | 0.95 | 0.27 | 20 | 0.47 | 0.22 | 15 | 7.63 | 0.22 | 22 |
| LAB170 | 30715.2 | 0.87 | 0.62 | 9 | 0.46 | 0.35 | 12 | 6.92 | 0.54 | 11 |
| LAB176 | 30141.4 | 0.89 | 0.48 | 12 | 0.44 | 0.51 | 8 | 7.15 | 0.41 | 14 |
| LAB176 | 30142.1 | 0.90 | 0.46 | 13 | 0.45 | 0.44 | 9 | 7.19 | 0.38 | 15 |
| LAB176 | 30143.1 | 0.89 | 0.49 | 12 | 0.47 | 0.22 | 15 | 7.14 | 0.41 | 14 |
| LAB176 | 30143.2 | 0.93 | 0.35 | 17 | 0.44 | 0.52 | 8 | 7.44 | 0.28 | 19 |
| LAB176 | 30144.2 | 0.92 | 0.39 | 15 | 0.44 | 0.49 | 8 | 7.33 | 0.32 | 17 |
| LAB188 | 30724.1 | 0.83 | 0.81 | 4 | 0.42 | 0.78 | 3 | 6.64 | 0.72 | 6 |
| LAB188 | 30724.2 | 0.81 | 0.92 | 2 | 0.41 | 0.97 | 0 | 6.47 | 0.84 | 4 |
| LAB237 | 30281.4 | 1.07 | 0.07 | 35 | 0.50 | 0.07 | 22 | 8.56 | 0.05 | 37 |
| LAB237 | 30282.1 | 0.89 | 0.51 | 12 | 0.43 | 0.65 | 5 | 7.10 | 0.43 | 14 |
| LAB237 | 30283.2 | 0.92 | 0.39 | 16 | 0.44 | 0.50 | 8 | 7.35 | 0.32 | 18 |
| LAB237 | 30284.1 | 0.85 | 0.71 | 7 | 0.45 | 0.39 | 10 | 6.79 | 0.62 | 9 |
| LAB259 | 27112.12 | 0.95 | 0.28 | 20 | 0.47 | 0.20 | 16 | 7.61 | 0.22 | 22 |
| LAB259 | 27112.14 | 1.03 | 0.12 | 29 | 0.51 | 0.04 | 25 | 8.20 | 0.09 | 31 |
| LAB259 | 27112.3 | 0.89 | 0.51 | 12 | 0.44 | 0.56 | 7 | 7.10 | 0.43 | 14 |
| LAB259 | 27112.7 | 0.93 | 0.35 | 17 | 0.48 | 0.14 | 19 | 7.42 | 0.29 | 19 |
| LAB259 | 27112.9 | 1.06 | 0.07 | 34 | 0.49 | 0.10 | 20 | 8.50 | 0.05 | 36 |
| LAB262 | 30612.1 | — | | — | — | | — | 6.28 | 0.97 | 1 |
| LAB262 | 30612.4 | 0.80 | 0.97 | 1 | 0.42 | 0.84 | 2 | 6.41 | 0.88 | 3 |
| LAB262 | 30614.1 | 0.99 | 0.20 | 24 | 0.45 | 0.42 | 10 | 7.88 | 0.15 | 26 |
| LAB262 | 30614.2 | 0.93 | 0.34 | 17 | 0.44 | 0.56 | 7 | 7.45 | 0.27 | 19 |
| LAB270 | 30591.2 | 0.80 | 0.99 | 0 | 0.42 | 0.85 | 2 | 6.38 | 0.90 | 2 |
| LAB270 | 30594.1 | 0.92 | 0.39 | 15 | 0.46 | 0.34 | 11 | 7.34 | 0.32 | 17 |

TABLE 83-continued

Genes showing improved rosette growth performance at standard growth conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % incr. | Ave. | P-Val. | % incr. | Ave. | P-Val. | % incr. |
| LAB270 | 30595.1 | — | | — | 0.41 | 0.95 | 1 | — | | — |
| LAB270 | 30595.2 | 0.93 | 0.37 | 16 | 0.47 | 0.26 | 14 | 7.40 | 0.31 | 19 |
| LAB300 | 30061.2 | 0.91 | 0.43 | 14 | 0.46 | 0.29 | 13 | 7.26 | 0.36 | 16 |
| LAB300 | 30062.2 | — | | — | 0.41 | 0.92 | 1 | — | | — |
| LAB300 | 30064.3 | 1.08 | 0.07 | 36 | 0.51 | 0.05 | 25 | 8.67 | 0.05 | 39 |
| LAB306 | 30561.2 | 0.84 | 0.74 | 6 | 0.44 | 0.53 | 8 | 6.73 | 0.65 | 8 |
| LAB306 | 30562.2 | 0.81 | 0.93 | 1 | 0.45 | 0.40 | 10 | 6.45 | 0.85 | 3 |
| LAB306 | 30563.2 | — | | — | 0.41 | 0.95 | 1 | — | | — |
| LAB306 | 30564.2 | 0.81 | 0.91 | 2 | 0.42 | 0.75 | 4 | 6.48 | 0.82 | 4 |
| LAB306 | 30564.3 | 1.03 | 0.12 | 29 | 0.48 | 0.17 | 17 | 8.21 | 0.09 | 31 |
| LAB323 | 30381.1 | — | | — | 0.43 | 0.62 | 6 | — | | — |
| LAB323 | 30381.4 | 0.83 | 0.78 | 5 | 0.43 | 0.61 | 6 | 6.66 | 0.70 | 7 |
| LAB323 | 30383.1 | — | | — | 0.42 | 0.88 | 2 | — | | — |
| LAB323 | 30383.2 | 0.81 | 0.89 | 2 | 0.42 | 0.78 | 4 | 6.51 | 0.81 | 4 |
| LAB83 | 30191.1 | 0.92 | 0.38 | 16 | 0.45 | 0.41 | 10 | 7.37 | 0.31 | 18 |
| LAB83 | 30191.3 | 0.80 | 0.95 | 1 | 0.41 | 0.96 | 1 | 6.42 | 0.87 | 3 |
| LAB83 | 30194.2 | — | | — | 0.42 | 0.78 | 3 | — | | — |
| LAB83 | 30194.3 | — | | — | 0.43 | 0.60 | 6 | — | | — |
| LAB94 | 30681.8 | 0.98 | 0.20 | 23 | 0.47 | 0.19 | 16 | 7.84 | 0.16 | 26 |
| LAB94 | 30682.2 | 0.80 | 0.94 | 1 | 0.41 | 0.92 | 1 | 6.44 | 0.86 | 3 |
| LAB94 | 30682.3 | 0.82 | 0.88 | 3 | 0.41 | 0.91 | 1 | 6.53 | 0.79 | 5 |
| LAB94 | 30684.2 | — | | — | 0.41 | 0.99 | 0 | — | | — |
| cont | — | 0.79 | — | 0 | 0.41 | — | 0 | 6.25 | — | 0 |
| LAB182 | 30451.3 | 0.97 | 0.80 | 4 | 0.44 | 0.77 | 4 | 7.74 | 0.80 | 4 |
| LAB182 | 30453.4 | 0.95 | 0.86 | 3 | 0.43 | 0.96 | 1 | 7.64 | 0.86 | 3 |
| LAB182 | 30454.2 | 1.07 | 0.36 | 15 | 0.46 | 0.50 | 9 | 8.57 | 0.36 | 15 |
| LAB191 | 28152.1 | 0.94 | 0.93 | 1 | 0.45 | 0.71 | 5 | 7.52 | 0.93 | 1 |
| LAB191 | 28153.2 | 1.00 | 0.63 | 8 | 0.46 | 0.54 | 8 | 8.01 | 0.63 | 8 |
| LAB191 | 28156.2 | 1.11 | 0.24 | 19 | 0.50 | 0.15 | 18 | 8.86 | 0.24 | 19 |
| LAB191 | 28156.4 | — | | — | 0.43 | 0.88 | 2 | — | | — |
| LAB221 | 30122.2 | 1.07 | 0.35 | 15 | 0.48 | 0.29 | 13 | 8.57 | 0.35 | 15 |
| LAB221 | 30123.2 | — | | — | 0.44 | 0.80 | 3 | — | | — |
| LAB221 | 30124.3 | — | | — | 0.43 | 0.99 | 0 | — | | — |
| LAB221 | 30124.4 | 1.06 | 0.41 | 14 | 0.47 | 0.39 | 11 | 8.46 | 0.41 | 14 |
| LAB221 | 30125.2 | 1.12 | 0.23 | 21 | 0.49 | 0.28 | 14 | 8.99 | 0.23 | 21 |
| LAB222 | 30472.2 | 1.00 | 0.65 | 7 | 0.47 | 0.38 | 11 | 7.97 | 0.65 | 7 |
| LAB222 | 30473.1 | 1.11 | 0.24 | 20 | 0.49 | 0.23 | 16 | 8.91 | 0.24 | 20 |
| LAB222 | 30474.1 | 1.17 | 0.15 | 26 | 0.50 | 0.17 | 18 | 9.34 | 0.15 | 26 |
| LAB222 | 30476.1 | 1.02 | 0.55 | 10 | — | | — | 8.15 | 0.55 | 10 |
| LAB222 | 30476.2 | — | | — | 0.44 | 0.79 | 3 | — | | — |
| LAB225 | 30492.2 | 1.03 | 0.51 | 11 | 0.46 | 0.48 | 9 | 8.21 | 0.51 | 11 |
| LAB225 | 30493.1 | 1.18 | 0.12 | 27 | 0.50 | 0.18 | 17 | 9.45 | 0.12 | 27 |
| LAB225 | 30493.2 | 1.08 | 0.33 | 17 | 0.48 | 0.33 | 12 | 8.66 | 0.33 | 17 |
| LAB232 | 30462.4 | 1.22 | 0.06 | 32 | 0.46 | 0.51 | 8 | 9.80 | 0.06 | 32 |
| LAB232 | 30463.2 | 0.94 | 0.94 | 1 | 0.45 | 0.71 | 5 | 7.51 | 0.94 | 1 |
| LAB260 | 30071.4 | 1.08 | 0.35 | 17 | 0.51 | 0.15 | 20 | 8.68 | 0.35 | 17 |
| LAB260 | 30072.2 | — | | — | 0.43 | 0.96 | 1 | — | | — |
| LAB260 | 30073.2 | 1.03 | 0.50 | 11 | 0.45 | 0.70 | 5 | 8.24 | 0.50 | 11 |
| LAB260 | 30073.4 | 1.06 | 0.40 | 14 | 0.47 | 0.42 | 10 | 8.45 | 0.40 | 14 |
| LAB260 | 30074.3 | 0.94 | 0.94 | 1 | 0.44 | 0.79 | 3 | 7.51 | 0.94 | 1 |
| LAB264 | 30131.1 | 0.98 | 0.75 | 5 | 0.45 | 0.69 | 5 | 7.82 | 0.75 | 5 |
| LAB264 | 30133.2 | 1.10 | 0.26 | 19 | 0.47 | 0.36 | 12 | 8.80 | 0.26 | 19 |
| LAB264 | 30134.4 | 1.04 | 0.47 | 12 | 0.46 | 0.48 | 9 | 8.31 | 0.47 | 12 |
| LAB264 | 30135.2 | 1.00 | 0.65 | 7 | 0.43 | 0.98 | 0 | 7.96 | 0.65 | 7 |
| LAB265 | 30733.4 | 0.94 | 0.95 | 1 | 0.43 | 0.95 | 1 | 7.49 | 0.95 | 1 |
| LAB290_H0 | 30663.7 | — | | — | 0.43 | 0.91 | 1 | — | | — |
| LAB303 | 30421.3 | — | | — | 0.45 | 0.70 | 5 | — | | — |
| LAB307 | 30761.1 | — | | — | 0.43 | 0.87 | 2 | — | | — |
| LAB307 | 30763.3 | 1.03 | 0.51 | 11 | 0.48 | 0.28 | 13 | 8.23 | 0.51 | 11 |
| LAB307 | 30764.1 | — | | — | 0.44 | 0.78 | 4 | — | | — |
| LAB307 | 30764.4 | — | | — | 0.43 | 0.96 | 1 | — | | — |
| LAB308 | 30931.4 | 1.09 | 0.30 | 17 | 0.44 | 0.71 | 5 | 8.71 | 0.30 | 17 |
| LAB308 | 30932.3 | 1.05 | 0.44 | 13 | 0.47 | 0.41 | 11 | 8.42 | 0.44 | 13 |
| LAB319 | 30775.4 | 1.07 | 0.38 | 15 | 0.49 | 0.25 | 14 | 8.52 | 0.38 | 15 |
| LAB320 | 30601.2 | 1.02 | 0.55 | 10 | 0.50 | 0.18 | 17 | 8.15 | 0.55 | 10 |
| LAB320 | 30602.2 | 1.04 | 0.47 | 12 | 0.45 | 0.66 | 6 | 8.36 | 0.45 | 13 |
| LAB343 | 30622.2 | 0.95 | 0.90 | 2 | — | | — | 7.57 | 0.90 | 2 |
| LAB343 | 30622.4 | 0.95 | 0.86 | 3 | — | | — | 7.63 | 0.86 | 3 |
| LAB343 | 30623.3 | 0.99 | 0.67 | 7 | 0.43 | 0.90 | 2 | 7.95 | 0.67 | 7 |
| LAB353 | 30554.2 | 0.98 | 0.72 | 6 | — | | — | 7.85 | 0.72 | 6 |
| LAB353 | 30554.3 | 1.16 | 0.14 | 25 | 0.47 | 0.39 | 11 | 9.29 | 0.14 | 25 |
| cont | — | 0.93 | — | 0 | 0.42 | — | 0 | 7.42 | — | 0 |

TABLE 83-continued

Genes showing improved rosette growth performance at standard growth conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % incr. | Ave. | P-Val. | % incr. | Ave. | P-Val. | % incr. |
| LAB182 | 30451.3 | 1.62 | 0.54 | 7 | 0.60 | 0.65 | 3 | 12.92 | 0.54 | 7 |
| LAB182 | 30453.1 | — | — | — | 0.58 | 0.95 | 0 | — | — | — |
| LAB182 | 30453.4 | 1.55 | 0.80 | 3 | — | — | — | 12.39 | 0.80 | 3 |
| LAB191 | 28156.2 | — | — | — | 0.58 | 0.96 | 0 | — | — | — |
| LAB191 | 28156.4 | 1.59 | 0.65 | 5 | 0.61 | 0.44 | 5 | 12.70 | 0.65 | 5 |
| LAB221 | 30124.3 | — | — | — | 0.60 | 0.58 | 4 | — | — | — |
| LAB221 | 30124.4 | — | — | — | 0.60 | 0.51 | 4 | — | — | — |
| LAB222 | 30472.1 | 1.59 | 0.64 | 6 | 0.59 | 0.78 | 2 | 12.73 | 0.64 | 6 |
| LAB222 | 30472.2 | 1.56 | 0.78 | 3 | 0.61 | 0.45 | 5 | 12.46 | 0.78 | 3 |
| LAB222 | 30473.1 | 1.57 | 0.72 | 4 | 0.59 | 0.74 | 2 | 12.57 | 0.72 | 4 |
| LAB222 | 30476.1 | 1.56 | 0.75 | 4 | 0.65 | 0.06 | 12 | 12.50 | 0.75 | 4 |
| LAB222 | 30476.2 | 1.70 | 0.30 | 13 | 0.64 | 0.11 | 11 | 13.57 | 0.30 | 13 |
| LAB225 | 30491.4 | 1.73 | 0.22 | 15 | 0.60 | 0.63 | 3 | 13.86 | 0.22 | 15 |
| LAB225 | 30492.2 | 1.51 | 0.99 | 0 | 0.58 | 0.99 | 0 | 12.05 | 0.99 | 0 |
| LAB225 | 30493.2 | 1.66 | 0.40 | 10 | 0.63 | 0.21 | 8 | 13.26 | 0.40 | 10 |
| LAB232 | 30462.4 | 1.73 | 0.21 | 15 | 0.61 | 0.42 | 5 | 13.84 | 0.21 | 15 |
| LAB260 | 30071.4 | 1.66 | 0.39 | 10 | 0.63 | 0.19 | 9 | 13.29 | 0.39 | 10 |
| LAB260 | 30072.2 | — | — | — | 0.58 | 0.91 | 1 | — | — | — |
| LAB260 | 30073.2 | — | — | — | 0.60 | 0.50 | 4 | — | — | — |
| LAB260 | 30073.4 | 1.69 | 0.31 | 12 | 0.65 | 0.06 | 13 | 13.54 | 0.31 | 12 |
| LAB260 | 30074.3 | — | — | — | 0.60 | 0.56 | 4 | — | — | — |
| LAB264 | 30131.1 | 1.53 | 0.87 | 2 | — | — | — | 12.27 | 0.87 | 2 |
| LAB264 | 30131.2 | — | — | — | 0.58 | 0.91 | 1 | — | — | — |
| LAB264 | 30133.2 | 1.64 | 0.47 | 9 | 0.62 | 0.31 | 7 | 13.10 | 0.47 | 9 |
| LAB264 | 30135.2 | 1.85 | 0.07 | 23 | 0.63 | 0.20 | 9 | 14.79 | 0.07 | 23 |
| LAB265 | 30731.3 | 1.62 | 0.54 | 7 | 0.61 | 0.44 | 5 | 12.92 | 0.54 | 7 |
| LAB265 | 30732.3 | — | — | — | 0.58 | 0.94 | 0 | — | — | — |
| LAB265 | 30733.4 | — | — | — | 0.59 | 0.83 | 1 | — | — | — |
| LAB265 | 30734.4 | — | — | — | 0.59 | 0.73 | 2 | — | — | — |
| LAB290_H0 | 30663.3 | 1.51 | 0.97 | 0 | — | — | — | 12.09 | 0.97 | 0 |
| LAB290_H0 | 30663.7 | 1.75 | 0.18 | 17 | 0.65 | 0.05 | 13 | 14.03 | 0.18 | 17 |
| LAB308 | 30931.4 | 1.58 | 0.69 | 5 | 0.59 | 0.86 | 1 | 12.64 | 0.69 | 5 |
| LAB308 | 30932.3 | 1.75 | 0.18 | 16 | 0.65 | 0.07 | 12 | 14.02 | 0.18 | 16 |
| LAB308 | 30933.2 | — | — | — | 0.61 | 0.54 | 5 | — | — | — |
| LAB319 | 30771.5 | 1.67 | 0.36 | 11 | 0.64 | 0.16 | 10 | 13.38 | 0.36 | 11 |
| LAB319 | 30774.1 | 1.52 | 0.93 | 1 | 0.58 | 0.96 | 0 | 12.16 | 0.93 | 1 |
| LAB319 | 30775.1 | 1.55 | 0.82 | 3 | — | — | — | 12.36 | 0.82 | 3 |
| LAB319 | 30775.4 | 1.61 | 0.57 | 7 | 0.61 | 0.40 | 5 | 12.86 | 0.57 | 7 |
| LAB320 | 30601.3 | 1.62 | 0.54 | 7 | 0.59 | 0.87 | 1 | 12.94 | 0.54 | 7 |
| LAB320 | 30601.4 | 1.56 | 0.75 | 4 | — | — | — | 12.51 | 0.75 | 4 |
| LAB320 | 30602.2 | 1.58 | 0.66 | 5 | 0.58 | 0.93 | 1 | 12.67 | 0.66 | 5 |
| LAB320 | 30603.1 | 1.55 | 0.80 | 3 | 0.59 | 0.81 | 2 | 12.41 | 0.80 | 3 |
| LAB320 | 30605.1 | 1.62 | 0.55 | 7 | 0.62 | 0.26 | 8 | 12.25 | 0.89 | 2 |
| LAB343 | 30623.3 | — | — | — | 0.58 | 0.96 | 0 | — | — | — |
| LAB343 | 30623.4 | 1.51 | 1.00 | 0 | 0.63 | 0.19 | 9 | 12.05 | 1.00 | 0 |
| LAB348 | 30506.2 | 1.55 | 0.82 | 3 | — | — | — | 12.37 | 0.82 | 3 |
| LAB353 | 30554.3 | 1.52 | 0.95 | 1 | 0.58 | 0.98 | 0 | 12.14 | 0.95 | 1 |
| cont | — | 1.51 | — | 0 | 0.58 | — | 0 | 12.04 | — | 0 |
| LAB108 | 28504.1 | — | — | — | 0.55 | 0.48 | 5 | — | — | — |
| LAB108 | 28505.2 | 1.21 | 0.59 | 7 | 0.53 | 0.79 | 2 | 9.70 | 0.59 | 7 |
| LAB108 | 28505.4 | 1.18 | 0.73 | 4 | 0.55 | 0.44 | 5 | 9.47 | 0.73 | 4 |
| LAB119 | 28411.1 | 1.15 | 0.89 | 2 | 0.58 | 0.09 | 11 | 9.24 | 0.89 | 2 |
| LAB157 | 28142.3 | 1.22 | 0.55 | 8 | 0.52 | 0.99 | 0 | 9.77 | 0.55 | 8 |
| LAB157 | 28144.2 | — | — | — | 0.52 | 0.92 | 1 | — | — | — |
| LAB157 | 28146.1 | 1.16 | 0.87 | 2 | 0.54 | 0.52 | 4 | — | — | — |
| LAB231 | 28582.1 | 1.19 | 0.69 | 5 | 0.58 | 0.15 | 11 | 9.55 | 0.69 | 5 |
| LAB231 | 28583.1 | 1.16 | 0.88 | 2 | — | — | — | 9.26 | 0.88 | 2 |
| LAB231 | 28585.1 | — | — | — | 0.55 | 0.51 | 5 | — | — | — |
| LAB231 | 28585.3 | 1.25 | 0.43 | 10 | 0.59 | 0.06 | 13 | 9.99 | 0.43 | 10 |
| LAB238 | 28422.4 | — | — | — | 0.55 | 0.44 | 5 | — | — | — |
| LAB238 | 28424.3 | — | — | — | 0.54 | 0.67 | 3 | — | — | — |
| LAB238 | 28425.5 | 1.20 | 0.67 | 5 | 0.54 | 0.58 | 4 | 9.57 | 0.67 | 5 |
| LAB240 | 28592.2 | 1.17 | 0.78 | 3 | 0.53 | 0.72 | 2 | 9.39 | 0.78 | 3 |
| LAB240 | 28592.6 | — | — | — | 0.54 | 0.61 | 3 | — | — | — |
| LAB240 | 28595.1 | — | — | — | 0.53 | 0.77 | 2 | — | — | — |
| LAB242 | 28081.2 | — | — | — | 0.56 | 0.20 | 8 | — | — | — |
| LAB242 | 28083.1 | — | — | — | 0.53 | 0.83 | 1 | — | — | — |
| LAB267 | 28381.2 | — | — | — | 0.54 | 0.62 | 3 | — | — | — |
| LAB267 | 28383.2 | 1.17 | 0.79 | 3 | 0.54 | 0.60 | 3 | 9.38 | 0.79 | 3 |
| LAB269 | 28342.3 | — | — | — | 0.53 | 0.78 | 2 | — | — | — |
| LAB269 | 28343.4 | 1.24 | 0.47 | 9 | 0.58 | 0.08 | 12 | 9.90 | 0.47 | 9 |
| LAB269 | 28345.2 | — | — | — | 0.56 | 0.29 | 7 | — | — | — |

TABLE 83-continued

Genes showing improved rosette growth performance at standard growth conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % incr. | Ave. | P-Val. | % incr. | Ave. | P-Val. | % incr. |
| LAB279 | 28353.2 | — | | — | 0.53 | 0.71 | 2 | — | | — |
| LAB279 | 28354.1 | — | | — | 0.56 | 0.28 | 7 | — | | — |
| LAB283 | 28363.3 | 1.18 | 0.77 | 4 | 0.55 | 0.49 | 6 | 9.46 | 0.77 | 4 |
| LAB283 | 28364.3 | — | | — | 0.53 | 0.86 | 1 | — | | — |
| LAB283 | 28365.1 | 1.17 | 0.78 | 3 | 0.57 | 0.20 | 9 | 9.39 | 0.78 | 3 |
| LAB298 | 29242.1 | 1.15 | 0.94 | 1 | 0.54 | 0.70 | 3 | 9.18 | 0.94 | 1 |
| LAB299 | 28061.1 | 1.17 | 0.84 | 3 | 0.55 | 0.43 | 6 | 9.33 | 0.84 | 3 |
| LAB299 | 28063.2 | — | | — | 0.53 | 0.87 | 1 | — | | — |
| LAB299 | 28064.1 | — | | — | 0.52 | 0.99 | 0 | — | | — |
| LAB299 | 28066.1 | 1.20 | 0.64 | 6 | 0.54 | 0.53 | 4 | 9.62 | 0.64 | 6 |
| LAB302 | 28822.7 | — | | — | 0.54 | 0.63 | 3 | — | | — |
| LAB336 | 28374.1 | — | | — | 0.57 | 0.14 | 10 | — | | — |
| LAB336 | 28374.3 | — | | — | 0.53 | 0.84 | 1 | — | | — |
| LAB339 | 27272.4 | 1.19 | 0.71 | 5 | 0.57 | 0.13 | 10 | 9.50 | 0.71 | 5 |
| LAB345 | 28492.2 | — | | — | 0.53 | 0.87 | 1 | — | | — |
| LAB58 | 28442.4 | — | | — | 0.53 | 0.79 | 2 | — | | — |
| LAB58 | 28443.4 | 1.20 | 0.66 | 6 | 0.55 | 0.46 | 5 | 9.59 | 0.66 | 6 |
| cont | — | 1.13 | — | 0 | 0.52 | — | 0 | 9.08 | — | 0 |
| LAB129 | 30825.5 | — | | — | — | | — | 10.73 | 0.88 | 2 |
| LAB130 | 30544.2 | 1.51 | 0.49 | 8 | — | | — | 12.31 | 0.25 | 17 |
| LAB130 | 30545.1 | 1.47 | 0.68 | 5 | 0.55 | 0.65 | 3 | 11.78 | 0.41 | 12 |
| LAB130 | 30545.2 | 1.42 | 0.95 | 1 | 0.54 | 0.91 | 1 | 11.48 | 0.53 | 9 |
| LAB163 | 30831.3 | 1.50 | 0.57 | 7 | 0.54 | 0.94 | 1 | 11.97 | 0.34 | 14 |
| LAB163 | 30833.1 | 1.46 | 0.72 | 4 | 0.56 | 0.41 | 5 | 11.88 | 0.38 | 13 |
| LAB163 | 30833.2 | 1.64 | 0.18 | 17 | 0.58 | 0.26 | 8 | 10.50 | 1.00 | 0 |
| LAB163 | 30834.2 | 1.67 | 0.12 | 19 | 0.60 | 0.07 | 13 | 13.54 | 0.06 | 29 |
| LAB164 | 30522.4 | 1.46 | 0.75 | 4 | — | | — | 11.65 | 0.46 | 11 |
| LAB164 | 30523.3 | — | | — | — | | — | 10.95 | 0.77 | 4 |
| LAB164 | 30524.1 | 1.69 | 0.10 | 20 | 0.55 | 0.72 | 2 | 13.50 | 0.06 | 29 |
| LAB164 | 30525.2 | 1.54 | 0.41 | 10 | — | | — | 12.31 | 0.25 | 17 |
| LAB164 | 30525.3 | 1.42 | 0.91 | 1 | 0.55 | 0.66 | 3 | 11.39 | 0.56 | 9 |
| LAB171 | 30841.3 | 1.55 | 0.35 | 11 | 0.54 | 0.94 | 0 | 12.43 | 0.21 | 18 |
| LAB171 | 30841.4 | 1.54 | 0.40 | 10 | 0.54 | 0.93 | 1 | 12.34 | 0.24 | 18 |
| LAB171 | 30842.3 | 1.77 | 0.04 | 26 | 0.58 | 0.21 | 9 | 14.14 | 0.03 | 35 |
| LAB171 | 30843.2 | 1.50 | 0.57 | 7 | 0.54 | 0.80 | 2 | 11.97 | 0.35 | 14 |
| LAB175 | 30512.3 | — | | — | — | | — | 10.53 | 0.98 | 0 |
| LAB175 | 30513.4 | — | | — | 0.54 | 0.78 | 2 | — | | — |
| LAB175 | 30514.3 | 1.43 | 0.87 | 2 | — | | — | 11.61 | 0.48 | 11 |
| LAB175 | 30514.4 | — | | — | — | | — | 10.84 | 0.82 | 3 |
| LAB204 | 30863.1 | 1.51 | 0.52 | 8 | 0.54 | 0.90 | 1 | — | | — |
| LAB204 | 30864.1 | 1.45 | 0.78 | 3 | 0.56 | 0.50 | 5 | 11.61 | 0.48 | 11 |
| LAB261 | 31073.1 | 1.50 | 0.57 | 7 | 0.55 | 0.58 | 4 | — | | — |
| LAB261 | 31074.4 | — | | — | 0.55 | 0.74 | 2 | 11.24 | 0.64 | 7 |
| LAB261 | 31075.1 | — | | — | 0.55 | 0.68 | 3 | 10.84 | 0.82 | 3 |
| LAB263 | 30891.6 | 1.55 | 0.39 | 10 | 0.54 | 0.84 | 1 | — | | — |
| LAB263 | 30892.2 | 1.60 | 0.22 | 14 | 0.55 | 0.73 | 2 | 12.83 | 0.14 | 22 |
| LAB263 | 30892.3 | 1.52 | 0.48 | 8 | — | | — | 12.31 | 0.25 | 17 |
| LAB263 | 30892.4 | 1.46 | 0.71 | 4 | 0.56 | 0.46 | 5 | 11.72 | 0.43 | 12 |
| LAB271 | 30901.3 | 1.48 | 0.66 | 5 | 0.57 | 0.36 | 6 | 11.82 | 0.40 | 13 |
| LAB272 | 31123.1 | — | | — | 0.55 | 0.66 | 3 | — | | — |
| LAB272 | 31125.4 | — | | — | — | | — | 11.14 | 0.67 | 6 |
| LAB272 | 31125.5 | 1.48 | 0.65 | 5 | 0.56 | 0.43 | 5 | 12.01 | 0.33 | 14 |
| LAB284 | 30911.3 | 1.82 | 0.02 | 30 | 0.60 | 0.09 | 13 | 11.16 | 0.73 | 6 |
| LAB284 | 30912.2 | 1.43 | 0.88 | 2 | — | | — | 11.43 | 0.55 | 9 |
| LAB284 | 30913.1 | 1.58 | 0.29 | 12 | 0.54 | 0.78 | 2 | 12.62 | 0.18 | 20 |
| LAB284 | 30913.3 | — | | — | 0.54 | 0.88 | 1 | 11.23 | 0.64 | 7 |
| LAB284 | 30914.3 | 1.57 | 0.33 | 11 | 0.56 | 0.44 | 5 | 12.52 | 0.20 | 19 |
| LAB286 | 30921.1 | — | | — | 0.54 | 0.95 | 0 | 10.77 | 0.86 | 3 |
| LAB286 | 30922.1 | 1.98 | 0.00 | 41 | 0.67 | 0.00 | 25 | 16.30 | 0.00 | 55 |
| LAB286 | 30922.4 | 1.59 | 0.28 | 13 | 0.58 | 0.22 | 9 | 12.70 | 0.17 | 21 |
| LAB286 | 30923.3 | 1.48 | 0.64 | 5 | 0.56 | 0.54 | 4 | 11.83 | 0.39 | 13 |
| LAB329 | 30102.2 | — | | — | — | | — | 11.03 | 0.73 | 5 |
| LAB329 | 30103.1 | 1.63 | 0.17 | 16 | 0.59 | 0.11 | 11 | 13.44 | 0.07 | 28 |
| LAB329 | 30103.2 | 1.46 | 0.72 | 4 | — | | — | 11.70 | 0.44 | 12 |
| LAB329 | 30104.1 | 1.57 | 0.31 | 12 | 0.56 | 0.41 | 5 | 12.54 | 0.19 | 19 |
| LAB329 | 30104.2 | 1.57 | 0.32 | 11 | 0.57 | 0.30 | 7 | 12.53 | 0.19 | 19 |
| cont | — | 1.40 | — | 0 | 0.53 | — | 0 | 10.49 | — | 0 |
| LAB107 | 30533.4 | 1.26 | 0.39 | 14 | 0.57 | 0.47 | 7 | 10.06 | 0.39 | 14 |
| LAB107 | 30534.3 | — | | — | 0.54 | 0.93 | 1 | — | | — |
| LAB107 | 30535.2 | 1.15 | 0.78 | 4 | 0.55 | 0.71 | 3 | 9.20 | 0.78 | 4 |
| LAB121 | 30801.4 | 1.24 | 0.41 | 13 | 0.57 | 0.41 | 7 | 9.95 | 0.41 | 13 |
| LAB121 | 30802.1 | 1.12 | 0.90 | 2 | 0.55 | 0.75 | 3 | 8.99 | 0.90 | 2 |

TABLE 83-continued

Genes showing improved rosette growth performance at standard growth conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Val. | % incr. | Ave. | P-Val. | % incr. | Ave. | P-Val. | % incr. |
| LAB121 | 30802.2 | 1.21 | 0.53 | 10 | 0.56 | 0.57 | 5 | 9.68 | 0.53 | 10 |
| LAB121 | 30804.1 | 1.21 | 0.52 | 10 | 0.55 | 0.75 | 3 | 9.70 | 0.52 | 10 |
| LAB129 | 30824.2 | 1.19 | 0.62 | 8 | 0.55 | 0.82 | 2 | 9.53 | 0.62 | 8 |
| LAB129 | 30825.1 | 1.29 | 0.29 | 17 | 0.56 | 0.62 | 4 | 10.31 | 0.29 | 17 |
| LAB130 | 30544.2 | 1.26 | 0.35 | 14 | 0.57 | 0.42 | 7 | 9.47 | 0.64 | 7 |
| LAB130 | 30545.1 | 1.32 | 0.21 | 20 | 0.60 | 0.20 | 12 | 10.57 | 0.21 | 20 |
| LAB130 | 30545.2 | 1.15 | 0.79 | 4 | — | — | — | 9.20 | 0.79 | 4 |
| LAB163 | 30831.3 | — | — | — | 0.55 | 0.75 | 3 | — | — | — |
| LAB163 | 30833.2 | 1.19 | 0.60 | 8 | — | — | — | 9.56 | 0.60 | 8 |
| LAB163 | 30834.2 | — | — | — | 0.55 | 0.67 | 4 | — | — | — |
| LAB164 | 30524.1 | 1.21 | 0.53 | 10 | 0.55 | 0.74 | 3 | 9.68 | 0.53 | 10 |
| LAB164 | 30525.2 | 1.31 | 0.24 | 19 | 0.55 | 0.68 | 3 | 10.48 | 0.24 | 19 |
| LAB164 | 30525.3 | — | — | — | 0.53 | 0.98 | 0 | — | — | — |
| LAB171 | 30841.3 | 1.13 | 0.89 | 2 | 0.55 | 0.71 | 3 | 9.02 | 0.89 | 2 |
| LAB171 | 30842.4 | 1.29 | 0.30 | 16 | 0.59 | 0.27 | 10 | 10.28 | 0.30 | 16 |
| LAB171 | 30843.2 | 1.25 | 0.37 | 13 | 0.56 | 0.53 | 5 | 10.02 | 0.37 | 13 |
| LAB171 | 30845.1 | 1.35 | 0.16 | 22 | 0.57 | 0.44 | 7 | 10.78 | 0.16 | 22 |
| LAB172 | 30852.3 | — | — | — | 0.54 | 0.91 | 1 | — | — | — |
| LAB172 | 30853.4 | — | — | — | 0.55 | 0.78 | 2 | — | — | — |
| LAB175 | 30514.4 | 1.15 | 0.77 | 4 | 0.54 | 0.82 | 2 | 9.22 | 0.77 | 4 |
| LAB204 | 30862.3 | 1.16 | 0.74 | 5 | 0.55 | 0.66 | 4 | 9.28 | 0.74 | 5 |
| LAB204 | 30863.1 | 1.27 | 0.36 | 15 | 0.57 | 0.51 | 6 | 10.12 | 0.36 | 15 |
| LAB204 | 30865.4 | 1.14 | 0.83 | 3 | 0.56 | 0.58 | 5 | 9.11 | 0.83 | 3 |
| LAB261 | 31074.2 | 1.20 | 0.56 | 9 | 0.54 | 0.87 | 1 | 9.62 | 0.56 | 9 |
| LAB261 | 31074.4 | 1.24 | 0.42 | 12 | 0.56 | 0.54 | 5 | 9.93 | 0.42 | 12 |
| LAB261 | 31075.1 | 1.32 | 0.24 | 19 | 0.60 | 0.20 | 12 | 10.55 | 0.24 | 19 |
| LAB261 | 31075.3 | 1.30 | 0.26 | 18 | 0.57 | 0.45 | 7 | 10.40 | 0.26 | 18 |
| LAB263 | 30891.6 | 1.30 | 0.27 | 18 | 0.58 | 0.28 | 10 | 10.40 | 0.27 | 18 |
| LAB263 | 30892.2 | 1.32 | 0.21 | 20 | 0.58 | 0.32 | 9 | 10.59 | 0.21 | 20 |
| LAB263 | 30892.3 | 1.37 | 0.14 | 24 | 0.59 | 0.24 | 10 | 10.93 | 0.14 | 24 |
| LAB263 | 30892.4 | 1.29 | 0.27 | 17 | 0.59 | 0.20 | 11 | 10.33 | 0.27 | 17 |
| LAB263 | 30893.3 | 1.26 | 0.38 | 14 | 0.57 | 0.41 | 7 | 10.06 | 0.38 | 14 |
| LAB271 | 30905.4 | — | — | — | 0.54 | 0.87 | 1 | — | — | — |
| LAB271 | 30905.6 | 1.12 | 0.91 | 2 | — | — | — | 8.98 | 0.91 | 2 |
| LAB271 | 30905.7 | 1.16 | 0.73 | 5 | — | — | — | 9.29 | 0.73 | 5 |
| LAB272 | 31121.1 | 1.43 | 0.07 | 30 | 0.59 | 0.24 | 10 | 11.46 | 0.07 | 30 |
| LAB272 | 31123.6 | 1.17 | 0.68 | 6 | 0.54 | 0.86 | 2 | 9.38 | 0.68 | 6 |
| LAB272 | 31125.4 | 1.24 | 0.42 | 13 | 0.55 | 0.77 | 2 | 9.94 | 0.42 | 13 |
| LAB284 | 30914.3 | — | — | — | 0.55 | 0.77 | 3 | — | — | — |
| LAB286 | 30922.1 | — | — | — | 0.55 | 0.68 | 4 | — | — | — |
| LAB286 | 30923.3 | 1.28 | 0.30 | 16 | 0.56 | 0.60 | 5 | 10.26 | 0.30 | 16 |
| LAB286 | 30924.3 | 1.26 | 0.37 | 14 | 0.56 | 0.54 | 5 | 10.06 | 0.37 | 14 |
| LAB329 | 30102.3 | 1.11 | 0.96 | 1 | — | — | — | 8.89 | 0.96 | 1 |
| cont | — | 1.10 | — | 0 | 0.53 | — | 0 | 8.83 | — | 0 |
| LAB137 | 31312.2 | — | — | — | — | — | — | -1.38 | 0.83 | 251 |
| LAB154 | 30692.2 | — | — | — | — | — | — | -1.63 | 0.79 | 313 |
| LAB154 | 30693.2 | — | — | — | — | — | — | -4.25 | 0.47 | 980 |
| LAB154 | 30693.8 | — | — | — | — | — | — | -2.80 | 0.61 | 610 |
| LAB178 | 30632.1 | -0.14 | 0.92 | 84 | — | — | — | — | — | — |
| LAB312 | 30943.1 | -0.11 | 0.96 | 45 | — | — | — | — | — | — |
| LAB342 | 31705.4 | -0.11 | 0.96 | 46 | — | — | — | — | — | — |
| LAB342 | 31705.6 | -0.10 | 0.97 | 31 | — | — | — | — | — | — |
| LAB54 | 28131.1 | -0.11 | 0.96 | 43 | — | — | — | — | — | — |
| LAB54 | 28136.2 | — | — | — | — | — | — | -0.49 | 0.98 | 23 |
| LAB97 | 31306.1 | -0.08 | 1.00 | 4 | — | — | — | — | — | — |
| cont | — | -0.08 | — | 0 | — | — | — | -0.39 | — | 0 |
| LAB312 | 30943.1 | 1.46 | 0.86 | 2 | 0.52 | 0.87 | 1 | 11.70 | 0.86 | 2 |
| LAB342 | 31705.6 | 1.58 | 0.36 | 10 | 0.57 | 0.21 | 10 | 12.65 | 0.36 | 10 |
| LAB56 | 31451.3 | 1.53 | 0.53 | 7 | 0.54 | 0.51 | 5 | 12.27 | 0.53 | 7 |
| LAB56 | 31455.1 | 1.55 | 0.48 | 8 | 0.55 | 0.45 | 6 | 12.42 | 0.48 | 8 |
| LAB97 | 31306.4 | 1.51 | 0.61 | 5 | — | — | — | 12.06 | 0.61 | 5 |
| cont | — | 1.43 | — | 0 | 0.51 | — | 0 | 11.48 | — | 0 |

Table 83.
"CONT."—Control;
"Ave."—Average;
"% Incr." = % increment;
"p-val."—p-value.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (9211 sequences)

SEQ ID NO: 1 - DNA, 1153 bp, Hordeum vulgare
gtagtcgcgccatagctgcagctacacatctcagcgttaacaggccaagatgaagctcgtcgtgctctcggccctgctcctgctttctctcgtcgccgtctcctcggcggaggaattcgatttcttctaccttgtgcagcaatggccagggtccttctgtgacacgaagaaggggtgctgcttcccggacaccggcaagccggcgacggacttcggcatccacgggctctggcccaactacgccgagtgcaagacccgcggcgagctcgacggcgccttggagatggtgaccaggcggaggaagaagtgctggccggagtcctgcaacagcgagcgcctcaagctctgggaaatcagggacctggtgacggagctggacgccaactggccgacgctggcgtgcaagggcgggaagagcttcgagttctggacccacgagtgggagaagcacggcacctgctccaacctggaccagcacggctacttcgcgacggcgctcggcttcaaggcccgccacaacctcaccagcatcctcgccgacgccgggatcgtgccgtccgacaccgagacctacttcctcagcagcatcagggacgccatcagggaggggaccgggttcacggcgaacctggagtgcaaccgtggcgtcgacggcgagacgcagctgttccaggtgtaccagtgcatcgaccgcgacggggagaacctcatcgactgcccgctgccgatgcagggcaactgcaaagacagggtccagctgccggccttctgattaaatttgagttctaattgaacatccattgccgccgcccgtcggggtgtggcggctgattggctcgacgcggccggccatctgcacggcgcgcggctggattacgtgatggatgtacctttgtgttggttatcggttcagttaaaattccgtccagtcctgagttctggacatcgacgtaacgttttctatcaattcctgatctcaacaggcgaataaagacttctaatcttgtctttcgattttgctccacatattctgaacgaggtcaaaagatggaacaaagtatgtcacaagtcacaacactgagttgggatcttttgttgttttttcgagatgaccttgagttggcatgggtgcgtgcattcttgagcggccgcc

SEQ ID NO: 2 - DNA, 1483 bp, Hordeum vulgare
aacatcatcacgatcaatcgcctcacgctttcggttcctaatccaaccacctccaccatcacctccgtgctccccgtgccacgcttcccctgtccgtccgagagctccaccagctagcagccatggacggcaagggctacaccacaccgccaaccgcgcctgcgccacaggccgaggcaggagcgcctcacttctatcccccgacggagcacggcaccgcgccacagccgggatcgcaggtctcctatcccccgatgccaaaggccatggatggccaggacgccgccgcgccacagccgggagcgccgccgcacccgtcctccccactcacgcagcaggccatggagctagagggcaagtacgccgccccacagccgggcactggagctacgccgtcccccccgacgcagcaagccgtggacggcaaggacgccgccccgacaccgcccgccgagtcggcgcggtggggtacgaggcagatgggtccgccagcggcgccgggggcgcatcccgagaaccagcaggcagcgcagtggacggccacgcgcggggaccaggagctgccgccgtacgtcatcatgggggcaccggagccggcgccggcggcgtcggcgcggcggactgacaaggaggccagggacagccccatggagcacatcctcgacttcttcaacacctggagccgcaaggccgaggagctctcctccaacatctggctcaacctgaagacggcgccgtccatgtcggacgcggcgatggggaagctgagcctgggggcgaaggcgatcacggggggcggcttcgagaagctctacaagcagaccttcggctccggccccgacgagcacgtgaagaagacgttcgcctgctacctctccacggccacgggccccgtcgccggcacgctctacctcaccaacaccaacgtcgccttctgcagcgaccgcccgctctccttcgccgcgccgtccggccagaccgcctggagctactacaaggtcatgatcccgctcgccaagctcgccgccgtcgagcccgtcacggccaaggagagcccgcccgagaggtacatccacatcgtcaccgtcgacgcgcacgacttttggttcatgggcttcgtcagctacgacaaggccgtgcgccatctgggcggggcagtctcctcgtcgcagcaccacggcgccgcgccggcgccggcaccggcaccgacctacgagtgatcggctgattgccgccgtgtacgtgtgtccgtggctctctgcttttgattgccgtgtgtgtgctctgctttttgcgcggatctgtttagtgagtgcttgtgtagtggatgtccgtgtgattatgtattgttgtctatacgcttttgtcgaaatttaacgcgttcttcttaatttccttcaaatattcttctccacctcttgtacggtatatttgtgttactcggagttgggcactgtatttgaattttgagcatgttttctag

SEQ ID NO: 3 - DNA, 2203 bp, Hordeum vulgare
aggttaggccttcccaagtttgcagaggagataagctagcaagccgctccaaggccccaggacgccatggccacaaaccctggcctcttcagcgagtggccatggaagaagctcggcagcttcaagtacgtggtgctggcgccatgggtggcgcacggcatccagcaggtggcgaccaaggggtggcgcgaggccgacctgggctacctggtgatcctcccgtcgatgatgctccgggtgctccacaaccaggcctggatcacggtgtcccgcctccagaacgcgcgcggcaagcggcagatcgtcgaccgcggcatcgagttcgagcagatcgaccgcgagcgcaactgggacgaccagatcatcctgagcgccatcctcttcttcctgggcgcgctgcacctgccgggcgggcagaacctgccgctgtggaggacggacggcgccgtgctggtagcgctgctgcacgccggccccgtggagctcatctactactggttccaccgcgcgctgcaccaccacttcctctacacgcgctaccactcccaccaccacgcctccatcgtcaccgagcccatcacctccgtgattcatccatttgccgagctcgtggcctacgaactgctcttctcgatcccgatgatcgcctgcgctctgacaggaactgcttccatcatgacgtttgagctctacatgctctacatcgacttcatgaacaacatgggccactgcaacttcgagcttgtgcccgcatggctcttcaaatggttccctcccctcaagtatttcatgtacacaccatcgttccattctctccaccacacccagttccggacaaactactctcttttcatgccgctctacgactacatatacaacacaatggacaagtcgtcagataagctgcatgagaaatcactcgacaacaagcaggaagccatagatgtggttcacctcacccatctcaccagcctgcagtccatctaccacatgaggcccgggttcgccgagttcgcctccaagccgtacgcctcaaagtggtacatgcgcatcatgtggcctctatcgtggctctccatggtccttacatgggtgtatggttcttggttcaccgttgagaggaatgtcatggagaaactaaggatccagtcatgggccataccaagatacaatttccattatgggttgaactgggagaaggaaacaattaataacctgattgggaaggcaatatgtgaagctgacaagaagggagctaaagttgttagtcttggactcctgaatcaggcccagagcctcaacggaagtggagaactttatctacaaaagtacccaaagttggggttaaaattggttgatggaaccagtctagctgctgcagtggttgtcaacagtattccacaaggcacggatcaagttgttctttcaggaaacatttcaaaggtggcttgcgctgtggcagcagctctgtgcaagaaaaatatcaaggtcacaataacaaacaagcaagactatcatttccttcagcccaaaatgccagaagatgcagctgacaacctaatattatcaaaaaccggcatcgctaaggtgtggataattggagaaggtgtagatgccgctgaacagttgagggcaccgaaaggaacacggttcatcccgtactcacagttcccaccaagaatggtgcgcaaggactgctgcacatactcgacgactccagcaatgagcgtgcctaaaacactgcagaatgttcattcgtgcgagaactggctgccaaggagggtgatgagcgcgtggcgcatcgctgggatggttcatgcgttggagggatgggacgagcatgagtgtggagacaaggtgctcgacatggacaaagtttggtctgctgcacttctgcatgggtttcgccccgttactgaggattgatgggtctggttgcattgcaagtcgagtgaataagcgctacgcagatgaagatgccgtatgctcgctggagccatgctaaggaagatgaagaagcagacgtattggctagcagaagagtataattaagtactagtttgatccaccaaggttacttggttagcgtaccattactgcattattcgtctcctatggtatgagttgatgacttggttcagcctagtagtatttgtaatgctatcaataaataagtaaatgtactacgacggtctattggtct

SEQ ID NO: 4 - DNA, 1807 bp, Hordeum vulgare
cggcacgagggaaggtaacagggccagatatgcagcgtctcgcctcctcccggcggctcctccaggccgcgctcgcccccggccgggcgcattccagcctcaccgccgccgcggtcgccgccgcgccggagaatggcgccggcgcccccaagatgccgccgttcgcgtacacgccgccgccgtacgacgggccgcgggtggcggagatcgcccagaagcgggcccagttcctcagcccctcgctcttccacttctacgaccgccccttgaacatagtcgatggaaagatgcagtacctgtttgatgaggatggtcgccgctaccttgacgcttttggtggcattgctaccgtttgttgtgggcactgccaccctgatgtgattgaagccatagtcaaccaggcgaagaagatacaacactccacagttctgtatctgaatcatgcaattgcagactttgctgaggctttggcggccaaaatgcccggtgatctgaaggttgttttcttcacaaattctggcacggaggcaaatgagcttgcactgatgatcgcacggctttacactggttgccatgacattatttcgcttaggaatggataccacgggaatgcagctgcaacaatgggtgccactggtcaatgcaactggaaattcaacgttgtacagacgggagtgcaccatgcacttaatccagacccatatagaggcgctttcgggtcagatggagagaaatatgccagagatattcaggaaaccattgactatgggactacaggaagagttgcagggttcatttcagaagccatacagggagttggtggaattgtggaactggcgccaggatacttacctgtggcctacgatatggtaaggaaagctggtggcctctgcattgctgacgaagttcaggcaggagttgcgcgaactggaagccacttctggggatttgaagggcacggcgtcatcccggacatagtcacaatggcaaagggtatagggaatggaataccgataggagcggttgttacaacgcctgagatcgctaaggtgttaacccgcaggagttacttcaatacctttggtggcaaccctgtcagtactgctgccggccacgctgttctcaaagtgctggagaaagaaaagctccaggaaaatgcgttcgttgttggctcctacctgaaggatcaacttaacgctctgaaagagaagcatgacatcatcggcgatgttagggggaaaggcctccttcttggtgttgagctggtgaccgaccggcagaagaaaaccccggcgaaggctgagatcgcgcaggtcatgagccacatgaaagatatgggcgtgctggtggggaagggcggtttcttcggcaacgtgttcagggtgacaccgccgttgtgcttctccaaggaggactccgacttcttgatcgaggtgatggacatcgcgctgtcgaagctgtgaagaggcactgagctcatgcaggcttagcatggggagcagcatccataaataagagacgatctgcgagacagcacctcgttgtctcgtgttctgtcttgcaaaccctcgagtgcgcacatctgatccgtgtttcgtcgacattattaggcttgctgccttgagtagtaaactgtatgcatgaccaataagttcttggtaataaagatattcagatgtgttttattgtatcctgcattcttcctgctatctactctttatgttcctaaatgtaagtctttttaggggttcctggatgtatatagacatactttagagtgtaggttcattcatttttctccgtacct

SEQ ID NO: 5 - DNA, 1144 bp, Hordeum vulgare
gcctcgtgccgcccgttcccacaagctcctctcctctcctgtcgtctccatagcagcagcagctctccagctcgagcaagaaagaagtagtgattaagatttgattcgtgaaaatgttggccatcttccagaagcaggtggcgcacgcgccgcaggagctcaacagcccgcgcgggagcaccgccaagcccaagaaccccgacgagatcctccgcgacttccacgccgctcacccctccgacgccttctccacctccttcggcggcggcgccgccctcgcctgcgtcgccgcgcagccacgcaacctcgccgccggcggataccagaggatgttctgcgggctggacgacatctactgcgtgttcatggggacgctggacaacctgagcagcctgatgcggcagtacggcctcaccggccgctccaccaacgaggcgctgctggtcatcgaggcgtaccgcaccctgcgcgaccgggggccctacccggcggaccaggtggtgaaggacctctcgggctccttcgccttcgtcgtcttcgacaaccgcggccggtccgggtccggggcggcggtgttcgcggcgcagagcacggacggcggggtgccgctgcactggggcgtggcggcggacgggtcggtggtgatctgcgacgaccgcggcgtggccaaggccgggtgcgggcggtcgtacgcgccgttcccgccggggtgcatgttccacagcgagggcgggctcaagagcttcgagcaccccatgaaccggctcaaggcgttcccgcgggtggacagcgagggcgtcatgtgcggcgccaacttcaaggtcgacgccttcaccaagatcaactccatgccccgcgtcggcagcgccaccaactgggccgccacctgggacgacgccgccatctgatctcatccacccggcgccggcgacgcccgcctagattgctcgtcggacttctgaatgacgaatctgggcttgctgcattttacttgcttttttccctttctattggcaacgtatgtacatcctgatctgatctgagccgtgcgtgtgtgtgtgtgtgggcgcgctgacacatacggttgtttgcttgtagtagtaagtacgatgggaggaataagacgactttgcttccagtccaa

SEQ ID NO: 6 - DNA, 1759 bp, Hordeum vulgare
agatattcccgagtgagaggctcagcgcaagatggagcaccaggcacacgtcgccggcgagaagaagggcatcatggagaagatcaaggagaagctccccggcggccacggtgaccacaagcaggccgctgacacccacggccagcaggggcacgccggcacggggacgcatggtgccccggccactggtggcgcctatgagcagcagggtcgcaccggagtcaccggcacggggttgaatggcgctgatgccggcgagaagaagggcctcatggagaagatcaaggacaagctccctggtggccacggtgaccagcagaccacagctggcacctatgggcagcagggacacaccggcaccgcggcgcatggcaccccggccggcggcggcacctatgaccaggagggacacaccgggatgtctggcatgggggcgcacgacacccacgccacgggcggcgcctatgggcagcatgcacacaccggagggaccggcacggggacgcacggaaccggcgagaagaagggcgtcatggagaacatcaaggacaagcttcctggtggccacggtgaccatcagaagacgagtgacacgtacgggcaccaggaagacaccgaaatgactggcatggggaggcatagcacccctgccaccggcggttcctatgggcagcatgtacacaccggacagaccgacatgggaacacacggcaccggcgagaagaagggtgtaatggagaacatcaaggataagctccccggtggtcatgatgaccaccagaagactgctggcacctacgggcagcagggacacgtcggcacggggacacatggcacccccgccactggcggcgcctacggacaacatgaacacaccggagcgaccggcactggaacgtacggcactggcgagaagaagggcatcatggagaacatcaaggagaagctccctggtggccacggtgaccatcacaagaccggcgacacctacgggcaccaggaagacaccaaaatgactggcatggggaggcatagcgccccggccaccggcggctcctatgggcagcatgcacacaccggagagaccggcacggggacacacggcaccggcgagaagaagggtgtaatggagaacatcaaggaaaagctctctggtggccatgatgaccaccagaagactgctggcacctacggacagcagggacacgtcggcacggggacacatggcacccccgccactggcggcgcctacgggcagcatgaacgcaccggagcgaccggcactgaaacgtacagcaccggcgagaagaagggcgtcatggaaaacatcaaggagaagctccccggtggccacggagaccaccagcagacaggtggcatctacgggcagcaagcacacgtcggcacggggacgcatgacacgccggccaccggcggcacctacgggcagcacggacacaccggagtgaccggcactgggacgcacggcaccggcgagaagaagggtgtcatggagaacatcaaggagaagctccccggtggccacagtgaccaccagcataccactgagacctacgggcagcatcggcacactggagtggccggcacggagacgcatggcaccacggccactggcggcacctacgggcagcaggcacagaccggcacgactggcgctggcacacacggcaccgacggcacgggcgagaagaagagcctcatggacaagatcaaggacaagctgcctggacagcactaa

SEQ ID NO: 7 - DNA, 980 bp, Hordeum vulgare
gagaaccccatctcaactctcaagcctcaagagctcacagtggataagctcgcgctctgctctcactcccagacacacacacactacacagcacagacactctctctgcttcacgatcttctccactgagctcgcgaggaggagagccgcatcgatctattcccgaccatggctgcgcgagcgctgaccgccgccgccggccgccgggtggccggccggaccgggacgacgccgcttctcgcctcgtgcaggaacggggccagcatgagccactcctcggccacggccggcgcgcggcgggaggaagagccgtacaaggacgtgcatggcccggcggcggcggcggcgatgacgggggcgcaggtggaggcggcgctgaaccgcaagaacgtggaggtgctccagggcgaggaggaggaggaggagcacgtcgccacggtgctgccggacgagaccgtcagcatccctgccggtgacggcgaggaggacgcgtcgtgggtgcccgaccaggacacgggcgtcttcggccccgcccacgtcgacgccacccacggcgacggcggggcagcgcatcccgccccgccgcacctgttcggaggcaccacggccacggcgtactccacgcacgggtcggtgctcgaccaggcggtgttcgtccgggaggaggacatggaggacgtggagaggcccgccgccgtcgacatggccaacgccaacgcagacgtcaacggcagcatcaagaacttctagtgtcggtttcagtttcaggcgatctgtcggtcctctgtactttcaggttcagtaagctaagtttagtgctggcgccactgcctccgtagtggtgcactctagaagagaataagcccccaatccgtctctgtagggtagtgtttcactggtgcagttaatcagtaatgctcatgtattaataaccagtttggtactagtatcaataaagaagttagcctcatgttgctctt

SEQ ID NO: 8 - DNA, 1831 bp, Brachypodium distachyon
ggattctcgatccattccaatcccccgtttcccgttctctcttctctctagtggtgtcttctctgagggaggaggcgtttccatttgcatggacaagggccacctcgggggtggcggaggaggaggagggctggtcgctctggacgcgtcgccgcggcctctcgggttcctcaacttgctatcgccggcgccgtcgttccacaggagcatggaggcggacgacgttggcaccggcgccggtggcggcggcggcggcagggggcggaggtccgtcgaggtggacttcttctcggacgagaagaagaacatgaagaagagccgggtctcggccggcggcaccgatgcggaggggcacaaggacgccggcgccggactcgccatcaagaaggaggacctcaccattaacctccttccggggaggagcgaccggtcgatggtggtcgacgacgacgcggcgtcccggcccgacaacgacaagaacggcaggcaagacaccaacgagctcgcggcgatgcaggcggagctgggccgcatgaacgaggagaaccagcgcctgcgggggatgttgacccaggtcaccaacagctaccaagcgctgcagatgcatctcgtcgcgctcatgcagcaaaggacccagctacttccgacccaaccgcagcaacaacaaccgcctcccactcacgaggatggcaagatcgagggtgctatcgtgccaaggcaattccttgacctgggcccttccggcgccggcgcaggcagcgaggtggccgaggagccgtccaactcgtccacggaggtcggcagcccgcgccggtcgtcttccaacgggaacgaggaccctgagcgcagcgacaacccggaaggcccgtcaaccgcgggatggttgccgggacgggcaatgaaccagcagcaactgggagcggcggccaagggccacgaccagcaagcccaggaggccaccatgaggaaggcccgcgtctccgtgcgcgcgcgatccgaagccccaattatcgccgatggatgccagtggaggaagtacggccagaagatggccaagggaaacccttgtccacgcgcgtactaccgctgcaccatggccaccggctgcccggtgcgcaagcaggtccagcgatgcgccgaggaccggaccatcctgatcacgacgtacgagggcacccacaaccacccgctcccgccggccgccatggcgatggcgtccaccacgtcggccgccgcgtccatgctgctctcgggctccatgcccagcgccgacggcagcgcgggcctcatgagctccaacttcctcgcgcgcaccgtgctgccgtgctcctccagcatggccaccatctcggcgtccgcgccgttcccgacggtcacgctcgacctcacccacgctccgcccggcgcgcccaacgccatgccgctcagcgcgctgcggccgccggcgccggcccccgggcagttccaggtgccgttgcccggcgccggcggcgggatggccgggccgacattcgcgatgccgcagcagatgctgtacaaccagtccaagttctccggcttgcacatgtcgtcgtcttccgacaccgcggagttcgcgcagccgaggccgcagatgggccagctctccgacaccgtcagtgcggcggctgcggcgatcaccgctgacccaaacttcacggtggcgctggccgcggccatcacgtccatcattggcggccaacacgcggccgccgctgccggcaacaacaacggaagtaacaacaacgtcacgaccaccagcaacaacaccaccaccaccaccagcaacaacaccaacagcgagacccaatga

SEQ ID NO: 9 - DNA, 1576 bp, Brachypodium distachyon
ctccccaggccatcttccgctcactcgaaaatagtaccctcctctccctccggcgctcctctctcttctcttctcccttctttgttaccggggctcgctagcgcatcgaatcggaggaagaacgtacggctcgaagcttggtgtttttacgcctctacggttagaacaaatggatccatggatcggcagccagccatccctgagccttgacctgcacgtcggcctgggccaccaccaccgccaccaggcgcagccggtggtggcgctcgtcaagcccaagatcctcgtcgaggagaacttcttgcccctcaaaaaagaccccgaggttgcgggccttgaggcggagctgcagcgggtgagcgaggagaaccgccggctgggggagatgctgcgggaggtggcggccaagtacgagtccctgcagggccagtacagcgacatgaccaacgccgccaacaactacagccacccgtcctccgcgtccacggagggcggctccgtgtccccgtcgaggaagcgcaagagcagcgacagcctcgacggccacacgccatccccgccaccgccgccgcagctctccttcgtcccggagcagcaggcggagtgcacgtcgggcgagccgtgcaataagcgtgtccggccggcggcggcgtcggaggagtgcaagcccgtggtgtcgaagcggtacgtgcacgccgacccctccgacctcagcctcgtggtcaaggacggctaccagtggcggaagtacgggcagaaggtgaccaaggacaacccttgcccgagggcctacttccggtgctccttcgcgccggcttgccccgtcaagaagaaggtgcagcggagcgccgaggacaggaccgtgctcgtggcgacgtatgagggcgagcacaaccacggccagccgccgccggcgcagccacagcagcagcagcagcacgatggcaagaacggcgccgcgaagccgccccaggcacccgtggctgcggctgccgcgcttcaccagcaacatcagcagcagaagcaggaacaggaagcggcagtcgtgaatggcgaggcggccgcggcggcgtcggagctgatcaggcggaacctggcggagcagatggcgatgacgctgaccatggaccccagcttcaaggcggcgctcgtcaccgcgctctccggccggatcttcgagctctcgcccaccaaggacctcaactaattaatccccatgctccactccactccagtccagcttggggcggccgattagttcgccattgctgcctgcctgcatccacctccgtcaaatcgacggacaacgaagacgcgatcgattccatcagggatccagctgcagctgctctacacagaccagatcttttcttggacgaacacgaagtcaaggcaaatggagagtgggtcgattgacgatcaaatgttgtaacaacacgtaggatacacgggcagaaacactagaaagtgtacaatccaatttattttttactactaggtaggcgaaatgttccgttcctgtagaattcagattcatcaatgagaaaggaatcaagtggccacgtccacacaatca

SEQ ID NO: 10 - DNA, 764 bp, Brachypodium distachyon
acaccaaatgcccctacatatataaggcctggacgtggatcactcaccagttatagcttcttctactttgtggtgaaggaaaactgaatcccggtcccagctgatcaagccatggccatgagggctctcgcactgccccactcacaaagctccacatttgggcttcaccagagcttgccatccttcaagccaagcagcgccagtacaagatcagtcagggcctatgcaaaatcagatgaagaggaggagaaggtgcccaagcagtccttgtttgggagcatcacagaggcgctggacttctcgcaggtccgctcggagaaggatgcggagctgctgtatgaagccagggattccattaaagaagaagggaagatgacaagggagcagtatgctgcccttcggaggaagattggtggcacctacaaggatttcttcaagtcatatgttgatgttgatggggaatatgtggaggaaggttgggtggataagacctgcaaagtttgcaagaaagacacaaggggggagccacggcaagttgacaagctaggaagatatgttcatgtcgcttgcgcggagaactcaaaaccgacaaacttcttcgccaaactcttcggcggatgaacttcttttgtactaccaaacgcatcgttttgtgtcgtggttagataaatagatgggtgttatagcctcaagggattagaacagtattatgtgccatttgaaatcctatttaaggagcatatgcacattctataattccattt

SEQ ID NO: 11 - DNA, 1090 bp, Brassica napus
ttggcctcttcgtctttgttttgctatttactccattttctcaaatatttaaaacagtatttttgcttcctttattttcttgtaatggctttctctccgatcaactgcctcattttcgatttggatgacacattataccctctgaaaacgggaatagctccagccgtcaagaaaaacatcgacgattttctaatggagaaatttggattttctgaaagtaaagcttcaagtctaagagttgaactcttcaagagttatggaagtactctcgctggtctcagggcattaggtcacgatgttcatcctgatgaatatcacagtgtcgtgcacggaaggttgccgtatggttcaatccaacctaacagcaaactaagaaaccttctgaacaaaatcaaacagaaaaaaatcatttttacgaattcagacaggaaccatgcgatgaaggttcttgagagattgggtttagaagattgtttcgaagagattatctgtttcgagacaatgaacccgaatttattcggggcaaccacccgaccggatgagcatcccgtcgttctcaagccttcgttgaccgcaatggatgtttgcattcgtgcagccaacgttgatcctcgccgggcggtgtttttggatgacaatgtccacaatattaccgcgggtaaatctgtggggcttcgcacagtcctggtgggaagatcagaaaagactaaagatgcggattacgcggtggagactgtaactgagatagctacggcggtgccggatatttgggcgacggctacagccggatgtgatgacggcggtgagaggatcagccgcagcaagagtgagctggaaggtatggcttcgatcacagccgtcggtgcttgacgtatcgagttggcgaatcgtgaccgttggatattttaacatttagtggttgggattgtacagatggcgttaaatgttgataacgcatgtgaaaaaaaataatagaggtggtggaggatattaatattcatcccatctggaccccaaatgtgaatacgcaatgaaaatgttaaatgtatgatgataatgatttcaataagatgtgtacattttgtgttta

SEQ ID NO: 12 - DNA, 1104 bp, Gossypium hirsutum
tcttcttctttcaaagtttgcttatatggattctcctttcaattgccttttgtttgatttggatgataccctttacccttcaagcactggaatagctcagggtatcaagaaaaacatcgatgattttctaattgagaaatgtggaatgtcggcgacgaaagcttcaaatctcagagtcgaactcttcaaaacttacggcagcaccctcgccggactgcgagcgttagggtatgacatcgatgcagatgattaccacgattttgtccatgggagattgtcatacgatgtgatcaagccagaccctcagctacgttctctgttacgtagcatcacccaaaggaaaattatatttacgaattcggacagagttcatgcggttaaggtaatgaaaaggttaggaatagaagactgtttcgaccaaatcatatgtttccagacactgaatcctaatttgtcagaatcaaagtgcgtcgttctcaagccgtcgacggatgccatcaaaattgctcttcacgtcgcacgtgttgatcccccacgcaccctatttctagacgacaatgttcagaatatatccgctggaaagactttgggcctctggacttgtttggtagtttccaattttttaaataaaaagaactactcatttaaaatgcatgaatctaatattattgtgtggtctaaggttgggaagagtggtgagggaaaggaagcagattatgcaatagaggaagtcaagaatttaggggatgtgataccagaaatctgggtcaacaaacaggatggtggtgacagaagcagaagtgaatcggagttggatcaattcaatatctctggggacctaattgaaaaagatgtgggcttagctcttacggccccactatgcacatgattaaaaaagtcatgttaaccagccatgtataatgtcagaagcttcaattgcataaattaaattcacctttgctgtaaaagtttaacatttctttcgcttgtaatattaataatatttcttttagtttttatgttttcttcttaattaatatgtgccatgtctcaacttgttacattgtaattcattaaaaaaaaatcccatctctgagtttattt

SEQ ID NO: 13 - DNA, 2068 bp, Gossypium hirsutum
aaacaatagaagagaatttttaggaaaaagaaagagagaaatcaaaggcaatagcatagcaatctagtgtcgtcaactaagctcgaggggaagttggagctctacttggtctttttcttttatttggggggaatcaaaatatatgggttcagaacatgaattgccagctgatagaagttatagcaagcctcttggaattcgattcttggaatacattaagaaagtgaagctttcctatgaaagtcatcaagccattgtcttgattgtaacatttttcgcatacgctagctatcatgcgacgaggaaaaccaccagcattgtcaagagtgcccttgatccccaatcatctgatgtaggcttgaagttcccgtggaggataacataccttagtgctccagaaagcaaaggactttcatgggctctaggagatggttgggcgccctttaacggatccgatgggacggccttgcttggtcaacttgatgtggcctttctttcagtatgtgctttaggaatgtacttctctggacacatgggtgatagaatgaacctaaggatctttctgacagtgggaatggttggaactggcttgtttacttcactatttggtgctgggtattgggctaaaatccatagcttttattactacctgatagtgcaaatgattgctgggttatttcaatcgacgggatggccttcggttgttgcagtagttggtaaatggtttgggaagaagaagagagggctgattatgggtatatggagtgctcacacatctgttgggaacattactggttctttgattgcttcagcactattgagctatggatggggttggtcctttgttgtgccaggtctgcttattgctttcatgggcttggtggttttcttttttctgcctgttagtcccgaatcagtcggtgcttatagagaagaagatgaagtggattcacttaggaagaacgaagaggaagagggagttacggagcctctattgggctcaaatacggagctcaaggaaaaagctgtagggttcattgaggcttggaaaattcctggggttgctccttttgctttctgcctcttctttgccaaattggtcgcttacacatttctctattggcttccatactacattagccatacagcgattgagggtaaatatttatccaatgaggcggctggaaacttgtcgacattttttgatattggaggggtgcttggaggaatcttagctggacacatttctgatcgtctagatgcgagagccataactgcggcaacttttatgtattgtgctatccctgctctgtatttctaccgtagttacggacacgtttccgtggtgatgaatgtagctctcatgttcatctgcggaatgttcgtaaatggcccctatgctcttataacaactgctgtctcagcagacctgggaacacacagttcattaaaagggagctccaaggcattggcaacggtaacagcaatcatagatggaacaggctctgttggtgctgcaatcggaccattattaactggttacatctctgcggagagctggagcgcggttttcacaatgctcatgggagcagcactagttgcagggctactgttgacaaggcttgtagtggccgaggtggcagctaggatttccgaatcaaggtcacaaggaggatcacaaacaggatctgaagctccagaactggatgtatgattgattttgtaggggcaacataagctccacctgtataaatagtgtgtgattttcatatttttctttgctgtagttataaaatgaagagaggaaaagctttctttatgacttggcaaggagaagatttttttagccttctccatgattctagttatgattaccgtggagtttttatttttattttttattataggaattatttggagggagaagttggagtaaaagaaaatagaagagtaatgagagaggattttctctgccaatctgtatgtacattctgtatgttacactatattaattgatgaaggcatcattcaatgctgttgcttattaaaaacttcacctctacttttg

SEQ ID NO: 14 - DNA, 1486 bp, Vitis vinifera
aacggttaaatctgcaaccccacaaattttctctctatttcgtctgaaacttccattcattgaagccttcaccgattcacttccaagctacttcttaattcacaatcctttttctctatttaaatacattatctctggtagatttaagctcaatacagcgattgcggagccagttttttttagagagaaaaagaggggaaaaatggcgaatgaagatctggagaggggaggtggaatgaagaacaggggcaacaacggccacccaccgggctactactcctctacgtactatgcggaggcttccgagactcactggacttcgtggttgattcccatgtttgttgtagcgaatgtcgctgtttttgtggtggtcatgtatgtcaatgactgccctaagaagaataccgggatcgagggggcttgtgttgctaagtttcttcggaggctctcgtttcagcctctcagggagaaccctctctttggcccctcgtcttctacattggaaaaactgggaggtcttgagtggaacaaggtagtttatggggatcaaggatggagactggtcacttgtatctggttacatgcaggtgttatacatctgctcgcaaacatgttgagcttagtctttattgggattcgcctcgagcaacaatttggatttgtgcgtattggaataatctacatggtgtctggatttggtgggagcattctctcttcccttttcattcaacacaatatctctgtgggtgcgtctggtgctctgtttggacttcttggagcaatgctttcagagcttattaccaactggagtatttataccaacaaggctgcagctctgttcacacttgtcgtgatcattgccattaatttagcggttggaattcttcctcatgttgacaattttgcccacattggaggattcttgacgggattcctccttggcttcattttgttgctccgaccccagtttgggtgggtgaagcgccagcatcgtccagctgatgcccgtgtccaatccaagcacaaggtttatcaatacgtgttctggttggttgcgatggctttactgattgtcggatttactgttgggttggtgatgctgttcagaggagagaatggaaatgatcattgtagctggtgtcattacttaagctgtgtgcctacctctaaatggaaatgtgacaactgatggaacagaacagttttcaacatcttactaatttcacacttgtgtgtcttccttcatcagcttccttccttcattcttttcttgttttatttttatattttttaatttttttcacactggtgtgctttcttgcgtgtaaattcatagttcatgatatttaaagtatatttctgtagttgtcttttggacagaaaggaagtgttgttttcttggattcacatgggaattttttcccatcatatggacactgacctagtgattacagacaataaagttatttcaatgtatttcaattta

SEQ ID NO: 15 - DNA, 1449 bp, Vitis vinifera
gctggaatcggatcggcgatcacacttctcagatcgaagtgcctttggtttattgtcagcttctagatagtcacaacttttgtctgaagatactatgacagaaatgatggccaatcattctgactctcaacattttgagctgaaaaacctgaaagaaatgattttcaatgtgaatgaaagagacgttgttaagtcatgtgctcagcattccaatggagagtgtatggagatcaaagagccaactgatcatgtagagatcacagaaaaggaattgctagagaaaggctatatgcagtacggatgtccacattatcggagaaggtgccgcattagagctccatgttgcaatgagatttttgattgtcgccattgtcataatgaagcaaagaatagtattaaggttgacaaggcacagagacatgacattccacggcaccaagtccagcaggtgatatgttcactctgtaacactgaacaagaggttcgtcaagtttgtattaactgtggtgtatgtatggggaaatacttctgtgagacctgcaaactattcgatgatgatacatctaagaaacagtatcattgcaatgggtgtggaatttgcagaattggagggcgagagaacttcttccactgttacaaatgccgttgctgctactctgttctgctaaagaacagccatccttgtgtggaaggagcaatgcatcatgactgccctgtttgctttgagtatttattcgagtcaacagatgatgtgactgttatgccatgtggacatacgattcaccaaaactgtttgaaggagatgagggaacatttacaatatgcatgccctctctgctccaagtctgtttgtgatatgtccaaggtgtgggaaaaatttgacatggagattgcagctataccaatgccagaaccttatcagaacaaaatggtttggatcctttgcaacgattgtggaaaaacctcgaaagtgcatttccatgtcctggctcagaaatgcctaaattgcaagtcatacaacactcgccaaaccagaggctgagatagtggcaacaaccctcaaccggagatcacaatgatgacccacactcagtttaaattcgtcacaatctgggttttgagaacctttttcaaccactagattcacaggtcgtgaattactggagacaaggactcatgggtcccgcgcaacttgctctgtcgagccattctcagggctattccgccttgaatagtcttaagctttcgctttcttctccatttcatgtccttttcttgtattctgttttcttatgttaaaatgttgaaagcactcccaccgccctcggttttgttgtagataaaggagttgttaggttgttttttcccttgaatcctagtggtgtggtgtactttgattatatcacatactagtatattattaccatttgggaacaaaatatgctgcta

SEQ ID NO: 16 - DNA, 1594 bp, Vitis vinifera
ggtggagaaagaatcttggcagaccagtttcatgggcactgggaagtggatgggctccatttgatggagcagatggtacagctttgcttggtgatatcgatgttgcattccttggagtatatgccattggaatgtacttttccgggcacttgggcgataggttaaacttaagaatctttttgacagtgggaatggtaggaactggtttgttcacttcgctgtatggtgtgggttactgggcaaatatccatattttttactatttcttgatagatcagatgtttgctggtttgttccaatcaactggatggccctcagtagttgctgtggtaggcaactggtttggaaagagcaagagaggactaattatggggatatggaatgctcacacttcggtggggaacattgcaggttctgtgattgcttcagtcctattagcctatgggtggggatggtcctttgttgttcccggcctcatgattgcttttgttggtctggtggttttcctcttattgcctgttagtcctgaatctgttggagctgttgcagaggaagatcaagtacactctcccaggaaaaatggggaggaggtaactgaacctctattgcagtcggatacagaggttaagaagaaagccatagggttcattgaagcatggaaaattcctggagttgctccttttgctctttgccttttcttcgccaaattggttgcttatacatttctttattggcttcctttctacattagccacacagatatagatggcaagtacttatccagtgaggcagctggaaacttatctacagtctttgatgttggaggggtggttggaggaattctagctggccatatttcagaccgcctaggtgccagagccataacagcagcaagttttatgtactgtgctatccctgccctcttcttctaccgaagctatggaagcatttccgtgcctgtaaatgtagtgctcatgttcatcactggattgtttgtgaatggcccctatgctcttataacaacagccgtctcggctgatctgggtacccacagttcactggaaggagattcaagggcattggcaaccgtaacagcaattatagatggcacaggttctgttggggctgctctaggcccattactaaccggctacatctctgccaagagctggagtgcagtttttacaatgttgatggcatctgctctggtggcaggcctacttttaactaggcttgttgtggccgaggtggctgccaagatcgcagaatcaagacggcaaggagggccaacatcaagatctccagtaccgcttgaagtgtgatttctctgaagagttataattagcttgtattgaatgtgtgatattctcaatgtttatgagcagcctaggttcaccgcctctgattatcagatggggcgaagatcttgtatgtttaaagatgggagagggtgctttttaaccttcttcatagttagtttgtaaattgaaggaaaagtgagtcacgtatttgattctacctatctatatgtacatttttcacccattttatcagtaaagggatcacacatccagaaggatggttcacgcagaaa

SEQ ID NO: 17 - DNA, 1995 bp, Oryza sativa
ctcgccttacacatcgcaccactctctcttactcgtccatacgccgagtccacgagatctcgccgtagtccatacaccggttgatcggaggtcgtgttgccgccggcggtggccatgatgatgatgggggaaggagtcagcagcgtcccgccgtggtctcacctccccgtgagcggagtcgatgtactcggcggcggtggtggcggtggggatgagatgacgccgtacgtgatcgccgcgctgcgggattacctgccggcgaatgatgtcggggtgggggctgacgaggaggaggaggccgcggcgatggccgcggcggtggacgcgtacgcgtgcgacgagttccggatgtacgagttcaaggtgcggcggtgcgcgcgcgggcggagccatgactggaccgagtgccccttcgcgcacccgggggagaaggcgcgccgccgcgatccgcgcaagtaccactactccggcaccgcgtgcccggacttccgcaagggcgggtgcaagcgcggcgacgcctgcgagtacgcccacggcgtgtttgagtgttggctccacccggcgcgctaccgcacccagccgtgcaaggacggcaccgcctgccgccgccgcgtctgcttcttcgcccacaccccggaccagctccgcgtcctcccggcgcagcagtccagccccaggagcgtggcgtcctcgccgctggccgagtcctacgacggctcgccgctgcgccgccaggcgttcgagagctacctcaccaagaccatcatgtcctcgtccccgaccagcaccctcatgtctccgcccaagtcgcccccgtcggagtccccgccattgtcgcccgacggtgccgcggccatccgtcgcggatcttggcccggcgtcggctcgccggtgaacgacgtcctggcctcgttccgccagctccgcctcaacaaggtgaagtcgtcgccgtccggcgggtggagctacccttcgtcgtccgccgtctacgggtctcccaaggccgccaccggcctctacagcctccccaccactccactggcttccacggcaacggtgaccaccgcctccagcttcatgcccaacctggagccactggacctcgggctcatcggcgacgaggagccggtccagagggtggagtccggaagagccctccgggagaaggtgttcgagcgactgagccgggatggtgccatctccggcgacgccacagccttcgccaccgccggtgttggcctcgacgttgattgggtgtccgacctcatcaactgaggcttccaagtcgctattggaagccccttttgtgagcatcaaggatgatggcatggaggaggagaaggtggcggtaagaagaaaatgatggcacgacaaaaaaatccttcattttcttttgtgatttcaagtcaagtttctactaattcctgtacatatctatctcccatgtgaatattcatggttggtggagaggaggcaagtatggaaagatgggtggatttgttttggggttttgaggtagtagcaaaattacccacaaaaaaattaggtgaaaaaaaaaagaggagtagaaatggaggtgattcagtgtctcctgtgtgcatagggtgtgtggaggtgaaggaagcacggaaggaagaagatcatggcggaagaagatggccggatttcggccgccgtcgcggcggcggccctgcctatttcagtgatttctgggggtttatcctctgttcatcgtttgttgcatcatcgactagctgatgaagatcgtcgatcgatttcaatcaagccccccctcttgttgatttcctattttgttgatgtaatctttgttttgttaagaacccccaacagcatattttgtaccttagctttaaatctgaaaatcttttgctgactcatctacctatatgtggtgatgaagcccccctcaatgtattgtaatcacctgcttcaagtaaatgatccaataatattatgttgctatatgtttcatta

SEQ ID NO: 18 - DNA, 2269 bp, Oryza sativa
ccctcatctccgctccattcccccctcccgtgtcgcagcgagaagcatccatcggaattctcgtcgaccaccgcaaccgccatgggcggcgcccacagccgcgaggacctcgacctcacctcctccgacgacgaggacgacgacgaggagtacgacgcccagaccgccacctccgccgcctctcgagaggacatcctccggacctctaccccctcctccctcgagttcctcgacgcgaagctgaaagcgctcgatctcaagtaccaggcgccgaacgcggcgaagctgtacctccacgtcggcggcgcctccgcctccgcgcgctgggtgccggccgagcggcgggcgacctacgccttcgtcgacaaggcgacggcggcgggcgacagcgattgtggcggcccgaggtgggttctggaggttggtccgggtcccagggtctccgcccccgtcggcccggcgctacagctcaaggcgctccccgcgcagcgccgggccgatttcgccgcgggcggctccgtctgggcgctgcggctgccgaccgacgccgccttccgccgattccggcaggagtacgaccggtgcctgttcgagaacacgtatggcgtcgaggccacggatgagggccggaaggaggtgttcggcgctgacttcgccgcgtgggcgcgccccggtgagtccgacgacgccgtctgggccgacgcagaggactccttcacccctcccgttgcgaccccggcgagagacctgctcgaggagttcgaggaggaggccggggacggcagcatccagagcctcgcgctgggcgcgcttgacaacagcttcttggttggagggtcagggatacaggtggtcaagaatttccggcatggcgtgcacggcaagggcgtctctgtgaggatatctgatggccgtggtggtgggaacgcgtacatgacaccgcagaaggctctgcttatgcgtggcgagacgaatatgcttctgatgagccctggagagactggcactcgccattccaatggcgtccatcatgttgatatagagactggcaaggttgtggctcagtggaggtttgagaaggatggaactgacatcacaatgcgagacatcgccaacgacagtaagggcgcgcagctggaaccctctggatcaaccttcttaggattggatgacaaccggctatgccggtgggatatgagggattccaggggcagggtgcaaacaattgggagctcatctgagtcaccggtgctgcaatggtcgcagggccatcagttctcaaggggcaccaatttccaatgctttgcaagtacaggggatggttcgattgtggttggttctgtggatggcaagattaggctctattccaagagttcgatgcggatggcgaagacagcattcccagggcttggatcaccaatcacacatgttgatgttacttatgatgggaagtggattctgggcactactgatacatatttgatcttgatctgtaccatctttaaggacaaggatggtaaagagaagacaggattcagtgggcgtatgggaaataggattgcagcaccaagattgctgaagctctccccattggattcaattttggcagggtccgagaacaaattccatggcgggcagttctcttgggtaacagagaatgggaagcaagaaaagcatcttgttgcgacagttggcaaatttagtgtcatttggaactttcagcaggtgaaggacagcaaccatgagtgctaccgcgatcaggaagggctcaagagctgctattgttacaaagttgtcctgaaagacgaatccattgttgacagccgtttcatgcacgagaaatttgcaacaaccgactcccctgaggctcctctggtggtggcaacacccatgaaagtcagctccttcagtttagccaatagacgattacactgacagtcttattttgctttgcgtatcatggtgggagaatctactggtttttgtgtagctcactgctgttcctttcgtggtgcgagaatctacaggttcactgctgttcctattggttcatttgttacttgattttggtgtagcaggcatgttgataatactagtactctttgtgaagattgctggagttgtaatacttgttagttgtaactaggtttcggtgtactctttgtaaatgttgacgatagcgttctgggtgaagacctaatctcttctgggactggagttgtaactaatctgcgtttttatggggctgtttggttcccagccacacttt

SEQ ID NO: 19 - DNA, 2090 bp, Oryza sativa
tactataaataaatactcccttccacacaacaaagagaggaaggaaagaaaaggaaggaaaggaaacggaaaccgatcaccctcccctcaaccaaccaaccacccacccaaccagccaggcggccggccgccaccgtcagcgagcagctgccgcggcggcgctcacgcgtctcctccccccctatttatatccggcctcgtcccatctccaccctttcctcaggcaggcgcacatctagcccctgcccccctcctttccccaccctaataataatatttttttccaatccccgaattccccccccaagaactccctcgatccaaaaggcaccgccgattttggtaatctagaaggttctagacgggcgaggaggatgcgggtgctggaggacgacatgttcccgtcgacgccggggaaggtgaagatcgagagggcgacggcgatgaaccgccagctccaccgctgcttcgcgtcgaccagcaccatgttcctctgggcgctcttcctcgtcgccatgaccgcgtcgtacctcagcttccagtccttcgtcgacacctcgtccaagtacttcgccgcctcctggggcgggctgcactgggagcgccagatccgcgcgtccgccgcgccgaggcggccgcccgggtcggcggcgggcgcggggatgtcggtgctcgtgacgggcgccgccgggttcgtcggcacgcactgctccctcgcgctccgcaagcgcggcgacggcgtcgtcggcatcgacaacttcaactcctactacgacccctcgctcaagaaggcgcgcaggtcgctgctcgcctcgcacggggtgttcgtcatcgagggcgacatcaacgacggccgcctcctcgccaagctcttcgacgtcgtgcccttcacgcacgtgctccacctcgcggcgcaggcgggcgtgcgctacgccatggagaacccggcgtcctacgtgcactccaacatcgccggcctcgtcaccctcctcgaggcatgcaaggacgccgacccgcagccggccatcgtctgggcctcctcctcctccgtctacggcctcaacgacaaggtgcccttcacggagagcgaccgcactgaccagccggcgtcgctgtacgccgccaccaagaaggccggcgaggagatcacccacacgtacaaccacatctacggcctctccatcaccggactccgcttcttcaccgtgtacgggccatgggggcggccggacatggcctacttctccttcacccgcaacatcctgcaggggaagcccatcacggtgtaccgcggcaagaaccgcgtcgacctcgcccgcgacttcacctacatcgacgacatcgtcaagggctgcctcggctcgctcgacacggccgggaagagcaccggcaccgggggcaagaagcgcgggccggcgccctacaggatcttcaacctcggcaacacctcgccggtgacggtgcccaacctggtgtccatcctggagaagcacctccgcgtgaaggccaagaagaacgtggtcgagatgcccggcaatggcgacgtgccattcacgcacgccaacatctccctcgcgaggcagcagctcggctacaagccgaccaccaacctcgacgtcgggctcaagaagttcgtcaagtggtacctctcctactacggctacaccaggggatccaagaacttgtgactataatccgccctaattcttctgctaattcttttctttttctttcttctttttttcttcttattctctggccatccagtggtcgattccactccaggatcaaaacattaacattcttatttcgactttttttttgggggaaatattttaggatgttctttggaatactggggggaattcttttcttgggggaggggagggaggaagaagaaagcaatggagagcagcatttttctcttccttttccctttatcttctccatgctcttctgtaaatttcgttctccataacgtttcacaccctcgaattttttgtgtgtaatctggctggtcatagctgagctatgaatctttcttgagctaaactaatcaaacaataaaacaacaatgcgtttaaatttcg

SEQ ID NO: 20 - DNA, 2794 bp, Oryza sativa
tttattttactaccaacccgctcacagtttgaccacgggttgttctccacttctcctcctccctctctctctctcgcagcagtacacacaagcgaagcaaaagcgcggtgcggagaagtctccccgccggggaggcccgttcacaccggtgattgggttggagcaattaaagctttcctcctagtcaaccccagctcctctgcgaggaaagaattgatctcttttataatcctgggctctcactgttcgtttgcttcttcgtttcgcctgccaaactttccgagaagcggagcagcagttgaggagaaacgacggggagaagcggccgaggaggtctggagaaaaggctcagcgggcgttgtaatattagagctcagaggacaccattgacaagcagaggaattaggttctacatcaacctgataaattgtgcatcgtgtgatgttctgggcgtttcttgcttcatggcaagcgtaaacactggaggtttacgcctggtgagatgcccaaagtgttataacattctaccagaacctcccagtgttgaggtctacaagtgtggtggttgtgacaccatacttcgagttaaaatccgtcccagcaatggacaaaatgtagcgacgaaacaagtccggcaagactccgatgatttttcggttgctaccaccgcgagcaatggagtgcatcctcaaaagaaggatattgctttcagtggtgctaccatggacagatcccgtacccctgatgctccgagcactgacacagagcatgccagtaatggcacgagcagcaacgataatggccatgctatgtcagttgagaataatgcttctgaagttgcagatactgacaacaaggaagattgcaatttggatggccagaacactagtggaaggatcgaaggcccttctgaagaaataccacccaatgcaaatggcatggatatcgattccgacagagaggaaacctacaatgtggaaggaattgctgagaattcagaggattgcagggtaagaggaggtggagatattgatacagaatgcaacctgagtttacctgagcacgaattgcccttacatcaggagagcaagtcagactccgagctgaaggaagcaaccaaaaccgaagacgaggcaaccaagaaaggccatcttgtgagggtgcaatcccgttcttgcgatcttcgagagtcgcatcgcgcgtcggccggtagctcaatggatttccactctgccaggacttccctccagtccaagagcttcagggcgagcgagccgctccaatcgaagatcatgaagacagtggacgagctgagaggtgacctctctgaatttttcagcaaacctgaagaagaaggagaagacgacgacgatcgcaagccaaaaacagcagcttaccctcctcgtccttcaaagcaagacggctacagcaagcctcgtgcgccgttcacttccagtgtgccactcacggcttaccaccctgcagctaagcattccggccatgtatctcgcctgagcaggtcaggccaagtccctcctcctcctcatcatcatcgtgagctttcctcgctgcgatatcgccggcggcgcagggcctactcgtgctgccacagcgaccagatggagacgatgaggcgaccgtgctcccacgactgctgccattaccatagctgccggccaccaccatgtcaccaccatgaccggccatggaagagccaagaaggcgcgatgcaaaggccgccggtgcaggagacgacgaggcgccgggctccgcccaggcaccactgccggccggtgctgcgcggcgcgccgttcgtcgtctgctccggctgcaaccggctggtccagctgcccaccgacttcgccgtcccgagcaaaggcacgcgccggctgcagtgcggctcctgctcggagatcctctcctactcgtacagggacccggccaagaagaagctccagtctccgtccggcgacggcgaggagtgccagtacagcaccgacgactacgagatccatcaggcggccggcgacgccgacccgttctcgtactcggaggagtacggcgtgatcagctactccaccgaggaggagcagcagccgctgcacgtgtcgaggaactcgtcgttcgacaccgtcgacgacgagcggagcgccaagctgcaccggctgatggggtactcgtcggcgagcgagctgctgcggctgcggcgctcccccgacctgtacgagagcttcggagagcggacgcccgctgcaagaacgagtgacacgaagggcaaggccatctgcgtagctgacgaagaggagcatcccagcgcgaaggtgagaagaggccgtggcttgccgctcccagggatcctgaagaaggggatccatggactggaatccctgaagctcaggtagtcactcgtcaggtcatagcggatgatgtacactactctattttttgaggattaactgattatggccagtttagggaattcagaaacgggcttggttattagggtgctgggatagtgggtaagatgctgataggtgtgatagttcattgtatttgatcattagtttgtgtaaaggttggttttctgtggcaattttgtgtgctttttggtggtggtgtgtgatttgcagtattgttgattgtataggctaaaaaggctacgacctgtgtgcaaattagctgttgtaactattttgagtttttttttaatcttgatagaggagtttttcttccttctgaaatggaaaaggattgccacttttgattatgaatgtttgaagctgctgtacgtatc

SEQ ID NO: 21 - DNA, 1219 bp, Oryza sativa
aaacaggcaaacgcactcgcatctccaattcggtccgaatttttccaaattccaattgctcatcgcgcttcgaattcgttgccgagatccatccaatctttgagttaagacatgccgtcagagttcgtcgccgccaggaagaagccgccgccggagttgttgttcgccgccggtcggaagaagcagcagccgccgccgcctggcatggcgttcgtgccgtcggagttcgccgccgccggcgttggcaggaagaggcagcctgcgccgccggtggagatacgccgggtgtgggcgcacaacgtggaggaggaattccggatcatccgcaacgcgatcgatcacttcccgtacgtgtccatggacacggagtttcccggcgtgatccaccgcccgaccaagcaccccgccctgctcaccgccggcgaccggtacgacctcctccgccgcaacgtggacgcgctccacctcatccaggtgggcatcaccctcgccgcgtcccccaccgcggcgcccgcgctcgccttcgagatcaacctctccgacttcgaccagcgcgtccaccgccacgccgccgagtccgtccagctgctggcggagcacggcgtggacctcgccgcgcaccgcaggcacggcgtcagggcgagcgcgctggcgccgctgctcatgtcgtcgggcctcgtctgctcccacggcgccgtcaagtgggtcaccttccactccgcctacgacttcgcctacctggtcaagctcctcatggggcggaagctgccgaggtccatggccgagttcctgaacctggtgcgcgtcttcttcggcgacgaggtgtacgacgtgaagcacatgatgcggcactgcggcggcgagctgtacggcgggctggagcgcgtggcggcggcgctgcaggtgaagcgcgcggcggggcggtgccaccaggccgcctccgacagcttgctcacctgggacgtcttccggcggatgcgggagctctacttcctcaagcatggcgtcgaggcctaccaaggcgtgctcttcggcctggagctcgacatggacatgcccagcaacaaaacaccctcgctgccgctggtggcagcgagatgatacgatctcctctcctccgctgtaaaatttgttgattcgtcgtctgcaagaaaggatttctttcggcagatgtacagtaataataagagggaaaaaaagatggtttaattgattggtt

SEQ ID NO: 22 - DNA, 1120 bp, Oryza sativa
gcgtatgctttatccaaaaatgcgagaagagaatgcgcgttgactggacaggctcctgctcctgtccaacttagcggccagtagtccccagctgcagctagtactcatggagtggtcgtcatgaaactctcagtataaaaggaccctgcagcctgatcccctgtcaatacaaccagctgcacgcccattcgtctcaaacacacattctttgattcttccttcaatttccccttttcaactctgtcatcaacttaattgttagaagcgacctaaagattttgcggccgatcgagcatggcgtccccttcggctctgatcgcaatgctcctcgtcatggtcgtcggctgcgccgccgtggcctcggcgatggagctgagtttcattgtcggagatgcgcagggttggaacaccggcgtcgactacaccgcttgggcgaagggcaaaaccttcgaggctaacgacacgcttgtattcagatacgccaggaagcagcacacggtgacagaggtgaccaagagcgactacgacgcctgcaccgtcagcggcaaaccgatcagtgatttcgaaggaggcgcgcttgtgacattcatagcgctcagccccggcgagcactacttcatctgcaaaatcggcaaccattgcgccagcggcatgaagctcgccgtcaccgtctccaactccagcgacaccccgaggccgcaaccttggattgggccttactccacgccagccagcgcgtccgcacacctgcacgccggtggcgccgtcgtcgcggcggccgttgggatcctcctcaatctcgccctcttctgagatcgcattgacgcgtcgagcggcatggacgttggcagggtggaggcaatgcatgattctttgtagcgtttctgatgaaatttgtttgattattttgtttacgttcgatcgtgtatacgtgcgtaataatgatttattggtcttgtgatttattttctccttatattcatttgtatatcctctgatataattttctgtacatctcagcattctgtatgccattcagtgatgtaggttagagtaacaaagaactttgctgtgatgtctttatactaacttaaaagtgaactcgttatccttccatccc

SEQ ID NO: 23 - DNA, 1465 bp, Oryza sativa
atatcacacttgcactgagcactggacgcgtcacattcacaacagcatactatagtcagatatagttgtgattaattagtgagtagagtgtgatacctggactttgagagctagaaatggcaccgacttcgacgttcccggtcatcaacatggagttgctcgccggggaggagcgacctgcggcgatggagcagctggatgatgcttgcgagaactggggattcttcgagatcctgaaccacggcatctcgacggagctgatggacgaggtggagaagatgaccaaggaccactacaagcgtgtgcgcgagcagaggttcctcgagttcgcgagcaagacgctcaaggaaggctgcgacgacgtgaataaggcggagaagctggactgggagagcaccttcttcgtccgccacctcccggagtccaacatcgccgacatacccgacctcgacgacgactacaggcgcctcatgaagcgcttcgcggcggagctggagacgctggcggagcggctactggacctgctctgcgagaacctcggcctcgagaagggctacctcaccaaggccttccgtggccccgcgggcgcacccaccttcggcaccaaggtcagcagctacccgccgtgcccgcgccccgacctcgtcgagggcctccgcgcccacaccgacgccggcggcatcatcctgctcttccaggacgaccgcgtcggtggcctccagctgctcaaggacggcgagtgggtggacgtgccgcccatgcgccactccatcgtcgtcaacctcggcgaccagctggaggtgatcaccaacggcaggtacaagagcgtgatccaccgggtggtggcgcagaccgacggcaacaggatgtccatcgcgtcgttctacaaccctggcagcgacgccgtgatctcccctgcgccggcgctggtgaaggaggaggaggccgtcgtggcgtaccccaagttcgtgttcgaggactacatgaagctgtacgtgcgccacaagttcgaggccaaggagcccaggttcgaggcgttcaagtccatggaaaccgagacctccaaccgcatcgccatcgcttagcaaccccggcctcgctcgctctgttctgtgtactgtgtgtgtgcatgaactgtggtttcgtcgtcgttttgtgatactcctacataggattcgtcagagtggttcgtactgtactgaataaaagagcatgcagctagccaggtgtagccgtgtaggtatgaatagattactactcgcgacgagctcgaaagtttgtaccgtgtcggattcttatttcgatccgtgtcatagcaagtccctgtttatttcttggctactagtactaagcactgcctgcagtctcctcgtgaccttgcctgtatcttggtttggatgcattattaccttgatttttttttggcaaaaaattacgtactactttgacaacttggtgacactgt

SEQ ID NO: 24 - DNA, 1332 bp, Oryza sativa
accaccactcgcagccgtttccacttcaccattcaccaacgcaaacgcaaacgcaacgcagcggcggtagacgaagcagcagcaggtagcggttcttggtcggttcgccatggcagcggcggcggcgaggtacgacgtggagaagggagggaggaagagggagggggaggaggagaggtgcggttcgccggcggcggtggcgcagtacccgcagcgggagggggagagggagtgggtgccgtggctcgtcccggccatcctcgtcgccaacgtcgtcgtcttcgccgttgccatgtacgtcaacaactgcccctcccacgcctctcgcggcggcgcgtgcgtcgccggattcctccgccgcttctccttccagcctctctccgagaacccgctcctcggcccctcctccgccacattgcagaagatgggagcactggtatgggacaaggttgttcatgagcatcagggatggaggctagtgacctgcatctggctgcacgccggtgttgttcatctgcttgccaacatgctaagcctcgtgctcatcggactcaggctcgagcagcagtttggatacatgagaattggcatcatctaccttgtttctggcattggaggcagcgttctttcatcgctgttcatcagaaacagcatctccgtcggtgcttctggcgctctctttggtcttcttggagccatgctgtcggagcttttcaccaactggaccatatacacgaacaaggctgcagctctagtgacgctcttgatcgtcatcgcgatcaacctcgccatcggcatcctccctcacgtcgacaacttcgcccacatcggagggttcttgactgggttcctcctcggattcatcttcctgatgcgcccacactacggatggatgcagcgatatgtcctgccttcctctgtcaagtacacctccaagaagtacctggcttatcaatggatcttgctggccgtggcctcggtcctagctgtcatcggattcgccgttgggctgtcgatgctcttcagaggggtgaatgctaatgaacgctgccattggtgccactacctgagctgcattcctacctcgagatggacctgcgggaactgaagatttagtagaaacgcaacaaactgaagacattaaggagatttattgaaagtgtttgatgcacagacatacaattttactgtatataacttatacagacataccctcccaggggtttagtcagttcacttgattgattcattctgttcgtttgtctgaattatttggaatagaaacatcttctccttgctcgcataggagtgattagcgatcttgagattcga

SEQ ID NO: 25 - DNA, 1967 bp, Sorghum bicolor
cgagtccacgagatctcccgtagaccaaagacgacgagttagaggggaaggaaggagacacagccacccgatcctagccatgatgatgatgggcgagggagtgagcgtgccgccgtggacccaccacgtccccgtgagcggcgtcgacgtcggcggcggcgacgagatgacgccgtacctgctcgcggcgctgcgccagtacctgccgtgcaacgacgccgccgctggcgccgaggcggacgacgaggacgcggccgccatggccgcgggcgtcgacggctacggctgcgacgagttccgcatgtacgagttcaaggtccgccgttgcgcccgcgcgcgcagccacgactggaccgagtgccccttcgcgcacccgggggagaaggcccgccgccgcgacccgcgcaagtaccactactccggcaccgcctgcccggacttccgcaagggcgggtgcaagcgcggcgacaactgcgacttcgcgcacggcgtcttcgagtgctggctccacccggcgcgctaccgcacccagccctgcaaggacggcaccgcctgccgccgccgggtctgcttcttcgcccacaccccggaccagctgcgggtgctgcccaccacgcagcatcagcagtccagcccccgcggcgccgcggcgtgctccccgctcgccgactcctacgacggctccccgctgcggcgccaggcggtcgagagcttccgcaccaagagcatcatgtcctcgtcgccgaccagcaccctcatgtcgccgcccaagtcgccgccgtcggagtccccgccattgtcgccggacggggccgccgcgttccgccgcgggtcctggccgggcgtggggtcccccgtcaacgacgtgctcgccacactccgccagctccgcctcagcaaggcgaactcgtccccgtcgggcgggtggggcggctacccggcatccgcggtcggctacgcatcgcccacggcgggtgggttctacagcctgccaaccacgccgacaaccctggccaccgcctccggctacatggccaacatggagccgcttgacgtcagcttctgcggcgacgaggagcctgtggagagggtggagtccgggcgggccctccgcaccaaggtgttcgagcggctcagcagggatggcgctgtttccggcgacgccaccgccggaatcagtggccctgacgtcgggtgggtctccgacctcatcaactgaggcggctgccggtcgttcttgcttcaatggcaatgtcattgggggcatggaggtgaaaggcggtggtaagccgtaacagagaaggatggcatcaagaaaaaaaatggttccctgtttagcttttgttgcttccagttaattccgctaatcccctgtacatatctatcgcgctgtgaattttctccggttggttggtagacggaggatgctaggtggtggtggtggaaggtggggtggatccgttttggggttcttgaggtagcggaaaatatccgttcaagaaaatagaaaaaaaaaatgtagatgtagtagccggcggaggtggtggtttgtgtcctcttctgggcatagggtgttggaggaaggcgaagcatggcggtggctggtggtgacgacgaagaagactgccggatttgccgcgcgcacggcggccgctgcttggtgatttctgtgattacggagcgtgcatgctagtttgatgttgtgtcaagttgatcgtttgtgcattagtaggcatcggctagatggcgattgcaacctgcttgtggattactacccccattttgttaatgtaatctgttttatcaagacccagcaagcattccctacagcatattttgtacttaatattgtagtagtagtaggtgctgaaatctcattcacccgctattggaggtgaatttcccatgtaatcttttgctcaagtaaatggtttaatgaaatctatgtctattattaatatcgccct

SEQ ID NO: 26 - DNA, 1270 bp, Sorghum bicolor
tcatcacagagctcacgcaccaccagagccgagaggaaaggcgactatagcaggcatggcgacgcgggcggacgtggagaagggcggcgtggtgaggaaggagcccggcaaggtgccgtcgccgctgtacccgcagcacgagggggagagggagtgggtgccatggatcgtccccgtcttcttcgtcgccaacatcacagtcttcgtcatcaccatgtacgtcaacaactgccccacgcacaccaccacgccgcgcgacgccaagtgcgtcgcacgattcctcggccgcttctccttccagccgctgcgacagaacccgctcctcggaccatcctccgccacgctcaccaagatgggggcccttgtttgggagaaggtggtgcaccaccaccagggctggcgcctcctctccagcatgtggctccacgccggcgtcctccacctggtcgccaacatgctctgcctcctcttcgtcggcatgcgcctcgaacagcagttcggatacgtgaggatcggtgcgatctacatcctgtccggcctaggcggcgccgtgctgtcgtcgctcttcatccgtaaccacatctccgtgggtgcctcaggcgcgctcttcggcctgctgggcgccatgctctccgagctcatcaccaactggaccatctacaccaacaaggcggtggccgtggcgacgctcctgttcgtcgccgccgtcaacctggtgctcggcatcctgccccacgtcaacaacttcgcgcacatcggcggattcctcgcggggttcctcctcggcttggtcgtgctcatgcgcccgcacttcgggtggatggagcgatacagcatgcccgccggcgcaccctgcaccgccaggaagtacctcgcttaccagtggatcctcctcgccgtcgccctgctcctcctcgtcgtcggattcgcggtcggcatggcgatggtcttccgcggctccaacgccaacgacagctgccactggtgtcactacctcagctgcgtgcccaccgccagatggaactgcaccaactgatcatccagcagcagcacgagttgccaccttttttaattcctctctctccttcgtatatcctacccagcttgtcatgcatacacatactacacacagttgtaattcctttcggccggggtactgttactgtagatagcttctttgatgggggttgtgaactgtagagtcccgttgagatcttatctcctgttcatttgattcattcttttacataatgcaatgctattattgaga

SEQ ID NO: 27 - DNA, 1390 bp, Sorghum bicolor
ctcctgctctctctcgcctctggtgcgcagagctctcttgaagcctcgagacccgtctcgccactgctgctgttctcagctctgccgctgcgcaagctgttgcattgcagtccgcgagccttgagctgcagctgctagctcgctcttcaccacagtccgcagacatggagttcgaagaccgctgccacaaggtccaggagcccaagttcgactgcctcctcttcgacctcgacgataccctgtacccgctgagctccgggatcgcaggccatgtcaagaacaacattgaagattacatggttgagaagctgggtattgatgagagcaagatcgagaacctgggcaatctgctgtacaagaactacggcaccacgatggctggcctcagggcgatcggctacagcttcgattacgatgagtaccacgccttcgtccatggaaggttgccgtacgacaacatcaagcccgaccctgttctcaagcacattctcaagaacctgcgcatccgcaaactcatattcaccaacggcgacatggtccacgccgtgagagccctcgagaggctaggcctggaggactgcttcgaggggatcatctgcttcgagaccctgaacccgccgtgcccgccgcagggagacgaggagccggagatcttcgacatcgccggccacttcgcccgctccggcaccgccgacgagcttcccaagacccccgtcctgtgcaagcccaacgtcgacgccatggaggaggcgctcaggatcgccaacgtcaacccccacaaggcgattttcttcgacgacagcgtacgcaacatccaggccgggaagcagatcggcctgcacacggtgctggtgggcaaatcgcagcgggtgaaaggcgcggaccacgcgctggagagcatccacaacatcagggaggcgctgccggagctgtgggaggaggccgagaaggccaaggaggacgtgctctacgccgaacgcgtcgcgatggagacctcggtcaccgcgtaaaacctcccgaatcctccggagccgaactttctcgacatccagaaacgcgacgatcacacatcactgcccgagccagggctggtgagctcacgctggaactgactgaatccagcaatggccgggccaaggatttccgacagcaggagggggtgcagcatgtaaaggggggaacagcagatgagatcatgtttgggatggtcccaatatatagttatgtatcagccagacctttgtttgtaaattaccagcattagaagtaataaggaaatggagtttacttgtacgtttcttgtgttctgtcatctgaagcaataaaactggttagcaagaccggaagagcaacgcatttgcttctctgaactgctgccagatttctcttc

SEQ ID NO: 28 - DNA, 1469 bp, Sorghum bicolor
aacttccatttatgcacaggcgcactctggccatcggaaagtaaaggcccaggcagtgccgtgactgactcgagacgcaggagaaggatcgagaccaggcggtggcttcccgggggcaggatcgtcgcgaccacgaaagatgtcttactcaagaggatccagtgaaaggtatggatctcgctcaccttactcgagaagcagctattcaaggtacagaagtcgctctaggagtgtggactcaagcgatgctgaaaaccctgggaacaacctgtacgtgactggtttgtcaactcgtgtaacggatcgagatctggagaagcacttttccactgagggagaggtgattgatgcaagcgttgtgcatgatccttggacaagggaatcacgagggtttggttttgttaccatggctactgttaaggaggcagatcgctgcatcaaatatctggaccgttctgtgttggaaggtcgggtcataactgttgagaagattttgttgacagcaacagggtagatgttggtagctgctctgcaacaaactgatacaacctaacaccaaaccatgccacctcagccaaagggcaaagagaagacgaggtagaaccccaacacctgggaagtatcttggcacaaaatcttcacgtggacggaggtactccccaagctactcacctgttagaagggaccgttacagttcccgctactcgcctgatcggagggaccgttacagttcccgctatcggagggaccgttacagttcccgctactcacctgaacgtgacctgtcttattctcctgatggtagaggccggtcatactctccatatgacagaaggcgatcatactctccccacggcaggcatggatcttattcccctgacgatcggcgtcgatcatactcaccttactacagaaaccgatatcgttcaaggtctccataccgctacagaagacggaggtcaccttctgtttcgccatactacagccggcaccggtatagatctgtctccaagtcacccagtgtttctccaacaaggaccagagagcggagctattcccacagtttatcgccacagagaagctactctcgcagccattccccagaatcggagagatcaacgagctactctcctaagaaagggagtagaagggaaccctcatgtagcagatattctggcaagaggcgtcgttcaagggaaagctactctcatagccgcagttcatactccaggtccgtgtctagggagcgctcagcttgatctgcgaggtgtatcgtcctaggttgttataagatgccctgtatccgtatttgacagaactgatgtgttttcatgatcattatatgctggctattgtgaacttgagaacagcatggatgtgtgcattgtactgtattatgttatgttcattttgtatgagacagtgaaaaatttctgatgctatcttgctattgttggttcgttcttggt

SEQ ID NO: 29 - DNA, 1560 bp, Sorghum bicolor
atcgtccccaaaccacgcgcgacactggtagtacagcggcagctgcgaggagtgcgagcgcgtgaagcagcaggaagaccggcaagaagccgatggcggttgtgagcggcagcggcggcgggaggctgaacccctgggcggagcccttcgtgccttccggggtgcggtaccgcggcctgatgcagacgcccgagcagcaggaggtggaggacttctcccccgagtggtggcgcctggtctccgcctccccggccttccgcgaccgctggctccgcgagtacggcgcgctcggcctgctcgacgccgaggaggacctggacgacgccgaggtcgacggcttcctccccgacgacttcttctccgctccggccccgcgccaagagagcgagcgggagggcggcgtggccggggctggtaagaaggtcggcggaggcctcgaggtggcggcgtgggggatcgacaagtggtggcgggcgcacggtgggccgccggaggccccgaggtacgcggagaaggcgccgcggagggtggcggccggcgccagggtgagcccccgccccatccagcagccgcgctgaagtacccgatccgttcccgcgcacgcgtccatccgccgacggctgctcggtgccagatcttggcacaggaaaaactaggcacccccaaaaaaaaaaggtttccttttccaatcttgcaatttgctttggtgtgttcgtcttgcgcagtttctggatctggactctgcttcagctcgagatcgaatgggaagatcctctgctgcgttgtctgtgctcatccctgtactgtgtaaatatgataacaataacatgcagtcagacttttagcttccgtcttcagcatcatctttgtggcgtgattttttttttcaggagccacagcgaatttgattaaggccttggttacctaaaatttttttaagtttttcatcgtattttatcttgcggcagatacatgaacattaaatatagataaaaaataattaattgcagtttacatgtattttgtaagatgaattttttgagccatagtttctatagttaaataataatattaaataaaaataaaaatactatagtatccaaaaaattttcacctcctcaactacttgtttagtttatccaaaacattaaatttttttaaatttttcgtcacatcaaatcttgcagcatatgaattagaccaaataaaaacgaaaatgctacgggatccaaaaccaaaaaaatttggtaactaaacaagacgttagttacaatagtaccactagtacagtgccttctgtagttgcaagcaagccttgtttacttctaaaagattttgtaaaataagaatagcactacttttgtttgtatttaacaaataatgtctaatcataaactaactagacttaaaagattcatctcgcaaattataggtaaactgtataattagttatttcttttgtctatatttagtgctacatgcatgtgtcgcaagatttgatgcgatgagaaatgtgaaaatttttgcaaaatattttaggaactaaacaagaccttgatt

SEQ ID NO: 30 - DNA, 1415 bp, Sorghum bicolor
aacccagaaacagagaactagagaagtccgttgaggcgtcaggcgtgaacaccaggaggaagaagaagaagcaaaccagccaagaaaccgactccctaatcgggggtccctcaactcggtcccttgtccttgtccagttgtcccctcccctctcgccggtgctgctcttgcctactccgatggctgatgctgccgccgccgccgcccccacgaagacagcgaacatcccgacgacgatgcgggccgtgcagtacgacgcctatggcgggggcgccacgggtctcaagcatgtggaagttcctgtccctatggccaaaaagaatgagcttctattgaaactggaagcagcaagcatcaatccagtggactggaagatacagaaagggttgttgcagccttttctgcctcgtaaatttccttttatcccagtgactgatgtggcaggagttgtggctgatgttggtccaggaatcaatggattccaagccggagatcaagttgttgctatgctcaactcacttaatggaggtggacttgctgagtatgctgtggcatcagaaaatctgaccgtcaagaggcctcccgaggtatctgctgctgaaggcgctgggctgcccattgccgctggtactgcgctccaggtgcttaggaccatcggcgccaagttcgatggtactggccagcccttaaacgttctgatcaccgcagcatcaggtggtgtgggtctctatgccgtgcagctcgcaaaactggctggtctccacatcactgccacctgtggcgcacgtaacgtagagctggtgaagagcttgggcgcggatgaggtgcttgactacaggacgccagagggtgccatcctgcagagcccctcaggtaagaagtacgatggcgtcgtccactgcactgtcgggatcagctggtcaacgttcgagcctgtgctggccaccaacgggagggtgatcgacatcactccaaacttcactgtgttcctcaaatcggcgctgcacaaggtgaccttcgccaagaagcggctggtgccgctgctcctgtcgcccaacaaggcagacctagagttcctggtcgggctgctgaaggacggcaacctcaagacgctgattgactcgaggttcccgctgagcgaggtgagcaaggcgtgggagaagagcatcgagggccatgctactggaaagatcattgtcgagatggtaggctaatctatgcgtccattacctacatagacttccagggagaatatacttaagcatgatctaggcagttggacactacagggttaaggtcaacagatatggagtactagtgtctgagtttggtcgtcgtacaaattaaattattcgtgagagtttggtcgtcgtacaaattaaattattcgtaagtggtgaaccagtttacaggct

SEQ ID NO: 31 - DNA, 1599 bp, Sorghum bicolor
ctctctcgctccgctcttcgccccggcactctgcgagtctccatagcgctcgacacatcaccgcggcaactcgccccggttcggttccaccgccgtctcggcaatctctcctgcctcgtcttctcaagccctcccgcccgccatggccgcgaactcccccttcgactgcgtgctcctagacctggacgacaccctgtacccgggcaacaccggcatcggccccgccctgaagcgcaacatcgacgagttcctgcaggccaagctcggcgtctcggcggagaaggccgccgccatgcgcgtcgagctcttccgcacgcacggcagctccctcgccggactcatcgcgctcggctatgacgtgcacccggacgagtaccacagctacgtgcacggcaggctaccgtacgacatgatccccgccgacccgcagctggcgcgcctgctgcagagcatcccgcagcgcaaagtgctcttcaccaactcggaccgggcgcacatgaagcgggcgttggagcggctgggcgtggacgaggccgtcttcgacgccgtcgtgtgcttcgagaccatgaacccgcacctcttcggcggcgaggccagagaggagcgcgtcgacggcggcgaccacccggtcgtggtcctcaaaccggcggtggacgccatcgtggcggggctgcgcgccgccggctccaacccacgccggacgctcttcctggacgacagcgagaggaacatcaccgctgggaaagcgctcggcctccgcaccgccctggttggcaagagggtgaggagcaaggacgcagactacgcgctggagaacatcggcgcgctccggcgggtcatcccggagatctggggcgtcgtcgccggcggcgagagtgaacgatcggaccacagcattgacaagatgccgatgaggtccgacctggactccatcatccagcccacgtccatccaggcctaataacctcatcccacccaacttcataaataatcaatcagtcagaatcatgggatgccactaataaatcaaatctccatcgtctctctctctctcaccacctaatcgatcatcatgtacattattctgattcctgatgtgcgtccgtgcgcgcgtgtgtgtgtgaatatctatctgtacctatctagctgacaggcatgtacatacacatttctgatcagcaccggttgtcagtgcatgtaaagcagcaattcgccaaattccaagtgcatgacgagtcatcatctgtattatgataagaataacaagtcgtacttatgtaactatcgcgtgctctgttctccatatatatgtcccgatgtaaagaataatcagatacgcagatggtggaagcaccaaaccctatcttgggttattggtgaatgcgtgtttctcaatggatggaaaagcctcatccgtggcaccatacataaatagacctcttggagatcatgcagtattgtttacatggacaataatcaatgtgatcctattcatacgtgaccactcctattcatgggttaacacatgatcgagtctaacgcatctggtcgtaacacacatgcatacacacgatctggtctatgttgccgaatgttgag

SEQ ID NO: 32 - DNA, 1458 bp, Sorghum bicolor
ctctcgccgcagtccggcgtagtattattgctttgcttgctcgctcgaggtgcacgtggcggtggaagcttcccggtggggggtgtgggtggcggaggcggtggtggtggtggttgattggttgatgtcgatggcgcaggtgtgctgcgactcggccgcagcggcgacggcggcggcggcacaggtggttggggcggaggcggaggccagggccagggcgcgcgccgagaggcggcgtcgggctggggaggccgccgggaggtggaggcacgcgggcgcggccgctggtggcacgcccgacgctgccacgaggaagcggagcctcgaggccggggagctgctcgtggcgcgcaagcacggcgccgcgtcggtggccggccgcaggagggagatggaggacgccgtgtccgtgcgcgaggcgttcgcgctcgcggagggctcccacggcgggaggcgcgacttctacggggtgttcgacggccacggctgctcgcacgtcgccgaggcgtgccgggaccggatgcacgagctgctcgccgaggagctcgctgtcgccgccgccgccgacgacgtctcctggaccgcggcgatggagcgcagcttcgcccggatggacagcgaggtgatgtcggccggcggggccagcggcgcctgcggctgcgacgcgcacaagtgcgaccacgtgggttccaccgccgtggtggccgtcgtggaggagcggcgcgtggtggtggccaactgcggcgacagccgcgccgtgctgtgccgcggcggggacggcgcgccgccggtgccgctgtcgtcggaccacaagcccgaccggcccgacgagctggcgcggatcgaggccgcgggcgggcgcgtcatcttctgggagggcgcgcgcgtgctgggcgtgctcgccatgtcccgcgccatcggggacggctacctcaagccgtacgtgtcgtcggtgccggaggtgacggtcaccgaccggtccgacggcgacgagtgcctcatcctggccagcgacgggctgtgggacgtggtcagcaacgaggccgcgtgcgaggtggcgcgcgcctgcctccgcaggggccgcgccaagtggtgcgccgaggccgccgcgctgctcaccaagctggccctcgccaggcgcagctccgacaacgtctcggtcgtcgtcgtcgacctccgccggaggaatcatcactagttggatctgtgcagtcgccagttttagtagtactagtagtacaaggtaggatgatggatggtgcacaaaaggatttcgcgggtgacgggtgtgtactaattgggttttttttcctttctttttcatcaaaaaaaaaaaatattttttttgctgtactctccctgaatcaaaaagttcagaggagcacttagattagttattatggtggaaccggaatttgatccggataccatttggaatgaaaatgaagtgttgcataa

SEQ ID NO: 33 - DNA, 1454 bp, Sorghum bicolor
ggcttcgtcctcgtcacgacttgtcagccgcactggcggtacactcttcttcatcacccggacgcccggaacggccgcacacggcacacgcattgcttgcttgtcgtgctgagccgctccactcctcttccccccgctgctcgcctctcgattccttccgcctcatcgcgtccggcgaaccccatgtccactgcgaccgcggccctcgccgccgcgcgatcccccgctgtcgcgcttctcagcctgcgccgccgcgcccacgcggctgctcccattcgcttccccggtctccgcgtcggctccggttgccgtcacgtagctatggcttccgcggcgcatgcccgcgcccccaccgacccgcttcccaagggtgctgattcatttttccgggcagtgatctcgaacatggaaaaggtttatttgagcaggaatcctacagccaaaaccattctagagcttgtacgatcttatgatggtgatcacatttgttatgaccaccttgctttccggacatttggggtcaatggttatggtataaactcactttctgaatttttcactgattttggttatgtacctcgcgaagaactcagatttccagctaaaaagcttagagcactatggttttccccgcccaccaatggtggctactctggaactggtacatatggacctttgccaaggatattcatttcagaactgcttgtggatgagttgactactcaaagccaggaaattatacataagtacattaaaacttctggcaatggaaataatcatgctgctcttgcaagtacttctggggagctgacatgggaaaagcccatctattcagatttccagattttgtctagtgaaagtgaatatgctgcatggactcttgttaatggctatgcactaaatcatgccacaattgccacccatcgcctagaatcagatatcagaaatattaataagttcaacaaatttgtggaggacaatggcttcaagttaaattcagaaggagggattctgaaagtgagtcctgatggtctccttcagcaaagttcaacagtagctgattcatcattgtttacatttgctgatggaataactgaatctattcctcgatcttacattgaatttgctgaacgtctcctgctaccacagttcaaagatttgcaagatgaagaggtgaaagaataccacaggcgtgatggttttgaggtgggcaatgcggacaagatattcgaaagtacatcgagggatcagctgacaaggacatctgcataaacagtgaactctagatctattgtgcaaatgacccaatgtgcctcttggaagtgtgttggaggcatgtattgtgaaatgattgtacctacttgagtgaaataaaacatgagaatcaataaaaagtaactgttttttattctacatctgttgaatccaaagagagaatcagttactgtttctgt

SEQ ID NO: 34 - DNA, 2753 bp, Sorghum bicolor
ctcccctcccttcctctgcagcgccagcgccgaccaacccaacggccacggcaagctaagcgaggctgggaggcggtggccgagggttcgtcaagccaagccaagcggagcagagcaagggtttgctcctccccccatccgccccgccgcggacgaggctctgcttctcagcgtgacaagcctggcgaacaagctgccatggacctggtgggatccttgctcatgaacacgacgcgtctgcttgacccctccgggctccacttcttgggctggctcgtcaccgcgggctccattggcctcgccgcgctcatctacgctctcctcaggctgcagcgcgaggcggcgctgtactggaccaaggcggccagggagaagcgcgccgcgtggaggaggtcgcggtgcccgagctcctgccactcgtggtccgaggaccgcttccacggcggccagccgtcgacgtgctgcgtctgcctgtcgtccctcagcggctccgcgcagggcgccgacgacgtggttcaccgctgctccgtttgcggcgtggccgcgcactcgagctgttctccccacgctgagaaggactgcaagtgcgttgcgcaggctggcacttcgcccttgctgcatcactggtctgagaggtgggtggagctggacgataacccagagatatcctccttctgctactactgcgatgagccgtgcggtgtgcctttccttggtgtctctcctatatggcgctgcctgtggtgccagcggcagatccatgttgattgtcatgcgaagcttttgaaggaaaccacaaacacttgtgatcttggccttcttaggaggcttattgttcctccccaatcagtgaaagaagttggtcaaggttcaggaattagcggaatgctcaactcaatcaaggatgggtttgccaattcaacagctgggaatcgtaggaggccacgcaacaagaaacgcgggaataaccatcctggtggcaaggcaaattccattcccgcaaaaggctcagtccttgattcagtgcttgaaggatttgctagattgaagggcctggatggaaagtatgcactggcaaagcctttatctcaaaattctctaaagcaaacatatcgatctggtattcctaatgaacgagtgagaaagtatgaacttgttgatttgccacaagattcaagaccactgctggtattcatcaacggcaagagtggaggcagaaatggaccttctcttagaagaaggctgaacatgttgttgaatcctatacagatatttgagctaagtgctcctcagggacctgatgttggattacaactattccacaacgtgaaacacttcagaatccttgtttgtggtggggatggaactgtagcctgggttcttgatgccattgaaaagcagaactatgaatctcctccccctgtcgctattcttcctctcggaactggaaatgacctatcacgtgttatgcgctggggagggggtttatcttctgttgaacgagaaggaggcatatatgcacttttaaatgatgttgaccatgcagctgttacagtgcttgatcgctggaatgtagccatcaaagagaagaatggaacagaaggtcaatgcaccaagcaagtaaaatttatgactaattatttaggtatcggatgtgatgcaaaggttgcttatgacttccacacctctagggaggaaaaaccagataaattttgcagtcagtttgtcaacaagctgatatatgctagagagggtgcaaaggatatgatggataggtcatgttctgatttaccatggcatgttagccttgaagttgatggggaaaacattgaaattccggaggatgcagaaggtgtgattgtaatgaatatccctagctacatgggtggtgttgatctgtggcaaaacgacaatgaccacgatgatgatttcagtttgcaatcaatccatgacaaaatacttgaggtggtttgtatatcggggacatggcatttaggaaaactgcaggtcggactttcaagggcacaccggttagcccaaggaaaagttataagattgcacctccacagttcgttccctgtccaggttgatggtgaaccatggatccagccacctgggtgtcttgagatatctcatcgtggacagatgttcatgctgcggaggacatctgaagaacctactgggcatgctgccgcaatcatgagtgaggtcctcgtgaatgcagagtgcaatggtgtgattgatgcgtctcagaagagattgcttctccacgagatagcactccgtttatcctcttgacacttcatccagtcctgctgctctcatctcacaaggctgacccattttgtatcctttgataccaaacctatcatctctgttgagaaatccctttgcacagacgtatactgcacaatggtagagttggtatatacaatatatggagatagaaggtgtatacaatacgaggagatagaaggtgtatacaataatacaaggaggaaatagaagtttccttttgtgtttgactgtaccttttaagataggccctctgcttctttgtggctggttcataggagcagctgttgaaagaattttgtagcgcatagagccattgtaactgcaactagggctcaatgagaaatgtaactagagtggatgtcagtgtcttttttgcaaagatattcatgcaattgttaccgcattttgtgagatctgtaattttgctaactgatgttttgtggcgttgtcgtgga

SEQ ID NO: 35 - DNA, 1998 bp, Sorghum bicolor
agagacggaccggctccgatcgaagctgcccgtgcccgacgaccatggcgtcagctgcgagaaccacgccggggccgggcaggtccgtcgtcgtcctcgtctccctcgccacgctcctcctcgtcaccttcgtctccaccgtggagagctacgacggccggcatgccgtggcgcactcggtcatggcgcggcggtcccgcctggggacccgacacgtgcagcaccaccaccgccgcaccaccacggtgccgcaccggtacgtccttgcggagaagagcagcccgaccggcggcggcagcagtcccaagaaccgcagcagctcccctgcgacggccaacaacgccagcgcgccggcgccggccgcctcgcagagtgacggcgggcgtcgccaccgcagccacaagcaccgggtgcgcaactggatcatcggcttcgtggtgggttccgtggcgggcgtcatctccggtctggtgctgtcggtgctgttccggctggcgctcaactgcgtccgcgggcggtaccggtcgcgctccggcgtgatgatcttcaccccgaagctgatccggcggccggagcacctggcgttcctggagaaggaggacgggctggcgtcgctggccgtgatcgggcgcggcgggtgcggggaggtgtacaaggcgcagctccccgtggagcgggagggcgacgcgccccgcttcatcgccatcaagaagatcaagaagcacggcggcgacgcgccggccaccaacaacaacctcagcgacgaggagagccggcagctggacaagcggtcgcggcagatccagtcggagatccgcacggtgggccacatccgccaccgcaacctgctgccgctggcggcgcacgtgccgcgcccggactgccactacctggtgtacgagtacatgaagaacggcagcctgcaccacgcgctgaaagccggcaacagtgccgtcgaggtcgaggacggcggcggcggcgaggacggaggcaccggcacctgcaccggaacctccggcgggctttcgtggccggcgcgtctccgcgtggcggtgggcgtggcggcggggctggagtacctgcacgtctcccaccagccgcagatcatccaccgggacctgaagccggccaacatcctgctggacgacgacctggagccccggatcgcggacttcgggctggccaaggcgatgccggactcgcacacgcacgtgacggcgtcgaacgtggccggcacgctggggtacatcgcgccggagtactaccagacggtgaagttcacggccaagtgcgacgtgtacagcttcggggtcatcctggcggtgctggccacggggaaggagccgtccgaccagttcttcacggagacggaggaggtggtggggctcgtcaagtggctgcgccgagtcatggagagcggggagcacgcgcaggccatcgacccggccatcgccggcgccggacacgacgagcagatcctgctgctgctgcgcatcgcgctcttctgcaccaaggacgaccccaaggagcggcccaccgccaaggacgtccgctgcatgctctcgcagatcaagacctagccacccagccacttcaatcagatcaatcactacatacaaattactacccgtttgagattatctcctagatttaccagtcatcagcgaatcgtatctttagtcataacattttaggcaaacgaagaaagtagtttcaaatttcaataaattctctctgcgtctctggactgtggattagtgctagctagagtagcaactgttgtattgtagcacgtatcgtgaaatcgtcgcggcagctgtcaagtgggaccggttgactaggactggtcagtaggatagtactagatcgggaagtcggcgcacgcgctggactagggaccggacctggtatacacatcaatgcatctctatcctttgtttttgcttgcgagatgcttgcgagctttggcatggttagtgctaaataccagtatgattc

SEQ ID NO: 36 - DNA, 2514 bp, Sorghum bicolor
ataacttccaagaactgggggcgccgggaggtagcaacaagaggaaggagacgacgacgacgcggccttcggctgggagtgggaggggacaaaggggcgtagacgacgaggaggaagcgtccagggggaccctgccctgttcgaaaggctggcagctgctggtgtcttctgctattactatctgaagttctgaacttggaagatattcttctcagccttagaaactttggtgctaactagaccccagcctcgtattgtgagctgtgggtgatgttctggtaccttgatggcaaacacagaaggttttcgccttgtgagatgcccaaagtgtctgaacattctcccagaaccgcccaaagttacagtctacaagtgcggcggatgcggcaccacccttcgagctaaaatccgtgccagcaatggccaacatgtggctgcaaaacaagtccgccaggactccgacagttattcggttgcaaccgccgtgagcaatggggtgcctcctcaaaacaaagaccaaggctccattggtgctgtcacagagaatttttccttcaatgctgacgctccaagcaccgagcatgacagcaatggaacaaggagcagtgaaaatggtgatgatatgctggctgggcagaatgctgtggtggttgaggatactgagaacaaggacaatcgcaatttcgaagaccaggatagcagttcaaggatggaaggtcctgctgatcaaacacgcctgaatgcaaatggcatgtatttaaattccggtgaaacagaaaaccacaccgttgaacaacctatggagaattcagagacttaccgagtaagtggacatgatgatactgaatgccacttgaacccctctgaaaacaaaccgatttcttctgagataagcaaagcagccgtcagtatgcaagatcctgagcagaaggaagcaggcgaatccgaacatgcggcaaacaagaagagttatcttgtgagggtgctgtctcggtcttgtgatcttcggtcatcaataaactcgattgatttccactctgcacggacttcgcttcaatccaaaagcttcagggctagtgagccccttcagtcgaagatcatgaacacaatggatgaactgaagggtgacctttctgaattgttcaataaacctgctgcagactgcaagccaaaggcacacaaccctccacgcccttccaaacaagatggccacatgactcgtgcagccaccacaaccagcgcacctcttgcagcataccatcctgctgccaagtattctggctatgtgtctcgcctaagcaggtctggccaggttcctcttcctcctcgtggactgccgtcgctgagatatcgccggcacagggtttattcattccatcatcacagcatgcaaacggaaatgagaccttgccgtcatgagtgctgccatagctgccagccaccctgctacagatcctgcaaccaagaatcttcagcgatgcacaggccaccgatcatggagatcaggcgtcgtcctcctcccagaaatcactgcctgccagtgctacgtggcgctccgttcgtcatctgctccaactgcgtcagtctggtccagctgcccaccgacttcgccgtccctagcagagggacacgccgggtgcagtgcggctcctgctccgaagtcctctcctactcctacagggaccccgccaggaagaggctgcagtcaccatttgggggcgatgagtacagcactgatgagtacgagattcaccaccaggctgccgctgccggcggcggcttcgagcaagcagatccggtgtcctactccgaagagtacgggctctcgttcggcgtcagccactcgactagcaccgaggacgggcagccgctgtacgtgtcgaggaactcgtccttcaacaccgtcgacgaaaggatgatgggcaaagacggcaagcttcaccggcttatggggtactcgtcggcgagcgagctgctgcggcggcattcgcccgacctgttcgagagcttcgacaggcgcacgcccaccatcgaaagaacgcacgtcgtcgacaggaagggtaaaggcgtctgcgtggcagaaaacgatgccggcgagcgagacggtggtgcggtggtgaagagatcgaaggcgaggagtggtggcttgccgctccatgggatcctgaagaaggggatccatggcctggaatcactcaagctcaggtcgtagctcatgatcttcgttaggcggtggcgaggctcaggcgatcgagtttaggagagagtagcatacacgacaggtttagagtttagtggttggcgttctgaggtgtgcttactgcttagttgctagcttgtgtgtgagtttgtttgcaatccatctgtgtgtggagttggttgatttgcaaattttgtgtgatcttcgatgtgtgtaaggtttgcacgccacacatgctcgatgctgtggatgtgcatatatttgattggtgatttgtgcgcgattaattcatcatcgattcatcggtttggctc

SEQ ID NO: 37 - DNA, 1218 bp, Solanum lycopersicum
taatatcaattctctccatacactttttgtcattattaattcattgatgaaatgcagacaaaatgaactccacattcacatgaaatgtaaaccaattttctcaatttcccaatcatatctctattatatatactcttccttccttccaacttgtgtctccgttaattatagcccttttttttttccaccatggagctataacattaaatcacaataatacatccattttattttatttttctaaaaaaattgggtcgccggaaaatcaagattccggtaacccatagtaattattttgtttatacatagaaattttttcttttctgtcgcctggagattaaaaaaaggtgatgataaatggcaaagggtcggaaactggccacgagtcgcagtgaaatgttattaggaaactacccaagctatagaaatggaactgcaacagtcaacggttcctccgaactaggagaagatgatgtctgggcaacggttgatgacatggatgatcacgattcaaggggcgagtggagtccacgcgccgccgctgagggtaacaacggatacgtgaaccgtaaggtccaacaatccgaccaccaccaccacagccaccgcgggcgccaggttgggggcttgtcattggctttcgatgattcaggtaaaacggcatctcctcgaatcttgcaccagtttcgcggacaagacgcgccatccccacgtgtggcacacatggccacgtcagcacctgtgaatgtccctgattggtctaaaatataccgagttaactcggttgaatcgttgcatgactcggacgatggtgttgatgatcatgactcggagatggttccgccgcatgaatacattgctcggagccggaactcgaacgctcactcggtgtttgaaggtgtgggccgtacgttaaagggtcgggacttgagccgggtccgagatgctgtgtggagccagaccgggttcgatggctgagttcatcaatcgaactatctatcgttttgttagattaaaagattttataactattttagctgtttggagaattaaaaaagcaattgatgataattatttttttgctagataaatttttggtcttgggcaattattaaggttgaatgaatgcaaagtcagtgaatcaaccagctcctacagagcctaagtttaatttttttttctattaatatattttcacatatttttgagtatgtaaca

SEQ ID NO: 38 - DNA, 1002 bp, Solanum lycopersicum
cgggccgggggtgtctactcatcatttcacaaaaatatttgcatttataatttgttgaatttgttttctctctgctatggattcttcctcaccttttgactctattattttcgatttggatgatactctgtattcgtctgcgactggaattggacaatcgttgaagaagaacattgacgattttctggtggagaaatgcggttttccggtttcgaaagcatcggctttgcgtgttgagcttttcaaaacttacggcagttctcttgccggattacgagctataggttatgatgttgatgccgatgattatcacagctatgtgcacggaagattaccgtatgatttgattaaaccggatccccaattacgaagcattttgcgtagtattaatcaaaggaaaattattttcacgaattcggatcgaattcatgcgatgaaggctttggatcgtctgggaattacggattgttttgaacagatcatttgtttcgagacgatgaattttaacctctctaaggcaacaaggccggaagagattccggtgatattgaagccttcaatggaggcaatgaatatcgccattgaagctgctcaggtcgatccttatcgcacgctcttccttgatgataatgttaagaacattgctgctggaaaagctgtggggcttcaaacagttttggttggaagatcaaccaagacaaaagaagctgactatgcattagagatagtgactgatttggttcaagtagtaccagcaatatggttcaaggaagaagaaaaagatcaaaaagtaacacgtacaagaagtgaaatggactttcttgcaactacatctgtgggtgcttaatctatgtcaagaaaaaaaaaaacaagtctactaatctatgtacaagtgtacatattcctaataataataatgtaatttttaatgtatgtgaatgtacttgttacgtatatataaaaattatgaacaaattattataacaaaagaaaagccagtgg

SEQ ID NO: 39 - DNA, 1387 bp, Solanum lycopersicum
attttatttcgagagccttcgcaaattagagagagaaagagaagtatttcgatcctacgctaccataatctcttcacgatgtcgtactccaggaggtcaaggtattctcgctcaccttcatacgatcgatatagcaagtctgtctcaaggtccagatgtgtttcaaggagtcggtcaaggagctgtgattcaagtgatgttgagaacccagggaacaatttgtatgtgactggtctctcaacccgcgttaaggagcgagatattgagaagcatttttctgctgaggggaaggttgaagatgttcgtcttgttttagacccatggacccacgaatctcgtgggtttggtttcgtgacgatgtccagcgttgaggaggctgatcgctgcatcaagtctctgaatcgctcaatacttgaaggcagagttatcaccgtggagaaggccaggaggagaagaggtagaacacctactccaggaaaatatttggggcttagaactgttcgcgttcgtcgtgaatcacgaacttatcctcattattcaaggaatcactctccttgttactcatctgaaagctacaggagcaggagcaggtcttactctccatattaccgacaagagcatagatcatactcttattacagaggacgccagagatctcactcatcgtattacagtcggcaccactgctactcagaatcaccttattctccttactatagtcgtggaagatcttactctcgatctttatccccatataatgggcgtgatcggtcctactctccagatgactgttattacagaaggagccgttaccatgactattctcccgacaatcatcggcgtgatcgttcctattctccagatgaccgttactatagaagaagccgctaccgtgactactctcctgaaagccatgatctttcagactctccagatgttcgtgacaacagaatgagccgctatcgcgactactctccgaacaacagttactattatcgaaggaaccgatatcgttccatttctcggagcatttctcctcggtatcggagaagctactcgcgcagtgtatcacctaggtggtcaaagaggagctattcaagaagcgtttccaggagcagctgctctcgtagcagttactctcctaatcagaagaaaagctctaagaagagtcgcagtgttagtgcatcttccagatttgtttcaaggtctgttacacctaggtcttcaccttcatcatgaaaggactacactactaggaaggtctagtctgtcactctctgttgcaaagagtttaaagttgtattagattggtcattcaagtagaatttctcaagataacatatctgctttccagcttatgtgactggtggaaatgagatctagctgt

SEQ ID NO: 40 - DNA, 2082 bp, Solanum lycopersicum
tccatcaaccaccacagtttccctcgttcacctctctcctccctctctgtccggtttaccggaaaaacaagaatctcaaatgacttcgaatatccacttttttcttttatacgttgtgagccttttcctttttgttcaagcaagattgaatctttatccaccagatcatgctgcactcttgcttgtacaaaaggacttaggcatcatttctgttaacaacccgtgtacgctcgcaggaatatcgtgcgagcgtagaccgggtaacacaacacaagttgtgagagttacccgtattgtattcagatccaacggattaaagggaactttgtcttctgctattggcaaactcactgagctcaaagagctttctctttccgacaatcaactatctgaacaaatccccgttcagattattgattgtcggaagttagagattcttcaacttcaaaggaacagattttctgggaagattccatccgaattgtcagctttaaaccgtttaaggatagttgacttttcatcgaatgagttttcggggaatcttgatttcttgaagtactttcctaatctggaaaaactgtctctggctgataatatgttcactggaaaaataccattttcattgaaatctttccgaaatcttcgttttctcaacatttcagggaatagtttccttgaaggtccagtacctgtcatgagccaaattgagcatttatcagcagatttgaatcgaaaaaatggcgttcctaaacgttacattctagctgagaattcaacaaggatatctgcaatgggacctgcttcggttccagctccagctccagcacctgtcaatcgtgttgtaccggcgatgcataaacgtaagaacaagaaaaggaagttacgatcttggtttcttggtttcctagctggaacttttgctgggggtatatctgctgtgctctgttccttgctattcaagatggtaatgttcttcgtaagaagagggaataacgattcaagtttaacgatatacagtccactgatcaagaaagccgaggacttggctttcttagagaaggaagatggagtggcatcgcttgaaatgattggaaaaggtggctgtggagaagtttatagagcagagctaccggggagtaatgggaagattatagctataaagaagattatccaatccccaatggatgctgcagagatcacggaggaagatactaaggcgttgaacaagaaaatgcgtcaagttaaatcagaaattcaaattgtaggtcaaatcagacaccggaatctgcttccattactcgcgcatatgccaaggccagactgtcattacttggtctacgaatacatgaaaaatgggagtttacaggatatcctgcagcaagtcacagaaggcacaagggaattagattggttgggacgacacagaattgcagcgggggtagctgctggtctcgagtatctccatataaaccatactcaacgcataattcacagagatttaaagccagcaaatatcctacttgatgatgacatggaagctcgagttgctgattttggccttgcaaaggcagttccagatgctcatacacatatcaccacttcaaatgttgcaggaactgttggatttattgcaccagaatattatcagacactgaagtttacagataagtgtgatatatacagctttggtgtggtgctagctgtgttggttatcggtaagggtccatcggatgattttttccaacatacttctgagatgagtttagttaagtggctgaggaatgtaatgacttctgacgatcctaaaatagcaattgatcctaagcttataggaaatggatacgacgaacaaatgcttttggttctcaagatagcttgcttttgtactctcgacaatccaaaggagaggcctaacagtaaggatgttaggtgcatgttaactcagatcaagcattagataaccaatacactggttatgtaactaagaatctgttctgtattttcagtttcgcaagttgatattttgttgtaattgtgttatacatgtcaaatcaatattcattccaccttaaaaaaaaaaaa

SEQ ID NO: 41 - DNA, 652 bp, Solanum lycopersicum
ttcatacaatataatggggcttagggctattcccttttcaccttctcaaaattattatttgagtggttcagaatatttgcccaaatgcagtgttcttggtagcagcagaactggctcatcaaaactagtactaacaatttcagcaaaggctaaaaaagatgacgcacaagaagaagaagaagaaccaaaaaacaagaggaaacaatcgttgttttcaagtgtaactgaagctcttgatttttctcaagttagatctgcaaaggatgctgagcttcttgatgaagcaagagaaaaaactcaatctggagagagaatgtctaaagaacagtatggagctcttagaaggaagattggtggaacatacaaagatttcttcaagtcctatgttgaagtggatggacaatatgtggaggagggatgggtagacaaaacatgcaaggtttgcaagaaagatacaagtggagaagcaagacaagttgacaaaatgggacgatatgcgcacgtagcttgtctacaaaaatccaaccctggaaatttcttcaccaagctcttctcaagatgaattttatagtatatatcctcctcatatatatgaatgaactccacagaatataatagccttggccattttgtgtttttctttttttcttga

SEQ ID NO: 42 - DNA, 2044 bp, Solanum lycopersicum
cagaagagacgcagcaacattcttcttccaattcacaaattacaaggtagttttgttgatctgtaaaagaggaaaagttttttttttttaatcttcctctttatcagtttgtttgggtagcaattaatgggatctctaccggagccaattatggatgaaacttacagcaagccccctggaattagggtgatggagaggacaaagaaggctaacctctctttcaagacatatcaagggattgtgttaattgtaacatttttagcttatacaagttaccatgctactagaaaaaccacaagcattgtgaaaagtgctttggatccccagtctcctgatgttggcttaaagtttccgtggcaaaggcgtaatacgacttatgaccaaaatcaaagttcaaaactttcttggatgcttaaagatggttgggtaccgtttaacggacctgatggtacggcgatgcttggtgaacttgatgtttcattcctttttgtatatgccatgggaatgtatttctccgggcacgttggtgataggatggatctgagaatatttttgacaattggaatggtggggactggtgtgttcactgccctttttggagttggatattgggcaaatgtacacatcttttattactatctaattgtacaaatgatggctggattgttccaatccacaggatggccttcagtggttgcagtagtggggaattggtttggaaaaaagaagagaggacttataatgggtatttggaatgctcacacctcggtcggtaatatcgcgggttctgtggttgcttcattattgttgaagtatggatggggttggtcaatggttgttcccggtacccttattgctgttgttggcgtggtagtattccttctcttgccggttaatcctgaatctgtgggagctaataaagatgaagatgaagtgttctctcctagaaaagaaggcgaggaagtaaccgagcctttcttgagatcagacggagaagaggaatcagccgtgggttttattgaagcatggaagattccaggggtggcgccgtttgcgttttgccttttctttgcaaagttggtagcatacacatttttgtattggctgcctttctacattagccacacagctatagaaggaaggtatttatccaatgaggaggctggaaacttgtcgacattgtttgatgttggaggggtagtaggtggaatcctagcaggttacatatctgaccgcttagatgctagagctataactgctgccagcttcatgtactgtgctatcccggttctctacttctatcgcagctatggacacgtctccatgaccataaacatcatcctcatgttgatcaccggagtattcgtgaatggtccttatgcattgatcacaactgctgtttcggctgacctgggaacacatagctctttgaaaggcaattcacgagcgcttgcaactgtcactgctattattgatggaactggctcaattggagcggccattggaccacttctaaccggttacatttcaactaacagctggagtggtgtatttacaatgctaatgggatcagcttttatagctggtttgtttctgaccaggcttgttgtagctgaagtgggtgccaagattcaagaattagggtcccaaggatcatcacctacatcaaggtcccctgactttctagtgtgaaaataataattgtggtatattcttttattgctttttgtgaatccatttcgaagcctcgattcgaatgttagcctaggatcatagagatatatagagttggagatgcatttcttgtataaagtcaagaaatgaaagggtttctagtatccttgtgtacagtgtgggagtgagtttaaaaggtgggggatcactcccaatatcatgaaatagcatttccacgtatgtacattctcgtgtgccagaaaaggatcaaatacatcatttttagtatagtgggaacctgggttattgggcgttttgtatatcatctttttattattatgattattgaataaagccagtgcattctctc

SEQ ID NO: 43 - DNA, 796 bp, Solanum lycopersicum
ggaaaagctataaataactatccaatccttatctatcaaccatcaaaactgaaagcaagtaaacacagaaaattctcaatagctcactgaaaatgtcactgatcccaagaatcttcggcgaccgacgaagcaccagcgtgttcgatccattttcaattgacgtatttgatccattcaaggaattaggcttcacagtttcaaattcaggggagacctctgcatttgccaacactcgaatcgactggaaggaaactccagaagctcatgtgttcaaggctgatcttccagggcttaagaaggaggaagtcaaagtggagatcgaagaggatcgtgttcttcagatcagcggagagaggaacgtggagaaagaagacaagaacgatacttggcaccgtgtggaacgcagcagcgggaaattcatgagaagatttagacttccggagaatgcaaagatggatcaaattaaggcgtctatggagaatggagtgcttactgttactgttccgaaggaggaggtgaagaagcctgatgtcaagtccattgagatctctggttaaaatatgtgaatttattgtatccttgtatgggcaaataaaaaataatcgtatctgtagtgtttgaagtcgttctgtttctgtattaaagtcttcgaatcggctctgtttctcacctaatggcgtagttgatgtacttgctgtaaaatttcatgttgaaagatgtaatagtagtgttgtaatatcctctttttttcttagaacacttcataaaatgcaaatttgattcatcatctttgtca

SEQ ID NO: 44 - DNA, 1326 bp, Solanum lycopersicum
tggttctagaaaccgctgaaagcttcttcaaatcataataatcgaaattcaaaggaacacataaattttcaagtctacccaaacaaattgataagatcattcttctgagcatttgcatccctctttctgtgtgaaggaagaggcaaagaatggcagcatacaggtggaagagtttcaacgatgatggcgatcgtcctgagaaacctcgtcgctatggcgttacagaaatgaagggtcccaactattcccttttctcgagaggccttcttgaggatgttttagagtctatgggtcattttgttgatgggctaaaactatgtgatggatcccatactgtgatgccaaagaattacatcaaagaagtgactgatatggcacataaacacaatgtttatgttagctctggtgattcggcagatcaaatgcttttccgaggtccttcttctcttaaagaatatattgaggaatgtaagcaattggggtttgattcaattgagcttgatgttgcatcacttggtttacctgaggagaccctcttgagatatgtgaggctgattaagagcagtgggctcagggctaagcctcagttctctgttaagtttaataagtctgatatagccttcgccggtgacagagcttttggggcttacgtgattccagcacctcaaacctctgagatggttgaagatgtggatcttttggtcagaagggcagagagatgcttagaagctggggcagacatgataatgatcaatgctgatgatttatgtaggcaggctggtttactaagatcagatattgttgcgaagattgtgggtcgtcttggacttgagaaaactatgtttgaggcatcaaatcctaaaatctctgagtggtttgtcaaacgttatggtccaaaggttaatcttatcgtggaccactcacaagtaatggatctggaatgcctcagaggacgtaacctgggtcagaatcactcatctgtacttggcaggtcatattttttgctctgatcttgtgatgtccatagagaaaactgtgctcattgtagcgaacaacgtgtgtctgtaaaatgctttgctggtcatgttcagatcatgtttgaacttttaaatgaaaaaaaaggagagtacacttcagatatgtactcatgtactgtaatgattgcagtcttttcagggacttctttttttttttttgcttgaagttcagctgtttgtaaagatgttcttttatgttctagtgcctaaatggctgaaagttcaccaaatctttgaaagatttgaggatctgtgcttttgaatattatataatgtgtaccattttccc

SEQ ID NO: 45 - DNA, 1142 bp, Solanum lycopersicum
gaaccagagcttaacaccataaagatacccttctatcaactgtcaactactgccacagagatgatacatgaacattacatttccaatccacacacataaatatatcccaaatcaagaaatctcctcctcaatcttcctttttttttattttggtgcaagatttgcatgattgaagccgaattaataacatgtttgatacaggggaattttctccaagttcttcaacagctgctgtgtctgcagagtgttttagcagtagcagttgcttcagcagtctatcatcctcaaagaagaagaagattcatagtagtaacaacgcgaggaggttcagcgatgaacagattaaatcattagaaaccatgtttgaaacagagaccaaacttgaaccaagaaagaagcttcaactagccagagaactcggattgcaacctcgacaagtagcaatttggtttcaaaacaagagagctcgatggaaatcgaagcaactcgaaagggattacagtatacttaaatccaattatgacaatcttgcttctcaatacgaagctttaaagaaagaaaaacaatccttgcttattcagttacaaaagctgaaagaaatcgagtcagacaacagatgctctgtaattaagaaaaatgaaatggaagggatgccaagcttgtcttttgacttatcatctcaacatggaacaaatggtgttatgtcagatgatgacattgacagcagtataagagccgattatctcgggttagatgatgatgcaaagtatcatctactgaaaattgttgaaacaggggatagttctttaacttcccctgaaaattggggctgtttagacgacgatggtatcttaaaccatcagcctaatagttctagttatgatcagtggtgggatttctggtcttgaatcaaaatcgttgataaatatttaaaaatgatcagataccaaattgctagcggttcttgtacatttgatcgagcatgctggcaccctcctctgttatcactttcatcttagcaacttacagtgcctttgtctactggacaaactgtaatcttgtatactagtactagtccatggtggttttagtttgtatgccttgaaatatactatgagtaataataataattatcagaccag

SEQ ID NO: 46 - DNA, 1185 bp, Solanum lycopersicum
aaaaaagaaaaaacaaaatgaaattctgagtgttcctttttctttttccatctgtgcagtggtcatgacgagacgaaaatgccgccacgccccttatacagatgattctcgccgccgttttgcaccaccggaagcccaaccccaaccccaactccaactccaactccgtattcacccgtcagacttaattgatgatcgggaagttgctcagcaacgcgagattgaaaaattgctccaggaaaaccgcagtctagcgggcgcacacgtctctcttaaccaggagctctccgccatccagcacgagctccgtcttctctcttccacagccgcaaccgtcaagaccgaaagggatgctgaagtccgtgaggtttacgacgaggcacggaagaaggagtctgatgtttgtatactcgatgagcttagagtagatttggctcgggttaggagcgatattcagaacctagttgacgaccgtaaagagctcactgccaaattgcagaacatggaggaagatctcgtcaaagttggttccgagttacagcagtttcccgtaatcaaggccgaaatggagtccatgcataaggaagttcaacgaggaagggctgctatcgactatgaaaaaaagatgcacaccagcaaccttgaatatagtcaagcaatggagaaacataagattactctggcttctgaaattgagaaactacatgctgagcttgcaaatgcagagaagagggcaagggcagcagcagctgcagcggctccaagtaatttaaatcaccagatttctgcagcaactccgaattttacatattctgccaattatggaaatcctgaaacaggatatggagagaatctgtaccctgcgccttatgctgtacatcaggttcagggtagtgctgatgcaaatacccaatatgttggtggacatcactagttggttgtttgaaagtgtgctggatgacaagcatcgtacttagggatgttttacttcatgagaaaagtggtggtttttggaaacatttgtctcagaattcagataataactgtttctacatgtctctttgacctgggtttagtcgtttgaatttattagttgattggatagcattaactaactagataaaaatgtggctgtacatttatgaacttctagaggaataatgggcaggtaagacctcatcaagg

SEQ ID NO: 47 - DNA, 2314 bp, Solanum lycopersicum
acatttgccatttccagcctgcaaagcacatcaaccatagtatcatggattcacagtcgtcaccacatggctctattatcttctccaccgtcggcagaaccaattatggcttcgacatcttctccatcaaatctccattttcttttctcaattctccggtagaacatcgcctcacagacggtacctccatcaattacaacggacagtttgtcgatgaagatcaaacacttgtattcgtctcggagagatcaggtgctcctcgcatttacttgagacacccctcctctcaggtacagatggaacaacttcctactcccattgatagcctatttctcgaccgtccatttcttcgaaataaacaactctactatatttcagctcatcagcaacccaaacaagttttcaccagctcgtccgctctttactctaccaatatagaagataatagtaacatcatccgcttgactccgtacggctgtgttgattatagtccggcgatttcgcagtctggacacctgattgcggttgcatcgtacggagaccgtcgttggcctactggtgaattccatgatctgactactgatattgttgttttccctgaatctgacccagaaaagcggatagttgtgtgccaacacggtggctggccaacttggtctggtgattcgactatctattttcaccgacaagctgatgatggttggtggagcatttttagagtagatttgcttgaagattcactcaatctgcgtactgatccgattcgagttactcctcctggtgtgcattgctttactccagcggcctcacacagctccaaatcaatgattgctattgctaccagaagacaggggacgaagtatcgccacattgagattttcgatgtggagtctcacaagttctattcggtgaccgagttgcttaaccctaccactcaccattacagtccattcttctctcctaagtcgtcgtttctcagttatcaccggttccgaggtgaatcatcatcgggagatgcaacaattccttccttggccccgataatttctccagaaaaaggactgagaatgctgaggcttaatggatcatttccttccttctctccctcaggtgactttattgcgtttaatcatgatttcaatcctaattcaggcctcaaaatcatcaaatcagacggttccaagaagtggacattgttcagaggccgtacagctttctgcaactcctggtctccagccgaacccaatgtgatttttacgtcaatcggacctgtattcgactctgtaaaagcaactgtccaaatagcacgagtttcattcaattcattaaatctaactaacgatgattgcagagaaattccagtagaaataaaagttctcacaaaagaggagacgggaaataatgccttcccttcctgctcgccagacggaaagcacattgtattccgttcaggccgtgcagggcacaaaaatctgtatattatggattctgttaagggagagctggagggtggaggaattcgtcagctaacagaggggccatggattgatacaatgccaagctggtcacctgatggaaagctgattgcattttcttccaacaggcacaatccggataatgtcacttgcttcagcatttatgtgattcatccaaacggcacaggtcttcgtaggatccacgtggcagggccagagggatctgatgaagtagataaagagaggctaaaccacgtatgctttagtaaggactgtgaatggcttctgttcacgggcaacttgggtggagtaacagcagaaccagtgtcactgccaaaccaataccaaccctacggtgacttatatttggtgaagttggatgggagtgggttgagacaactgacatgtaatgcatatgagaatggaactccggcatggcacccatcaggtacgcctatgactgctttggacatagaacggaacgttatagtaggagataagttgaggggtgaatttgatgatgtactatggatgaattgttgaggtagaacaaaagtgtccagtcaagagaaagatcaatctgaacttcaaacaggtgctattgttgttctctcattgagttcagatatcatattattcgtacgggctgacgacagaagtatctcggcaaaatgatctggtcaaggattcttgtattctattttcgggtctcttacatgttaaaataaacatctctagagagatttgatgtaaattgttatgggataaacgcaattgatcctgcaattttgaaggatcaattgctttggcatgaagtaaaagaaagaaataatgttgtt

SEQ ID NO: 48 - DNA, 2675 bp, Solanum lycopersicum
tttctaacacatttctcagcaaaaatggggaaaaagcagcaaaaaaaggtccaaaatcaagaagaattgttgaaaacattgggagatttcacaagcaaagagaattgggacagctttttcactatcagaggttcagatgatgcttttgaatggtatgcagagtggtctcagctcaaagaaccacttctctctaatctcacaattccatcatcaaacgacgccgtttctgccaaagaactgcaaattcttgttccgggttgtggcaattcgaagctctctgagtatctttatgatgaggggttttgtaatattactaatgttgatttctctaaagttgttatttcggatatgttgagacgaaatattcgggctagacctgttatgaaatggcgtgtcatggacatgacgaatatgcagtttgcgaaggagagctttggtgccattctcgacaagggaggattggatgctttaatggagcctgagcttggatcaaagttagggactcagtatttgtctgaggttaagagattgctaaaagttggggggagatttatttgcctcactttggcagaatctcatgtattaggtttactcttcccaaagtttcggtatgggtggaagatggggattcatcccattgctctgaaaccatctgacaggtccagcctacagacttttatggtggtagccgagaaagaaaattctcctgcattgtgccaaatattgtcaactgttaatcagtcgtccttaggtggtccaaagaaccaggttcatggactctttcaagcacttgaagatgaaaataaaatacgtgcagattattccagtggttctgatatcacatatgcactagaagacttgaaaatcggagttgaggggaatctggcagagcttcatccaagtcgtagagttcagcttagtttaggtgaacctggggtttcccttttctgttacagagctgtgcttcttgatgcccaaaggaactttggaccttttgcatatcaatgtgctgtttttcttgtgccaaagactcgagctcatgagtggctgttctcttcagaagaaggacaatgggcagttgtagaaagctctaaggctgctcgtttaataatgattttgctggattctagccattcagacgccagtatggatgacattcagaaagatctctctcctctgataatgcaattggcgccaggagattttgacgatgaagctcagataccttttatggccgcaagtgatggaatcaaacagcgaaagattgttcaagagatcacatctcccttgactggtccaataattgtagatgatgtgatctatgagaaagttgatgaaaatattagccgtctctttgcatctgaggatgtgatatttcgtcgccttactttccaaagaacggagagtttagtgcaatctgaggctgtgctatcaaaagaaggatcaccgaagtctctagctgatattaatcagaagataggccagtcatcttcaaaatccaagaaaaaaggaaatcagaaaaaatctgggtctaatgtctcatcgtctgatggattgagcaaagatttgaaagttgaccacagttatttggccagttcatatcatactggaatcatctctggttttacattgatatcttctcatttggatggtttggcatctacgggaggcatggtgagatcagtagtaattggtcttggagcaggattgcttcccatgtttctacgtaagcacctgagttttgcagagattgaggttttggagttggatcctgtggttgtagatcttgctagagactattttgattttagagatgatgaacggttaaaggtacatgtgactgatggtttgaagtacgtcaaggatgcagctcatgcagttaccaatggttatgaaaatgatgtttctgaggcaaaggtcccttcttccaatggtaattccaccctgtctaatgcaccacttaaaagcacagaaaaaattgacatgctcattgttgatgtggattcttcagactcgagttctggtttaagttgccctgctgcagactttattgaagagtcttttcttatggcagcaaaagattctctttctgatcaaggtctatttgtcataaatttggtatcgaggtcacaagccatcaaggattccatttactccaaattgaagtcggtatttcctcacctcttccaccttcagctggacgaagatgtcaatgaggttattttcgctctcaagacagagacatgtatcacggaagataaatttcacaaggcttctcaacgacttacaagattattaaacctagagaactcctcatggggccaaaatataacagaagccactagcaagatcaaaaggttgagatgatttacgcattgatgaatgctatcgaatactgcagtctaggggcgaagctagaagcacaagtatgagttaattcagcctgaactataaacccttaaagttcaaattctagctccgcctccatccatgcctgctgaggctgccaataaatcaatgcacttctttttaagtacctcttcgtcgaaccactgattatcccccttcaagtttgatatttacatgccttgagatttataacatatagtattgaaattgctatgtacattggataaatttgatatgtttgtcaaagttatataatgagtttatat

SEQ ID NO: 49 - DNA, 1275 bp, Solanum lycopersicum
agctgtattttttgtctgtgttcttctctttaatacccatatcacaagtgttcaatttcattttctggactgaagaatttgagatttttttttctaattcttactgaaaacccatcatgggttcttcgttttctgtgttgattcctcagttttcatctactgttactcagcaaactcacccaagtcttggtgatttgccggaaagttgtgtagcttcagttcttgtatacatggacccgcctcagatctgtaaattatctatgcttaatagggcttttagaggcgcttcttctgctgattttgtgtgggagtcaaagttgcctatgaattacacctctattattcaaagggtctttgctggtcgaaattttccggctaatttgtgtaaaagagatatttatgctaagctttgtcgacctaattcttttgatggtggctcaaagaaagtttggttagataagaaaactggaagagtttgtatgtctatatcttcaagtggcttggtgataacgggcatcgatgataggagatattggagtcggattgaaactgatgaatcaagattcaagtctgttgcatatctccagcagatctggtggttcgaagttgatggagaggttgatttcccattccccgttgggtcctatagcatattcttcagactacaagtaggacgagcctcttggagatttggacgccgagtctgcaactccgagcatgttcatggttgggataggaaaccggtgcggtttcagctgtcgacatcagatggtcaacaagctacaactcaatgctacttgaacgaacctggaatatggaagtaccaccatgtaggtgacttcgttgctacgggttcagtagaacccatgaaagttaaatattcgttgactcagatagattgtacacatactaaaggtggactatgtgtagattctgtactgatatgtccagtagagtttacagagaggttgaagcagagtttttgatttgctgattacctgttgctgaggtaggctcgtttggtaggaggggtaaaggatatgactaatcccgagatttattttgttatgagtttattccatatttggttagggtaaaatcgcaggagataacgattatcgtggaataactcgtttctaaccaaacgagccctaggagttgtagttctagtgctatccatagtttttccgggtggttagtattaagggataatcatatattagactgaggcagtctgtgtaaatgtgaacaatgggaactttttatccattcatt

SEQ ID NO: 50 - DNA, 1518 bp, Solanum lycopersicum
cattttctctgtgtgcgcatttatctgtatacattattcggcatttgcaggtcggagaatctgatcggagcaagttgtgatcgacgatcggagttgaaaggcttgtagttgttaaattcatccataaggctaaatgggagacatagtgattgaacattcagggtcgccacattatgaggccttgaacttgcaaaatgttacaacatctgagaatgatgctgatctggttcggagttactgtgggggcttctttcctgagggtagtacacatgaagaaaaatccacttgcaccgaagccctcgacagaggattctttgaatatggatgttcccactatcgccgtagatgtcgcattagagccccatgctgcgatgagatgtttgactgcaggcattgtcataatgaatctaagaacaatatcaacattgaccagaaacttcgacatgagattcctcgtcacaaggtggaaaggattatatgctcactttgtaatacagagcaagaggttcggcaagtttgcatcaattgcggtgtgtgcatggggagatatttctgtgaaacgtgtaagctatttgatgatgatatatccaaaagacagtatcactgcagtggttgtgggatatgcaggattggtgggatggagaacttcttccactgtcccaaatgcagatgttgtcattctgttctattgaggaacagccacccctgtgtagagggggcaatgcatcatgactgtcctgtttgttttgagtatctctttgagtcgataaatgatgtaacagtcatgccttgtggacacactattcataagaactgtttgaaggagatgcaggaacactaccaatatgcttgtcctctctgctgtaagtcggtatgtgatatgtcaaaggtgtgggagaaatttgacatggaaattgctgcaacaccaatgcccgaaccttatcaagacaagaaggtttggatcctttgtaatgattgtggaatcacctcagaagtgcaatatcactttgtggcccagaaatgtccatgttgcaaatcttacaacacccgccaaacaagaggtggataaaaggaccaaatatcaatagccaatctggctttcaagtgaaaatgatcccacaccctatgtggctagggtggtacctctgagtgggaatgattgggctttacaagctaagcttgtagaagaaataacggaaagaaggggttctaatatgatcctgcttgtaacacttctgaggttatcgtgttttcgcgttttagtagtacgtgcgttttatatgccagtgcaattttcaagacactgattatttgttcagtgttagccctattattgttggcatgtgtgattcaatcctttatagcacaaagcgagttggactgtggcatgttaagtggctgagagacttgatgtgttgtgtgatatgtattttccagttaattactcacttgaagataaatttgtattattacttcatatttattaagtagtatatttctttaagaaaattatgacgt

SEQ ID NO: 51 - DNA, 650 bp, Solanum lycopersicum
atacaaaaaaaacagggtttaagccccaaatacagccaaaaccctacaaattttctctgcttcttcttcttcttcttcctcaacaatggcgcctatgagtggaaagccctttgctttgaccggatcaagcagcaagaatgacggcgttttagctaggatttctcaatccaccattgttacgaaggggaaacaagcagcttgtgatgcgacttatgtggggaaaaagcttgcgaagagtactggaaaagctgcttggcttgttgctacaacgtttttggttctgggtttgccgttgattattgttatggatcgtgaacagcagctgaatgatcttgatcttcaacaagcaagtcttcttggtgcttcccctgctactacacagaattgattttgttagtgggtttgagaaatttgtagaatgggttgggaaagctgcagtttattagttaaaaaaagaagatcttgatcttcaatagaaattatttttcgttatgtttgtgtttttttgttagtgttttgatgatggatttcgagattggatcgatgaaatttgtagaatgtgttggttgttttattagatgtttgggaagctgcagtgtttattagtggaaaaaatttgatcttgatcttcaatggaattgatttcactt

SEQ ID NO: 52 - DNA, 1418 bp, Solanum lycopersicum
ccagaggcaaaatttcatgtgaaacctaaatatccatagccctccgatctgaagcctctgatatccttccatgggtctaatgtaatccgaaggcataactcaactagtatgtggatggacagtacattgcctccggtctatttgatggtccgttactcaaacactccgattgtttcaatcgggttgatttgattatcattttcattcagtttttgaagtttttatcaaatgtgacattgagttctgcttggttgaacgttttggcagttataattctcctaccattaagttcaattttaagtccacaatatgtagagtgtcctcttccttttatggagttatggtctaatagccaaagaggaaaaagaacatcaagaaggaaaagctctatgtggtattgaggattctcatcaaattaaaatggatactctctcctaatagaaaagttaacgaacaattaatcatgagggaacttcatggcatttgtagcctaacttgaataagtttcttggattggcttgacctaaatagaaggaagctcgagctacattgcaaaagcttttatcagcttgtgatgaagaaaattgaggatccaacatcccgtcaacagttctattcaaagcgcaaggataccatccttaagaagtccaatgagttggctgttttatgtgatgtggatgttggtcttctaatgttttctccagccggcgaagtgactagctattctagcaaagaacgtcttgaggatgtcatgctccttgctatgaacaaggctggtgaactgaacaagctatctcctgaaaatccaaatgaacaggctttgatggactctctcacacaatcaaaacatgaagccgaaatggtggagaagatagcgattgttgaggctcatgaggagaagcttaatggggtcaaagaaagactaagtgaagcacaacagaaaataaggtattacgaaccacaagtggagagtatcaactctgtccaagaagctgatgcatatgagaagttcattttgagtgctctggaactgattcaactatcaaaggcaaaactcttgggtgaccaggaatttctccagagaaatgaaaatgttgcggtgtcttctgtcaacgcagaggctatggctgctgaaggaaccagtgggggatggatgtattgaggaaacaggccggatcacggcggggaagtagctgaggatgtccaacagctatagcaggaataatagttatactagtttataggttaagaacttagtagaataaataacttgcccctatcaggcaagcaaaagtatgaataatgttgcatttgtctattgtgaatgcaactatttgaatatggcatctgaatatggcatcaaaacatagctattgtgttttgaaatagaaaacaatttggtttgggttgatttggtt

SEQ ID NO: 53 - DNA, 1385 bp, Solanum lycopersicum
actagtgttcaaatgttgtcttttacgataaccttttagtggaaaggcggccgcgtgtcgcccaaaagatatactctatactactgccgtctaccgatttcaccgctatatattcatttcctatacaatctgttttcgcaggttttgttccaatttcaaggtgttgttgcttccccaattcacagagaattgaaattggtgaatttgatatggctgggaagattatgcatgctgttcagtacgactcttatggcggtggagccgctgccttgaagcatgtggaagttcctgtcccaactccgaagaaggatgaggtcttgctaaaactcgaggctgcaagcataaatcctgttgactggaaaattcagaagggcgtgcttcgtccccttcttcctaccaagtttccttttattcctactaccgacgtgggaggagaggttgtagaggtaggatctaatgtaaaaagcttcaaggctggtgacaaggttgtggctatgctcaataccctgaatggaggtggattggctgaatatgcggtggctaatgagagtttgactgttccaagacccgctgaagtatcagctgcagaaggtgcaggtcttgttattgcaggtcttacagctcttcaggcccttgtcaatcctgctgaggttaagctcgatggaactggaccccggaagaacattctagttacggctgcttcgggtggtgtcggtcactatgctgttcaactggcaaaacttggaaacacccatgttactgccacctgtggagcgcgcaatatagattttgtgaagagcttaggagctgatgaggttcttgattacaagaccccagagggagcagctcttaagagtccgtcagggcaaaagtatgatgcagtgattcactgcacgacaggcatcccttggtctacctttgagcctaatttaagttcgagtggaaaggtggtcgatataactccaggagttagtgccatgtggacctttgcagtaaagaaattaaccttctcaaagaaacagttggtgccactgcttctgattccgaagaaggagaacctggaattgattgttgggcttgtgaaggaagggaaacttaaaaccgtggtcgactccagatttcctctgagcaaggcagaagatgcttggagcaagagtattgatggacatgctaccggaaagattgttgtggagccatagagtactggtctaaaaaggcttgtgtgcagtttgtcatctggctaggaaaccaaaaagttaaaagttaaattacaatttacccttgttataaattaaaatcttataaaaatatttaactatttaatttgaatattaaattacattattttaataaaaatgctaatgacttttgcgcttctttaaaga

SEQ ID NO: 54 - DNA, 886 bp, Solanum lycopersicum
cctttttcataaattttcacatagtcctttttgatttaataaactctaactttgaactctctgaggagtccattgtaaggtcaatctccaatattcccccaaaatggatgggagcaattattacttgatgaataggagccacattccagcatttggtagctgggactgtaacaatgattttccaattcctttcactcagtgctttgaatctgctaaaaaagttgggttgctcagatacagctactctgatgaccgtgatttgtatgtcgccggagatctataccagaatgatatcctcactccggccatgatcgtcgttcctcgtcgtaagagaaaatcaagtattagtgatggagttggaaaagcaagaaaggagaggtgggtggtgtgcaattgtgaatatgaatatgatgaagagaaaaaggacataactattgttccacctccacctccacctataagagcatccaaagcagtagatgaagatctctacaagatttcccctcaattgctccactataagcctacaaggaaaggtgttaggagattcttttcgagctgcttgctgccaacttgtgcttcttgatcctcaaataacacaagattgtcaacattatataggactagtagtatcgtattaatagttgctatgtgtctaatattaatttagtgtttggagtattttcttggggttttagcactaaattggcttataaactcagagattatgccagcccaagaaaacaattatcaatcattagcttaggatggtcaaaattaagagaattccttctctattctattgctagtatgtttccctttggaagtatttttcgtctcaattgctctgctagctaatgcacttctgttttgcttcctgggaacc

SEQ ID NO: 55 - DNA, 2526 bp, Triticum aestivum
ggcgtcctcgctcccaaccgagaaaacctcgccgtttctccaaccacttctaaacccctgctctcgtagctagggtttgagtctgctgctcgcgcagccacgccatggctaccacgccggcgctccacgacgcgctgctcgactttacttcgcgggagaactgggacaagttctttgccctccgcggcgatggcgacagcttcgagtggtacgcggagtggccgcaaatcaaggccccgctcctgtcgctcctccttggggaagaggggacggagatccttgtcccggggtgcgggagctcgtcgctctcggagcagctgtacgacctggggttccgccgcatcaccaacgtcgacttctcccgtgtcatcgtggccgacatgctccgccggcacgcccgtgtgcgccctcagatgcgttggcgcgtcatggacatgaccaacatgcagtttccagatggttcgtttgatttcatacttgataagggaggattggatgctcttatggagccggaggttggcacaaaactggggatgaaatatctagacgaggccaagagggttttgaagtcaggcgggaaatttgcgtgctttactctagcagaatcccatgttttagacctacttttgtctgagttcaggtttggatgggatatgactattcaagctatagctagtgaaccctctagcaagtctgccttccagaccttcatggtggtcatggtaaaagggaagatgggtgttgtacacacaataaaatcactagtggaccagcctgctgaatactgtaacatgcaacaggcaaatgcagtaattcatgctctgcaaaacgagaacaaaatccgggagtcacacaattctggtgttgatatacttttctcgttgcgagatcttcagctgggcactattggagatctaaaggttattgtcccaggacgaaggaggcagttaattctcggtgaacaaggaagctcattgtattgctacaaagctgttttaatggatgccaagaatcaaaacgagacatttgtataccactgtggagtttttattgtgcctaaggcacgagctcaggaatggttatttgcttcagaggaagggcagtggcttgttgttgaaagtgcaaaggctgctcgtctaatcatggtattcctcgatagcagacatgcaagtgctgacattgatgttgttaagaaggatttatctcctcttgttatggatctagaacctgaatatcctgaagagacagaccctatgccattcatgatggctagtgatggcgtgaaacaaagagatattctgcaggaggtaacatcagaaataacaggtcctatggttgtggaagatgttctttatgaaaatgttgatggagaccaaagctgcatgtctgaaaaaatgttccggcgacttatttttaaaagaagttctggcttagtgcaatctgaagcattgttaatgagagaatcaccaagtgacgagacggacagtaagaccaagaactcatctgcatcatcaaaaaagaagagccagaaaaagggactcactggatccaaggacagtctcagggtcgaccatagctatcttggtagctcttatcacagtagtatcatatgtgggctttctttagttgcatctgctctgagtgctgcggcatcatctggagaaagggtcagtaccactattgtaggccttggggccgggagtttaccaatgtttcttcgtggatgcctccctcatcttaatattgaggttgttgagttggaccccatgatggaggaggtagcggcgaaatattttggcttttcaatggatgagcaattgaaggtgcatttgggggacggaatcaaattcattgaagaaaatgcccattctgaaccaaatggcaaagacagtgatgcagttagaattcttattgttgatgttgattcatctgatctaagttctgggttgtcttgccccccagcaaactttgtcgaagatgctttccttatgtcagcaaaaaggttcctttcagctgggggccttctcatcatcaatctagtcgcgcgatcatctgcagtcaaggaaatggtcatttcacgattgaaagcggtctttgaaaacctatactcactgcaacttgaagaagacgtgaacgaagttctgtttgcgtccccaagcaaaagatacctggaaatcgatcaccttgatgaggctgcaactaaactgaaggctatgctgaaattcccggtggatgtggaatcagatatgaagaatttgcagaggctgcagtagtataggcatctgtgcttgtgaggcaccatccattactcccggcactcagatatgaagaatctgcagaggatgcagtagccggtaggtgtaggcttctgtattgcagataatgcagtatatgtggaatctagcttttccaagcatgatgaatttaattttctcttcttcattatataccccaaaggtgtcctcccttaatttgggatgaaaaaagtgctcggatcttccgtgatgtttcagccatagtgaccaa

SEQ ID NO: 56 - DNA, 1495 bp, Triticum aestivum
gtgtacgtgcgacccacgcgtccgctgcctcagcaccagcctaacccggcagacgccaagatcaagcaaccgagcgcataaagcaagctcaggagccagaaccttcttcgatcgatcagcgacagtcgggcggaacaagaatcagttcgatccggccggtgcaagaacttgctgggaccgggacaggcgtgggccgacgacgacgacgccgggggttttccgctttccgacggcaagcgaggtggcagtggcaccggagggatgggcctttcggcggtgaggcgtaacacgccgctcttctccaagtcgccggcgtccctgctgctgctctccaagctgctcaccctctactgttgagctcccggcgggcggctgtttccttctcggtcgagtgagtcatccatccatgggcgccgtggggtcgtccgcgaggcggggcgggggcaccgcgctgggggacctgccggagaactgcgtcgccgaggtgatgctcaggctgaacccgacggagatctgcgggatggcgcggctcagccgcaccttccgcggcgccgcgtccggggacgccgtctgggaggccaagctgccgcgcaactacgcgcgcctcctcgccgccgccggcggagacgaggaggccgccgcgttggaggcggaggccatcccgaagaaggagctgtacgcgcggctctgccgccgcaactccctcgacggcggaaccaaggagttctggctcgacaaggctggtggaggcacctgcatgacaatctattcgagggcgctttcgatcaccggcattgatgacaggagatactggaacttcattccaaatggtgaatcaaggttccgttcggttgcttatctctggcaaatctggtggtttgaagtcagaggggaggttgagttctgcttcccagaaggtacatacagcctgttcttccgtattcatcttggcaggcctttcaagcgggtcggttcccgggtttacagttccgagcacatccatgggtgggacgtaaagccggtgcgcttccagctatggacttcggacgggcatcaggcccagtccaagtgttacctaactgatccaggcgtctggatctatcatcatgtcggcgatttcctcgtgaaggactcgaacgagccactgaatatccaatttgcaatggttcagatagactgcacacacacaaaaggaggcctgtgtatggattcagtggttataaaacccaaatgccttgcgcggaaaaagggacctggccgttatgagtagatttagtgagcagattaaacctgatatctatagaaacaatatggttttgcttacttcctccgtcgtgtgctttcgcctgtcgatgtttgttcaatcctgtaatgtaaatgtaattggaggggtgagtgatcttttatttcctcttgtccctatataggagcatcaagcatgtcaccccttgtaaattgtgccctccctgacagatataaattttcgcctggggta

SEQ ID NO: 57 - DNA, 1576 bp, Triticum aestivum
gataacaacacggcaagcagaactgctgaagcagatcgcttgcatacaatgctccttgcaatggctgatgcacgggctgttctaataaagttagcagatcgtgtgcataacatgaggaccttagaagccttgcctttggtcaaacaacaaagatttgctaaggagaccatggagatctttgtgcctttggccaatcgattggggattgctagctggaaagaccagctcgaaaatctttgcttcaagcacttgaaccccgaagagcacacgaagctgtcatcaaaattcgcagaaacctttgatgaggcgctaatcacatctgctgtggatacactggatgaaggtctgagggaagcaggcatctcatatcacaatctatctggaaggaacaaaaacctttacagtgtttactccaagatgcagaagaagaatttgacaatggatgaagtccatgatatccatggcctgcgccttgtggttgacaaggaggaagattgctaccgagcactcgatgttgtccataaactctggccccaagtcaccggaagattcaaggactacatatcgcggccgaaattaaatgggtaccgttcattgcacactgttgtcatgagcgacggtgatcacacattcgaagtccagatccgcacaaaggagatgcatctacaggccgagtatgggttcgctgcgcactggaggtacaaggaaggctcgtgcaggcactccttcgtgcttcagatggtggaatgggcgagatgggtgcttacgtggcaatgtgaagcattgaacaaggaacattcatcgtcccaagtgaaaagcgattccatcaaacctccttgcccgtttcccctgcattcggaggaatgcccttactcgtacacccgccaatgcaaccacgacggacccttgttcgtcatcttactcgaacatgataagatgtctgtccaagaattcccagcaggctcgaccgtaatggacctgatgcaccgcgttggagccaacagcccgaggtggagcccctacagcataccgatgaaggaggacctgcggccgaaggtgaaccacgagcccataagcgacctgggaagggcgctgagcatgggggacgtggtggagctgaccccggccctccccgacaagtcgctgaccgagtaccgggaggagatccagcgcatgtatgaccgcggtggtttcgcccttgccgccacccgcagcggcagcggtggctcaagacgccgatgaccccgcggcgcttaccgcagtgttaacaaacaacctgttgtacgatgatgttcgagtccaacccattcaattcgttgtaaatacatacagactacatagtctaattcttggcggccatgatgaggcgctgtaggatcacccccggatgcaaggggagagtccaccagccttggctgcaaaatgtgtacactagcagagcagaaccatgtatactatgacaagagtcgttcaagttcgattcggcttctgcttgccaggatctgtggagaggagcaacttgagctgtttgtattattgcgatgaaaagatcctgtgatggaaaaaaaaaaaaaaa

SEQ ID NO: 58 - DNA, 550 bp, Oryza sativa
ctcgatgaactctacaagtcattttgtcgccatcagcttctttcatcaccaactcgatcagaccgcagagacgagggaagatgagctcgtcggcgaagacgtcgtggccggaggtggttgggctgagcatagaggaggccaagaaggtgattctcaaggacaagcccgacgccgacatcgtcgtgctgccattcggcacggcggtgccagaggattttcgcttcaaccgtgtccgaatcttcgtcgacaccgtcgccgagacgcctcgtgtgggctagctagcagaatatatatagctttaaattaaaattaataatggttagtagcgatgctgctgtgccccgaccgtatcctttctctaaaattgatatcatatatatgtattatatgtgtgtaaatcatcaatcctgggatgaaaaagatgaatcagctgtcaggaccactgcatggtcttcttgtactcctctcaaacttgttcttgcaacccgtctaaaaaacgaatttctaaaaaatgaatacggacatagcatatatccacactagtacagaa

SEQ ID NO: 59 - DNA, 780 bp, Oryza sativa
gctgctgctgcgagacgtgtcggcaaccatggtggtctcctgccagctcaagcctgcgccggctccggccgccgccagcagaggcggcggcgcgcctcacctccagcagctgcgccgggcgtgcgtcgcggcggcggcggcgtgcgcggtgctcgggacggcgggcggccccggcgaaggcgccgtgatggcgcgtgcgccggaggcgacggcggcggcggcggcggggccggcgcggtggagcgaccgccggcagtgcccgccgtggcgcgccaactcgctggagaacatcgtgccggagaacctgccgcggccgtcggctcgccggaggttcaacagcatcacggcggcggcggcggcggagagcgcgccgccccccgcgtcggcgtcgcccgacgccgtgctcccgttcttggcgccgcgctccggcatgggctgcttctccctctaaacgcgacatacgaatggtacgtgacacgatcgagcatggcatttgtaaaggggaagattaattagatacccccaaattagtttagcaaaattagcatagccttgtactatacgactactacggccttgtcatttgtcgaggaagatggtagtattggactattggttatttataggttctagaagaaataaatgttcttcccacttattagtagccgggaaatgaaaaatagatatggttctatttgtgatatgttccatgtatcttaattctttgcttgcaaataagcaaatcctgcagctgatcaatataactcgcttatttggcct

SEQ ID NO: 60 - DNA, 1199 bp, Sorghum bicolor
aaatcgacccggatccgagccaggcacccgcacgatcccaccgcctcctgccgatcaccgggacctagcatcgccgcggcggcggcgggagaggggaaggaaggcgatgaggaaacgggagcgggagaacccgtgcgggatctgcggtcactaccacaagtacgaagagggggaggtctgcggggtgtgcggccaccgcttgaagccatcggatggggagggcgccccgtcgagccatgagtccgccttccccacagaggtgctgaaggagttcctcttcctcgggagctacgacaacgcctcacgctccgaggtcctcaggacgctcagtatctcgcacatccttaacactgtgcctgattgccacaatctttacaagaattcattcacgtatcacagtcttcaacgggacaggcctttggattttgacgaggcaaaccagtatctagagaaatgtgaaagagataaatcgcgtgttcttgttcattgcatgactggaaaaaacaggtctgctgctattgtcgcagccttcttgatgaagtctagaggatggagacttgcacagtcttttcaatgggtgaaagaccgaagaccgcaggttcaactgacagatgcttctcagaatgagcttttggagtatgagctgaagctttttggacccagtgctcaacccttggttcccactgaatcatttgcttctcttggatttggttatgaaaaaccagcaggtgacatccaagcacctatgttcaaccaaatgaccatgccatccatatttgagcgagtcaacccaaatgatcaccccaccaatttcacttttggagctgagaggatagcggaagttaaccctcacgataacaatagtgatggtggggtaaacccaactaaaacagagaacctgatggacggctcttaagatggtttcatgatgtcactgttcaatctccatgttgcagtgtactccttgctgcggaagtaaacccaactgctcagtgcaccgaatacatcggctgtctaggtttcagggaggttttgccctttgtcacttgagaaatggttctttggcaaccgaccttttctttagaatgactatgaaattagtctcaacttgtagtaatagatgtttgtggctcatatctctgttccctgcaaagctgctggaggttcttgcccatattcctaatcctatatttccggtt

SEQ ID NO: 61 - DNA, 1107 bp, Sorghum bicolor
ctgctgctcttgctgtcctctgtgctatccgctagggtttatctgctcgaggaatggcgtcgctgcaggtctccggcgcgggggttggcgccgcggccttcgctgcgaaggggaaggcctccatcggtgcgctccggcttccatctacggtgaccgtcggcgaggtctgcccggcccggcgggcgttccgcggcctcgtcgtcagggccgccaccgtcgtcgctcccaagtatacaacacttaagcctttggccgatagagtgcttgtaaagattaactcttccgaggagaagacaactggtggaattttgctccctacaactgctcagtccaaacctcagggtggtgaggtagttgctgttggagaaggaaggataattggggataagaaagttgatgtcagcattcaggttggagctcaagttgtatattcaaagtatgctggaaccgaggttgagttgaatgactacaaccatctggttctcaaagaggatgacattataggtatcttagaaactgatgacgtgaaagacatgaagcctcttaatgaccgtgtactaatcaaggttgctgaagctgaagtcaaaactccaggcggtctattgcttactgaaactagcaaggagaagccatctatcggaacggtcgtagcggttggcccgggccccctggacgaggaaggcaagaggagcccgctgtctgtgtccgcggggagcactgtcctgtactccaagtacgccggcagcgagttcaagggcgctgatggcacgaactacatcgtgctgagggtgtcggatctgatggccgtcctctcctgagctgggctggaggatagaggcgcaggagcaggatgccatgccattgccagtgccagccagccagtggtaccacaaccacaactcccagttgctgcatcggcgcatcgccattttttgtgggaatgggggttccctggcggcctaccagtactgtaggtttcctcgcggctttccgtttttttttttcttcttcttggtcgtcttgtctgactgccctccgaggaacaacaataagcgagcattcagaaattcggtcgcacgatgaaagggcttcactttgtactctgtc

SEQ ID NO: 62 - DNA, 1371 bp, Sorghum bicolor
agaatttcacgcctcgaacaagcagaggcccagccagccatctgcaaggtacaagtagcccgcccctggcacgcacgcacacagagagaattcagccgccgccgacgacgacggacatggcgcgctgggccattgccatccacggcggcgcgggcgtggacccgaacctgccgcagcacagccaggaggaggcgaagcgcgtgctggcgcggtgcctgcaggtgggcgtggacctgctgcgcgcgggcgcgcaggcgctggacgtcgtggaggccgtggtccgcgagctcgagaccgaccctttcttcaactcgggccgcggctccgcgctcacccgcgccggcaccgtcgagatggaggccagcatcatggacggccgcggccgccgctgcggcgccgtctccggcgtctccaccgtcaagaaccccgtctccctcgcgcgccgcgtcatggacaagtcgccgcactcgtacctcgccttccacggcgccgaggagttcgcccgtgagcagggcctggagaccgtggacaatagctacttcatcaccgaggacaacgtcggcatgctcaagctcgccaaggaggccggcaccatcctgtttgactaccgtatcccactgacgggagcggacacgtgcagcgcgctggcggcggccgcggtggacagcggcaaccaccaccacaaggctggcatggtgatgaacgggctgcccatcagcgtgtacgcgccggagacggtgggttgcgcggtggtggacgcgtcgggcgcctgcgcggcggccacgtccacgggcgggctcatgaacaagatgaccggccgcatcggcgactcgccgctgatcgggtcgggcacctacgcgtgcggcgcgtgcgccgtgtcgtgcacgggcgagggcgaggccatcatccgctgcacgctcgcgcgcgacgtcgccgccgtcatggagtacaagggcctgcccctgcagcaggccgtcgactactgcgtcaaggagcgcctcgacgaaggcttcgcggggctcatcgccgtgtccagcaccggcgaggtggcttatgggtttaactgtaccggcatgttccggggatgtgccaccgaggatggattcatggaggtcggcatctgggagtgagtgagccagcgagtcctcggaggtggagacgtgtgctgcatgtggcaatcctgcgattgccatgtgcataatctctgtttctggtacttggtagtattgctattgggttgtcagtagtagtggtcacaagtgttgtccactgatcactagtggtagcgattggagattggacctgaggttaataaggatggtgattgtgtgggaatgccctgaataataattaataattagtgtgaaaagt

SEQ ID NO: 63 - DNA, 788 bp, Sorghum bicolor
ctcgcccgccgcccgccgcctgccgagcacgaatccagaagctcttgggactcgaacgagcatggcggtctcctccatcagctgctcccttcggcctccagctcccgtcagagaagcttccgctcgtctgacgccgccgcagccgtcgccaccaaagacgacggccacgccgtgggcggacgggctgcggcgggcatgcgtggcggcggcggcaaccgcggcgtgcgtcgtgatcgggacggcgggaggtggcgacgtggtggcggcgtcgatgccacgcgacacccccgttctggctgtggacgcgcggccggcggcggcggcgccgcggtggagcgaccgcagggagtgcccgccgtggcgcgctaactcgctggagaacatcgtgccggagaacctgccccgcccgtcggcgcgccggaggttcaacacagtcaagcgagcgccgcggaaggcccccgcgctcgggcgtcaagcggtggcgccgccgttcctggcgctgcgctccggcgtggacgactgcttcaccctctaggcaaggcaagttaggcaggtagtactagctgaccattctccagctgaatttgttgtacttatttgttttggaatattgtacccaagaagttcgaagtgaacggaaacagtaggatattttttttttgtattccggattttacaggagatgatttgtttgtgttattgtttagttccaaaaaattttgcaaaatataaatagtatcactttcgtttgtatttgacaaatattatccaatcatgtactaaataga

SEQ ID NO: 64 - DNA, 1736 bp, Sorghum bicolor
gccaagatctccctctctgatctgaccagggccgggccaccgctgccatttgcgtctgctcctcgcaaacccctgtctcgctttgcacttcgtttcgccaactataaagccgggggtcctctggtgtgtgacctttttataccgatgtgcagtgcagcgtcaacttcgtcaggtttcttggctccaacaaccttcgttcctgggtcactctaaactgtaaagatggggtgtggtccatcaatccccgagaagtacagcatacgagggaagagtggcaagcgccggagcatcatacaggaggttgctgtgttcgtgcccaccatccgcataccgttggcttctgacatagctcatccgctcaggggaatagtttccaaggatctcgtcgatcgcctctccacactccgtgctcatgtcgtcgcgctggctgaagaaatctattctgcggacgtatcagctgttcaagaactgcaacatgcgttagaggagtacttgccagttgttcttggtttaacaatgaaagagagccgtcttgaatcgtcagtacaattcacctggaagaccttagacgatgaccaggagtgttgtttggcgagtgcatggtacgaggtgctctcagtggtccacatgatggccatgcttgcattgtttgaggccaatctattactcattccaaagaacagtcaagttggtggtgaaaggaaggtatcagaagatgcaaagaaggatgttgtcgattcattgctcagggcatcgggatgcttagactatttggtgcatcgcatacttgttcaaatacctgcacaatgtgtggaaatacagcttggcctggcttctgaatgtgaaaaggcaacattgtcagtaaagaggaggctagcctgtgagcaagtcagttatttttctcaggctcactattgtctgtcgggatgcgatacaagtgactcatatggaaagaagcttctgctgttcctgaagtggaaatgcatggaggctaaggctgtagcatattactaccatggtctcgtactcgacaagggcggtgaaccggccaaccatatcagtgcagtctgctgcctctctgcagctgacgacctactttcagacagcaaaagggcttgcttgagtttctgcttggcaaatcctgtcacaagggtacctcctccttggggtgtcatgaaaaacatgcacaaaaaaatcccagatgttgcttacaagaagtttcaagtgtatgggcatctgtttgagcaaaataagaatagcacacttcaatcagttcctgatctaccagagtttgcgctgtcactgagaccggaaggatacgaattgccaaccactgattcaatctgggagaatgttaatggccaacctcagattcagagcctcaaggagcatctggacgatggcgaagatgaagtagatacaaaatgatagttctcacttccaaatgcttcctttcattgtaccaccaaaagtagcagaagttatactgtagacttcaaaatgcttaatccaaaatgttttggattcagcatatgccacaactgcatctgtataattgcaagcattaccatgtgatatagtaaagtcttgatgtgtaatagaatcataaataataggaaataatagttggtttcttactgtaattgcctgagttttattttcccaactggaagaacagagcacacagataaaaaacttatggcacacatttcaataaaacaataataattgttcat

SEQ ID NO: 65 - DNA, 2268 bp, Sorghum bicolor
actttcgttttcggctcctatacccggacacccgcactgccgcacccgcagccctccgcgcccagagagagcggagcgcctctgccaccgggggcggcggccatccaaccccacagcagctaggcgccacggcagctgtcgtgcccagccgccttctgcgcctcccctacctcagccaaaccctatcctcccgcccggaaaacagtattggacgatgttgattagagcggatggtggtcatgccacaagaaggtcgaagaagaataaaataacttgcaatgacgatagagacacaacagagccattgatttcaggtgatattcatcaggactcagaacaaggtatctggagtgagctcagtgaagaagttgcattgaatttgcctggaagtgttgtctcagttgctgtgctgtgtggaagttctgtgttatttgcatgctcgggaatagctataggatgccaggggtgtgtcacaaggattctgacttcagcaagtttggttagagcattaaatgataaaacaaaacaccctgctaacttgaaggttgaagtgcgctatggaggcaatgttgtcacaggatttttaggaaaatatgatttagattatggcattgctattgtcaatgtcacagcctgccttgatgttcaagctatacgtctcacccatgtggtggagatggaatttcgtccatctacaaaggtagtagctttagggcgtgacctctctggcaaattaatgactactggtgggatactgacccgcgattcaagagaatctgaagatagtgaagagcttatgctatccacttgtaaaatctgtgagggttgggaaggcggaccacttttcaatgtagaagggaatcttgttggcatgaaccttttttttgttaaagaaagaactgtgttcctgccaacaagtataatctttgaacggttggagcatttccgagtattctttaggaggggtgaatttcttgaacggttacggaacttgaaggcatgcagtactggtgagacactggtacctgagaacagtggtgctgatctaacaagatgctcaaaggagaaaagaactgatgatctcacaagcttggatattaagactgatctcacaagaagctcaaagaagaaaagaacttgcagtggtggaggaaagacaacgaagtcattgatttctggaaatagtgatgttcttagtgatgatccatttgaggatctagacatctcaggttatccaaagccaccaatagaaatgtctgatggcatggttttagttaatacttttgaagatacttttggcgataaatatggtggaggtgtttggagtgaacttagcgaaacagtttgttcaaacatatctcgaaacgttgttgcacttgcttcatgctatgggaaaagaaggatttttgcatgcactggtttttttgttgaatggaatggatgtacaactattctgacgtcagctagcttactgtcagattttgttgatgacgagaagattcttgaagacttgaggattaaagtgttgcttccaaccaaacatatcagagaagggacattactgcattataatatacattacaatgttgctctagtcagtgtcaaggatttctgttctccacatccgatggatattgaacatcagaggcatagtcgtcctcgtcaattagtatctgtagggcgctgcatagaatcaggcacactaatggctgcaagagggatacatttgaacaggtttgggagactggattgcaagttgctacagtactccacatgtaaaatcaccaaggctgggattggagggcctgtcgttgatcttgatgggaaatttattggcatgaacttctatgacatgcaaagaactagacctccatacctttcatgggatgtgattcttgatgtcttggcacattttaagacaaagcggtctgttcctgaagtaggccatgctagttattatcaatttgctgtcctgtttaactggactattgatggagataagagtgtgcgtccaaacagttggcctgtgcccaaggcattttggtgccctgctgagtatgttgacatggtgggtcaatcgtgtgttcaaaagcgaggcaaacgcagccgccccagaattagagttattaatggaagggagtaccgatatgcgtagagcatttctatttccttctttgttctgtatatattcgtgttaatgaacctgtttgagctggtttctgaatcaaagatcatttttatataatatattagagtttgttcacgtgt

SEQ ID NO: 66 - DNA, 1865 bp, Sorghum bicolor
cgctaacctccatcgccaaccgggccgtccaagcggcctgtcgccgtaacgcagcgattcccacacacccgtacgttggcagttgcactccggacaccatcaaaacaggcgcccatatcgtctctctcgcgcgccccgctcgatctcccacgcaaacgcacgcaaccctcaggcctcagctcgccaccacacacacagaacgcgtgtgctcctgccttcctgatcgagcaacgagctagctacctagcttgaggacgacacgacacgatggccttgcaggtcaccggcggagtgggctgctgctgccctcgtcctcaaccgggctgtggcggccggcggttggcgcaggcggcggcggcgctctgtcgcccgccccgcgctgtagcgtcgtccggcacgaccacgacggtggtggaggaggacgagggcaaggtgaggctgggcggctcaagcgtcgccgtcaccaagctcggcatcggcgcgtggtcctggggcgacaccacctactggaacgactccgagtgggacgataggagactgagggaggcacaggacgcgttcgatgcgagcatcgataacgggatgaccttcttcgataccgcagaagtatacggtacagcgctcatgggagcagtcaattctgaaagtttactgggaggattcatcaaggaaaggcaacagaaggaccagatcgaggtggccgtcgcaacaaagttcgctgcccttccttggagatttggaaggggtagtgttctttccgcgctgaagaaatcactagaccgtcttggcctatcgtcggttgagctctaccaactccactggccagggatttgggggaacgaaggataccttgatggtctcgcagatgcttatgagcaaggcctagtaaaggctgttggagtctcaaactacaatgagaagcgccttcgggatgcgcatgctcgtctcaagaagaggggtgttccacttgctgcaaatcaggtgaattacagcctcatatacagaaccccggagctgaatggtgtgaaggcagcttgtgatgagctcggtatcaccttgattgcttattcaccgatagcccaaggtgttctgacaggtaagtacactccagaaaagccccctactggtcctcgagcaaatacatacacccctgagttcctcaccaagctccaaccacttatgaacaggattaaagagattggagcaagctatggcaagagtccaacccaggtgtctctgaactggctgacctgccaggggaatgtggtgccaatccccggagccaagaatgccagccaggccaaggagttcgctggtgcactcggttggagcctgacaggagacgaggtcgaagagctacgaactctggcacgcgagatcaagggcatcaagatgcctatcgaggagtcgtagatactccgtatttcaccaaccccatgcatggtatagcactgattagagattataaggttttaaagcgagaagaagaaaacacacggatctaaaaaggaaccaagatgtgtaagtactaagtagaaaatgcagctttcaacgaatctcatgcctatcagcctatgcactataactctgctgcctgttctccgctttacaaatacttagaatggaaagatagagactattgtgccgcaaagcaacacaaaagaaactactcaaagtgaaagaaaagttacggtttgctttacagcgtttgtaaatttatgacatgactattgattgtaagcaagaaaatattatggctgatctcaaaagtgtaaaatatgctaccaacataaatatgttaggtaaatgttcaaaacatatttcattgttataagaacttcaagaagtaagaagttatacttgct

SEQ ID NO: 67 - DNA, 1229 bp, Sorghum bicolor
ctcctctagaactagaagcaatcaagcaatgacaagaatataactactagagagactgatggcggacccggtagaatggagtcgggagaacatcacattcttgcacgaaaacgaggtgaacgcggatgcagagaattggcttgctgtcactgttgtcctcaaggtgccaccaacagcaaaccaagattcggttaatcgcgaattgatacggtgtgcaattctcgataagtgcaggataatagtttttaaaagtgacattatgcaatatgatcacggttacttagtgcgcaccagcgggagggaagaaacccaattgatcctgaatactgattttttggacgttgggcccaacaagcttattgtctatccatggtctccctacaatggttccacctgtcaatattttgatcacataccacccaacatcggaatggtgacaccagctaagcgcccacgagagtctgatgttctggaaaatctaaaggttaggggtcacgggctgccaccacatttatgcacgagcaatgtcataagaaaagtcttctctagcatatgtaggtttcacaagatggaaatataccagggagatctgagttttgccatctggacatttgcaagccgacaatgtatacctgatacatggactgtagctgtcatcaaagatacaatgttgtacatgtggccactttggctctttgtagaaggctgtgcaccgccgcctgccccaaggtcagaggttttgaagaacacacgggtgaagttcaacctgtacccagggacatccttaggtggtggaggtggaggtgcaagtggaagtggaggtggtggtactgcaggtggacatgatggacactctcgtgaagctatgctattaggttacgttgttgaatcaccgtcttcatctgattcatcatcagattcagattccagccaaccggacagcccatgccagtccgatctatttgccgaaccaactttgagagtatcaactagcgacactgtttcccaagtacctgagacgccactaggttcaggagagacagaactcgttcccgcctacaactactaaatgtgcttgttatgcatttgaacttgagatgtatttgaacttgtgatgtggttgatacttgggatgtatttgtgaacttatggttgtggactttggtttgactattgtgaacttgttatgtatttgaactatagatgtatctgtaatgaatgtttatggt

SEQ ID NO: 68 - DNA, 1865 bp, Sorghum bicolor
gccggcaacgagcccgaagaagcctcgcgaagacatggcggggaagaagcgcaagtccgggtccgagaagccggcgaagcaccgcctcccgctgggagccgatgccgacgcggttgccgaggcctcgaagcgccgccgctcgggcgccgccaagcagcaccaggcggacgaggaggcgtccatcccgccctccctcagcgccaagatcctccgcgaggcgcgcaagcagcagcaggaggagatgcgcgccgacgactccagcgacgagcagcggccctctgctgccgaggcggccgcggggccgtccacgtcgtcctcgttccccgtccccgccgcggatggcgaggaggaggaggacgacgacgtcgacgagttcgacgggtttgacgcgcagaccgagtacgacggcggcgaggtggagatcaacgaggaggatgagagggcccttgctgccttcatgtcaaaggacaaagctgccgagcgcacccttggtgatatcatcctccagaagatcatggagaaggacgccgaggttgcaactgaaggacgacctcgtgtaaaattggacaacagcattattgagctttataaagaggttgggaagttcttaagccggtacacgagtgggaaaattccgaaagccttcaagcgcataccatcgctggagtgctgggcagatgttgtgcagctaacggagccagagaattggtctcctaatgccgtgtatcaagcaactcgcctcttctcttcgaacatgaacacaaagaacgctgagcggttctatgaagccattttgctacctcgtgttcgtaatgacataaggaagaacaagaggctgcattttgcactctaccagtcgctgaaaaaggccctttataagcctgcggcatttaacaagggaattttgctgccactctgtcgggaaaggaattgcaccctccgtgaagcagtgattattgggagtattatccagaaagtctccattccatttctccatgcaagtgtagctctagtaaaactagcagagatggagtactgtggcactacaagttacttcatcaagctatttctagacaagaaatatgctttgccgtaccgcgcgcttgatgcagtgcttgctcacttcatgcgttttcttaatgatgagaggaccatgcctgttatatggcatcaatcactgcttgcattcgtggaaagatacaagaatgagttagagaaaaaggataaggagaaccttgcacgtttgttggatcaccagaaacactatttggttactccagaaattcgaagggaacttcgagggagctgcaacaggggtgaaaaagatatgaatttgcagactttgtcacctatctccgtcattaccaagcctatcgaggaagacaagtgggacgtaccacaagtgccaatggaggaagattagccatattctccagtgtcaatttttacacttaaatgatttttggggcaaacttctaaagatattgctgtgattttttggtcataaacttgtagtgccaatattataaaatgggtacccagtagatagggccccaatgttctgggaaggtattttgcaatcagaatgcgattcacacagtagtttgttttgattggaacttggaacctgaagatcagttggcgcatttcaaggggtcattcagcatggatatgtggtatactgcctttctcagaggtggataagaaatagttgggtttttttgatcctggtattttgtaaccgtgatagaactaaattatgtcgtacttgaaccagaaatggaaatgaatgatcacgagttcgtttgatttgtttagggtgtttgttgcttgcataatcccctatctggacctctgtattacaa

SEQ ID NO: 69 - DNA, 786 bp, Sorghum bicolor
ccgatcgatcgaagcatccgccttccggcgtgatgttcccgtgccgccctctggctccgcggcccccgccgcgtgccctttccctcttgcggcttcctccgtcgtcgctgcggccgccgccgtcgtctctgcgcgtggtgcggtgcatggcgaaggagcggcgggtgcggatggtggcgaagcagatccagcgggagctcgctgacatgctcacccgcgaccccgtcctgcagcgcgccgtgctccccgaggccgcgctcggcgccgaccgctacctctcgtcgctcactaccatcgccgacgtcgagctctccaacgacctccaggtgtgcaaggtgtacgtgtccgtgtttggggacgagagggggaagaaggtggccatcgaggggctcaaggccaagaccaagtacgtcaggagccagataggcaagcggatgaagctgcgcctcacgccggagataaggttcatcgaggatgagtctatggagcgtggaagcaggatccttgctatacttgacaaactaaaggaggaaagggagcaacaagaaggaaaagatggagaggaagatgtagaaggttcatatatatcagaagaagaagatggtgactgggatgcagatgacccagatgaggaggatatcatttatgtaaaatagcctatcgtcttctgggaacttggtcatcattcatccagagcacagcagttctcttcggagtttaatccagtgaagttcagaactcactgcttacctgcttgtcgaagcactccaaagtatatcagcactt

SEQ ID NO: 70 - DNA, 662 bp, Sorghum bicolor
cttcggtctttcctttgaagtgttcttaggtttgtgttgcctaatatggatgtcgttgctggctggacctggtcagaactcgggcaccggcgtggggaaacagaacaacccacatgatccccgaagtaccactcgagggaggtgacagagtttggagcctgccggtccactggaacagtgacggaccctctgaccaggactgctacagtttacttcgggtattttctcggaagttggaacagaagaatgcctcatgtctcatgaggccgggatcgtagaattttgcctgcctgcctgcctgccttgctgcgaccaagagctccacgtctccgtcgccggggcaaagccgtgccgcacgggacgaggaaattcacggcacatcacgtataggcaggaggaccgagagttgtgcaagtcaggatctccccgtctcttgcttcaagtgttgcgttgcctacatgcattcttgacctagctggatagtaggtgagtgtagtaactagtcaaatcttgtgcaagggcatgggcaaaacgttacatgatttgccaataccatgtcggatgtgatctaacggtttctgatagtcagacagataccgtgcagcactgaaactctggccttgtttagttgccaccgaaaaagttttcaagattccacgtca

SEQ ID NO: 71 - DNA, 1085 bp, Sorghum bicolor
tcgaggaggagcaacaaggagggagagaagatagcacaagggcaccctcgccaacctcgaagctagtccaaactagtgggaggttgtgtgcagggatcgagcaagacgacaattaacctactgttgctgctgctgctgctgctgctactgctaggtaacaaccaaggcaagcgaccaggcagcaatccatctctcggcatccatggcgcggggcaaagtgcagctgcggcgcatcgagaacccggtgcaccggcaggtgaccttctgcaagcgccgcgcggggctgctcaagaaggcacgggagctctccgtcctctgcgacgcccacatcggcatcatcatcttctccgcgcacggcaagctctacgacctcgccaccaccgggaccatggaagagctgatcgacaggtacaagactgccagcggagaagctgccgacggctccggcgacaacagaatggatccaaaacaagaaaccatggtgctgcaacaggaaatcaatctgctccagaaaggactcaggtacatctacgggaacagggcaaatgaacacatgaatgttgacgaactgaatgcccttgagaggtacttggagatatggatgtacaacatccgctctgcaaagatgcagataatgattcaagagatacaagcactaaaaagcaaggcatgtcaaaaacttgaaggcatgttgaaagctgctaacgaaattctccgggaaaagatagtagaacagagtagtttgcttgatgtaggcatggtggtagcggatcaacagaatgggcattttagtacagtcccactgatagaagagatcactaacccactgactatactgagtggatattctaactgtaggggctcagagatgggctattccttctaactgtaataacaccctggagggctcattctgttgattatgattactagtgtgtaatacaattaataatgtttgtgtaatggtttgttctgctactttggtgtaccttgtcgtataaaccatagcccttcaggagtgccctggtattgtattgtggtgctttttactttccataataaagaactactaccgaggagttctc

SEQ ID NO: 72 - DNA, 1541 bp, Sorghum bicolor
gcacatccggatcatctgcgactgcgagcactcgctccaaccgtcgccgatctccaggcgcagcggcgatgagctccggaaaggcgcagcagcggccacacgccgtgctcatcccgcagccggcgcagggccacgtcacgccgatgctgcacctcgccaaggcgctgcacgccagggggttccgcgtcacctacgtcaactccgagtacaaccaccgccgcctgctccggtcccgcggccaggactcgctcgccggcaccgacggcttccgcttcgaggccgtccccgacggcctgccgcagtccgacaacgacgacgtcacgcaggacatcgccgcgctctgcctgtccaccaccgagcacagcgccgcgccgttcagggacctgctggcgaggctgaacgccacgcccggcagcccgccggtcagctgcgtcatagccgacggcgtgatgagcttcgcgcagcgggtcgccgaggagatggggatcctggccttggttttctggaccaccagtgcgtgcggcttcatggggtacctccacttcgccgagctcatccgacgagcctacgtgccactcaaagacgaaagtgacctgtcgaacgggtacctggacaccgcgatcgactggatccccggcatgcccggcatccgtctgaaggacatccccagcttcatcaggacgacggacccggacgacgtgatgctcaacttcgacggcggcgaggcgcagaacgcgcgcaaggcccgcggggtcatcctcaacacgtacgacgcgctggagcaggacgtggtggacgcgctgcgccgcgagttcccgcgcgtgtacaccgtcggcccgctcgccacgttcgcgaacgccgcggcaggaggcgggctggacgcgatcggcgggaacctctggaaggaggacacgagctgcctccggtggctggacacgcagcgaccgggatcggtggtgtacgtcaacttcggcagcatcacggtgatgaccgccgctcagctcgccgagttcgcctggggcctggcgagctgcggctcgccgttcctgtgggtcatcaggccggacctcgtgtccggcgagaacgccatgctgccggaggggttcgtcacggacaccaaagaaaggggaatcctggcgagctggtgtccgcaagagctggtgctctcgcacccgtccgtcggcctgtttctgacgcactgcgggtggaactcgacgctggagagcatatgtgccggcgtgccgatgctctgctggccgttcttcgctgagcaaccgacgaactgccggtacgtgtgtgacaaatgggggattgggatggagatcgacagtgatgtgaggaggcaggaggtggcgcggctcgtgcgcgaggcgatggacggggagaggggcaaggcgatgagattgaagtcgatggtgtggaaggagaaagctcgacaagcagtggacgaaggtggatcctcgaggaaaaacatggaccggatggtcgagttcctgctcgctgggaatgatgttcctagctgaatttattgaaaaaatgct

SEQ ID NO: 73 - DNA, 2104 bp, Sorghum bicolor
cccggagcttcgcgatgcagcagcgccttctcgcgctggtggcagcggcagccctgctgctggcgctgcggccggcgctggccaccgacccctacgccttcttcgactgggacgtctcctacgtcactgaggcgccgctcggcgtcaagcagcaggtgataggcatcaacggcaagttcccgggccccgtcgtgaacgtcagcaccaactggaacgtcgtcgtcaacgtgctcaacgacctcgacgagcccctcctcatcacctggaacgggatccagcaccggaagaactgctggcaggacggggtgctgggcaccaactgccccatcccgtcaggctggaactggacgtacgagttccaggtcaaggaccagatcggcagcttcttctacttcccctccaccggcctgcagcgcgccgccggcggcttcggcggcatcgtcgtcaacaaccgcgacgtcatcgccgtgcccttcggccgccctgacggcgacatcaccatcttcatcggcgactggtacaacaagaaccacacggatctgaggaagatgctggacaaggggaatgacctcgggatgcccgacggcgtgctgataaacggcaagggtccgtaccggtacaaccacagccttgtgccggccggcatcgagtacgagaccttcaatgtgcatccgggcaggacgtaccgcatccgggtacacaacgtgggcacgtcgacgagcctcaacttccggatccaggggcacaacatggtgctggtggagacggagggctcctacacctcgcagcagaactacacgaacctggacgtccacgtcggccagtcctactccttcctcgtcaccacggaccagaacgccagctccgactactacgtcgtggccagcgcccggcaggtgaacgagtccctctggcgccgcgtcaccggcgtcgcggtgctccgctactccaactccagggcccccgcctccggccccctcccggacccgccgcaggaccagaacgaccgcaccttctccatgaaccaggcgaggtccgtccggtggaacctgagcgccggcgccgcgcgccccaacccgcagggctcgttccgctactcgtccatcaacgtcacgcaggcgtacctgctgcggagcacggcgcccgtgtccatcgacggcaggcgccgcgccacgctgaacgggctctcctacgcgccgccggagacgcccctgcggctggcggacgcgtacggggtcaagggcgtgtacacgctcgacttccccgagcggccactcaacaagggcgccccgaggatcgcgcgctccgtcatcaacggcacctaccgtgggttcatggagctcatcttccagaacaacgacaccaggatgcagagctaccacatggatggatacgccttcttcgtcgtcgggatggactacggcgagtggacggaggacagcaggggaacgtacaacaagggagacggcgtggcgcggagcacgatacaggtgtacccgggcgcgtgggcggcggtgctggtgtccctggacaacgtcggcgtctggaacgtgcggtccgagaacctggactcgtggtacctggggcaagaggtctacgtcagggtcgtcaaccctgaggacaccggcaacaagaccgagatgggcatccccgacaacgccctctactgcggccagctccacaagtaccagaaggagcagacgccgcaccacaagatgggggtgtctgctgtggcgccgagctcgttgtccctggcgcgccggctggtcgcgtcggcgctgctcgtggccggatccttcgtgttggcgccgtagagtggcaccgttacttgtgcgccgaggcaacaccgttgacataggcttgtttaggattattagaggtgtaggccgcgtcattgtcatttttccctgtcgatatgagaaatgttcttgttcatgtgccagtagtgctgggctctgcctgcctgactgcacacgatacagtgttccttcgctttttgtgtatgtgtgtgtgtgcgtgttgcctgttaggaagggtcgattgtttatctctgattagttcgtcccttttgttcgacgtgataactctgatcttagcgtttctc

SEQ ID NO: 74 - DNA, 382 bp, Sorghum bicolor
agaagcaagatagcaataagcaccgtatcagttgcactttcaattcgcgaccgacaaccgacgacgatgagctccacggcgacggcggcggattgcggcggcgccaagacgtcgtggccggaggtggtcgggaagagcgtggaggaagcaaagaaggtgatcctcaaggacaagcctgacgccgacatcgtcgtgctgcccgtcggcacgatcgtgaccgcagattttgtgcccaaccgcgtccggatcttcgtcgacaccgtcgcccagacaccccacatcggctgattaattaagaggctggctgatgcctagctagctttgattccttccttgctccagaactgaatattctattctgtaaaatgaataagtcggacat

SEQ ID NO: 75 - DNA, 1691 bp, Sorghum bicolor
tttccgatgcccgacccaaccaaagcacatggacagacgcgagcgattgcgaggggaccggagaagacacggcactgccgtctgctgtgctcccggctcccccgccccgcaccacaagcgcgtgcgcgccgtcaagtctcctctacagcaacttccaccgcgtactccctccctcgtcccgtctccaagtttcgcggggggcgaaggttgctagccagagcagtcgcggtctgcgctgcggcaccggcacggcgacgaggtggggatggagtaccgcgacaagctggtgctcgcgcccatggtccgcgtgggcaccttgccatttaggctactggctgctgaatatggtgctgatattacttatggagaagagattattgatcacaaattgttgaagtgtgagcgtgttacaaatgaatctcttgggactactgattttgtggagaaagggactgacagtgtagttttccgtacatgcccagaagaaaggggtagggttgtattccaaatgggcacatcaaatgctgtgagggcacttaaagctgctcagcttgtgtgtcaggatgttactgctatagatatcaacatgggctgtccaaagtctttttcgcttagtggagggatgggtgctgcattactctccaagcctgagcttatacatgatattttgacaacattgcggaggaacttggacacaacagtgacatgtaaaatccgtcttctgaacacacctaaagacactgtggagttggcgcgccggattgagaaaactggtgttccagctcttgctgtccatggaagaaagattaaagatagaccaagagatcctgccaagtgggatgagatagccgatgttgtgtcagcgctgtcaattcctgttatagctaatggagatgtctttgagtatgaggattttaagagaattaaagatgctacaggtgctgcttctattatggttgctagaggtgccatgtggaatgcctctatcttttgtgccaaaggaaaaacaccttgggaggatgtcaagagagagtatgtacgaaagagcatattgtgggacaacgatgtgaagagcacgaaacataccttgaaagaaatgataatgcactattcttgccttgaacttcctgaggggaaaggtgttattaagtgtgatacatcagaagatttagcgagactatatggggaggaggactactataattttgttgtttcaaataggaaatgaatacagtttggtgctgtgagctttcatgtgtatcagcttctgcttggattcctatctcactttttattactgggattaggaggaatctgccctgtcaccaaggaaaacgattcgccatttttgcgctgtctggacgtaggaccactagtccagtaagggttttcaaattgggggaaaaaaaagacactggagctgctgatctttcccttctactggtaatagataggtgcatacggctggaattaatcaaacaccagattttttaaaaaaactgatactaatctagaccatggaaattttgtcatgtattgttggtggagatactatggtgcttttgggggaattcaaatagacttcgacatgttgactgtactgttatggccctgtggtctaacagagttttcatgatatgtctttgactggtatttagcctggcacttaatatttgcaactcacctcatgc

SEQ ID NO: 76 - DNA, 2783 bp, Sorghum bicolor
gtagcgattctctgtgttcgcaccagccagcgccggcacaggcaaacgcaacaccgcaccgagccgagccacttagcgagggagcagcctccacctccacctccacggcgacgagagaatggggagaggagggatcggaggcgcggtgggcatggccatggagaacgccgattccgcccgcgcattcgtcaaggacgtcaagcgaatcattatcaaggtgggcacagctgttgtcactgggcagaatggccgattggcaatgggcaggctcggttctctctgtgaacaggtgaagcaactgaattttcaagggtatgaggtgattctggtaacctcaggagctgttggtgttgggaggcagaggctccaataccgtaagcttatccatagcagctttgcagatctgcaaaatcctcagatgaactttgatggaaaggcctgtgctgctgtgggtcaaagtggcctgatggctatctatgacacattatttagccaacttgatgtaacatcatctcaacttcttgtaacggatcgtgatttcaaggatccaagttttggggaccagctccgcgagactgtttttgcactattaaatcttaaagtaataccgttatttaatgagaatgatgccatcagtacccggagacaatcagatgaggattcatctggtgtattctgggataatgacagtctagcagctctgttggcagccgaacttaatgctgatcttcttatcatgcttagtgatgtggagggactctatagtggtccaccaagcgatcctcagtcaaagattatccacacatatgtcaatgaaaagcatgggaagctaattagttttggagagaagtctaatgttggaagaggtggcatgcaagctaaagtggctgctgctgctaatgctgcatcaaaaggtgtacctgttgtcattgcaagtggatttgcaacggatagcatcattaaagttctcaaaggagaaaagattggtacacttttccacaatgaagcaaatttgtgggaatgttccaaggaagctacagcccgagagatggcagttgcggcaagagactgttcgagacgtctacagaagttgtcatcagatgaacgcaaaaagattttgctagatattgctgatgctctggaagcaaatgagggtgcaattaggtctgaaaatgaagccgatgttgaggcagcacaaggtgctggttatgaaaagtcgttggttgctaggatgaccctaaagccaggaaagataacaaaccttgcaagatccattcgtgccattgctgacatggaggaccctatttcccatacattgaaaagaacagaggttgctaaagatctggtttttgagaaagcatattgcccattgggtgttctgctcattatttttgagtctcgtcctgatgcattggtccagattgcatctctggcaatccgaagtggtaatggtcttcttttgaaaggaggaaaagaagctatgcgatcaaacgcaatattacacaaggtcataactggggttattccagatattgttggtaaaaagctcataggccatgtgactagcaaagatgaaattgctgatttgctagcgcttgatgatgtgattgatcttgtcattcctagaggcagcaagaatctagtctcccaaatcaaagcaacaactaagattccagttttaggtcatgctgatggtatctgccatgtttatattgacaaatcagccgacatggatatggcaaaacggatagtattggacgccaaggttgattatccagcagcatgtaatgcaatggaaacactacttgttcataaagatcttaacaagagtgagggccttgatgatctattagtggaacttgaaaaggaaggagtagttatttatggtgggcctgttgcacatgacaaattgaaagtaccaaaggtagattcatttcgccatgagtatagctcaatggcatgcactctcgaatttgttgatgatgtgcagtcagctatcgatcacataaatcgttatggaagtgcacacacagactgcatcatcacaactgatgaaagtgctgcggaggcttttctgcagcaagtcgatagtgctgctgtgtttcataatgcaagcacaaggttttgtgatgggacacgctttgggctaggtgcagaggttggcataagtacagggcgcatacatgcccgcggacctgttggagttgatggacttctaactactcgctgcattttacgcggtagtggacaagtggtgaatggtgacaagggagtggtttacacccacaaggatcttcctttgcaatgaggcaaagaacctctgttgtagaacaattgctctcgtaacgaatggctgaactcccctttaagtacccttttccttttttccatgcaacaaagacaggtgtcgtaacaagcagaaggaactgatactctctctgcggtgcctatttattagacaatgatgtattcagaccattttggtacgaggcttgtaagctgtgtttgtcctgttattgtcgtataagctctagaacttccgagacatctgtattagaggcgtagtagctggttgaatgcgatggttttggatgaaactcgaatctgttcccgtgcaattataatgcatgtgtgatgagatcctaaaaatctgtaatggtctgtaattttatctgctgcttggtattttcataaatgtgcaaatggaagaagaaggaaaaacaatattatttccttagaaaaagatggccaattaatagagggggatgaaaatttactagagc

SEQ ID NO: 77 - DNA, 1320 bp, Sorghum bicolor
tctgccccatctggtcccaaaagtggaaaaaaggcagagtggagcacaccttccgttttaggaaggtgagaagtgggggagccggggagttgggagagagagtgagagagagagagaggcagggatcagcggcggctggcggaggagatggaggagcgggagaagctcgtgtgcctggccaagctcgccgagcaggcggagcgatacgacgatatggtggaattcatgaagaatcttgctaggatggatgtggacatgagtgctgaagaaaggcatttgttctcagttggtttcaagaacactatcggggcaaagagagcatcgtggagaatcatttgttcacatgagcaaaaggtcacaactgatcgtcagactggtgtgatgatagatgcctataagaagatagtagaagatgaactaaggaaggtttgcaatgaagtattgtcagtcatcgctattcactgccttcccttggccaatacgagtgaaaatgtcgtattcttttataagatgaaaggtgactactaccgatacttggctgaatttagcagtggaactgaaaagaaagctgcctctgaccagtcacttatggcctatcagcatgccatggttgtcgcctccagtgagctctcacctgcccaccagatccggcttggtcttgctctcaatttgtcggtcttcttttatgagataatgaactctcatgagagagcttgccaagtggcaaaacaagcattcaatgaggctcttactgagataaattctggtgaaggggtttacaaggatagcacacttatgatgcagcttctgaaggacaacttagcattgtggacatcagaactaaccggaggtgaagcatccaaggataatgatgtcgacatggagggttgattgatatgagctcaaggaacacagaacacacgcaaagtatccaatctgcgctgctagcgaacccgggtcctcaagtttttctgcatcggaattcggaagatccccacttatttttctgaagttttctgttcctctgtttcggccatcgtttggccctagagtcagtgtccctactaagtgtttctcagaggtctggactggtgaccatccaacaagctttggtcatattttgtgagcttgtgctggtgaccacccagctctgatgttatgttgcttctttttttttcggtgcttcagaggcatctttgtacaccgatgacaaaatgtatctcttatcaatacattaaaagactgtcgctgtcgttattaatctagctatcctgttccaggtgatgctatatcggcaatttacattgatgagagtgagtt

SEQ ID NO: 78 - DNA, 1717 bp, Sorghum bicolor
agctagcggttttctctcgccgacggccgaccaccgcacacgcacacgttcagcgatttcgcgggggaatttgcattgattccgtggagttccatccgcccgctgtagccgcgattggggatcggggggcttgcgggccgaggaggagccagaagaaggtagcggcggagaagcttcttgatccggggacggacggggcctttggagattcgtccgtcgatcgggtctcatctgcggaagccgggtcagaaaaaatcgttgcgactggaggaggcggcgcgagggcatgggggcgtgggtctcggtcctgctcgggatggacgacggagccgcggcggcggctgccgccaggcctgctgctgtgggcctgggcgacctgccggagctctgcgccgcccaggtgctgctccggctcgacccgccggagatctgcagtctcgcggggctcaaccacgcgttccgcggcgccgcgggggcggacttcgtctgggaggccaagctgcctgagaactacagctacctgatggagttcgtcggggggagcggcgacgaggggaggcggcggcggcggcgggccggcaagaaagagatctatgccaggctcgccaggcctgtgcctttcggtgacggccagaaggaattctggttggacaagagcaaaggcatgatctgtatggcactgtcgtccaaagcactggtgataactgggattgatgacagaagatactggcaacacatgccaacttcagaatcaagattccagtctgtagcctaccttcagcaaatctggtggtttgaggtggttggtgaagtcgatttctgcttccctgttggaacatatagcttgtactttagggttcatcttgggaagttctacaaacgatttggccgccgacattgcacctcagagcatgtccatggttgggacaagaagcctgtccgcttccagctatcaacctccgacggtcagcaggcactgtctcagtgctacctggaggagcccgggagctgggtcctgtaccacgctggcgattttgtggcctcaaagcctgaccagccgatgaagctgaagttctccatggcgcagatcgactgcacacacacaaaaggcgggctgtgcatcgactcggtgctcatctatccgaaagggaaggggtttcagcaggagagggtggtcaggtctcagaaatgagactgtagattgttgtggaggtactactcacagtaggatgttagaccaaatgcagcttgcagcctgatcttatttttgctttgggctctagttcgcaacagaggtgaagtgtatatggttgtagaactcgagtttttgtgtggtcaggtgaccactagagtgctctgttagtcctttcccaaggtcgttttcgccccccttgagctgaattgggacttcgagataaccatgaaactgtactgaaatgagtttgaagatgtcgttcccagtttctaatttgctatctactaagtttctgatcctttcttttcctgttcttctagtttttgtgatgtgctgttccactcttgagctgaattgagacatagagtaacgtgtggtatttcttttctattcttttaattcttgtgagcgttttttcactgacatactgaattgagaccgaaatgagttcgaagagatgtggttcccagtttctgatgtctcaattcatagttatgtgctatcaattcattgtttaatgtg

SEQ ID NO: 79 - DNA, 1188 bp, Sorghum bicolor
agagaccgtcatcccctcctcgatcccctccttcttcctgcgaacgcacgcacctctcctcctcaccttgctcgccgagcgccatccgccgctctcgcctcgcctcgcccgccgagcgctgccttgcccgccatccgccgctctctcgcctcgcccaccgagcgccacctcgcccgctgagcgccgcctcgcatcccgcccccgcgagcctcgcccgccgccgcctcgagaccggccgcctagcgacgtccgccgtgaggcgagagcgccgtccgccgcgagaccggccgcttcgcgcaggtcgtcgtccgccacgagccccgagcgcagtcgatccacgcctcggcgagagcgccgtccgccacgagactgtcctcgagagcgtcgtcctcgatctccaaccgcgacagctccgtccttgagcgccctccgcggcagagtcgtcctcgttcgttaccgtccgcgcgagccccgtcctagagcgccgcccgtgactgctttgttcttggccgcaacaagcaccgtcgcgccggtcacgaccacctggaacctgaatatcaagacccaaggctgaaaaaatccgacgtgaacaagcagctctagatgaatgtgtgaagttcttggtggtaggcccattgctgatgagattaaagagctgtgggaagactatgaaaacaattcttctattaaagccaatcttgtaaaagattttgacaaagggaaaccatcttttggttgttttagtctgagtttttacctgacagcccctttttggccaacgaggtcctggtaccggctgctaaagccgagccacctggagccgtcgatgaggttgtcgacgtgcacggcgagcttgagggagctggccgggttgtggaggacgacgtggaaccacaacctagggacggtttgatcatgttttgccgtactacgcagatgaagtcaccatagttgtcggtcggcatgatgaaggagtcccttgactttggtgttaccggattatggattatgagtgttgcttcatttgtgtattgtctgtgatataggctatatatagtaggacatatgggtaattgtgtattatctgtgatataagctatatatagtagcagatatgggtacgtatgtaattttctaaaacacaatcagcccattgttttttaatattaatcagtccattgtgatctc

SEQ ID NO: 80 - DNA, 1031 bp, Sorghum bicolor
agccgtccattcacatcgaagcatagcagccaaggcggattccgcgctccggggccgccatgaagctgaagctcctctcccccttccttctcctcgccttcctcgccgccgcggcgtacgcggcgccggcgtcgcgcgaggcggcggcggccgccgtcacgaccacgctgcagtcggcgtcgtcggacccggagaaccagtgcgtgtacacggtgtacgtgcggacgggttccatctggaagggcggcacggactcgacgatcggcgtgacgctgctgggcgcggacggcacggggatccggatccgggacctggtggcgtggggcgggctcatggggtccggccacgactactacgagcgcggcaacctggacatcttcagcggccgcgggccctgcatgagccagcgcccctgcgccatgaacctcacctccgacggctccggcgcgcaccacggctggtactgcaactacctcgaggtgacggtgaccgggccacacctgggctgcgcgcagacgctcttcaccgtcgagcagtggctcgccaccgacgcgtcgccgtaccgcctgtacgccgtcgtcgacgagtgcgagagcgagacgacgacgaagcggcggcagcggcaggagacggagacacagacacgctcgccggccggcgaggccgaggctgatgaggccaccgtgtccgtgacggcgctctgatcctgcctgtgtgacccatgccccccctaattatgtgatcgatggatccccatcgggattacgttcgtcttgtggagacgctgtgtgatcgcgcgattgatttcgccgccttgtttttgtgcgacgaggttctggtgcgtagtacgtacggggagaataaaagcagcgttttctttctttcttcaagcttgcatttctgttggctgttgctgctgtccaaaccttcaagctctatcactctatcctttgactcagctggtagggtgtggtaaagtttggttatgtgtctgcatcagctcatttatctctggatacggtcatttgcca

SEQ ID NO: 81 - DNA, 2017 bp, Sorghum bicolor
acatggacggcagccaagtggtgctggaccgacgccgctctacgcggtgacgagtgcaagccccagtcccggcgacctccgccgccgctggcagccgccgatatggctccaccctagccccagtagccgcgaacaagcgctccccgcagcagctccaccccaattcgtccgcgccgccacccgcagaagccccaagctgccccgtgcccaaatctagcagctcgcccccgtcacctcctgcccgtcggaatggctgccggtaaagcgcgcaagagagcacggcaagcagctccggcgagcgacggcggcgaccgcatcggcgccctcccggacgaaaccctacaccatgtcctctccttcctccccgcgcaggaggcggtgcggacctgcgttctcgcccggcggtggctccacctctggaagtccgcgactggccttcgcatcgtcggcgccaacggggaggcgccggtgcctttcgaggaggtccgggagtttgtcgacagcctcttgctcctccgtggaagctcacctctggagacatttgagctcagggtcgccggagacgatattgacgttcgccacgtgaggctctgggttaggtacgccgtgcagtgcaaagcccaggtcctgcggctcagcttccttgggaatacccatgtaggtcctgtggctcggttgcggccggatgacccacccctcgcctccaggcacctgaccaagctagagcttcgcggcctagtgttcaacgatgatttccttgacttctcgagatgtcctgagttgcaagatctacatattcaagactgcagcttggagtatgccgagaggatctcgtcccagtccttaaggcatctatatatcagaggcgcattcaacccgagttcccgagcaggaattcttgccccaaatcttgcttcattggtgctagaagtcacttttggcatgacccctgtaattcagaaaatgcccttgttggttaagggaactgttggattccgtgggctttgtgaagacttatgtagcagtcctgctcctaactatgtcagctatgtggactgtgataagagctgccgaggttgcatacgtgatggcagtgcctgtgtgattttgtgtgctgtgtcccaagcagaggatttggtgttgatagcttcccctgatacgttcattttcagaagggatttgaaaggttgtcctacatttaatcgactaaagtctttgtgtctcgatgaaaactggtgtgtgcctgatgagtatccactatcatgtattcttgaactttcaccagttttggagaagcttgctattattctatatttcaagattcacctacttgaagctaatgtgcaaattaaaggaaggttcaatccaaaggagctaccaccaaccatatcatcacaccttaaggaagttgaaatcctttgtggaggggttgatgggaacgttcttaaagttttgaggttcctgagcaaacttaacatcagttttagtttcccccccatagaagcttaaagctgaagacggatttttctgccacttaattacattaggaaactaagcttaaagctgaagacggatcttctgccacttaattacattaggaaactaagagccacagacagctgatatcactaagaatgatgccttcttcctgtggggttgtttttatttcctccacttgttgtaccaagttaagatgatctacttgaacctgataagtttcatccgggaagcacttttcggccaattgagtaagcatcatgctgtcttttgtctctagggttgtttcccagttctacctgtgtactgccaactttgctggacctggtttaccgtgatatgctgtttcttgcaacctttcctgtgcagcttactcaaggtgcctagctgttcatttcttgttatgtgcatgtctattgccttgttcttcctagatgagacagatatgtggaccggtactaaatgcccatggattgtaactttgatgtgtaaaatggcgttcaatgatttctgagttctg

SEQ ID NO: 82 - DNA, 1489 bp, Sorghum bicolor
catagcaatcgtcccccgactccagtcgcttcatccccgatacctttctcctggcttcccatccgcccatctccgtctccggtgcggccatcgtcgctcccagcgactcccctcacacccacgacgccgcaacccatcgcctgtaccctagcaccacccacagctggcctcccctcccgccgccgtggagaaactcctccgcctcccggagctgctccgctgccccgatgccgctagacgcgctgccgcaggctctggtgccacatccaccgcatccccatcgcgggacaggacaagagaggtcggcttccagcggcatcctccatgccggccagcgagctcgcctcctgattcaacacggcaaggtgcggatccagtagcatggagccctgccccggcgcgcttgcgcggctttggcatgtgcggctccggcagcgcgcggcactgccccggtcacctgctccagccctgcctcacctgaccgagccttcgaggaagtctagctaacctgttaatctgttactctataaacgctgagcggacctccacggagacggcggcagcatccagagcctcgtctttgttggccctttgtctgccgagtgctggtgaggttgtctcacgtagatttagatcaggttgcaatgattaagtcaattatttaatctatccgctgaaactggaatagctagcgggaggaggaggaaaaggcagttgcaggccacaacactggtttaggacgatgccttgctgtctactaagcaggatatccaggatgccatcctcattcatggccccagcaataagcaactgcgagtgcgaggagttatcagtccccaatatattcttgttggcattgacaaatcaggcggccgaattggtctgctatcgtcgaagtttatgcttcaggttatcagcgtgcttcacatcgttcatctaaaattctgcaaaacagaagaagaggaaaaagagccacaatagtaacagtaccacaaatattttgccctaaaggtcataaatgcatacattatgttattaagggctcaagatcatctgaagttgagggcttgtggaaaagtcctcctcaagaattctcttatctccagtatcctcaagagggatggtgatgataaaattaaaattgtagacctatatcccacacatgacaagaatgaaattagaaccattgagaaatgggttttatcgtacctggaccatgacatgacacttaaggtgaggtggctgtgaggagattgttgttggtggcacgctaggagcaccttgaaatagaccggcaactgggtgacgttgagggatgaatattgaggcaagagagaggtgatgaagttgcactttgttacttagatcctttgagaaataaagttgtaggcatccgaattgcctagctcttgaaaactatttctacttatgtggaaggcaaagtgtgtctctattgctacatgttcaaataaaaagtttcctttgatga

SEQ ID NO: 83 - DNA, 1563 bp, Solanum lycopersicum
gagtgaaaagaaaaaaaacatggagaagaagggtcatgcagtgtgtgtaccatttcctgcacaaggtcatgtaataccattcatgaaattagccaaattattgcactccagaggtttctatgttacatttgtcaacactgaatataaccatagacgtctaatccgatcccaaggtcctgactttgtgaaaggcttccaggatttccaatttgaaactatcccggaagggttgccaccatcagatcgcgatgcaactcaagatcctgcttccttatgtgactccataagaaaaaactgctcgactccttttcgggaattattatcgaagcttatttcatcacccaaagttccaccaatttcttgtgtaatatcagatggtgtgatgagctttgctaataaggctgcgcatgaatttggcatccttgatgtccaattttggacagcctcagcttgtggttatatgggataccttcaattggatgaactaacaaaaagaggcattatcccgtttaaagattacagttttatggaggatggtacactggatagagttgttgatggaattccaggaatgagaaacattaggttcaaagacttgccaagctttatcatgactactgatccacatgatattttgttaaactacttaagggatgaagcacaaaattgcttgaaatcttctgcgatgatcatcaacacgttcactgaattggaacgccaagtccttgaagcgattgaagctagacacccaaatatttatgttacaggtccactttccttgatggaaaaaaccatcccagaaaatgaattgagctcatttaggccaagtttatggaaagaagaattccattgtcttgagtggctgaataaacaggaaccaagttctgtagtatttgtgaattatggatgtgtcacattgatgtcagacaatcacctaaaagaatttgcgtggggacttgcaaatagcaaacacccattcttgtggattgttaggcctgacatagtgatgggtaattcagccgtattgcctgatgagtttcttggagagattaaagacagaggattattagcaacctggtgcccacaagatcaaattctttcacacccgtctattggcgtatttctaacacattgtggatggaactctacgatggaaagcctaagttcaggagttcctctaatttgctggccattctttgctgagcagcaaacaaattgtagatatgcttgtgtagagtggggaataggtgttgaggtcaataaagatgtcaagcgtcaagaaatcgaagcaattattaaggatatgttagaaggtgaaaaaggtaaggagttgaaagacaaggcgttggagtggaagaagaaagcagcagaagcaactaacattggagggccttcatggaaacactttgatacattcttggaaagacttctccttaatagggaatagtatttgttggatatactattaaccattggttaagcaatagtattttatttaatcatgtgtgaaagactttatattttatctcatttatcataataaagtttttatttaaaaaaaaa

SEQ ID NO: 84 - DNA, 1432 bp, Triticum aestivum
ggaaaagtcacacacgatcagatcaagtcatgttcacttgttaaccaaaagccaacacatctaggtcaccgcttgcaagaatagatccatataagcagaaaagcaaaggaagaagcgcccattcctttttgggaaggttctcacagcagattagaggaatcaccaatccaggggaagtaggaggaggaggaggaggagatggaggagagggggaaggtggtgtgcatggcgaagctggccgagcaggcggggagatacgatgatatggtggattttatgaagaagcttgctaggatggatgtggatatgagcgttgaagagaggcatttattttcagttggttttaagaatacaattggtgcaaggagggcatcatggagaatcctttcttcacttgagcaaaaggtggcagcgggtgagcaggctggccggatgataagtgtctacagaacgaaagttgaggatgaactaaggatggtttgcaatgaaatattgtcaatcatcgctattcattgccttcccttggctaatgcgggtgaaaacgttgtgttctttcataaaatgaaaggtgactactaccgttacctggctgaatttagcactggggttgaaaagaagtctgctgctgaccaatcactcatggcctatcagcatgccatggttgttgcctccaccgagctttcgcctgctcatccaatcaggcttggccttgcgctcaatttctcagtgttcttttatgacataatgaactgtcatcagagagcttgccaagttgcaaaacaagcatttgatgaggctactactgagattaattccgctggtatggatggcaacaacgatagcacactaatgatgcagcttctgaacgacaacctagcattgtggaagtcagaactaactgaaggtgaaacctcgaaggatagcgacatcgatatggaggagggataactggaatgtgctgaaggctcccctgcatgcatgtgtgcaaaatgaccagaacataatggtaccaaacctgctggacactgttggtttttgtgacaatgcgctgatacaattttccgacattttagcagggataactggaatgtgcttcaaggctccctccctagcacgtatgtgtgtgaaataaccagaacatagtgctaccattgaaatcgccccaaagtgccttgcctactgtgcagcttgttagtagttctggggtcctcgcttggtgttttcctaggctttccacagtatggattggtaaccatgtgcccagctttgctcatgttttgagagcttggagcagtgaccatccatctttgatgcttttgtttctagttttcctccatgcgtattaagcgttgctgtatactggcgagctatatgtaactagtagtatctcagctatcaatgacgaaaactgtcatttttttcaaaaaaaaaa

SEQ ID NO: 85 - DNA, 974 bp, Arabidopsis thaliana
acgacactctctcgctctctctctgttcttcattttcaagaagaggctctctaatcgtcgtcagagaaaattgcagagagaattctgcttcggacattaagctcatgagtcatgacttcttcaatccatgagctttctgataacattggaagtcatgagaagcaagaacagagagattctcatttccaaccaccaatcccttctgcaagaaattatgaatcaattgttacaagtttagtctactcagacccggggactacaaattccatggcacctggacaatatccatatccagatccttactacagaagcatatttgcaccgcctccacaaccgtataccggggtacatctacagttgatgggagtgcagcaacaaggcgttcctttaccatctgatgcagtcgaggaacctgtttttgttaacgcaaagcaataccacggtatactaaggcgcagacaatcaagagcaagacttgagtctcagaataaagtcatcaagtcacgtaagccgtatttgcatgaatctcggcatttgcatgcgataagacgaccaagaggatgtggcgggcggtttctaaatgccaagaaggaggatgagcatcacgaagacagtagtcatgaagaaaaatccaaccttagcgctggtaaatccgccatggctgcttctagtggtacatcttgagaaggtcctacaagtagctttgttgtattttggctctgtttggtctcagatcatctatgtcttttagtgtatgatatatacaaatctttgtataaaggtatagataggttcttgggaagcaattaggtaaacgtgaagtgggttttagacttgtgattattaaataaaacccaccgaggaaaaagggaaataaataatgtccatgatgtttagttaaatacaatgctactgatattgttttgttataagaaattttggtaataaaacgaagaatggaagaatccacaaac

SEQ ID NO: 86 - DNA, 1462 bp, Arabidopsis thaliana
tttgttgagagaagaaaaccataattaaaaaaaaaaaaagagaaaaggagtcaagattagtcttttaagccatagccaatacccaatttgcagagacagaggaagagagagaaagatagtgaagagaaagaaacaaccatgttctgaggaaggagacatgcatcatcatcatcattcatcatcatcatcatcatcataatctcaagcttattacttaacttctttttctctccatctcttcttaccaaatccaaagcaccaaagtttattgaagtaaagatttgaagacaatgcaagtgtttcaaaggaaagaagattcatcttggggaaactcaatgcctacaacaaattcaaatattcaaggatctgaatctttcagcttgactaaggatatgataatgtctacaacacaattacccgcgatgaaacattcgggtttgcagctgcaaaatcaagattcaacctcatcacaatctactgaagaagaatcaggcggcggtgaagttgcaagctttggagaatataagcgttatggatgcagcattgttaataacaatctctcaggttacatcgaaaacttgggaaagcctattgaaaattatactaagtcaattactacctcgtcgatggtgtctcaagactctgtgtttcctgctcctacttctggtcaaatatcttggtctcttcaatgtgctgaaacgtcacatttcaatggtttcttggctcctgaatatgcatcaacaccaacggcgctgccacatttagagatgatgggtttggtttcttcaagagtgccattgcctcatcacattcaagagaatgaaccaatatttgtcaatgcgaaacagtatcatgcgattctccgtcgcaggaagcaccgtgctaaactcgaagctcagaacaaactcatcaaatgccgtaaaccgtaccttcatgagtctcgccatcttcatgctttaaagagagctagaggctccggtggacgtttcctcaatacaaagaagcttcaagaatcatcaaactcactgtgttcttctcaaatggcaaatggacaaaatttctctatgagccctcacggtggtggaagcggaatcgggtctagttcgatctcaccgagctccaattcaaactgtatcaacatgttccaaaacccgcagttcagattctcaggttatccgtcaacacaccatgcctcagctctcatgtcagggacttgaggcacatgagaagaccttgctccgagagaactcaggctaaactccggagactggtgatgatacatgacgggaagtcatccttggctacttatgttatcggttacaaaatttcttccttttaaaaactttgctttcatatcctctacaatctctcactctatattgagtgacttgacgaactttcaaatcattgtcaaactattttgttaacttccgattctctgagagtacaaattgcattaccc

SEQ ID NO: 87 - DNA, 1712 bp, Arabidopsis thaliana
acaacgtgaaaacacaggttcgtgctactactccaatgatacgggtctcaaaatactcaaaactctggcatgtctcaattccacaaattattgtttaatcattctgcttcttctgcttattaattctctgcagataactgcagaagaaagaagaaagaagaagaagaagagattagagcttgagccataatatataatcccttgatcattagtctaaagaaccacataaaaagatgggattctggtcgttgttggaggtggcttctatgccggttattcaagttcttttcatgagtcttgtgggagctttcatggcctctgatcgttgcaagctcttccctgttgaagcccgtaattccatgaacaaggtggtgtttgtactatttgcaccggctctcatgtttgccaatctagctcagacggttacacttgaagacatcatctcatggtggtttatgccggtgaacatgggacttacatttctaatcggaggacttcttgggtggttggttgttaagattttgaaaccacctccttatcttgaaggtcttattgttgcaacttgttctgcaggaaatatggggaacctaccaatcatacttgtcccagcaatctgcgatgaggacaaaagtccttttggtaaccgaagtgtatgtagaaccgtcgggctctcttacgcgtctttctccatggcgctagggggtttctacatatggacatacacattccggctgattaaagggtccgcaatgaaagttcaagccatagaagaatctgagaaaatagcaattaaatcatccaatagtgacttagaagctgatcataagacccatctcctcggtgcaccggaagacaaggaaaacaaagtggtaaaggaaaagacagggttttggagaaaaggagtagacttcctccatgagatattggaggagcttcttgcaccacctacacttggtgcaattatcggtttcattttcggtgcagtaagatggctcagaaatcttatcataggtgatgatgctcctttacgaatagtacaaagcactgcaaaacttcttggagatgggaccattccctgtatgactattatactagggggaaacctcatacaaggtttacgttcttcggcagtcaaaccgatggttgtacttggaatagtctgtgttcggtacatagctatgccaattatcggtataggcattgtactaacagctgcaaatctcggatttcttccagctgatcctttgtttcagtatgttttgatgcttcagttcaccctcccgcctgccatgaatatcggtaccatgacacagctgtacaatgttgctcaagacgaatgctcagtgctcatgctttggacctacttggtcgcgatactggccctcactgtatggtccaccatcttccttcacttgttagtctaaagaacctgcaactctgtatgagcacaagaagattctatctctctactactacagagaccgaagctctgtcaagggatcttaccattctttttgtctatcacataaaatttgatcataacttgatagatttttctggttgcatgcgtacctttctgcaaatcttcatttttctccatatcccgatttgtaaacgccaatattgtatcaagtattacatcaagtttaatgaaaaagcatatgaaaacagaggattaaaagtgatgcacctcccaaaattggcatccatct

SEQ ID NO: 88 - DNA, 749 bp, Arabidopsis thaliana
aaaactttgcttaaaaccaaaaacaaagtttcatttcttcttcttcttgaaatggcgacgagcaagtgctactatccacggccaagccaccgtttcttcaccactgaccaacacgtcaccgcctcttccgatttcgagctagacgaatgggatcttttcaataccggttcagattcctcttcaagtttcagctttagtgaccttacaatcacatccggtcgaaccggaactaaccggcaaattcacggtggttctgactccggtaaagctgcgtcttctctaccggttaacgtaccggactggtctaagattcttggagacgagagtcgacgacagaggaagatttcgaatgaggaagaagttgacggagatgaaattttatgcggcgaaggtacacggcgagttccaccgcatgaattgcttgcgaaccggaggatggcttcgttttcggttcatgaaggtgctgggaggactttgaaaggaagagatctgagtagggtgcgaaatactatttttaaaattagagggatcgaagattaattatcttttgggtacttcttttaaatctttgtttaaattgggggttacatatagaaatatgaggagcttaaatcgaaatttgtaagagctgttttttttggaattattttagtttctggattcacattaagtgttttttttaacttgagattgtattgaaattttgagacaccaaatatgaaaattgacttggtatttcttttataatt

SEQ ID NO: 89 - DNA, 2252 bp, Arabidopsis thaliana
tttgtatcttgctctgtctccgataccaaaaggtttttgtattctattgaagattataaactaaagggaggagctttgagaatttgattgttgatatccaaggatttgcaagctagttttttttttacgacgttatacttttcgattatgagtgcatcatgggctgatgtagctgactcagagaacacgggttctgggtcttctaatcagaattctcatccttcacgacctgcttatgttcctccacatctaaggaacaggccagcagcttctgagcctgttgctccattgccagctaatgatcgtgtaggttatggtggtccaccttctggctctcgatgggctcctggtggtagtggtgttggtgttggaggtggtggtggttatagggctgatgcaggtcgtcctggctctggctctggctatggtggacgaggaggtggtggttggaacaacagaagcggagggtgggaccgtagggaacgtgaagtaaacccctttgaaaatgatgattccgaaccagaaccagcttttactgagcaggataatacggttattaattttgatgcctatgaagatattccgattgagaccagtggggataatgtgcctcctcctgttaacacattcgcagagatagatctcggggaggcattgaatctaaatatccgtagatgcaaatatgttaagccaacacctgttcagcgtcatgcgattccgatattgcttgaagggagggatttgatggcctgtgctcagacagggtcggggaagacagctgctttttgctttccaatcattagtggaataatgaaagatcagcatgtacagagaccccgtggttcacgaacagtctaccctcttgcagttattctctcaccaacaagagagttggcaagtcagatacatgatgaggctaaaaagttctcttaccaaactggtgtgaaggtggttgttgcatatggaggaacacctattaaccagcagctccgggaacttgagaggggagtcgatattcttgtggcaacgcctggtcgattaaatgatttgctcgagagagctagagtctcaatgcagatgattagatttttagctcttgatgaggccgatagaatgcttgacatgggttttgaaccacaaattagaaagattgtcgaacaaatggacatgcctccacgtggagttagacagacactgttgtttagtgctacatttccaagagaaattcagagactcgcagctgacttcctagcaaattatatatttttggctgtgggtagagtgggttcaagtaccgatttaattgtccaaagggttgagtttgtccttgactctgacaaaagaagtcatctcatggacctgcttcacgctcagagagagaatggcatccaaggcaagcaagccctgaccttagtttttgtggagacaaagagaggagctgactctttggaaaattggttgtgcatcaatgggtttccagcaacctccattcacggtgacagaacacagcaggaaagagaagtggcattgaaagccttcaagagtgggagaacaccgattttggttgcaactgatgtagcagcacgtggccttgacattccccacgtggctcatgtggtcaacttcgatctgccaaatgacattgatgactatgtccaccgtattggacgaacaggacgtgctggcaaatcaggactagcaactgccttcttcaacgatggcaacacctcactggccagaccgctcgctgagctgatgcaagaagctaaccaagaagtccctgagtggctcactcggtatgcgtcacggtcctcttttggtggtggtaagaaccggcggtctggtggtcgatttggtggccgtgactttagaagggaagggtctttcggtagcggtagaggaggctatggcggtggaggaggagggtatggcggcggaggaggctatggtggtggaggaggctatggcggcggaggaggctatggtggtggatatggtggtgcttcaagtggtggatatggtggagaacctccaagtgcttgggactaagcttccaatgttctttttgttttggttacaacttttgacaaaaaaaatatttcttctacattcacaaagagagtatgtattgccccttacacctatgagatttcactcaggagatggatatataacaattgttgatgttttaggtgttttgatctttttaggctattattaggggttgtcataaaaacagtcatcagtttcac

SEQ ID NO: 90 - DNA, 1653 bp, Arabidopsis thaliana
acattgcatttcctaacgctcaacaaaatctctctctactaatatctctctctctctctctctattgttgaagaagactcataatcggagattgtttgtttttggtttgctctgtaaattggagaagttttgttagagatcaaatggctgggatttgttgcggtgttgttggagagactgaaccggcggcaccggttgattcaacttctcgagcttctcttagacggaggttagatctacttccgtcgatcaaaattgttgctgactccgccgttgctcctccgcttgaaaactgccgtaaacggcagaagcgtgagacagtagtgctctcgacgttaccgggaaatctagatctggattcgaatgtgaggagtgagaataagaaggctagatcagcggttacgaattcaaattctgttacggaagcagagagtttcttttccgatgtacctaagatcggtacgacgtcggtttgtggtagaagacgagacatggaagacgctgtctcgattcatccttcgtttcttcaacggaactctgagaatcatcatttctacggtgtctttgacggccatggctgctctcatgttgcggagaagtgcagagaacggttgcatgatatagtgaagaaggaagttgaagttatggcttccgacgagtggacagagacgatggttaagagttttcaaaaaatggataaagaagttagccaacgagagtgtaacttagttgttaatggtgctactcggagtatgaaaaattcttgtagatgtgaattgcagtctcctcagtgtgacgccgtcggatccaccgctgttgtatcggttgtcacgccggagaagatcattgtttctaattgcggtgattcacgggctgtgctttgtcgtaacggtgtagccattcctctctccgtagatcacaagccggatcgacccgatgaattgattcggatccaacaagctggtgggcgagttatatattgggatggagctagggttcttggagttcttgccatgtctagagcaattggtgataattacttgaaaccgtatgtgattccggatccggaggtaacagtgacggatcgaactgatgaggatgagtgtttgatcttggcgagtgatggactatgggatgttgtaccaaacgagacggcgtgtggcgtggctcgcatgtgccttcgaggtgctggtgcgggtgacgactcagatgcggcgcacaatgcgtgctccgatgcggcgttgctcttaacaaagttggctctagcaagacagagctccgataacgtgagcgtcgttgtggttgacttgaggaagaggaggaataatcaagcgtcgtcttaataattagtgttataattagtagtagtattagaataattgttacatagcctaattgtaattgtattctttttatttttctattttagtttttctcattttaaggtgttttttcttttctattttagttagctcttaattcaggctggggaagaaaaagagctgattaaatagtttgagtatttttcttatttttctattcaggtaatattatacatgtattcttttagtatggtcgttggaaatgtaataatctaattcagaggggaaaaatgttaaaatgaaagaacagattatgcgtatttaccatttt

SEQ ID NO: 91 - DNA, 1985 bp, Arabidopsis thaliana
attttaaatagtctctttcgtttatgtatatcacaaatacatatcacaacgttcatatttgcaatgtgccaaaatcctccacgtgttaaatccatttgttcatagtttctcgttacaagacaacaaatggtatcaatgtccacggaaaaattgcatacttgcacgcaatctcttcttcttcttcttcgttcttctcgtagcttgaaataagattcatcagaagagtaaataaacatcaaaatccaacaaaccaaactagaaaaatgtcagtagttttactctcttctacttctgcaacaatcaccaaatcccaatccaaaaagattccctttttatctcccaccacaaaattcccattaaaggtctcaatttctccatcaagatcgaaacttttccacaaccctttacgcgtggcggcgccgccgtctgtacccacttcggattcgacggaggagaagcggatcgaagaagaatacggcggagataaggaagaagaagggtctgagtttaagtggagagatcattggtatccagtttctttggttgaggatttggatccgaatgtgccaaccccgttccagctcttgggtcgagaccttgtactctggtttgatcggaatgatcagaaatgggcagcctttgatgatctctgccctcaccggctcgctcctttatctgaaggaaggttggatgagaatggacacttgcaatgttcgtatcatggatggtcatttggtgggtgtggatcttgcactaggattcctcaggctgctacttcaggtcctgaagctcgtgctgttaaatccccgagagcttgtgctattaagttcccgacaatggtgtctcaaggtcttctctttgtgtggcctgatgaaaatggttgggatagagccaattcaattgaaccccctaggttgccggatgatttcgataaaccggaattttcgacggtgacaattcaaagggatcttttctatggatatgatactctcatggaaaatgtatctgatccttcccatatagattttgctcatcacaaggttacaggaagaagagacagagccaaaccattgccgttcaaggtggagtcaagtgggccttggggtttccaaggtgcgaatgatgacagtccaaggataaccgcaaaatttgttgctccgtgctattctatgaacaaaattgagttagatgcgaaactaccaatcgtcggtaatcaaaaatgggtcatttggatttgctcattcaatataccaatggctccaggaaagacccgttccatcgtttgcagcgcccgtaacttctttcagttctctgtaccaggaccagcttggtggcaggttgtaccaagatggtatgaacactggacttcgaacttagtctatgacggagacatgatcgtacttcaaggacaagagaaagtattcctcgctaaatcaatggagtcaccagactacgacgtgaacaaacagtacacaaagctcacattcactccaacccaggcagaccgttttgttctagcattcagaaactggctcagacggcatggtaagagtcagcctgaatggttcggctccaccccgtctaaccaacctctcccttccactgtcttaaccaagcgtcagatgctagatagatttgatcagcatacacaagtatgctcttcctgcaaaggagcttacaacagtttccaaatcctcaagaagtttctcgttggcgcgacggttttctgggccgccacggctggtgttccttctgatgttcagattcgactggttcttgctggtttatcactgatatcagctgcttctgcatatgctttacatgaacaagagaagaactttgtgtttagagattatgtacattctgaaatcgagtagatttgttgtgtatatgtataatcatcatacaaagtacaaacattgtaaatcaaaatccagaggaacttttagcactataaaaccgatttaaccgttaaattttgggta

SEQ ID NO: 92 - DNA, 2341 bp, Arabidopsis thaliana
atcttttctcttttgctcatttcccagaaacctttgtttcatttgcttcgtgtgcgatcgcgagaacaagggaaaattagggtttatatcctcaagctttttcgaacaccattgatcgttgatctaagatttttcttctagtcgagtttcttaaggggctttgatcaaactcaaaattgaagaccaatactttgaaggattctggtaaagctaagcaactatgagttcaaattcatgggctgatgtttctgaatcagagagggcaccatctggtggtggttggggttattctcgtccgtctcgaaccaactatgttcctccacatcttaggagccgtacaccatcttcggagtttgttgctccttcacctggtaataatgatcgtgggggatatggtggtgcaaatagtggttatggtggtcgaggccaaggttatggtggtcgaggttcgggctatggtggtagaggaggtcctgtgggcggttggaatgccagaagtggaggttgggaccgtcgggatactgaaactaacccgtttggtaatgatggaaatgcagacccggctgttaacgagcaggaaaacactgtcattaactttgaggcctatgaagatattcccatcgagacaagtggggataatgtgccacctcctgttaatacatttgcagagatagacctcggagaagctctcaatctaaatatccagaggtgcaaatacgtgaagccgacccctgtgcagcgtaatgcaattcccatattggctgcaggaagggatttgatggcttgtgctcagacaggctctgggaagacagctgccttttgttttccgattattagtgggattatgaaggatcagcatatagagagaccacgtggagttcggggagtctatcctcttgctgtcattctctcaccaacaagggaattggcttgccagatacatgatgaagccagaaagttctcctatcaaactggagtgaaagttgtggttgcttacggaggaacaccagtcaaccaacagattagggagcttgaaagaggagttgatattcttgttgcaactcctgggagattaaatgatttgcttgagagaggtagagtctcattacagatggtaagattcttggcacttgatgaggcggacagaatgctggacatgggttttgaaccacaaatcaggaagatcgttcagcagatggacatgcctcctcctggtgtccggcagacaatgttgttcagtgctacatttcctagggagatacagagacttgcatctgattttctttcaaattacatatttctggctgttggaagagtgggttcaagtacggatttaattgtccaaagagtagagtttgttcatgattctgacaaaagaagccatctaatggaccttcttcatgcccagagggagaatggtaaccaaggaaagcaagctttgactctagtttttgtggagacaaagaagggagctgactctttggagaattggttgtgcatcaatggtttcccagcaacgaccattcatggtgataggtcacaacaggaaagagaagtggcactgagatcattcaagactgggcggacacctattttggttgcaaccgatgtggcagcacgtggtcttgacattccgcacgtggctcatgtagtgaactttgatctaccaaacgacattgatgactatgtccaccgtatcggacgaacaggacgtgcaggaaattcaggactagcaactgctttcttcaatgacaacaacacaacaatggccaagccactggctgagctaatgcaagaagctaaccaggaggtccctgactggctgactcgatacgcatctcgtgcttcatttggaggtggtaagaaccggcggtctggtggacggtttggtggtcgtgacttcaggagagaatcttttagtcgaggcggtggtggtgctgactactatggtggaggtggtggatatggaggcgttcctggtggtggctatggagcaatgcctggtgggtacggacccgtaccaggtggtggatatggaaatgttccgggtggtggttatgcaccttatggtagaggtggtggtgcttactatggtcctggaggatatggaaccgttcctaaccaagggtatggtcctggagtggctagtgcgtgggactaagctttaacttcaattcttcaagaaccgattatgttctctttctctctcacttatctctattgtttattattagggagcagccacagatgtgtatgtttgctctttaaatggttatgtagtagacacgaatcgtctctttgttcaatgtgaaaaaagaaaaccccctagtagacccatatt

SEQ ID NO: 93 - DNA, 1740 bp, Arabidopsis thaliana
aaacgccgaattctcatattctacataagacatggctctctttattatccttcctgtatattttttccttcataatatattactatccttctcgtttattaatacaaacttgaattcttcttcttcttaactttgtctgtcaattcacatatatatagtaccaccatcacataagtatctcataacacatcatggtgaacgaagaaatggagtcatcacttaaagtcatcgacgtggcacgagtcacaccatcaaactccgactcgtccgagtcactcactctcccactcaccttcttcgacctcctctggtacaaacttcacgccgtcgaacgagtcatcttctacaaactcaccgacgcaagtcgtcctttctttgactcagtcatcgtcccaaacctcaaaacatctctctcctcatccctctctcactacctcccactcgccggaaaactcgtgtgggaaccacttgatcccaaaccgaaaatcgtctacaccccaaacgacgccgtttcattcaccgtcgccgagtcaaacgcagacttctcacgtttaaccggcaaagaaccgttccccaccaccgagttatacccgttagtccccgagttacatgtctccgacgactcagcttccgccgtgtcgtttcaagtcacgttatttccaaaccaagggttttgcatcagcgttaatgcacatcatgccgttttagatggaaaaacgacaaccaactttctcaaatcttgggcacgcacatgtaaaaaccaagattcttttctaccgcaggatctaatcccagtttacgatcgtacggtcataaaagatccaatggatttagatacaaagatcttaaacgcttggcacagagtagccaaagtgttcaccggtggtaaagaaccagaaaaccccaagagtttaaagcttttatggtcgccggagattggtcctgacgttttccgatacactctcaatctcactagagaagatatccaaaagcttcgagagagactcaagaaagagtcttcttcttcctctgtttcctcatcacccaaagagcttcgtttatcaacgtttgtgattgtttactcttatgctttaacgtgtttaatcaaagctcgaggcggtgatccgagtagaccagtcgggtacggattcgctgtggattgtcgaagccttatggttccaccggttccatcgagttattttggtaattgtgtatctgcttgttttaaaatgtcgttaacggcagagacttttatgagtgaagaagggtttttagctgctgcgagaatggttagtgattctgttgaggcattggatgagaatgttgcattgaagattccagagattttggaagggtttacgactctttcaccaggaacacaggttttgtctgttgccgggtcgacccggttcggagtttacgggttggattttgggtggggtagaccggagaaagtggtggttgtgtcaattgaccaaggtgaagcgatttcttttgcggagagtagagatgggagtggtggtgtagagcttggcttctccctcaagaaacatgaaatggatgttcttgttgatttgcttcacaagggactagaaaattaaatcatttttttctttcttcagaagagtaaaataatataagaaataaaatttattgtggaaaattgtagctttctattgtcaaataaatctagtttagagttccagcttcaccaggaaactcaatctttgaaccacatat

SEQ ID NO: 94 - DNA, 1050 bp, Arabidopsis thaliana
actgtgtacaataccagccgacacttaacaattcacacctgctctttttactctttctaaaaccctaaattttctcgcttcagtcttcccactcaagtcaaccaccaattgaattcgatttcgaatcattgatggaaatgatttgaaaaaagagtaaagtttatttttttattccttgtaattttcagaaatgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaacaaagattggtgaagtggatctctctctgtatatagatacataaatacatgtatacacatgcctatttttacgacccatataaggtatctatcatgtgatagaacgaacattggtgttggtgatgtaaaatcagatgtgcattaagggtttagattttgaggctgtgtaaagaagatcaagtgtgcttgttgaacaataggattcactaacgaatctgcttcattgaatcttgtatgtaactaaagccattgtattgaatgcaaatgttttcatttgggatgctttt

SEQ ID NO: 95 - DNA, 1642 bp, Hordeum vulgare
cagcttcactccacagcgtctcggcgagggtttcggcggcggagaggatatggccgggaagaagagcgccgcggtgacccccgcgccctccgacggcgaggagagcgccggcgttcccagctccgctgccaagcgccagtccggcagacataagaaggaccccgccgccgccagccccggctccactgccaagcgcgcggccgggaggcctaagaaggtcgccggccccgccgagggctcagctatgaatcccgcgaagggcgacatgggggaggaggagaagggggcgaccccgaagaagaaggagaagggggcgaccccgaagaagggggagaaggcggcgaccccgaagaagacggagaagaagggggagaaggcggcgaccccgaagaagacggagaagaagggggagaaggcggcgaccccgaagaaggcggagaagaagggggagaaggcggcgaccctgaagaaggcgggggagaaggcggcgatcccgaagaaggcgggggagaaggcggcgaccccgaagaaggaggaggagaaggcggcgaccccgaagaagacggagaagaagggggagaaggcggcgaccccgaagaaggaggagaaggcggcggccccgaagaaggaggatgaggagaaggcgacggccccgaagaagaaggagaagggggagaaggctgctgccaagaagaaaaaggacaagggggagaaggcggcgaccccgaagaagacggagaagaagggggagatgggggacacgctggccaacatgaagaagaagaagaaagagaaggaggagatgggggacacgctggccaacatgagaaagaggaagcacggcgatctggaatccccaaaggcggcgaagaaacacaagggcaaggcggcaggagcggcgccggcggcaaccgagcccggcacctgcagcttcccgatggcgcgggtgcgggtgctgatgcgggacaaggacgccaccatccgatctaacaccgagaccgtcttcctcgtcaacaaggcctcggagttattcttggaggcatttgtggaggatgcttatcagaatgccctgaagggacgcaaaaagtcaattgcctacgataacctttcggcgggtgtgtgcaatgagaaacggtacaagtttctatcagatttcgtgccgctgagggtgaccgctggagatgcactcaaggctgtggtggagcggtcttagacagaggaggtgtcagtcctagaccatgagggagacacgcatgatcgccataggttctcttgtcgtgcgctaagctagcctgtgctgttttgtagggagggagacggtggaggtagggttgtctgggctactatgttcttctatagtaggttaggttgagaccagcgtagtttatggagaatgtatgttgtgcgaatttatggagaatgtaggctgagaccagcgtagttcatggagaatgtatgttgtgcgaatttatggagaatgtaggctgagaccagcgtagttcatggagaatgtatgttgtgcgaatttatggagaatgtaggctgagaccagcgtagttcatggagaatgtatgttgtgcgaattggagcggcaacccacccaccccttgtggcaatgcatgttgatgtgtgtctggtctga

SEQ ID NO: 96 - DNA, 1632 bp, Hordeum vulgare
tattcaaaagaacaaactcaacttgtggtgcttgaaattccgtgtccttgatgaggctgatgaaatgcttaacatggggtttaaggacgatgttgagcttattcttggcaaggttgaagatgttactaaagtacagacgcttctgttcagtgctactctacctgattgggtaaagaagctctcaatgagcttcctgaaagccgacaggaaaacagttgatcttgttggcaatgagaaaatgaaagctagtgcatctgttaggcatcttgctcttccttgcaacaaggccgcaaggtcacagattattccagacatcataaaatgctacagccatggaggacgtaccattattttcaccgagacaaaagaatctgcatctgagctctctagtttgattcctggatcccgtgccctgcatggagatatcgcacaagctcaacgtgaagtcgtcattgctggatttaggagcgggaagttccttgttttggttgctacaaatgtggcagcaagaggccttgacattaatgatgtgcagcttatcattcagtgtgaacctccacgtgatgttgaagcctacatacatcggtcaggtcggacagggagggctggcaatactggcattgcagtcatgctttttgatcccagatataaattcggtgtgagcagaatagagagggagtctggggtgaaagttgaacatatatctgcaccgagcctactgatgtggcacaatctgctggcaatgaagcagcagaggccatttcaagtgtttctgacagtgttattcctgtttttcggcaacaagcagaggaactgctaagctcctccagcatgtctgcagtcgatctactagccaaagcactggcaaaggcagttggctacactgacataaagaagagatctttgctttcatctatggagaaccatactacgttacaccttcaaactggcagatcgatgtatacaccatcgttcgtcattagtacattgaaaaggttcatgccagaagataggctttcaagcgtacatggtataaccctcacttctgacgggacaagcgctgtatttgatgttccttcagcagaggttcaagattacattcaaggcgcggagaacgcagccgggttgacaattgatgaagtgaagcaactgccagccttgcaagagagggagcagtccaagggtaactttggtgggtcgaggtttggccgtggaggtggtggaaggagattcggcgggggcggaggcgggcgatttggtggtggtggaagaggcaggggaggcggtggtgggaggtttaacaggaggtgaagatctataagagtataatctatttttgacgggagtttgagagatgaaagaaggcacagggaatcgtcaaagttttgactgcgccgtgtatccgggtttttgttttgttttatttgttagtgctttgcccccgagattatgacgatcaagtttgccaaactgaaacagtgtaaaatatttgatctgatactcagccactgttatgaaggagtatacttcgatgttgtgttgttttgagacatgcagcctcagttatcagctcttataagtacaagtctatttttggatgcgggggaaccaataatttatagaacggcctct

SEQ ID NO: 97 - DNA, 1274 bp, Hordeum vulgare
agcagagagagagagaggagactttgcagaggaggggaggggagagagagagagagagagaggcggagcaagttgcggaggagggaggaggggtcgccggaaaggggacatgctcccttcacatctcacatctcacagcttgaactgaaagcaagagtagaagcccatgagatgagacgcaagcaaaatatgcatgaaaatggcacaatcatgattcagtttggtcagcaagtgcctaattacgagtcatcagctagcgattctcctcgagaagtgtccggaatgagcgaaggaagctttaatgagcagaatgatcaatctggtaatcgtgatggttacacgaagagtgatgaaggcaagatgatgtcggctttatctctgggcaattcagaaacagcgtacacaccgccaaaacctgaccgcactcatcccttcgccatatcatacccatatgctgatccttactatggtggtgcggtggcagcttatggcacgcatgctattatgcacccccagatggtgggtatggtaccatcctctcgagtgccactaccaattgaaccagctgctgccgaagagcccatctatgtaaatgcgaagcaataccatgccattctccgaaggagacagctccgcgcaaaattagaggctgaaaataagcttgtcaaaagtcgcaagccgtacctccatgagtccaggcatcagcacgcgatgaagcgggctcgggggacaggcgggcggttcctcaacgcgaaggagaagtccgaggcggcttccggcggcggcaatgcatcggcgaggtctgggcatgccagcgttcctgcggacggcggcatgttctcgaagcacgaccacaccttaccgtccggtgacttccattaccgcgcgagagggggcgcctagggcggcgccgttgccccctggcaaatcatccttggcttatgtgtgtggcgaccgtcaactcggtcgaatgataatactgtagtaaactgaaagatttggggattgaaactgttacttggggtgtttggtagacagtctgttccgtttggggacgatgcgggccagtctctctgttggtggtagattcgtggcacggcaggtgctgctaagctggagcctgcttgaactgtttttcctgtcacttttatggggtaataaggaccatcatgtatgatactgggagcactcctgagtcggcgtcaattaccattcgccggcgttgatcctttgcgcacgtggggggtgtgtttatttagaactagaaaaaaaaa

SEQ ID NO: 98 - DNA, 522 bp, Hordeum vulgare
ccggctggatacgtgtgtcatccaccaccccttcccatcctgctctgctctgctcagctcagctcagctctgctgcctcccctccatccaccgagtgaaaaaagctctccgtccgccgaaggatcgaccatggcgggcacggccaactgcatcgacatcatcctcgccatcatcctcccgcccctcggcgtcttcctcaagttcggatgcgggcacgagttctggatctgcctcctgctcaccttcctcggctacatcccgggcatcatctacgccatctacgccatcaccaagtagagccgagccgtcccgagtatgctccgcagcacagtattttcaggatgatgatctcgtctgtctagtcgtccctccttgcttgtgtgggttcttttaattcttttccgtgtatgctgatgaagtgatgatgcaaattcctctgtggtttccatggaccatgtgaagaagcagcagcttctttatgtattatatatttatataaatgtatgagagcactctttggta

SEQ ID NO: 99 - DNA, 882 bp, Hordeum vulgare
atcgtgatcaccccacgccgtacctgtctgtcaccgtccattcccatcccatcccatcccactccaccagtccacaccgcagcagcactccagtgagctcgaaaccgagagggcaagaagaggaggaaccgatacagcactacaggcaaccatggaggtggtgaccggcagcaacggcgggaggctgaacccgtgggcggagcccttcgtgccggggagctggtgccgccccgcccccgtggaggctgcggcgtcggcggaggtcgaggacttctcccccgagtggtggcgcctcgtcgcctcctcgccgtccttccgcgacagctggctccgcgactacggcgacatgggtcttctggacgccgacgagtgcccggacgacggcgacgccttcttccctcctccggcgctgccgcgcaacgcagagggagaggggaggaaggaagaagccgccgtcaagaagagtgggggcgaggtggcgccctgggggatcgagaagtggtggcgggcgcacgtcgcctcgccgccggaggtcccgaagtacgcggagaaggcgcctgctaaggtcctcggcggcggcggcaggttcagcccccgcaccatccagcagcctcgctaagggaccggcgaatctcgtcgctccgtgtccatccaccgagatcttggcataaatgaggaaaatatactagaaaaaaatagtaatcctagttgttctgcgagctctcctgctccggataatcttgttgtgtcgttgtagtttgagttttcagccaaagatcgggcgaaggtcaattgcgctgcgtatgtacagttgtctgtaaatggtgtagtctgtaataagatgcagtgatacaatggctattcagtgcaaatggttctccc

SEQ ID NO: 100 - DNA, 710 bp, Hordeum vulgare
caaactcacaagcaagctcagtcagcacgccatggtgacgatgaagcgatgcatggttcctaccatcctgctgatgcttgggctgcaggcagcccagctcgtcgccggcgacgatgtgggcgccattctcctgccgagccaagcccaaggcgaagcagccatggcggcggccaagaagaggccatggaagtgctgcgacgagcccttctgcaccaggtcgttccctcccatctgcacctgcatggaccaggtcttcaagtgccccaaaacctgcaagtcctgcgggccgtccgcggctgacccgtcccgccggatctgccaagaccagtacatcggcgaccctggacccatctgccggccgtggaagtgctgcgacaagcctacctgcaccaagtccaacccgccgacgtgccgctgcggcgacgaggtcgacaagtgtgctccgacgtgcaagacctgcctgccgtccaggtcgcgcccttcccgccgcgtctgcatcgacagctactttggggccttcccgccaccgtgcacgccccgagaggccgtcgccgccggcggcaagtagctaccgcgcgcgcgtacgcgctggtcacccgatcgatcagcgtgccgttgatcgaatcgccacgtcgtctgtactgcgacctcgcttgcagcagcagcgctctgcagtggttgacaatataataaacatgtttctgaacaaa

SEQ ID NO: 101 - DNA, 1896 bp, Hordeum vulgare
ccactcgacagtagctagctaacggtctataggcgagatgagctggttgccggcgacgagggcgctctcctgcgtcgtccttctcctcctccttgtcgtcgccgtcgcgcctccggcgtccgcggcggcgatcaccaggggcgacttccccacggggttcgtcttcggcaccggctcctccgcttaccagattgaaggtgcagttgcagaggacggaagaaaacccagcatctgggacacattcacacactcaggctactcgcccggcggagccactgctgatgtgactgcagatcaatatcataagtacaaggaagatgtaaagcttttgagtgagatgggcgttgatgcataccgattttccattgcctggcctcggctcattcctgatggccgaggagctgtcaatgcaaagggactggagtactacaacaaccttatcaatgaactcctacgtcatggaattcagcctcacgtaacagtatatcatttcgacttacctcaggctcttcaagacgaatacaacgggatgcttagtcgtaaattcatagatgactacacggtgtatgcagatgtgtgcttcaagaattttggtgacagggtgaaatattggagcactctgaatgagccaaacattgagccaattggcggatacgaccaaggattctttccaccacagcgatgctcattgcccttcggcatcagttgcaacaatggcaactctaccacagagccctatatagtaactcaccatcttctgcttgcacatgcttcggcagtgtccctgtataaagagaagtaccaggacaagcaaggtggaaaaattggactcacattgctcggttcgtggaacaagcccgcgacacaaacacctgaggatatagcagcagctgcaaggatgaatgacttccacattgggtggtatatgcatcctttggtgcatggagattatcccccagtgatgaggaagaatgttgggtccaggctaccatctttcactgctgaagagctgaagagagtgcttgggtcttttgattttgtcggatttaaccactacgccgcctcatatgtgaaggctgatcttagcaagctggatcagaagctgagagattacatgggtgatgcagcagtgagatttgaaagcgtgccattttttgacttaaagaaccagtcgtcaccgtgggttctgagggaaatgctggagcatctccaggtcaaatacaagaaccctgtggtcatgatccacgagaacggagctgccagcgtggctgatccctctggtgataaggccctcgacgacgagttcaggtcgcggtacctgcaggattacatcgaggcgaccctccaatccagcaggaacgggtcgaacgtgcagggctacttcgtgtggtcattcgtggacatgttcgaattcctctttggctaccgcatgggcttcggcctctatggcgtcgacttcaactccgaggagaggacgaggtaccggaggcactccgccaagtggtatgccggcttcctccgtggcggcgagctcaggccggtggctgtccccggccaggcgtattcccagtgatcttggcacgcattttcaggcttctgtagcccacgaataggaggatggatgacgaataagcctgggaggatgattggttcttgtttttggatgggagttcaattttgcttgggcagtaggatttatacatctgcttctttggagtcgattgttccttatacattataaatgttcatcctgatgtatgtgctgaaaatattaatatatttcgatatgtatacatggtgtcggatttggtagtccgagattgaaatcacgtacctgcatttgggtagtacctgcaatgctgcgaaatcttaaagtgacacttatttttgggaccc

SEQ ID NO: 102 - DNA, 956 bp, Hordeum vulgare
cggcacgagggccgcccccaaacgaatcgcacccgcctgcgccgccttctcttctccagcgtcggatctccccccactcgccgccctcaccgcacctccattccccccctccaccaccttcactccacgcgctcgtctatataaggaggagggccggatgtcggacgcgccggcgagccccccgggcggcgggaacgggggaggagggggaggggtgggcagcgacgacggcggcggcggcggatacggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggccagcgacaagtgccagagggagaagcgcaagaccatcaacggcgacgacctgctctgggcgatggccacgctcgggtttgaggagtacatcgagcccctcaaggtttatctgcagaagtacagagagacggagggtgatagtaagctagctgggaagtctggcgacgtctctgttaaaaaggatgcacttggtcctcatggaggagcaagtgcgcaagggatgggccaacaagtagcatacaatccaggaatggtttatatgcaacctcagtaccataatggggacatctcaaactgaagatatggaccatctccgtgactgctgctgctctcctaggtgggttttcgtcatttggagcagttaaggaaactcttagtaccctcattagtcctgtgttgttcggtctgccagaactgatgctccaaggctgctttcccagatgtaaattgctttttcctgagaatagattcagttgtggtttagcatggttgttgttgttgttgccgtctgtaactctgtatatttatgatgttttaacagtttagcctcgtcg

SEQ ID NO: 103 - DNA, 1477 bp, Hordeum vulgare
gcaagcttccacctccttctccgctcttcccccgtccgtcctgcctgctcattatcggtccaccgatcgctcagcagaagagagaggagaggagaggagagaagagagaggaggagcacgacgaggatgagggggtggagagaggaggtggtggcgctgtcgctggaggcgcgcggccccggcgacgaccggccggagaagccgcgccgctacggggtcacggagatgaggagcccctgctactccttccgccccgcccaccacgcgctccaggaaatattggattccctcggtccttttgttgatggcctgaagttctccggtggatctcatagtttgatgggaaaggaactgatcagagagatcactgatttagcgcacaagcatgacatgtatgtgagcactggtgattgggcagagcatcttctgcgccaaggaccctcttctttcaagcaatatgtagaggaatgcaaagagttaggttttgacaccattgagctcaacgctggatctctcaagcttcctgaagaggctatcctgagactagtccgcctcataaagaacactggcttgcgagccaagcccctgttttcggtcaagttcgacagttctgagatgcctgcagctggtgatagggcatttggggcttacatagctccagtgaagcggagctcagaaagagtcgaagacgttgacctgctgatacggagggccgagagatgcctggaggcaggtgcagatatgatcatgatcgacgcagacgacgtctgccagcgcacggattccctcagggcggacatcatcgcgaagatcgttggccggctcgggctcgagaagaccatgttcgagacatccaatgccaacacctccgagtggttcgtcaaacgatacggcccacgggtgaacctcttcgccgaccactccgaggtgatgaacctggagcgcctccgcggcttggacgtgcgccggagggtccgccccttgctcccttcgccgttcttcctgatgtgatgacggccttgctgagtaatgatatgggactggggcctaagcgaagtgttgatggagctgagttttctgtactgggaggagttgtgtgaactgtactgagggacctaagcgctgtgttgaagtagtagcgagtcccggagccgaggcggcagtgtgttggtacttggtagcaggtaataaggatgaggctgtgtgtgtatgatctcggggtgatttgcactgggagtaagtcctactacttgtttcgaatgtgtgtgaatgtgatgatgcatctagagcaagattgcaaggattgctgggatgaacaaaagagatgacgtgtacaccgattcctgaagacgacgggaacaatacgggccttcgctgcattgcttaacagcaactctagctgatccctgtaataaccagttgctccctgtataaccgctaaccgatcgacatatagccgtaatcgtatatacttctg

SEQ ID NO: 104 - DNA, 1089 bp, Hordeum vulgare
atcaaacccagacagatagctccgcatttacccccaaatagatcgatccaagcaagccatgatgagaccctgctgcctctccctggccctcctggtcgccctgagcgccgtcgggtgcgcggcggcgcaggcggccgactacgacttcttctacctcgtgctgcagtggccggggtcgtactgcgacacgaagaagagctgctgctacccgcggacggggaagccggcggcggacttcgggatccacgggctctggcccaaccgcgacgacggctcctacccgcagaactgcaaccccgccaacgccttcgatccctccaaggtgagcgacctgctgagcagcctgcgcgcggagtggccgacgctggcgtgcccggcgagcgacgggctccagttctgggcgcacgagtgggagaagcacggcacctgcgcgcagaacctcttcaacgagcacggctacttccagacggcgctgcacctccgcgaccagctccgcgtcctcgacgcgctcgcctccgccggcgtcgcccccgacggcggctactacacgctgagcgccgtcaagggcgccatccagcaggggacggggttcgagccgttcgtggagtgcaaccgcgacgagtccggcaacagccagctctaccagctctacttctgcgtcgacgcccgcgcctccggcttcgtcaagtgccccgtccagcccggcggaaggccttgcggcgaccggatcgagttcccggccttctgatgcgccgatttctgttttcctcctgatttctgttttcctcctgattcattccctgcgttattatttatatagcgaagtttgagcgctcgtgatgttaatgaagacagtgtatgtcatgaaatggtgtaaacatgtggagggagcaggttgctatttattattcagataaacaagaagcaatactctacattttttggtcacatgcagcctctgattgcttgattgagagccgacttaggctatgtttggaaccataatagattatgataatctgaattatgaagatagattatataatctggtttataaaaataatttaggtggacatgtttggaggccag

SEQ ID NO: 105 - DNA, 1181 bp, Gossypium hirsutum
ggcacgagcttcaatatattatttctaaaaataaaataaataataaaaagggaaaactcaacgaacggtgttgataaaacctggttggctcatcagatctgatctgagtcgacttatctttttcctttcttctccagcgtccgattttcccttgaaaatccaatctctttcactcccgcccttttccatttttctttttaatcaatttcaatttttttcccactttctggattctttacatggcgacgtcggcaccggttccggcgagtccaggcggcggtggaagtcacgagagcggcggcgagcaaagcccgagatccaacgtgcgagaacaagagaggtttctccctatcgctaacattagccgtatcatgaagaaagctctccctgctaacgctaagatcgctaaagatgctaaggagaccgtacaagagtgcgtttcggagttcatcagcttcatcactagcgaagccagcgacaagtgccagaaggagaagaggaagacaattaacggggacgatcttctctgggctatggcaactttagggtttgaagattacatcgatccgcttaagatttaccttaccaaatatagagagatggagggtgatacaaagggttcggttaaaggtggagatacatttgctaagaaagatgtccaaccaggtccaaatgcccagcttgctcatcagggttcattctcgcaaggtgtttattatgggaattctcaatctcaatcacaagcccatatgatggcttctgatgccaggcactgagaacgagaccaaatccttcttgagccaatttcatcatccaaatctcattgaattatcatgtttcaatggtggcagaaacaggtgtgaaaaactgacattttggatggttcagatcatccttcacatgtaagctgttaatatcagtatatttggagtagattgagttgtgtgaaagaaatggtgtaaatgttaagagggtattattgtagatttgaactgttggagagaacataatattgtgttattaatgacattgtttagggaacttggtagtttatgttcatcatatatttataactgaacaatttaaggttcaaatacaatgtacaaagtttatttatgtgattgctgatttctactcaagaaaaaccaaaatattaaaaagtgcagacatgtctgccgcct

SEQ ID NO: 106 - DNA, 2714 bp, Gossypium hirsutum
aaaaaaaccctaagcaaaacgtcgaaggacaaaaatggggaagaagaaaaaccaaaagcagcaaccatcagcctcaaaagacgatcttctcaatacgctcggagacttcaccagcaaagaaaactgggatagcttctttaccatccgtggcagtgatgactcgttcgagtggtacgctgagtggcctcagcttcgtgactcacttctccctcttattcaacaacacccatcaccctcttccccttctccttcttcttcgttgcaaatattggtgcctggttgtggcaactcccgattatcggagcatttatacgacgccggatttggtgatataaccaatatcgatttttccaaagttgtcatctccggcatgcttcgacgtaatgtaagggaccgacccaacatgcgttggcgggttatggacatgacccaaatgcagttcccagatgacactttcaatgttgttctcgacaaaggtggattggatgctttgatggagccagaacttggccctcagctagggactaaatatttgtcagaggtcaaaagagttttgaagtccaggggaaagttcatttgtcttaccttggcagaatcccatgttctaggtttgttttttccgaagttcagatttggctggaatgtttgcctttatgctatacctcagaaaccatctactaagccggatctccaaacttttatggtggttgctgagaaggaaagttccaatgaacttcaccagatcatttcatctttcgatcattcttcccttgcttgcaatccaaatcagacttctggtcttcttgaagcccttgaaagtgagaatcaaatacgtggagaatacttgaatggctctgatgtactgtattctcttgaagatctgcaacttggagctaagggggatctgaaaaaacttagccctggtcgtagagttcagcttactctgggtgaccaaggggtctcacacttttgttacaaagctgtattgcttgatgctaaacaacagtctggggcattctcttttcactgtggtgtctttattgttcctaagactcggtctcatgaatggctcttctcttcggaagaaggacaatggcaggtggttgaaagctcaaaggctgctcgtctaataatggttttattagaggccagccatgctaatactggtatggaagatattcagaaggatttgtctcctctggtgaaaccattggcacctgctgataatgataaaggaaatcaaattccgtttatgacagcaagtgatggaatcaagcagcgaagcgttgtttaccagggatcatcttctttaactggtcccgttgttattgaagatgttgtttatgaaaatactgatgatgatgtcagtcactctttacccttccgccgccttgtcttcgaaagaactgagggcctggtacagtctgaagctttgctaactagggatggattgtttgacaaaagtgtttacggaacagagaagaagaaagccagttcatcttccaaatccaaacgaagaggagccctcaaaagaaataatgaatcaagcggcaaaatgaaggtgtatcatggttatttggccagttcttatcatacagcaatcatttctgggttttctctgatttcatcctatttggaaagtgtggcatcatcagggaatagggttaaagcagttgtgataggtcttggtgcgggcttacttcctatgtttcttcatggatgtatgcaatctatgcaaattgagggagtggagctagatcctgttatgcttaaccttgcaagagactattttggttttactgaagataaacgaatgaaggtacatattgctgatggcatccagtttgtccgggactacagaaacttattttcagctggcaatgaagtgctcctttcttccaacggaagttgcaaactttcagatgctgaaagcagaagtaccgctattgacataattattgttgatgtggactcttctgactcaagctctggactgagatgtcctgctgctgattttgtggaagattcttttcttcaaaacgtaaaagatactctttccgagcaaggtctctttgttattaatttggtctcaaggtctcctgccatcaaggatgcagttgtctcaaggatgaaagaggtttttagccacttattttgcattcagctggagggagaggtcaacctagtacttttcggtctttgttcggagtctcacattgaggaggattgcataccagatgctgcccttaaacttgataaattgctcaagtccgaacatcccgagataagccagagcatcacagatgcagcaaagaagctcaaacgtttaaagtgaagaccgtttgataacaaagtttcccctttaatgtattctcaagtaactcgagagcaagcttttgcagattttgaagcaaatggcattgaaactgggtgactgaagattgcgccacagaatgagaaaagtccgaggtgggtttttatttcctttctttgaatggtatgcattctgcatcatctccagtttggttgctcgatgtcttaatacttctgtcttgcatcgtttttgcatacattttaagcattacagtcgggggcccgaatttgaaatataccctcttcaatatgtaatagtattaacctgtaaatcacaccactgggtgtacaaaattagacaggatttttatttgacttaatcgattcattgagatttgagg

SEQ ID NO: 107 - DNA, 1535 bp, Zea mays
aacaccaatctgttcctctgttggttcgccgccctacgctggtgtggtgggcgctggccaggcaccgcctccggcctccagcttctatttaagaaggcgccccccgccaccatcctacccaccacacaccacacaccaccaccaccgcacacccggcggcgccaagcccttcgaccaggtagctgaccagcatcagctgagccgagcggcagatggtttcgcggccgctagaggcttagcgtcgaggaagaggaggaagcggcgtgccacatgttgagtgagcagacggcggctagcactagcagcagcggcggcggcgtcgagcgtcaggacaggtggctgcagccggtggcggagaacgaggaggaggaggaggagttcagggacatccacgcgctgagcccgccgccgagccagccgtcgtcgtaccgccgggcgcgcggcggcgagccgtgggggtccgccgcgggcgggagcaggcacacgtccgtccgctccgtggggagcgacaccgcgcccagcgagcccttcccgactatgaccagggagttctcggccatggtcgccgcagcagccagcgccgcagcagacagccgtgacgccggcagcgacgtcgtgggcagggccgaggaggaggaggaggaggagctggaggagaccaacccgctggccatcgtgccggacagcaaccccatcccgtcgccgcgccggggcccgccgcccgccgccccgggcgccgacgcggcggcgctggtggccgccgacgggcacggaagccgcgaaggcgggggggtgtccgtggggcaggtcaggaaggaggaggtggagtccaagatcgccgcgtggcaggtcgccgaggtggccaaggtcaacaaccgcttcaagcgcgaggaggtcgtcatcaacggctgggagggcgaccaggtcgagaaggccagcgcgtggctcaagaagtacgagaggaagcttgaggagaagcgtgccaaggcgatggagaaggcgcagaacgaggtggccaaggcgcggcggaaggcggaggagaagcgcgcgtccgcggaggccaagcggggcaccaaggtggcgcgagtgctggagctcgccaacttcatgagggccgtggggagggcgccctccaccaagcgctccttcttctgaacccaccggcctcttcttcaccagttcctctgtcttgccgccgccgcctgtgcagttcagttcagttcagttgtcctgtgggtcggaccgttcaccgcttcactccacgggatcaggcacagtgatcagtgccgtgctagctgtgtggaacgcttgttttagtgttgtatccacatgtacgatttgtaacgtttccttgcttctcccgtttcgtgttttcgtatggtatctatggtattgcaaagtccatggccacgatagacagggaaagcatatgtatacaccattagaaggatgtgctctgcgcctctgcccgagtcttgaggacaggagctgcatgtatttttcaccaatataatggttgtgtatgtcaattacga

SEQ ID NO: 108 - DNA, 1265 bp, Zea mays
cgcatagccgcatatatttggcagcaggagcggcctctcacttgcttcgacgtatttctctatctatctatacggttcaagggaccgaagaaggtagagagagaaacttgaaggggagaggaaggagatacaggttcatgttcatttaggtgtcagttcatctgatttctcagaagcaaaatgttgtttggagctcagtgacaccatcttgtaatgcatgtgccttttacgggaaatggaggatcattatgtccatcccaagtctaagtctaaccatggctccttgtcaggaaatggttatgagatgaaaaatccaggccatgaagtttgtgatagggattcatcatcagagtctgatcgatctcacccagaagcatcagcagtgagtgaaagcagtctagatgaacacacatcaactcaatcagacaatgatgaagatcatgggaaggataatcaggacacattgaagccagtattgtccttggggaaggaagggtctgcctttttggccccaaaaatagattacaacccatcttttgcttatattccttatactgctgatgcttactatggtggcgttggggtcttgacaggatatgctccacataccattgtccatccccagcaaaatgatacaacaaatagtccggttatgttgcctgcggaacctgcagaagaagaaccaatatatgtcaatgcaaaacaataccatgcaatccttaggaggaggcagacacgtgctaaactggaggcgcagaacaagatggtgaaaggccggaagccataccttcatgagtctcgacaccgtcatgccatgaagcgggcccgtggctcaggagggcggttcctcaacacaaagcagcagccccaggagcagaaccagcagtaccaggcgtcgagtggttcaatgtgctcaaagaccattggcaacagcgtaatctcccaaagtggccccatttgcacgccctcttctgacgctgcaggtgcttcagcagccagccaggaccgcggctgcttgccctcggtgggcttccgccccacagccaacttcagtgagcaaggtggaggcggctcgaagctggtcgtgaacggcatgcagcagcgtgtttccaccataaggtgaagagaagtgggcacgacaccattcccaggcgcgcactgcctgtggcaactcatccttggcttttgaaactatggatatgcaatggacatgtagcttcgagttcctcagaataaccaaacgtgaagaatatgcaaagtccttt

SEQ ID NO: 109 - DNA, 1198 bp, Zea mays
aagacgagggataaaagaacagcgcaagtggagtgatgcagccgagggggccagaccagaggaagggacggcggggaggtggcaaggcgcagagagcaggttcgcttggcggacgcaccgagggaggcgtgtgggagccatgcttcttccctcttcgtcttcgtcttccgcttccgcttccaaaggtaactcctttgggaaaaccgttaacgatcatctgaggtcaactttgagttttgataacaagcaacctccatttgcgagtcaaaactttgactacggtcaaacaatagcttgcatttcatacccgtacaatcgttctagatcaggagatgtttgggcagcctatgagtcacgcaccagcactgccactgtgttccgttcccaaattgctggtgggggttcatccacaagaattcccttgcctttggaattagcagagaatgaacccatatatgtgaatcccaaacaatatcacgggatacttcgcagaagacagttacgtgccaagctagaggctcagaacaagctagtcagagcccgaaagccttaccttcatgagtctaggcatcttcatgcaatgaagagggcacgaggttccggtggacgattcctcaacactaagcagctccagcagtctcacacagccctcaccaggtccaccaccacaagtggcacaagctcctcaggctcaactcatctgcggcttggtggtggcgcagccgcagctggagatcgatctgtgctggcacccaaaacaatggcctcacaagacagtagcaagaaggccgtttcttcagccctcgccttcactgcgactccaatgctgcgcagagatgacggcttcttgcagcacccaagccatcttttcagtttttctggtcattttgggcaggcaagcgcgcaagctggcgtccataatggaagtcagcatagggttccagttatgagatgaccggtttgcgaaccatagctggtgatccaggcgtctagggtcaacttcgctgtggtgtcttagtctctcaggcaattcatccttggcttaatttctggctttttattagaaggtaccaaaatgtgttccataccgttgtggccacagagcccataaaccagggggtttgatggttggcactcctacccaaactattgttgcagtggtgtttgttagaataaaccttgactattattctgtaca

SEQ ID NO: 110 - DNA, 1726 bp, Oryza sativa
ttcagactctcccactctcttctcccccctaattatctctctctccctaccacgtcgtcttctcttctctatcttctccgcctccgggaagaaggacaagaggagtaggagctccagttgcatggacaagggccacctcggtggtggcggaggaggaggaggtgggctgctcgctctggacgcgtcgccgcgcccgctcggcttcttgaacctgctctccccgccgccgttccacaggtcgaccatggaggccgacgacagcggcggtggcggcggcagggcacgcaggtccgtcgaggtggacttcttctccgacgagaagaagaacatgaagaagagccgtgtctcgggcggcgtcgccgccgaggcggacgacgccaagggacccgccgccgccggcctcgccatcaagaaggaggacctcaccattaaccttcttcccgccgggaacaacgcgaggagcgaccggtcgatggtggtcgacgacgacgcggcgtcgcggccggatcacgaggagaagagccggagcagcaacgagctcgcggcgatgcaggcggagctgggccgcatgaacgaggagaaccagcggctccgggggatgctgacccaggtgaccaccagctaccaggcgctgcagatgcatctcgtcgcgctcatgcagcaaaggcctcaaatgatgcagcctccgacccagccggagccacctccgcctcaccaggatggcaaggccgagggcgcggtcgtgccgaggcaattcctcgatctgggcccgtcctccggcgccggcggcgaggcggcggaggagccgtccaactcgtcgacggaggccggcagcccgcgtcggtcgtcgtctaccggcaacaaggaccaagaacgtggtgacagcccggacgcgccgccgggcgcgccgaacgccgtgccgctcaacgccgcgcggccgggcgcgccggcgccgcagttccaggtgccgctgccaggcggagggatggcgccggcgttcgccgtgccgccgcaggtgctgtacaaccagtccaagttctccggcctgcagatgtcctccgattcagccgaggccgccgccgccgccgccgccgccgcgcagttcgcgcaaccgaggccgccgatcgggcagctgcctggccctctctccgacaccgtcagcgcggcggcggcggcgatcaccgctgaccccaacttcacggtggcgctcgcggcggcgatcacgtccatcataggcggccagcacgcggcggcagctggcaacagcaacgcgaacaacaccaacaccaacaccacgagcaacaccaacaacacaagcagcaacaacacgacgagcaacaacaccaacagcgagacgcagtaaaaacgagttcggatcagtaattttcacatagatttccaagtttttactcttctttgttcaggataggttcttgatttctctcctttggtttcgatagctcggccgagctgtgcagtgggcacatggtatacactttcttttttcttctccactttcctggttttgcagcagcaaaaagttgtattaattcattgctttttcttagttctttttctaccgcaaaaacagctgttgatacttcgcagtaagtaataatcagtacaataataagtataataatagcatcttcctgagaattatgtacacttgtcaaagcaacaaaacaaaagaaacaatgacagcttactagatccctcttttcta

SEQ ID NO: 111 - DNA, 3602 bp, Oryza sativa
gaagccactcgccactgcaaagcgctctctctctctctctctctctcgcatcgcgcgcagccttcctcatccccgtcctgatccactccacctccctaatccacagcgcgcgccagaggaaatccggcgccggtcgaggcggccgcgccgcgccgccgtcacgcccagcccactcgattcggtcgcgtgtgcgctaggaagttcgtcatacgcctcgcggttttcacttcgtgtgtttttcttttaaatttttacctgtgcttcgtttaaagcctctcttgatcttaggtatagctttgctcgatctgattataggtatgttgtatgtttctggtctcccgtgattgcgcgtggattgtgattatgactaatttgcttgatctgaatatctgattgtggtggtggtgtgtgtgtgtgtgtgtctgatttgtctgatctgttgtggattattattgtatgatttaccgtggttttatgttgtttatatataagcgtttgccatgagtctgattaattgtattgttgcggtttttcctaggtgtcatactgtcatgctcgatttttacaaggtttagtgcaaactgatagatgatgtccatccccaaaactccgtctaccagtattggttcatgtgcgagcacacgggatagttcgagttcctgtttgatattgattcgctggcgctggttgtttggttggtttattagctagagttgtttgtgtgcaaaggtgggatcatggttgcaaaggcatattgatgaatgacgattcataagcgtggaaagcaatctctgtgcaaggggttattaggattctttgtgcgtattcactctaaaccgatagtcttgtattgctatcagcaccacgttatctatttcctaaccaatgttttctgcatatggactctgcattttgcttcctctccttgtaccacacccagtaccctatgtttgtgcctctcccatggtccatctctcctgttaaaaaaataaaaataaaaataatagaatagaaaaattctagaccaaatacagggaagaaaataaattttgtcaggcaagagagcgacgaggcgatggggaacttattacttttctggacaaatccttcaatttgcctcatctatatcaatggaattgggaaagcagtggactacttaccatgtattggctactaatttccaccactccttgccagagaattgggaaagtgaattctcttatgcaggttctgtcagagtattgtaccagtcattgagatgactgtattcagtagagaagttttgtagataggttaaatttcaggtacaaaccaatgaagtaaaaaagtcttagtatgatggatgtgagaggctcaagaagttccctgattggagaagcaaaggaataagttttttatatggatgtgctatggattttaattaaaagaatggagaagtttcttttgttgaagatgaagctgttggcagctggagagaatgggggtggacaccacagtaagtttgatgcagatggacactgttcgaattgcttgggaactcttccatggaatctggatggataccttattgagtagtaaatttcttaatacagctcgctatccagatagtgctagctgtgattgtttggtgatcaatctattgggattgtgccgactggagctgttcgacattgctttggtcttttgttgatttgcctggagttcggcagtatacagcaaccctggagtgcatgcagtggtttcctcattttttaggacctgactgcattctgtagtgagaactatcctgctaaatgcataatacttgcaggtgttttctgttgtattggcaacgtgatagtttttgtggtgcaaaacattcaagatgggcgccatggacgtacaacttgagtctactgctgttcaacatggacaagctaagataaatgtggaggaacatgctctagtttctctgttgtctgatgagaagtacgcaactgaaaagaccgaagatgtggaccctgatgattatgagaaacttgaggaagggataatgcagtatgggtgtgcacattatcgaagaaggtgccgcattcgagctccatgttgcaacgagatttttgattgtcggcattgccacaatgaaacaaagaattcaattaaaattgatgctgtgaagaggcatgaactcccacgccatgaagtgcagcaggttatatgctcgttgtgtggcacggaacaagaggtacggcaagtatgtatcagttgtggtgtatgcatggggaagtacttctgtgaagtgtgcaagctctttgatgatgatgtttcaaaacagcaatatcattgcaatggttgtggaatatgcagaattggtggcaaggagaatttctttcactgctcaaaatgcggatgctgttattctatagtattgaagaacagtcatgcatgtgttgaaggagcgatgcatcatgactgtccaatctgctttgagtacctttttgaatcaaccaatgatgtttccgtcttgccctgtggtcataccattcatgtcaagtgcttgcgagaaatggaggagcactgccaatttgcttgcccgctttgctctaaatctgtctgcgacatgtcgaaggcatgggagagattggacgaggaactagcaacgatatctgacacctgtgacaataaaatggtgcgcatattgtgcaacgattgtggggcaacatcagaggtgcagttccatttgattgcgcacaagtgccagaagtgcaagtcctacaacacccgccagatctgaagtggcgaagttttgatgtgattcattttgtatgggaagagagccctgggggatgctcattttgcaacacaaatcccgctaacgcctctgggaatctgatgagctctcggtcgttttcttgctcattggatgcctcagccgaggcaaatcactcgcatctgaaattcatctatgaagtggatgctgttccctcctgtgttcaatttattacctcaccatgtcgcagactcagagtcctgttcagcttaagtttctactagcactagccgagataataagtgcacgtctactcaagcttctgggcataaatggtggctagcttgtgtgttatggtgtgtacttgttgagtctcgggcaaacactgtaacggttagtggcatagtattacttcttgctcgtgtgcgtgtgtagtaggatggcggattgcaggacgtgggtgttatttactggtaggaactgtggtacttgcagtagccaccatttctcatgttcaatgccggtcccatatgccggtcttgttcagttcctataccttgctcggttgagaaaaatggcaaatctacctcagttcattttgttctgattatttaacagagggccaagtattgaattctttgggtttgcctctttgatggtgctagtatctgggctctagtagggataatggctttttctatcttttgacttgtagcatgtagcatataagcaactttgaaagttttaaattttaaatttgatagaattctaatctatatttttttatatggtcctttgaaataaatgattaaaaactattgaatctatgaaaattataaggatgtctcaattc

SEQ ID NO: 112 - DNA, 2853 bp, Oryza sativa
gctctcgctgccctcccgcccgttggccgaaggggaagaaggggggagagagagaagggagagagggaggaggaaggaggactgacatgtgggccccacatgtcagtgggcccacattctttttgtgtgaatgactaatgggtcccactcatattttttaattcaactgccacgtaagtgccacgtcaaagccacgtacaacgaagactcggtcaatatcgccacgtaggcgccacgtcagcgaaaccgctctccaaaaccgcccagggagtcaaattgaatcggttttaagagtttgggggttaagatatttggttttgtggtttagggccacggataagatttcgataccttttgagggtcgcaaagtgaacttattcctacagtgaaagggagatgcggcccattacgagtttacgacatggcccaatcacacgcggggaaagttgcgtgagggacttctcatgcgtacgagccgcgtcgcgtctccccccccctcccccaaggaccatgacacgtgggccatagcaaccgacctagcccggccccacacgcttcgcatccttacccatcaaaaccaaaccacgggcctcctcaccccgccgcacgccgccttcctcccagatccaaacctccctcgtcgtctccccttcccctcctcctcctcgacccccacggcggcggcgccaccggactccggcgaaccctcgcgcgcgcgcgcacgcaccgagacgtaccgtaccggcgacatgaatccctacgacctccgctacgccgacccttcctcctaccgcgacaggcgcagcgaccttgccggggctcccgtgctcgccgcgtcggcccccgcggccgccaacccctacgccgccgcgtacgcgcccgcgccggctgctcccgtggcccccgctggtggcgacttctcgcgcttcggcgggagaggccgtggtggaggcgcgggcggcggtgggtggggtagaggtggtggtggtggtggtggcgctggcggataccgaggcggcggtgggagaggaggtggaagggacgcgctggactcgctctccttgccgaagcctgacttccggagccttatacccttcgagaagaacttctatgtggagtgccccgccgtgcaggccatgtcagacatggatgtgtcgcagtatcgtcgccagcgtgatatcactgttgaaggccacgacgtgcccaagccggttcgctacttccaggaggccaacttcccagattactgtatgcaagcaatagccaagagtggattcgtagagcccacgcctattcagtcacaaggttggccaatggctttgaagggcagggacatgatcggtatcgcacaaactggctctgggaaaacactatcttaccttctccctgggttggttcatgttggtgcacagcctcgactagaacaaggtgatggcccaattgttctgatccttgctcctacaagagaactggctgttcaaatacaacaagaatctggcaaatttggatcatactcaagaactagaagcacttgtatctatggtggagcacctaagggaccacaaatacgtgaccttaggagaggggttgagattgtcattgcaacacctggtcggttgatcgatatgctggaaggtggtcacactaacctgcgaagagtaacatacctcgtcctggatgaggctgaccgcatgcttgacatgggttttgagccccagattcgtaaaatagtggcacagatccggccagacaggcaaaccttgtattggagtgccacttggccaagagaagtagaatccttggctagacaatttctgcagaacccatacaaggtaatcataggatcacctgatctgaaagctaatcattccatacagcaaattattgaggtcatatctgaacacgaaaagtatcccagactcagtaaacttttatctgatctaatggatggaagcagaatcttgatatttttccaaactaaaaaggactgtgacaaggtcactcgtcaacttagaatggatggatggccagcattatctattcatggtgacaaagctcaagcagaaagggactatgttctggcagagttcaagagtgggaaaagtcctataatggctgccacagatgtagcggcacgtggtcttgatgtcaaggatattaagtgtgtgataaattttgattttccaacaactcttgaagattatattcacagaataggtcgaactggccgcgctggtgctagtggaactgcattcacctttttcacactctccaatgcaaaattctccaggaatcttgttaagatcttgagggaagctggccaggttgtgaatccagcgctagaatctatggctaaatctgccagttctatgggaggaggcaatttccggtcaagggggcgtggtgggtttggtaacagatctggctcaaatagcattcccataagaggaagaaggccatactgagggcggcaaaaagattaaaacttttactgtataccgataggtggaacatgtcacacgaatggccaaatatacttatccaacagcgtaggatatgtgttccaagtttagcttcgacttggagaatggtttgtccagtgttattttgactattgaggcaacgtcctcgtgcggtactggttattgtttactattgttgggttacttgaaagaacagtttgctccatttgttatctttttagtatccgggttattgtttactattgttgggttacttgaaagaacagtttgctccatttgttatctttttagtatccggtattatttgtgctattgctattcattttttggagcaacttgagttgcgaatgatagggaggctgtttcagtt

SEQ ID NO: 113 - DNA, 2616 bp, Oryza sativa
gttcgtctcctttctcagtaactgcacccacctccacacctacacgcacacagacaaacaaagccaaaccccccgcctcgcctacatctcgcgctctccgccccccgcccgcctccactctgcatggacgcctccgccggctcgtcggcgccgcactcgcacgggaacccggggaagcagggtggcggcggcggcggcggcggcggacgggggaaggccccggcggcggagatcaggggtgaggcggcgagggatgacgtctttttcgctgacgataccttcccgttgctcccggacttcccgtgcctttcttccccgtcaagctcaaccttctcgtcgtcgtcgtcgtcgaactcgtccagcgctttcaccaccgcggcgggagggggttgcggcggtgagccgtccgagccggcctcggcggcggacgggtttggtgagctcgccgacatagaccagctcctcgacctcgcgtcgctgtccgtcccgtgggaggccgagcagccgctgttcccggacgacgttggcatgatgatagaggacgccatgtccgggcaaccgcatcaggcggacgactgtaccggcgacggcgatacgaaggcggtgatggaggcggccgggggaggagacgacgccggcgacgcatgcatggaggggagtgatgcgcccgacgatctgccggcgttcttcatggagtggctcacgagcaaccgtgagtacatctccgccgacgacctccgcagcatccgcctccgccgatccaccatcgaggcggcggccgcgcggctcggcggcgggcgccagggcaccatgcagctgctcaagctcatcctcacctgggtgcagaaccaccacctccagaagaagcgcccccgcacggcgattgacgacggcgccgcgtcgtcggaccctcagctccccagccccggcgcaaaccccggctacgagttcccctccggtggccaggagatgggctccgccgccgccacatcctggatgccctaccaggccttcacgccgccagccgcgtacggcggcgacgccatgtacccaggcgccgccggcccgttccctttccagcagagctgcagcaagagcagcgtggtcgtgagcagccagccgttctccccgccgaccgcggcggcggcgggcgacatgcatgcgtcgggcggagggaacatggcctggccgcagcaattcgcgccgttccccgtctcctccacgagctcctacaccatgccgtcggtcgtgccaccgccgttcaccgccggattccccgggcagtactccggcggccacgccatgtgctctccacgcctcgccggagtcgagccgtcctcgacaaaggaggcccggaagaagcggatggcgaggcagcgccgcctctcctgcctgcagcagcaacgtagccagcagctcaacctgagccagatccacatctccggccatccacaggagccctcccctcgcgccgcgcactcggcgccggtcaccccgtcgtcggccggctgccggagctggggcatctggccgccggcggcccagatcatccagaatcccctatcaaacaagcccaatcctcctcccgccacgtcgaagcagccgaaaccctcgccggagaaaccgaagccgaagccgcaggcggcggcgacggccggagcggagagccttcagcgctcgacggcttcagagaagcggcaggcgaagacggacaagaacctgcggttcctgctgcagaaggtgctgaagcagagcgacgtcgggagcctcggccgcatcgtgctccccaaagaagcagaggttcacctgccggagctgaagacgagggatggtgtctccatccccatggaagacatcgggacgtctcaggtgtggaacatgcggtaccggttttggcccaacaacaaaagcaggatgtatcttctcgaaaacacaggtgattttgttcgttcaaacgagctgcaggagggtgatttcattgtgatctactccgatatcaagtcaggcaaatatctgatacgtggtgtgaaggtgaggcgcgcggcgcaggagcaaggcaactcgtcgggggcggtaggtaagcataagcatggctcgccggagaaacccggcgtctcgtccaatacaaaggccgccggcgccgaggacggcaccggcggcgatgacagtgccgaagccgcagcggcggcggcggcaggcaaggctgacggcggcggctgcaagggcaagtccccgcacggcgtgcggcgttctcgccaggaggccgccgccgccgcctccatgagccagatggcggttagcatctgaagaaacagatgacagcagcagcagcaagcttcagtccatttgaaggttaattattagctagctagctccgtattataaccgatggtaaaacctcctaaaaaaattaattaagttgtgcatgtgaatcgtagcgctagctagggatgatatttgatcagtaacccgtagtccccgtaccagtgacgcttaagtacgcatggtttggttgttcatcgttgaacccctgtagtgtgtcgtcgtcctgtacatgcatcgaattatggaattaattaattaccttaatcgtcgtgtccattgcggctaacaagc

SEQ ID NO: 114 - DNA, 1488 bp, Oryza sativa
gtgagtatctgcgcttatctggcctatcatctgatcatctactgtcggctagctcgatcagtagctgggaccataattaatttaagttaagttcaatcaagaagtcgagaggcgatgtcctggtggaagaaatccagcggcaaaagcagcagcagcagcagccagtactacgctggctctgacagctcgtcgttcgccggaggaggaggagacgaccggtacggacgagccggcagcggcaacggccgctcgccgtggacgacgtccgaggagtacccgaggtacaccagcgacgacgacaaccgcagcggcagcggcagcgacgacgacgacgaccacggcgaccggaacaggcgcaggggaaagaagagcaacaagaagaagagcagcagcagcagcagcagctacaagtacgacgacgacggcggcgagagagaccggagctacagcaactacggcggctacggcaacaacgagggctacagcagcagcgcccccagcggctacaacccctacaacaacggcggcggctacggcggcccttcctacggcaacggcggcggctacggcggctctacctacggcaacggcggcggctacggcggctcttcctatggtaacggcggcgccatcgtagccggaggcggcggcggcagcgcccctgcctcctatggctatggctctaattccggctggggtgcgccggcgccgccgcggcaggagggtggctcagggtcggcgccgacgtacctcaacgtcatctacatgacgcagccagggtcgtcgtcgtcgcagaacgagaactccggcgagaggagagacaacggcggcggcggaggaggacgaaacgggctcttcggtccgacgttccaagccgtcggcggctatatggaccgtaggttcggattcgactgagcctgatagattcctaaattgcttcaattcaattcgtcgatgtctcctctccgttctgcatctcgatcgactccatcgatatctactgcaactctgcatgtgcacgcatgcatgcatgttggcacatacttaattcgtacgtactcaaattctacaagcgttcgttggttcagttaagttaagttattattcagaagaaataatcacggaaggccgccaaataatttgtggtaatgagtgctcgtgattctatagttttgttatttttttttcaactgccgaagaagtgtaaaccagtagtaccggctttcctgcttcaaggaaaaatgaagttgctaatgtactatatagtatatacacatgtgggtagctagctagctagtattgtgttgtataattgtactagccggagactgttttttgtgttgtactctagctatctgtatgctgtgtgtatgttcagtgtgctgctggctagctactcaatatgcttccatactactgtatttagtaagtgtttcttctgttcatacatatttgacacagttaactttagtcattacgttttgatca

SEQ ID NO: 115 - DNA, 3582 bp, Oryza sativa
tcactaatcccgatcccgatctcccccttccttccctacaccgaaagcccgaaacccaccttgcctcgcctcgcctcgccggatccagatctccaccgcctcgcctcgccgcgccgccaccaacccactcgccgtcgccgtcgccggcggcggatcggccccacatcacctcggcctccccgagcaaaccggcgggggacgcccccgggcaacgggcgggcgaagaggggcgcaatggagcagctgcggacgatcgggcgggagctggcgatggggtcgcagggagggtgggggcagtcgaaggagttcctcgaccttgtcaagtccatcggcgaggcgcggtccaaggcggaggaggaccggatcatctcgcgggagctggatcacctcaagcgccgcctcgccgaccccgacgtgccccgccggaagatgaaggagctcctcctccgcctcgtctacgccgagatgctcggccacgacgcctccttcggccacatccacgccgtcaagatgacccacgacgagtccctcccgctcaagcgcacgggctacctcgccgtctccctcttcctcgacgagcgccacgacctcgtcatcctcgtcgtcaacaccatacagaaggacctcaggtccgacaactacctcgtcgtctgcgccgcgctcaccgccgcctgccgcctcatcggggaggaggccatcccggccgtgctgccccaggtcgtcgagctgctcgcgcatcccaaggaggccgtgcggaagaaggccgtcatggcgctccaccgattctaccagcgatccccctcatccgtctctcaccttgtctccaacttccgcaagaggctctgtgataatgatcctggggtcatgggtgcaactttatgccccctctatgacctgattttggaagatccaaattcgtacaaggatttggttgttagttttgttaacatcctcaaacaagttgcagagaggaggcttccaacttcctatgattaccaccaaatgcctgcaccatttattcagattaaactattgaaaatacttgcggtgctgggtagcggtgataagcaggcaagtggaaatatgtacatggtcttgggtgacatattcaggaagggtgacactgcaagcaacattggcaatgcaatattgtatgagtgcatatgctgtatttcatccatattcccgaacgctaagatgcttgatgctgcagctgaaacaacatcaaagtttctgaagagtgatagccataatcttaagtacatgggcattgatgctcttggccggttaattaaaataaatccagatatcgcagaagagcaccagctggctgttattgattgcttagaggatcctgatgacactttgaaacgcaagaccttcgagcttctttacaagatgacaaaatcaacaaatgttgaagtgattgttgatcgaatgattgagtatatgattaacatcactgatcaccattacaagacagaaattgcatctcgttgtgttgagctagcagaacaatttgcacctagcaatcagtggttcatccagaccatgaacaaagtctttgagcatgctggagatcttgtcaacatccgagttgcacataatttaatgcgacttattgctgaaggctttggagaggaggatgaaggtgctgatagccaactaagatcgtcagctgtagattcctatctacggattgttggggagccaaagcttccttcttcgtttctgcagataatatgctgggttttgggagaatatggaacagcagatgggaaatattcagcttcatatattattgggaagctgtatgatgtggcagaggcccacccaactgatgacactgtcagggcttatgcaatctccgcaattttgaagatctttgcgtttgaaatcgctcttggaaggaagatcgatatgctacccgagtgccaatcgttgatagatgaattgtcagcttcgcattcaacagacttgcagcagcgtgcatatgagctacaggctttgctaggtttggacaaacaggctgttgagaatgtaatgccagccgatgcaagctgcgaagatattgagatcgacagaaacctctcgtttctaaatggttatgtgcagcaagccattgaaaatggtgctgcaccctacattcctgagagtgaacgctcaggagtggtaagtgttggcaactacaaggcccaggatcaacaagagacatctgcccatgctcttagattcgaggcctatgagctacctccagcagcttcacaggccagtatttccccaactactgacctggttccagttccagaaccaagctactataaggaagatcaccaaatgtcaagatcccagccatcaggcgattctctttctggtgaatttggtctcaaacttcgtcttgatggagttcagaagaaatgggggagaccagcctattcctcctcatctacgccttcaagttcaacatctagtcaacaagcaaccaatggaggcgttagttctgaggtgggagggtcaacaagttcacaggctcgggaatccacatatggttccaagagacagcaggccactgaagtttcagcggaaaagcaacggttggctgcttcactctttggtaaagctgataggaagacccaggctgggcgaaagacagcaaaggagagttcctcaactgagaaagtagctactgctaatgcaacaccgcagccagccaaagagcaagtaatcccttctgccccaccacctgatcttctggatctgggagagccagtttcatcaagtcctccattagctgatcctttcacacagttagaaggtcttctcggaccagcatcagcctctcctgtggtttctgaaaccccagcttcgagcacttcgaaaacaccagatcttatgtcaatcttttcggatgatgtacaaactggagtgaccagtggatccacagaaccatcactcggggtaaatgtggtcgctgcaaagaagggccctagccttcaagatgccttgcagaaggacgcagcggcccggcaagttggtgtgacgccgacagggaacaaccctattctattcaaggacttgttaggctagaatatacagcatatgttcagcgtgctcaaattgggtaagtggagtttgcctccaagatggtcttgattgcctgatcggtgaaccagtaatgaatgatgctgttcgatcagcacagggcacatgagggcatgaggtaaatttggttttgattcacaggacacgaccttttaccctcccaattgggagaaggtaggtttgggatgagatgtggatggttgcgggtctttttcctgttgcgtttttcacatggtaatttcttgtcgagacttagtgtacatgtgtttattacatgatgtgtaatttgtacatgatgagaccgtggtccagaagcgtgtgccggcgctttttttcggttcatctggcagggagtatatgttttgagatttacccacattggatatacagtagctgctgggcactagaaactcggttgccacttcctctgaaactggctggaataataaaatgtaagttttttcttccccttacgctttc

SEQ ID NO: 116 - DNA, 2406 bp, Oryza sativa
atgatccctgttttggacttggaatttcactagagcaccggcggcgtggttgcgggcggcggcgctggttcggctccttcgctcggctcggctccgccaccgcgccggaggctagggttctgcgaggcgggaggcgtacgcggcggcggcgacagtcgacggagcttccggagcaggagagctccgacggcgcacgctcctgcggctcctcctgcttcccgtccaatctcgcgacgccccccgggcagattcgaggacgaccggaggcggcgaacggcgacccccccgccggataccggcagactaggttttctttgttagcataagcttgtgaaaatttagcttgtttcttacttatggataactcacacgaacagccattaccccctggtgtcggggcatggccgccgccaccttccattcatcctgcaaaatttcaacctaatccacagccttatgcaacaccttatggcgctacacccaacaatggcagcaatcacaatgcagcgagctactctgctgctgcacaacccaccatgcctttccctaacatggatgctgggggtgcacaatcaaatcagacagctcatgaagtttccaaccataatgatagtgcagcagacattgaatctgctgtccaagaggctgttcttcgtgaacaggacattgagactcagcaagtcatacaaaatcaaagacaagcaaaagcaacaattgagcctacgcagtatggagaagacctcctttcaaaccgccgcaaccctaatgcattgaaggagcacttactaaaaatgacagccgagcatcgtgcagagatggcaaacaaaagggggaagccgcttcatgcagataatggcaatgttgaaattggcaatggctatggtgtaccaggagggggtgcttattatgctgcaaacatgtcaagtggtcaaatgaataaacccaaggatatagctgataaagcaaaaggtgccgatgatctccctgaatttttgaggcagagattaagagcaaggggtattcttaaagatgaggcgacaaataatagattcacgattaaacaaaatgtcgattctccagtagggcagataaaagctgcccaagagttgcctcctggttgggttgaagcaaaagatccaacaagtggtgcttcttatttctataatcagagcactggaacgacccaatgggatcgccctggtgctcctttgaacaccatgcaacatcaagctcctccatcctcgtccttgccagagaattgggaggaggcacttgatcaatcaacaggccagaaatactattacaatacaaatacacaagcaacacagtgggagccgcctactgctgtgaacccaggtgttgcgcctcatgctcccaccaatgctgctgttgagatggctgctcaaaatacagatatttggaactctcaaatgcagagatgtttaggctgtggtggatggggtgtaggtcttgtccagccatggggttattgcaatcactgcacaagggttcaaaatcttccttttcaacagtatccatcctacccaaacaatactacacactcaagcagtaacaaaaatccagggaatgtagcagccaaggacagatcaagcgcaaaacctccatttggcaaagcaaacagaaaagatcaccgcaaaagaaatcgccctgaggatgatgagcttgacccgatggacccaagctcttactcagatgctccacggggtggctgggttgttggcttgaagggtgtgcagccacgggcagcagatactactgcagctggacctttattccaacaaagaccatatccgtcacctggtgctgtgctgagaaaaaatgcagaggttgcatctcatggcaagaaacgtggtatggctccgatcaccaaaagaggggatggcagtgacggtctcggggaggcggattagatcaatcgtcgtaaattttccttgcaacccagtggactagcggtcattttggctttggcaatgactgaaacatcggtgcactgtcgtccaaaaagaagcaaactgtcagcagtaaatcactccagtgcaggagaacccagagctgagtgcattgtgagactgagcttaataagattcacatcctaaatgtgcccatggtgtaattctcgtgaaatctgcagaagttttcggtgtaaatttttgacagggtgaaagaattcgcaacaggaatagtgatgtagagctaatgtgtaatttttggtattaaccgaaacagttctgttgaatactagaatctaggggttgttttgtggataattcgacctgttaatgctaccatcttaatggaatttaacgtattaatgctagaatatgtaattcatgctatttcatttcagtacattattacaactgaatagttttgtattagttcgaa

SEQ ID NO: 117 - DNA, 5897 bp, Oryza sativa
atgtcgccccctctccaggcgcccgactacaagcacgtcacggaggagtgcctccgcgagtggaagggccagcccgccgccgccgccgccttccgcgtccccgatccggtccccatggcgcgcttcctctacgagctctgctgggcggtggtgcggggggacctgccgccgcagaagtgccgggtggctctggactcggtggagtttgtggaggaggcgcagcgaggggaggtcggctcagtactcgccgacatcatcgcccacctagggcaggatgttacaatctctggtgaatatcgcagccgtcttgtcaaaatgaccaaatcatttgtggagtcgtcattgattgcgcctaggctccttcaagagcgatgcgaggaagagttcctctgggaggttgaactgagtaagtcaaaggggcaggatttgaaggctaaggaggtcagggtcaacacacgtctcctttatcagcaaactaaattcaaccttttaagagaggaaagtgagggctacgccaaattggtaaccctcctttgtcaaattggttcagatttggcttgtcaaaattcttcttcagttactatgagcattataaagtcattgattgggcattttgacctggacccaaatcgtgtgtttgatattgttctggaatgttttgagctctatccggataataccatcttttgtcagcttatacctcttttccctaagtcccatgctgctcaaatattggggttcaagttccaatattaccaacgattggatgtcaatagcactgttccacctgggcttttccggatagcagctttgttggtcaaatctggttttattgaccttgatagcctctatgctcatttacttccaaatgatgatgaggcatttgagcattttgactccttcgtcacgaggaaaatcgatgaggctagtaatataggcaaaataaatcttgctgccactgggaaggaccttatggatgacgagaagcaagaaataactattgatttgtacacagcattggagatggaaaatgatataattgatgagcgagcccctgagattgaaaagaaccagaaacttggacttcttcttggtttcctgtcagttcatgattgggatcatgcacaactcctctttgagcgtcttgcacgcctaaatcctgttgagcatgttgaaatttgtgatagtttatttagacttattgaaaggagtatttcttcagtctatgatataattttccaaacacattataagatgcctcgtaaccctgtttatatgatggacacatcaccttcctcttcacaaagtttttcggttgatccgccgaaagagtttttccaaatgctttctgcttgtggaccataccttcatcgtaacacacaattatttcagaaggtttgcagagtacttaaagcgtaccatctgtcagcaaaagagtcaatccgtacagcaggtgtaatgtctccagactcgcgaattgaagaagcacttggatcgtgcttgctaccatcattgcagcttatacctgcaaatcctgctgttgatatggagatatggggagttctttctcttcttccttatgagacccgttatcgcttatatggtgaatgggagaaggataccgaacaaaacccaattgtccttgctgcaaggcaaactgcaaagttggataccagaaggctcttaaagcggcttgctaaggaaaatctgaagcaacttggccgcatggtggctaaacttgcccatgcaaatccaatgacagtacttcggacaattatccaacaggttgaagcatatagggacatgataactccagtcgtcgatgcttttaaatacttgactcagctggagtttgacatcttgcaatatattgtaattgaacgcttggctcaaggtggccgtgagaaacttaaagatgatggtcttaatctatctgattggcttcagtgtcttgcatcattctgggggcacctgtgcaagaagcatcattcggtggagctaagaagcctttttcagtaccttgttaatcagctgaagaaagacacaggcattgagcttgttgtactcgaggaactcattcagcaaatggcaaatgtgcaatacactgagaacatgactgaggagcaggttgatgctatggcagggagtgaaacattgcggcttcaagcttcatcactatttggatcaacaagaaattctaaggttctgaccaagtctacaaacaaattgagggattctttgcttccaaaagaagaacctaaacttgccattccccttttactgcttattgctcagcatcgatccaagattataattaatgctgatgccacatatatcaaaatggtcagtgagcagtttgatcggtgccatggaatactacttcagtatgttgagtttctttcaactgcagtaactccaacaacttatgttcaactaatacctccgctggaagatctgattaataagtatcatatcgagcctgacgttgcttttcttatataccgacctgtgatgagacttttcaaaagcactaatggaggtgacacctattggcctttggatgacaatgaagaaggggagtctgtatcatgtgatgatctgatattgcatcctgacacatctcataagtcaatcataagcgtagacataataagaatgaaaaaggttaaagcgagacaatggatgaccttggggtccctggaaggttggtggtctgatcttcttagcacagtccggaacactttcccagcaaaaacctggaatggtttatcacctgatttatatgctactttctgggggttaacactatatgatcttcatttccccaaagatcgttatgatgcagaaataaagaagctgcatgaaaatcttaaacaactggaagataattcggataactctagtattgcaatctcacgacgcaagaaggacaaggagagaatccaagatttgcttgacaaattgaacaatgaatcacataagcaccaacaacacattgcatcagtgctccaaaggctaggtcgtgaaaaggttaagtggttaaattccagtccagatgctctgaagatcaacatggaatttttccagcgctgcatattccctcgctgtgtttttagcatgcaagatgctgtgtattgtgctatgtttgtccaaacactgcactcactcgagactccatttttcaacacggtgaatcatatcgatgttttcatctgcaaaactctacagccaatgatttgttgctgcacagagtatgaggctggcaggctgggaaggtttcttcatgagacactgaagatggcctaccgttggaagagcgatgaatctttatatgagcgtgaatgtggaaataagccaggtttcgctgtgtacatcagatatccaaatagccagcgtgtatcttatagccagtttgttcgagttcattggaagtggagtggacgaataactaaggtgctgaaccagtgcatggaatcaaaagaatacatggaaatcagaaacgcccttattgtgctcacaaagatatctagcatttttcctgtgatacgcaaaagtggagtcaatcttgagaaacgtgttgctaagctgaagggggatgaaagggaagatctgaaagttctggcaactggtgtagctgctgctttggcagcccgcaagagctcatggctatctgaagaagagttcggcatgggtctccttgatcttaagcaagggccagcaaaaattgtgcctggaaatcaatcagcagatcctttgacagcaaaagatcagagtgttcgtgcaaaatccattgagggtaggcatgaacggtcagaagctgccatgaagcctgatgctcaacaaaagaaaaatgccttggctgcaaatggatctgataaccaaatgccatcttcttctgcacaaggaaaagtttcagggattatacgaggttctgatgaacctcccaaacttctatctgatgagggagttaaggtttcaaagcctactgcagaatctgagacaagggtgccccaaaagcgtgtggcacacaatgctggcaaggtatctaagcatgatatggtaaaggaagatacaaaatctgggaaatctacaaacagaggtgttactcaacaaggctcctctgttcctgttgataaagaagtattgtctcaggcagctgatggtgtgcaagataccaccagtaattctttggctgctagcaatggtaacttacatacggctccacggaaggtatcagcatcctcccaaaaatcaacactgttggctacacatactggtggagcagctaattcctctggtgaatctactgacttgattgactctaatatgaaacagcaaaagaggtttgttcctactgaagaacaagatagaggaactaaatggaggaaaggagagagtgaaggccgggatggtgacttcacagaacacactgacaaggacagaaatttggactcgcgattggtagataaatttcgtcccatggatcatgacaagagtgctagcgaggaacaaatcctaagtaggccagagaaatcaaaagaaaaggctgatgacaaatatgaccgggatcctagagaaaaagcagatcgaactgagaggcgtcgaggggaagacatcgagagaccaacagacaaatcattggaaaggagagagcgttctattgaaagaatgcaagaaagagggacagatagagctcctgataaaggaagagaagacaggaataaggaggagagaaataaagttaagcatgctgaaccatccatagatcgtgcacatccttctgatgaacggttccgaggacaaagcttgccaccacctccaccccttccagcaagttttgtaccccaatcagttggtaacaggagagatgaagataccgatcgaaggggtggtagtactaggcataaccaacgatcatctcctaggcgtgatgataaagaaaagtggcacttggaggacaatgctgcgtcgttgcaggatgatggaaagcaccggagagaggaagatattcgggacagaaagcgtgaagatagggatgtttcgtcaagcaaggtagatgaccgggatagggacaaaagtagtattgtgaaggatgaaagtgatcctaatagtgcttccaaacggcgaaagatcaagagagatcagtctggtttagaagctggggaatacgcaccttctgctccacagcttcccagtcatggaaccagtagctcacaagtgtttgaaacacgagagcgagaacgaaagggggcaatttcacagcatcggatatcccatgctgatgaccttcctagaatacatggaaaggactcgagcaagacaagtcgtagagaggctgaccaagtacatgagagagaatgggaagaggaaaagcgatcaagaacggaaactaaaaggaagcaccggaagtaggataattgttggaattttgttagatgcaaaacaagtcatgaattctcctgagctttacaaagaagcacatgatcagcaatgtacaacatcacatatttcatcgtattaacaggccattcagaggtacatgctgcaccagaatttttagaaataccttgattgaaggtgcagtttggtcctatcgcgtaacacgaacagaagttgtggatacatgacatttgtttaactcttatgtattctgttgtttgaacaatttggaatgcagagtacagacttaatggcctaacctttgatcttgtgatgtaaacttggatgagctgttcgccgtccagctattttgtaactctactaaccgcagatatgttcgttgtaggaagaattttgattgcaatttttgcactgtgtaggaataatgctaggggacaacaggcttgcacggttgtacatactacagttaacaatgtgtgcatgatcctatttttgta

SEQ ID NO: 118 - DNA, 1141 bp, Oryza sativa
atccatcccttctcacgccgcacacactgcggcccctgcatcgctagcgtgagcgagaacgagaacgagagacgcacgtagtggtaccttttgcgaacggtagcgagagcgagagatcgcgtggttttttttgatcgctagctgtgttagccatggcgccgggtgctgggtcgtcgtcgtcggcgaggaggggcaggcgcgtcgccgccgccgagccgccccgccgcgcgctcaggatgcgcgcgtcgtcgccgatgtactacacgtccgacgacgaggacttgccggagattgtcctgacgcccccggctccggcgccgccgcgcaccggtacccgctcgctgcggatgcacgcgtcgccgcccgactatgggcgccgccgtaccaaccgaccccgccgcgtggcacggacgaggtcgccgccggtggtgcaggaggcggagagggagccgccggcgccgcagcagccggcggcggtggtggtggagcgcgtgttttacatggtgggtagcccgccggacgtcatcacggccacgggggaagggccgggggggcgcacggtggcgggcttccgttgcaggaggctcacgtccacgcgcaccctcgtcgacggcgaggacgccgccgcccgcgccgccgccatcagcggcgcccgcgccctggtcatgtgcagctgccacggcgcgcccttcacccacgccgagttcctgctccacgccggcggcaccgacctgggccgcaacgtcaccggctacccgtggcttggcgacgagatggagctgactcctcccggcgccggcggcccccatctgtaggttcgccgcggaggtggccagccgtcgtcgtcgacgacgacgacgaccgcggagtggcgtctgcggcggcgcgcggcggaggcggcggcgagcaacgcatggtccggggagagctttgatctgatgcagtgtgtccgttttcaatgccagtcttcgctcttagctacttgcagttgactgctgtctcagtctgactgtcaagtttatctttaattttcgcaagtttactttcatgtttctaaattatcagttgtaatcgtcgatcgatgtaatagctctagatctcccggatcaataatatgaaaactgcatctttgttttttaag

SEQ ID NO: 119 - DNA, 2146 bp, Oryza sativa
aggcaaagggcgccctccacctcctcaccgccgcgccaccgatcacccgccccccacctccaccgccgccgccaccgcccgtcgccggagctccgaggatggcatcccgcgtcgccgccgccgccgcggcgatcgcgtgatggcccgcgccgcagctcgccgccgatggacgacgccggaagggcctccgctccagcggtggtgacggtgacggcctccgccgccgcccccacgcctcctcttcctcctcctccgcctcccccccctccctcgcagctccccgccaccgccgccgccacggacgagccttcccacgaccccgccgctctctatggagagggtatgtggcagcagatgaccatgagcggcagtggcgctatgcaacctggaccatatcctgagcggtccggagaaccggactgcacttactacctcaggactggattgtgcaggttcggtatgagctgcaggttcaatcatcctcaggataggaatctggctattgcctctgccagaatgaaaggagaataccctgagaggatggggcaaccagaatgtcagtattatctgaagactggaacatgcaagtttgggcctacatgcaaattccatcatcccagagaaaaagctggaattgcagggagggtgcagctaaacacattaggatatccactccgaccgagtgaaaaggagtgtgcatattacttaaaaacaggacagtgtaaatatgggaatacatgtaaatttcaccatccagaacttttcaatgctatggcttcttcacgtggttcacctatttatccttctgtacattcctctgcaaccgcgggtccaccttatactggaacaatggctagctgggcttttccaagaggttcttttattccaagccctagatggcagaatccctcaaattatgcaccgatgattgtaccgcaaggtcttgttcaagtaccaagctggaactcatatactggccaaatgatgcctgtttcatcttctgagagtcgactgcagtccccaggggctcaacaaacctatggaacttctcagcaagttgatgccagtgcaggcaatcagggaatgttgtcaccctacagatctagttcatatcctgtacctcaatacgcattgcagagagagaatgtatttcctgagagacctgatcaaccagaatgtcaatactacatgaagactggagactgtaaatttggtgcggtgtgcaagttccatcatccccgggtgcgatcaatgcctactccagattgtgtcttgagtccagtgggtcttccactacgtccgggagaagaactgtgcaagttctattctcgctatggcatctgcaagttcggcgcgaattgcaaatttgaccatccaacgatggctcctccaatgggagtgtatgcctacggctctgcttcaactaatgtacctatggttcggcgtctcctgcaatccccatccgcatccgcgtacacttcctaaggcggcgtcctggcagttgtgacccaaaccaccgtgatgtataaaaaagtccatcgcacgcccgtctcaggcgctgtgtgaatgttgccaccccctcctaactccccggaatcaaagttctgtaaattgagttgctaccggagatgtacagtttattttttgttaatgcagatctttgggaagcgaaatgacgtttaaaactttcttgttttcagcctgctttgcactgcggtgttgtttcatttcaaatgtgcattcatgtcaggttgcaaggtactgtggcctgtggacgaactcaatctgatgatcatcctttttatctgcattacatgttgtataattgcatggattagttgagagctctattccggaggtgtatcttagcatggtgaagttaaaatggacaacaaaaggcggtgcagtgcaactgagtctggccgtcacgtcacaatcattgttttctgttcacaagtaaaaacatgcagcttccttccaacgaccaaaattaatgctggcatgataaggtgccgaacctggtccaaccaagtttctcgtggtaaagcatgcgtaagcacctgcctacttcaggtcaaaagttcaaaactacaggttgtaaaatctctctgaggtgaccgatctacgtagatactccctcggtaac

SEQ ID NO: 120 - DNA, 1782 bp, Oryza sativa
aatcctgcgtgaccccagacgacgacgacgacgagtacacatgcgtttgagcgcgacatccccgcgcgcgccttcttcttcctcttcctccctcctcccatgactagaccatcctcgccatattcccgcctctctatatatattagggctcagctcctcctctcacctcgtctcctcctctcctctcttctctccttggctcagcttgacatcgtcggagcagcagaaaagtttgctcgatcgagctagctaactaggtcgtcggatcagtgataaatcgttcgccgatggatccgtggattagcacccagccttcgctgagcctggacctccgcgtcgggctgccggcgacggcggccgtcgccatggttaagcccaaggtgctcgtcgaggaggacttctttcaccagcagcctctcaagaaagacccagaggttgcggcgctggaggcggagctgaagcggatgggcgcggagaaccggcagctgagcgagatgctggcggcggtggcggccaagtacgaggcgctgcagagccagttcagcgacatggtcaccgccagcgccaacaacggcggcggcggcggcaacaacccgtcgtccacctccgagggcggctccgtctcgccgtcgaggaagcgcaagagcgagagcctcgacgactccccgccgccgccgccgccgccgcacccacacgcggcgccgcaccacatgcacgtcatgcccggcgccgccgccgccggctacgccgaccagaccgagtgcacctccggcgagccctgcaagcgcatccgcgaggagtgcaagcccaagatctccaagctctacgtccacgccgacccatccgacctcagcctggtggtgaaagatgggtaccaatggaggaagtatggtcagaaggtcaccaaggacaacccctgcccaagagcctacttcagatgctcatttgctcccgcctgccctgtcaagaagaaggttcagagaagcgcggaggacaacacgatcctcgtggcgacgtacgagggggagcacaaccacggccagccgccgccgccgctgcagtcggcggcgcagaacagcgacggctccggcaagagcgccgggaagccaccccatgcgccggcggcggcgccgccggcgccggtggtgccgcaccgtcagcacgaaccggtcgtcgtcaacggcgagcagcaggccgcggcggcgtcggagatgatcaggcggaacctggccgagcagatggcgatgacgctgacgcgtgacccaagcttcaaggcggcgctcgtcaccgccctctccggccgcatcctcgagctctcgccgaccaaggattgacgattgctactgatcgacgcggcggattcgatcgcttcttcttgcaactgcgggcatggccattgccatcctctcctgtctctgcctctctgttcttggtggcgccagcaagaacacgatcgacgcggtgtccatccatggcggagttcgatcgatcgattgatcggctagggaggaattgatgattcgctgtatataacctagaatttttacacgattactcgagggatagatcgacgagcaacattttcggccggcgcccatggctgatcaaccaacgatcatcggcggcggccggacgtgagcaagacgattcagaaaaaaattcagatatttgcgtcggcaaaagacgcttgtaacatgtagagtagggaggaaaattatttgaagtgtacgtagtgcagtccttttgagcaaaattaatcccaaatttgcttcggtcccgaac

SEQ ID NO: 121 - DNA, 3311 bp, Oryza sativa
ttcaattcaccgatttcgttcgttcacccaccacaactcctccagcgagtcggggactcggggtagatcgtagaaatacggagtatacatacgtacaccgctacatttctagattacagtatttacagatacgtgggcaacgtgatcacgcagcttattagcatttgttaagtgcgtagttcgttcgttcgttgattgattgtgttgaattaattgagaggggctaaagatagtagtagtggttggttggtgcggttgcggcgggtgatcgaacgatggaggtgtgctgctgctcgacgtcatcggccgtgcccgggaggaggttcgcggcggccggggcggcggcggcggcggtggcggcgaggtggggcgccgtgggggtcgggagggcggtggtgctggcgcacccgctgcgcccggcgccgcgcggcgggcacgcgcacgcgcagcaggcgggcgcgcggcgggcgcggcgcgcggtcgtcagggcggtgttcgagcggttcacggagcgggcggtgaaggcggtggtgctgtcgcagcgggaggccaaggggctcggggagggcgccgtggcgccgcgccacctgctgctggggctcatcgccgaggaccggtcggcgggcgggttcctctcgtcggggatcaacatcgagcgcgcgcgcgaggagtgccgcggcatcggcgccagggacttgacccccggcgcgccgtcgccgtccggctccgggctggaaatggacatacccttctccggcagctgcaagcgggtgttcgaggtcgccgtggagttctcccggaacatgggctgcagcttcatctccccggagcacctcgccctcgcgctcttcaccctcgacgatcccaccaccaacagcctcctcaggagcttgggagcggatccgagtcaactagcatcagtagcgcttacccgactccaagcggagcttgcgaaagattgcagagaacctgcaggagcatcatctttcaaagtacccaagaaatctcctgctggagctggaagatctgccttctcgaaatctttaaattcaaagaaagaaaagggtgcgcttgatcaattttgtttagatctgaccacacaagctagtggcgggtttattgatcctatcattggccgtgaggaggagattgaaagagtagttcagataatatgccgacggacaaagaacaatcctattcttttgggtgaggcaggtgttggcaaaactgcaatcgctgaagggttggctcttcgaattgcaaatggagatgtccccatttaccttgtggcaaagcgtataatgtcattggacgttggtctacttattgctggtgcaaaagaaagaggtgaactggagtccagggttactagtttaattcgtgaagtccgggaagcaggggatgttattcttttcattgatgaggttcacaatcttattggatctggcactgttggaaagggtaagggtgctggccttgacattggcaacttgctgaagcccccacttgctagaggtgaattgcagtgcattgcagctacaactctagatgaacacagaatgcattttgagaaggataaggctttggctcgccgcttccagccagtattagtagaggagcctagtcaggatgatgctgtgaagatattacttggtcttcgtgaaaaatatgaaacatatcacaaatgcaaatttaccttagaagccatcaatgcagcagtttatctgtcagcaagatatattcctgacaggcagctccctgacaaggccatcgatctgattgatgaagctggcagtagagctcgaatggaatcatttaataggaagaaagaagggcagtcttcaatcctcttaaagtcgccagatgaatactggcaagagataagagctgctcaaaacatgcatgaagtggtgtcatcaaaccagatgaagtattcccctcgtcaagagaatggcagtgctgccattaaagcaccaagcgaggacatgaatgagttgacatctgaactccaagttgaggaaccaattgtagttggaacagaggaaattgcaagagttgcctcattgtggtcagggataccagtccagcagttaactgctgatgatagaaagcttctcgtaggactagatggtgaactcagaaagcgtgtgattggtcaagatgatgctgttatggcaatatctagagcggtgaagagatcacgtgttggcctcaatgatcctgacagacctattgccactctacttttctgtggtccgacaggagttggtaaaactgagcttactaaagctctagcagctagttattttggatcggaatctgctatgcttagattagacatgagcgagtatatggagaggcacactgtgagcaagctcataggctctcctccagggtacatcggatatggtgaaactggtactctgacagaagctgtcaggagaaagccatttactgtagtattacttgatgagatagagaaagctcaccctgatattttcaacattcttctccaaatttttgaagatgggcatctgtcggactcacagggccgcagagtgtccttcaagaacacattgattgtcatgacatcaaatattggttctacatcaatttcaaagggaagacgaagcatgggtttcatgacagaagatactgaatcaagctcatatgttgcaatgaaatctctagtaatggaagagttgaaggcatttttccgtccagaattgctcaacagaatcgatgagatggttgtattccgtcccttagagaaaactcagatgctagcaattcttgatatcatcctacaagaagtgaagggtaggctgttagcccttggaataggcctcgaggtgtccgatgcaatgaaggacctgatttgcgaagaaggctatgacaagagctacggtgcgcggccactgaggagagccgtcacccacctgattgaggatgtgatcagcgaagcaattctatttggcgaatacaagcctggggacacgatactgatggatattgatgccggggggaaactttgcatgagccacctgaatgagaaggttgtccagttgtctgatccgacacggacattctgaagttctgcatactgcttagtacattagagatctaatttttcattctttcgagattactaattctttttttaggtagacacggaatatatttcattatgtacataacagttaagggattcgttcgggcatataaatgtcttaaaacttgtacccaactgtatattgttgttcaattgatcaaatatattattttgaaaccatagttgcggaatgttatcg

SEQ ID NO: 122 - DNA, 1288 bp, Oryza sativa
gtcgccaccgtcaccgaccgcgcgcgcacgcacgcacactccgtgtccaaactttcctcgaactcctccccgccgcataaatccccttcgcctccccgccgcgccccgcggcgtcgcacgatctcactgaggcataaagtgagagaccgtgattggatcgatcaccggagcgacgatcaatggcgacgctcaccgtgcccgccgccgtgccgcccgtcgccgaggactgcgagcagctgcgcaaggcgttcaaagggtggggcacgaacgagaagctcatcatctccatcctcgcccaccgcgacgcggcgcagcgccgggcgatccgccgcgcctacgccgaggcgtacggcgaggagctgctccgcgccctcaacgacgagatccacggcaaattcgagagggcggtgatccagtggacgctggacccggcggagcgggacgcggtgctggcgaacgaggaggcgaggaagtggcacccggggggccgcgcgctcgtcgagatcgcgtgcacgcgcactccatcgcagctcttcgctgcgaagcaggcgtaccacgagcgcttcaagaggtcgctcgaggaggacgtcgcggcgcacatcaccggcgactaccgtaagcttttggtgccacttgtgactgtatatcgctatgatgggccagaggtgaacacatcgttggcacattctgaagccaaaatactccatgagaagatccatgacaaggcttacagtgacgatgaaatcatcaggattctcaccacaaggagcaaagcacagttactagcaacattcaatagttacaatgatcagttcggccatccaatcactaaggatcttaaagctgatcctaaggacgagttccttggtacactaagggcgatcataagatgcttcacttgccctgacagatactttgagaaagtcattcgattggctctaggaggaatgggcacagacgagaactctcttacaaggatcataacaactcgtgccgaggtagacctgaagctgataaaggaggcctaccagaagagaaacagtgtcccattggagcgagctgttgctaaagatacaaccagagactacgaggatatactccttgccctccttggagcagagtgaggtgtatatctgctccatctcgtctgtctgatcctccttgtttgatcggaaaataagatctgcatagaactgtgttctattttgttgtttctgaatgatacaagtgagctagtctgcatagcagtgctcatataataaaatctgtcctgcatactggtttgtca

SEQ ID NO: 123 - DNA, 2304 bp, Oryza sativa
cggtaaccctcacaatcccgttcgtcgagatcgtcgcttcggcgtaacaacaaataaggggagatccccaagtcctaacccgaatccatttccaataatccatttcgccacgatttgttcttggttgtctgagagagagagagagagagatccgtatacattgctgctacttgaggtcaagcccgttcgttcgcgcgcgcgcgcctgtctgtctctgtttgattgattcttctacgtcgtcgacgtacgcctgttcatgatgtcgctcaacctggctcaccagaccggagcggcggccgccgtggcaccggcggcgccacgtacggccgtggtcgcggcggctgcgggtacagtgtctgctccggcggtcgcgccggcggcggcgccgagcctgcagctgcagacgcagactgtggacccggcggcgccggcgcaggggccggacctccccatggccttccaggcgctggtcgagagcctgccggaggagcagcacccggacgtgggcggcgaggagcggcgcaaggtgggcgtgccggtgtacgtgatgatgccgctggacacggtgcgcaaggacggcaacgggctgaaccggcggaaggcggtggaggcgtccctgaaggcgctgaagagcgccggcgccgaggggatcatggtggacgtgtggtggggcatcgccgagtgcgagggccccggccgctacaacttcaccgggtacatggagctcatggagatggccaagaagaacgggctcaaggtgcaggccgtcatgtcgttccaccagtgtggcggcaacgtcggcgactcagtcactataccacttccgaaatgggtgttggaggagatggacaaggaccaggacctggcctacacggatcggagcggccgccgcaactacgaatacctctcgctcggcgccgacgccatgccggtgctcaagggccgcacgccggtgcagtgctacggcgacttcatgcgcgccttccgcgaccacttcgccgccttcatgggcaacaccatagtcgagattcaagtcggcatgggtccggccggtgagctccgctacccgtcgtacccggagagcaatggcacctggagattccccggcatcggcgagttccagtgctatgacaggtacatgctgagcagtctcaaggcggcggcggaggcggtgggcaagccggagtggggcaacgccgggccgggagactccggcgggtacaacgactggccggaggactcgcccttcttccgccgtgaaggtgggtggaacactccctacggtgagtttttcatgagctggtactcgcagatgctcctggaacacggcgagcgcattctgtcggcggcgtcgggcgtgtacaccggcacacccggcgtgaagatctccgtgaaggtggccggcatccactggcactacggcacgcggtcccacgccgcggagctgacggcggggtactacaacacgaggcaccacgacgggtaccagccgatcgcgcgcatgctggcccgccacggcgcggtgctcaacttcacgtgcgtggagatgcgcaaccacgagcagccgcaggacgcgcagtgccggcccgaggagctggtgcagcaggtggcggccgcggcgcgggagtccggcgtggggctcgccggcgagaacgcgctgccgaggtacgacgagacggcgcacgaccagatcgtgacgacggcggcggagaaggcggaggaggagcgcatggtagcgttcacctacctgcgcatggggcccgacctgttccagccggacaactggcgccgcttcgccgcgttcgtgaagcgcatgacggagtccggcgtgcgggacgtgtgccgcgagcaggtggagcgggaggcgcagggcgtcgcgcacgccaccgggtcgctcgtgcacgaggccgccgtcgcgctcagcaactgatcgatcagccgacctcgcgcgtagaagggtaaaaacgctttacatattttatactcccaagattatttgttgtaatcagcgtcgcgtacgcgtgcgacgacatcgatcgctcaagtgtgcaaccttgatctgcgaaaagaagaagaaaaacatagtgtggtgtgcgtgtgtgtgtgtgtgtgtggggggggggggggggggttactgggtaagtacgtgtacgtagttgccacgtttcaggcttttgatgctggccgattctggcatcgctcaaagcttttgcttttgcaggaaatggatgtaactattacattttctatcataagaaaatacatgtacttcaaaacccgaaatgccagtactacattcgtgca

SEQ ID NO: 124 - DNA, 2259 bp, Oryza sativa
gggaagttggccgccgctgcgtagccgaagctccaccacacgacaccccgcaaaacgccatgcgtgctcctgctgcacacttgtcccccgcctcctccgccgtgccgtcacgcaaccacggactcctcctccacctccgtttcctactctcttcttcagtttctcacctctccgcacgagaaaattcgaatcccccttccggctgctggttttcgtgccagaaacaggcgattttaccagtgccagttagctctcgccttcctcctcctccatcgtgctactactctgttcttctggaagaacactggtctcctcgcctacctcagtcaccactcaccacaccaggtgcgagctataaaaaccggcacgccaaaaatcttcaaaaccacacagaaacctcagatctccgaggcttcccaagcgagtcgacgaaaatgcccgtgatggctccgaccgcatctcttctcctctccccgaggccgctgccggcgagccgccgggtcccctcgctcccggcgctctcggcttccggtcgcctgcgcctccgccgcgcccgcgccgacacacggctccgcgtggcggcgccgccgtccgtccccggggaggcggaccaggcgcccggggagaccgagccgagcacgtcgtcggccgacgagaagttcgtgtggagggaccactggtaccccgtgtccctcgtcgaggacctcgaccccagcgtgcccaccccgttccagctcctcaaccgcgacctcgtcatctggaaggacccaaaatccggcgagtgggtcgccctcgacgaccgttgcccccatcgcctcgcgcccctctcggaggggcggatcgatgagacggggtgcttgcagtgctcataccacggctggtcattcgatggctccggcgcgtgcacccggatcccgcaggcggcgcccgaggggccggaggccaaggctgtgaggtcgccgaaggcgtgcgcgatcaagttccccaccctcgtctcgcaagggctgctcttcgtgtggcccgacgagaatgggtgggagaaggccacggctaccaagcctccgatgttaccgaaggagtttgaggatcctgcgttctccacggtgaccatccagagggatctgtactatggctatgatacattgatggagaacgtctctgatccgtcgcatatagaatttgctcaccacaaggtcactggtcgaagagatcgagccaggcctttgccattcaagatggaatcaagtggtgcatggggatattcagggtcaaattctggaaaccctcgcatcagtgcaacttttgtggccccttgctatgcactgaacaaaattgagatagacacaaagttacccatttttggagatcagaaatgggtcatatggatttgctctttcaacattccaatggccccagggaagactcgttctatagtttgtagtgctcggaactttttccagtttagcatgccaggaaaagcatggtggcagcttgtccctcgatggtatgagcattggacttcaaatttggtctatgatggtgatatgatagttctgcaagggcaagagaagattttcttgtctgcatcgaaggagtcttctgcagatattaatcagcagtacacaaagatcacgtttacacccacgcaggctgaccgttttgttttggcattccgggcatggctaaggaaatttggtaacagccaacctgactggtttggaaatcctagccaagaagtgttgccttccactgtcctttcaaagcgtgagatgctagatagatatgagcagcacacactgaaatgctcatcttgcaaaggggcatacaacgccttccagactctgcaaaaggtcttcatgggagcgacagtggcgttctgtgcaactgctgggattcctgcggatgttcagttcagattattgcttgccgctgctgctttggttagtgccgctgtagcgtacgcattttatacgctccagaagaattttgtatttgtagattacgtgcatgctgagattgattaaacaagcatgacatctgatctgagatctggtgaagcgacatcacacgatcatttgtgcaacgtaagctagggaatatagattgtcggtggatatagtctaatgttgcattgtaggcaataggtttgtaatttgtattagctcttcggagatgatgtacaaaagttgaaatgaaaaatgtaattttgctcatcatggcccaatgacttttgattgatgactgatgagttattctcaa

SEQ ID NO: 125 - DNA, 1503 bp, Oryza sativa
cacacttccatttattctcccaaccgcacgcgctccgacgcgcagaaaggcagcgccgtgactgagaacaagagaggccggcacagagagacgctctcggctagggcacggatcgtcgcgacgaaggaagatgtcgtactccagaggatcaagatatgagtccgactcatattctacatcgcccagacggagcagccgttcaaggtataggagtcgttctagaagtgtggactcaagtgatgttgaaaaccctgggaacaacctgtatgttactggcttatctgctcgtgtgacagatcgagatctggagaaacacttttctgctgagggagaggttattgatgctagcatagtacttgatccatggacaagggaatcccggggatttggatttgttaccatggctactgttaaggaggctgatctttgcatcaaatatctagaccgctcagtgttggaaggtcgtgtgataactgtagagaaggccaagagaagacgtggtcgaacaccaacgcccggaaggtatctaggcacaaaatcatcatgtgtgacaccagcacggaggtattccccaagctactcgcctgttgaaagagaccgctacagttcacgctactcacctgagcgagaacggtcttattctccttatggtagaaggcgatcatattctccatacaacaggcgaagatcatactccccctatgagaggcgtagatcctactctccacatgaaaggagacagtcctactctccgtatggcagatccccttctccttatggtagacggcgatcatactctccctatgacacacgtggttcacggcgtcggtcatactcatcttaccgtggttcccgctaccgttcaagatctccataccgttacagaagagagaggtcatgttcctatgaccattctgtttcaccatactatagaaggtgctattctccaagtgctagaggacggagctattctcgcagtgtatcacctcagaggagctactcccatagctgttccccggattctcagaggtcagggagctattctccaaggaaaagatacagtgaaaggaaaccgtcgcgcagcaggtcgtcgggtaagaggcattctagggagagctactctcacagccgcagttcctactcaaggtctgtctccagggagcgctcagaatgaattgaagcttgatgttctagagatcaataaagctctctatgcctaagtgtatgtctgtatctcgtgaagcttactttgcacctgtttccaacttagaaaccgtgtaccataatatttgtgtcgtattgtatcggatacttctatatgtttatgcttactttcgtaggcagatattattggtggttcgttatggtgtccagatctacaatctgtagcatattgatacttactgtgtgttgtatcaggttctgttatgctgtcattttcgcaggcagacacagttggttcaggcagtcaggctgggttttgtgctactgtgggcaaatcaa

SEQ ID NO: 126 - DNA, 1264 bp, Oryza sativa
tctcccctccttctccccgcgttacaatcagcacacgctctctgctagtctgatcgctctcgccatcgcacctctgtctcgtcgaacaatggcctccaccgccgccgcttcctcccctttcgactgcgtcctctttgacctcgacgacacgctgtacccgggaagcgcgggcatcgggctggcgacgaagcgcaacatcgacgagttcctcatggcacggtgcggcgtcacggcggagcgggccgccgcgctccgcgtcgagctcttccgctcctacggcagctcgctcgccggcctcatcgctctcggctatgacgtgcacccggatgagtaccacagctacgtgcacgggaggctgccctacgaccggatcgccgccgacccgcagctcgccggccttctgcggagcatcccgcagcgcaaaattctgttcaccaactctgatcgcgcgcacatgaggaaggcgctgcagcggctgagcgtcgacgagggctgcttcgacgccgtcgtgtgcttcgagaccatgaaccctcacctcttcggtgaggcgccgtgcgcctccggcgatgaccgccccggcgtgatcctcaaaccgtcccccgatgccatcgtcgcggctctgcgcatcgccggcaccaatccacaccggacgctcttcctcgacgacagcgagaggaacatcgccgcaggaaaagctcttagcctccgcaccgtcctggttggcaagagggtgaggagcaaggaggccgactacgctcttgagagcatcggcagcctccggcgagccatcccggagatttggggcggcgtcgccgtcgccgtcgccggcgaacagctcgaccacggcgccgcggagaagacgaagggaatgaggtccgatctggactccatcatccagccaacgtcagtcctggcgtaatcggttcctaatccattcgcacataaacaaatcgccactaataaaagcaagtactgtccattaattatcatgtaaattattctgattcctgatgctgagtgcgtgtgcagtgtatttgtatatgggcctggctgacaaggaaatatgcatgtgtatatcagttctgatgatcagcttttgtttgctgtaaaatgtaaatggcactatgagcaaggaatttgtctttgattgctgttttttttttgtttgtgtgtgtgtgtgtggccactgtacaaattgaagcatgctattttttccccttaaaaaatcgtagagctgcaatgagtagtcaccgtgcacaatagc

SEQ ID NO: 127 - DNA, 1168 bp, Oryza sativa
agctatattaccatctctgtcatatctcctcctctatccatatccatattttccccttttccatccgcgagcgagggagtgagtgagcaatcgagatcgagatggaggtggcgagaggcggcgggaagctgaacccgtgggcggagcccttcgtgccggcgggctggtcggccacctactggcgctgcggcggcgtcgctgccgtggagccggctgtggccgaggtggaggacttctccccggagtggtggcgcctcgtcggctcctccccggccttccgcgaccgctggctccgggactactccgcgctgggcctcctcgacgacaacgacaacggcgacggctacgacctcgaggggttcctcctccccgacgacctcttctcctccacccctcatctggtgggagaaccggcggatgagaaggagggcaagggtttcggcggcgccggggggaagaaggtgaagggcgggtccgccgaggtggtggcgtggggcatcgacaagtggtggcgcgcgcactcctcgccgccggaggtgcccaggtacgccgacaaggcgcccaggagggtcgccgccgccgccgctagggtcaacccccgccccatccagcagccgcgctgagcgtccgtctccgccgccgcccgcgtaatcatccatccatccacccatcttgacaaacaagcagaaaaaaattagggaaaaaaaggttttgttttgttattttcgatctactcctagcttttttgctaatctcgtcgcgtcgtcatcgtcgtcaagatctgggttttggtcaggatctatggagctgcgagagatctcccctgtgttgtgtacagaatcatgtaaaaaaaatgctgatgtaataaagattgcagcgagagatttcgcagctgctgccttgtaatttccgagatatggatacagttcccctttcgtgtctgagctgtgatttttcattatccgtttgcctttctgattagcactagctttggtgcgatttgccaccctcagataaggaagagagactgaactctgaacaagtgcagcctagggggtatgacggacagaagcccagacattgttcctgtaaggaaaaattatacttttgactctactcctttaaccattaaaaccgatgcaaattatattcttgggcggttttaaaa

SEQ ID NO: 128 - DNA, 970 bp, Oryza sativa
acagccagtgcaaatctgatcgatcaagataatcgagcaaaatccatcagagttctaacattcgcgcgtgaatttcgaggttaatttttgaagcttaggatcaatggcttcccaccaggaccaggctagctaccgcgccggcgagaccaaggcccacaccgaggagaaggcggggcaggtgatgggggcgagcaaggacaaggcgagcgaggcgaaggacagggcgtcggaggcggcggggcacgccgccggcaaggggcaggataccaaggaggcgacgaaggagaaggcgcaggcggcgaaggagagggcgtcggagacggcgcaggcggcgaaggacaagacctccagcacgtcgcaggcggcgagggacaaagccgccgagagcaaggaccagaccggcggcttcctcggcgagaagaccgagcaggccaagcagaaggccgccgagaccgctggcgccgccaagcagaagaccgccgagacggcgcagtacaccaaggactctgccatcgccggcaaggacaagaccggcagcgtcctccaacaggcgagtgagcaggtgaagagcacggtggtcggcgccaaggacgcggtgatgagcacgctggggatgaccgaagacgaggccggcaccgacgacggcgccaacaaggacacctctgccaccgccgccgccacggagacgacggcgagggatcactagacgccgtgaatgatttccctttgggtctatttatgtatgttttcacttcaaattcggtgcaagtttgaatttgtttttgtgtcgttttgagtctgtatcgatgctgtatgaagtggtggtcgtcgcaggggaggatttctgacgggtgtgggtgatgtgtactgatgatgttcagttgttttcgtcagagtttctcgtctgtgttctgtttattatggcgtaacaataataaaagtttgggcctaaagcccgcatttgtggttt

SEQ ID NO: 129 - DNA, 2206 bp, Oryza sativa
ctccacccgccagccagccagcgcctcctcccctctcctccccacgcaacccgatccattcccaaatccctcctctcatcaactcgactctcggtcggcgtcaccggcgtcggaggcggaggcggaggcggcggccgcgtcggcaaggtagtgctgtgctggatcgagtcgagcagctggctgcgcgcgcggtttgtggctctctgtgtgagtccggcgctgctgcttcaattccttcttccccagggcacctcccgtgagccgccatctccctccctcacctacctctggattcgctccagatccgcccatgagtaggcccccacgcccaccgcctgctcgccatcgcgcctccactccaccacaccatgccgatccccaccacctctgacactactccgcccctccccctctctcattcccatggaggacctcgccctgcccgccgctcctcctgcccccacgcttagcttcacgctcttagccgccgccgccgccgtcgccgaggccatggaagaggctctgggcgccgcgctgccgcccctcaccgcccccgtccccgcccccggagacgactccgcctgcgggagcccgtgctccgtcgccagcgactgcagcagcgtcgccagcgccgacttcgagggcttcgccgagctaggcacttcgctcctcgcggggcccgccgtcttgttcgacgacctcaccgccgcctccgtcgccgtcgcggaggctgccgagccgagggctgtgggggccactgcgaggagcgtgttcgccatggactgcgttccgctctgggggctggagtccatttgcggccgccgcccggagatggaggacgactatgccgtggtcccgcgatttttcgaccttcctctgtggatggttgccggcgacgcggcagtcgacggcctcgaccgggcctccttccgccttccagcccatttcttcgccgtctacgatggccacggtggcgttcaggttgccaattactgcaggaagaggatccacgccgtactgacagaggagctgcgtagagcggaggacgacgcgtgtggctctgacttatctggccttgagtccaagaagctgtgggagaaggcgttcgtggattgcttcagtcgtgttgacgctgaggtgggaggaaatgctgcgtctggagcaccgcctgttgctccagacaccgtggggtcaactgctgtcgtcgcagtcgtttgctcgtcacatgtcatcgtagccaactgcggtgactcgcgtgctgttctctgccggggcaagcagcccctgcccctgtcactagatcataaaccaaatagggaagacgagtacgcgaggattgaggcgctgggtggcaaggttatccaatggaatggttatcgagttctcggtgttcttgccatgtcgcgatcaatcggggacaaatacctgaagccatatataatcccggtccctgaggtcacagttgtcgctcgtgcaaaagacgatgattgccttattcttgcaagtgatggcctttgggatgtaatgtcgaacgaagaggtctgtgatgctgctcgcaagaggatattactatggcacaagaagaatgcggccaccgcatcaacgtcatcggcccaaataagcggtgattcttcagatccggctgctcaagcagctgccgactacttgtccaagcttgccctacagaaggggagcaaggacaacatcactgtcgttgtaattgacctcaaggcacataggaagttcaagagcaaagcatgacattgcctccatgaacaataacaatagtttataggaagctagaaatgtgggaaatccaagacaatttatttagctgctgcaccggtacaatttgtttagctgctgttcagtactggtgctgctgcagctgcagctgcttctttgccctcgccatttatttctgccgagggatgtactactagtatactgtatttttctacacggtacagactcccaaatctgattcagggtcgaggacataaggtggatctgggaattttggggtctctcaagacaagacagaaaacataacaaaatctgtagatgtaggtaggagtcctaggacagattgggtttctgcctctggcattaatcgtttttgttaaccggtaaagatactgctacttgcaattgctgtttcatatatactcctatatctttcttgtgccttcccttgtgatcaata

SEQ ID NO: 130 - DNA, 2852 bp, Oryza sativa
attgttagcgaggagtcacccagattcttctccaacctctcgcccccgaaatccacacctcacaacgccccttacgcccacgcgagcgaacccacaagaaacacgcgcaaaatctcccctcccgccgcgaattcgctcggtttgatcgcccgaagatcgaagtgtttcgcgcgggattcgtgctctgcagcttaagtttagtgcggccttctagctgctcggatttgattgattgattgattggcgggtggtcagtcgatttaagttggttggattggtggtagcgcgaaatccgaatttcggaagttggtttggtggggggaaggggaattgcggttttgtggagtttgatttttggtggtttagaggttgggggaggtcgcggcgaggatgtccgtgccggcgattgccgtgtacaccagcccgccgggggcggtctacacgtcgtcgtcgtcgtcggagcttgaggcgagctcccggggctcggcgccgtgcgccaccgcggctcccccgtcgccggcgagctcccaccgccaccaggccatcgctggtgggctatcctgcctcttctcctcacctaccgccgcccctcgcgccgccgcggctcaggacgagctgggcgcgctctggcacgatagatccggcgaggcgacggccgtcggcggcgggggcgggggcgggggctactcctacccgcagccgtcgtcgccgttcaagtggcgggacatgctccaccacagccccgtgccgctgttccacagcccggcctcctcgccggcgtcacggagcccctcggcgtcctggctcgccggccgcgagcgcgagcggctcttctccagcttcgtgcgcaacgcgctcggctcctgcgtcgattacgcgccggtcgccgcgctgccgctcggcgtctcggctgctgtcggtgtcggtgccggcgagctcgcgttcgagctcgacgagcacctctccgaggcggagccgtcgtgcgagccgtacgctcgcgacctcctcgccggcgcccaggctcgccaccgcatcttccacgacgagctcgtcgtcaaggccttcttcgaggctgagagggcgcaccgaggccagacgcgggcgagtggtgatccgtacttgcagcattgtgtggagaccgccgtgcttctagccaagataggcgcaaacgcgaccgtcgtctctgccggactcctgcatgacaccattgatgatagcttcatggattatgatcagattttccggatgtttggtgccggcgtggctgatctagttgaaggggtctccaagttaagccacttgagcaaacttgctcgggacaacaatactgcaagcagaaccgttgaagcagaccgcctgcatacaatgtttcttgcaatggctgatgcaagagcagttctgataaagctagcagatcgtctacacaacatgaagacaatagaagctttgcctttggtcaaacaacaaagattcgctaaggagactatggagatatttgtgccgttggctaatcggttaggaatcgctagctggaaagaccagctggaaaatatttgctttaagcatttgaacccagaggagcacaaggagctttcctccaaacttgtcatatcttttgacgaagcacttcttacatctactctggataaacttgataaaggtctaagagatgaaggtatttcgtatcacagtctttctgggaggcacaagagcctgtacagcatatactccaagatgataaagaagaacttaacgatggatgatgttcatgacattcatggtctacgtcttgtggttgatacagagcaggattgttaccaagctcttgacattgtccataagctctggccccgagttgctggacgatttaaggactatatcctgcatccaaaattgaatgggtatcggtcattgcacactgtcatcatgtgtgagggcatacacccatttgaagttcagatccgaacaaaagaaatgcatctacaagcagagtatggatttgctgcacactggagatacaaggaaggtggttgcaagcactcttttgtactccaaatggtggaatgggcaagatgggtgctcacatggcaatgcgaagcaatgagcaaagagcggtcctcaggtttaggccgctctgatgccattaggccaccatgtccatttccctcgcattcggaggactgcccttattcttacactcgccagtgcaaccacgatggacccatctttgtgattatgcttgaacatgataagatgtctgtccaagagcttcctgcgaactcaactgtagtcgatctgatggagagagtgggggccaatagtccaagatgcagcccttacagcttcccactgaaagaggaattgcgcccgagggttaaccacaagcccataagtgaccctaaccggaaactgtgcatgggagatgtggtggagctgacgcctgcgctcccacacaagtcgctaactgagtatcgggaagagatccagcgcatgtatgaacgaggcgggtttgccctcgccaccacccgggacggtccggcaagctgacggtgtcacgactaccatgttaacctcctgttgtacaatgccctcaacctccatttgcttccttgtatatatcccagatactaattcttgcaggagagagccaaatgaacacccccagctgaattgtcaaaggtgtggagttaggtgttcagtgttctgatccaaagctgtctataacagtaaacagtttacaagctgatcaaatctgtactagaaattcagatcctcccaagattcaggagggggggacattcactgccttgtccgtgtgttgttgtaatacatctactgtatattccagtggc

SEQ ID NO: 131 - DNA, 1435 bp, Oryza sativa
attctctctctcgttgctcctgagatcgtctcgtctcgtggtggtggtggtggccattgccggagcttccaaggtgtttgatgtcgatggcggaggtgtgctgtgattctgcggtggtggtcggggcggaggcggaggcgagggcgagggcgcgcgccgggaggcggcggcgggcgggagttgagggggcagggaggtggaacgccacggcgacggctgcgggtgtggcggcggaggaggccgcgacgaggaagcggagggcgagtggtggtgaggccgggttggtggtggtggcgaagcggcacggggcggcgtcggtcgccgggaggaggagggagatggaggacgccgtgtcgctgcgcgaggcgttcgccgcgccggcgaacggggaggttgcggcggcgaggtgtgacttctacggggtgttcgacgggcacggctgctcgcacgtggcggacgcgtgcagggagcggatgcacgagctcgtcgcggaggagatgggcgccgggtcaccggcggcggcggcgcgcgagccggcgtcttggacggagacgatggagcggagcttcgcgaggatggacgccgaggtgatcgccggctgccgagccgagagcggcagctgccggtgcgaggggcagaagtgcgaccacgtggggtccaccgcggtggtggccgtcgtggaggagagccgcgtcgtcgtcgccaactgcggcgactcccgcgccgtgctctgccgcggcggcgcgcccgtgcagctatcctccgaccacaagcccgaccgccccgacgagctggagcggatcgaggcggccggcggccgcgtcatcttctgggagggcgcccgtgtcctcggcgtcctcgccatgtcgcgctccatcggcgacgcctacctgaagccctacgtcaccgccgtgccggaggtgacggtgaccggcaggtcggacttcgacgagtgcctcatcctcgccagcgacggcctctgggacgtcgtcagcaacgaggccgcgtgcgaggtggcgcagtcgtgcctccgccgcggcaggcagcggtggtgcgccgaggcggcggcggtgctgaccaagctggccctcgctcgccgcagctccgacaacatctctgtcgtcgtcgtcgatctccggcgaggcaacgccttgtagagagagtgtcacccagctgatgctgtagcatcagtactagtattgcagatattagctaagctaatggttctactaatctttttttttcatttcccttgtgttaaaaatcattttttttctcttctaattttctccctgaattaaccaagttcagtggagcacatagatcaggtgatggggttgtgcaactgctagttggtgtaaccagaatttcatctggataccaactgaaatgaaatgaatattaagcaagattatttgagaaggaagtttaaacc

SEQ ID NO: 132 - DNA, 813 bp, Oryza sativa
cggcgcggcgcaccactccaccaccaccaccaccactccaccgatcggcgagagcgcggggagatcgttcgacggcggcaagatgcagatcttcgtgaagacgctgacggggaagacgatcacgctggaggtggagagcagcgacaccatcgacaacgtcaaggccaagatccaggacaaggaaggtatcccgccggaccagcagcgcctcatcttcgccgggaagcagctggatgacggccgcaccctggccgactacaacatccagaaggagtcgacgctgcacctggtgctccgcctccgcggcggcagcaggggcggctacaccatccaggagcccaccctccgggctcttgcgctcaagtacagagagaagaagaaggtctgccgcaagtgctatgcacgccttcccatcaggtctcaccactgccgcaagaagaagtgtggccacagcaaggagctgaggttgaagaagaagttcatcaactcgctttcgatagcgtgaggcactggaaagtgttcaccagctgaatcaatctcttggatctccgtgtgcgcagctaccatgttatgtccagtttagaagtactccgtagttgttaatctcttggaacttcgtatgcccagctaccatgttatgtccgtagtctagaagtagttgtggtacttagtacgcttgagagctctgggttgttgcttaaagaagttgtaaccctgcgaagctgcgactgggatgttgaaccctctatcatcactctgaatgaagaagttatcgttactagtagtaaatttttaatctcctcccttttattc

SEQ ID NO: 133 - DNA, 3766 bp, Oryza sativa
gagctccttggttgtttcacactcccaacctcctcgtcccccttcccctcgttttcccccaaattccgctcctaaaccctccctctcctctcactccggccgcgattctcccgccgccccggcgatggtcccgatctaagcatgtccgacgccgacggcttcggttgcgagcaccgccgaccctccaagcgccgccgcgacgggcccgatcatgccctcctcccggtgtcccgagaggtgctgatgggccaccccgatgaccccgccgccgccgccgccgccgtgggggcggaatcctcctcggcctcgtcatacctcggggttgtggcggccgccgcgtccgcctccgcctccgcggcggggggtttctcctgcggggcccacttcttcgtgcgggccaccgactcgaggaccgtgtcgatgcacgcggcgtggggggacaccgtgggcgccgtgctcgcgcacctcgccgaccgggggtacggccgcgacctccgcctcgtctacgccgggaggcagctcgcgccggagaccgccctcgccgacctccgcctcccgccggactccacgctgcacctcctctcccgcctccgctccaccccctacccggacgcgtggcagctcgcttcctacatcgcctccaccgccgccgccgccaagtccgaccccgcccacaccagctccgccgccaacatcaacgagctcgtcaaggagttcatcctctgcgcgcaccgagccaacatgcggcagcgccatgatcgcgactcccccctcttcgatgcccaacccacgggggaccacgcggcgcagtacctcgagattttccgccaggcgggcgcccccttcgcgctggttcgcctctacgccgctaatccctcctccgcctcccaccatcacgcggagaacgccatcaaatgcttcctcaccatggatccttcggccttgccacccgacgtgctgccggtcatggcgccggtgctgcttgaattttgcgggttgctctctttttctgtgggcaagagggatgaactctatatatcatcccgttctatgcttgcaacagtgctcagcttgccttctgggcttcccccttgcatcaagtcaccttccaagctgatcgagcaggtccttccgtttgctgaagaaatagtgggagtggttatggacgaacttgcatcactggatatgactgtgtcatccaaaaaccttgaagacctctcaaatttctttaaagtgctgcgccagcaggcactccgttgggttcccaatggggggccattgcccaagaatctgtataacagtgagcgtgggcataatgacacgtgggtgtggaagttgcacgaaatgtcaatgaacttattgaacagggtggatgagtgcttgaagaggttggaaatggatctgtccttgtcatcggagaacagaggggtcaatataagtcaatctcgatgggttgcccggtcacatatgctggtcatgctgacacaactagattttatatcgatgatttatgaggatttggcacataacctacggcttgtgttgctggcacacagagatcctctcaatgccctcgtgcgctgttccaagaggaatgagcatctccactggcttgtgaagcataaagacctcctttgctttgaatcaagaaggaatttagtcttgatgatgctacctgagggaaaggatgaatacggggagcttcatgagatgttgattgatcggcaacacttattggacgagtcctttgaatacattatacaggccagacccagtgagcttcgcagtgggctatttatggagtttaagaatgaggaagcgacaggccctggagttctgagggaatggttctgcatggtgtgtcaagctcttttcagcccgcagcaagttctcttctcgccttgtcctagtgatcgacagaggttcttcttgaacggaacatctgctgtggatccactgcacctgaaatacttcatattttcaggacgaataattggattagcattgatgcatagagttcaagtagggatcacattggaccgcacattattcttgcatcttgctgggagaagtattaaattggaagatatttctgctgcagaccctgtcatgtatgcaagctgtaaaagaattttagagatggatgctgctgttgttgatggtcttgaactaacattttcccgagatgttcatgaattagggtctcgaaggactattgagctttgctcaggagggaaggatctccatgtaaatatcaggaacagagagctttatattgaccttcttattaagagtaccttcgtggattccatatcagttcagttaacccatttcgtgcgcggatttagtgacattctagttgatccggaactccagaaagtattttttgagtttttggatctagaagacttcgacggaatgctagggggaagcaacaaaactataaatctggaagattggaaattacatactcaatataacggctacaaagaaaaagatcgccagattatctggttctggaagctggttgagagcttgtcaattgagcaacagaggcagctgctgttcttttggacttcagttaaatatttaccctcagatggttttggtgggctggcctcaaaactgtacatatataaggtatctgagtcagctgaccgtctcccatcgtcacatacctgcttttaccggctctgcctgcctgcttatccatccttgaaagtgacgagaaaccagctgcagaagatcacacaagagcatgtgagctgtagctttggcacatggtagatgccgcccttatggtaatccaatatggtaaattctgtacatacccaagttagtgtcgatttacctgcctcaattgaagctagaaattaaaagcaataggctatcttttgtttgttttgtacatatttaaagtgttctgggccatttaatctagttaggcataatcagaagagagcaggttcctttcattctccctcttttgaaccaggcttccatttttcatatactttctggagaagtgtggtgggagcatttgcatcgtgctatgctcacaagctctggaagccagttaaggcttaaaccatgtcataaaggtaattgcaacgtgtagtagccatgtggcttggtgttcctggtggagctgaaattctgcatagagtcgagtagagttaaagtgatcatctgtttgtgaatctggacaaaatcggtcactgaaactttgaaggtatgcgactctgctaatgtgaagttaaaactcggatatgctttgctgtttagtaccagcaggcagcagaaattttctgggaatcagccagaaaccggtgtctcagcagctgacaagtgatatggaccatactctgcctgaacatatggattccaacgatgtctttggtatatgaatcacaattatatgttgacaactacacccggtggaatcggatgcctagttgatgtgtattcacacctttcaaatgttttgcatctgtgagagaaattccataccaaatcccgctgaaactctggcaaatttccacgggatgcttgtgcacggttgcacctacagtttctccacctttgcgagccgccgatggagagatcattgctgcactctaatcatctatcctctgattcattttgatttcactcatcttcctcccctcttcaacattttgtacaaccaatgaaatgcagttacttggcagcgctgaaacacaaatgccgaatagttttgatatgacgcaattgcctcataattctg

SEQ ID NO: 134 - DNA, 1955 bp, Oryza sativa
tgaactcgaacgagcaatatatatataatcttcagtgagaaaagcctcagaaccacaccctcgagagcccgagctggagaagaagagaagaaaaggcggccacggaatcgtcggccgccgccacctccgccgccggcgcagagctccgccggtatcggccaggtggctcttctcctctctcggaatcgaaggcgagcgcgcgctttaatttcttcatctccctccatcttcttcattggcggcggcggcggcggttttgcggcggcgcgtgcaggccagcaagaacgaagctaaggacagggaacagtgactgcttgttgaactaagctacaacaatcatgggcctcctggagctctttattacagcatgtgtgccggttctgaacatgcttctggttactggtgttggatcattcctggcaactgattttgttggcatactgaacaaagatgcacggaaatatctaaacaatatagtattttatgtatttaatccatctcttgttgcgacctatttagcacaaacaatcacattggaaggcttggctaaattgtggttcatgcctgtgaatattcttcttgcttgtacctttgggttaatccttggatggatcgtggtacatgtcaccagagcaccggctaggctaagaggcctcattttgggttgctgttctgctggcaattggggcaatatttttctcatcatcattcctgctctttgcaaagagaaaggaagcccgtttggagcacctgatgtttgtcacacttatggattagcgtattcttcactctcaatggctcttggtgctgtctttctgtggactgtcgcgtataacattatgcgagccacttcaaaagtggctgatgaaggtaatgctcgaacaaatgatacaaaagtatccaattcagggagcagtacaggaacagcgtcagaagagaatttatcaatcccaaacgataacaatcaatgcacactccctttgatatccaattcaagtgtaccttcaagcaaaactaaggtcacattgtcagagagagcgaagcgatttgtatcatcaatgttcggagcaattgacttcaagaagatctttgctccttcaaccattgctgtgattattgggtttataattggaggaacgcctctaattagaaatgctattatcggagaaaacgctcctcttcgtgtcattcatgagtcagctgatctaataggtggaggagcaattccatctgtcacactgataatgggagggaacctcctcaatggattacgaggagaagcaagcgtccagccttcagtgatagcgagcgtaatcgtcgtcagatacattcttctcccttcgctaggcaccttgctcgtcaaatcggcggttcacctgggcctcatccaccctgatcccctctaccagttcatcctattgcttcagtacgccgtgccgccggcgatgaacattgggaccatcacgcagctgttcggcgtgggggagagcgagtgctccgtcatcttcgtgtgggtgtacgccctcgcctccgtcgcggtgacggtgtggtcggcgttcttcatgtggacgctgtcgtgatagatcgatcgatcgatcggacgccgcgtgccggcgtgaggaggtttcagggggttcagagacgacgacggcgagacgtacggtgcgttcctccggcgagacaggatgaagcgaccgggcaagatgacgccggcgagagggcggcgcggctgctgctgcatcgcatttgcgtcgctggagaagatgcaacgcgacatctagctaaggcaattcatggcgttcgtgttcgttgtctcattccgagcaaataatgttgtgatttgtattactatctgtaattcggcgtgtgtgtttgccgccacattttggctaaattaatcgatatttgggccgggccgggatggcccaggatccagcgagaaacggttatccgct

SEQ ID NO: 135 - DNA, 1527 bp, Oryza sativa
aggaaacccaccaccgaattcgtccgtactcctcctcctgcttcccctccggcgacggcggcgcagatctccggttggaagttagggtgttcatcttgacacaaaatcatgccgaaatcaaactgtaccgaagcgaaaataagatatggattagctctccttccaattgatttatcgttctgtcaatattgatccgaatacgaaaattttaagtgctgttattttgaaggtttcggaaccggaattcggaattgcagtagcagtggatgcctttataaatcaagttcttgtccttggcttcaaatactcgatgtgtttcttggctaatcctaatccctagctgcttgtgtgttgcgtgtgcaatttctgacccttttgtggtggtgtatatcaacagagaaatctctagctttttcagcggcgaagcgaatccatggccgagcacctcgcttccatctttggcacggagaaggaccgcgtgaactgccccttctacttcaagatcggcgcgtgccgccatggcgaccgatgctcccgcctgcacaacaagccgtcggtctcgccgacgctgctgctctccaacatgtacctgcgtccggacatgatcacccctggaattgatgctcagggcaaccccatcgaccctgagaagatccaggccgacttcgaggatttctacgaggacatctttgaggaactcagcaagtacggcgagatcgagagcctccacgtgtgtgacaacttcgccgaccacatgatcggcaatgtgtatgttcaattcagggaggaggatcaggccgccagagcgctgcaggcgctgacggggcggtactactccggccgtcctatcattgtcgagttctcgccggtgtccgatttccgggaggccacctgccggcaatatgaagagaacagctgcaaccgtggtgggtactgcaacttcatgcacgtcaaggagatcggcagagacctgaggaagaggttgtttgggcacctgcataggtcccggagaagccatagccatggccggagccgcagcccgagcccgtaccattaccggagggactatgatcggaggagctcatcgcggtccagggaccacgacgattactaccgtggaggtagccacgattactaccgtggaggtagccggaggagcagcgagaggcaccgcagcagctacgacagcgatggcagcaggcggcggcacaggtccaggactaggagtcctgtcagggatggtagcgaggagaggagagctcaaattgagcagtggaaccgtgaaagggaggctgcacaagtgtgatctctggattagttgctgtttgcaatggcccatgtttctcatcttgtactggtagccctagattaaattagcatcatatcttatcttaatgatctgagcttggatgtactcgagattttccttactgaacttgaattttctgtcagatgcatgtgttaactgaacctatttggtgttaaattatatttgtactgatggttgtgtgctttcggttttgttca

SEQ ID NO: 136 - DNA, 1346 bp, Oryza sativa
tcatcaatcatcctatagttgctcccctatttcagcatctcaatttaagaaaggtgtgaaggcatgccgatcccggaaaaggacggggtggaggacaatcaagaggatgatacattttcaaggttgcaattgcttgcacaacaacgacatgccatggagaagttctggaggatgagccaggaacagatcgaagaatccgcaggcaacgaagagcttatactgccgatttcccgtgtcaagaatatcatccatgcaaaggagggtggtatgatgttatctgctgataccccagcttttgtaacaaaactttgtgaacttttcgtccaggagctcatccttcgtgcttgggtgtgcgccaactcacacaatcgtgaaatcatacttggcacagatattgctgaggcaatcaccaccacagaatcctatcactttcttgctaatgtagtccatggccaccaggcgctaggaagcaacataccagagataggggtttctgcttggaagcgccataagctagatgaaatgacctcactctgccatcctccccaagcagtgcaggtcacagatttagctaaccatccacccaatattcctgtttgtcctcctataggtcaatcgggtactcagcacacaacatctacacatgttttgatgatgcaaggagaatctattcacaaggcaagtaaagaaaaatccccactgaaggaagtgatggtgccgaccaacaaggtgggcatgaccaacagctcttatggagttcctaatggtggtggtgctactagtagtaaagttgttattgatagcccgaaaggcgaaacagcacaagttttctcttcccagcatgcatgtccttccctagaagataactatgttattcccattcctgctggacatggtgatagttttcgtactcttgatgaggccaatataccccagctacatcaggagcagaaaaactttatttcacaagatgctattgttggtgaaaacattccgctgaatgagtctttggaaaagagcaagcataaggatgaggacttactttttcctgacaaagatcttcctgagtgatctacaagacagaagatgaatttcatgacaatactaggaatacaaaataagcaacgaactgaagaaggatgcatcctggttaatccatcgaccatgtcttagtagagttttcttctgtgtttctgtgttgaagctttatgatttaccttatactttagtcaagatgaataagaaataagtatgtgtttccgtgtgaggcggtaatatgtagtaccttgtatttccatccatcttcgtatggacaataataataagacctctgtttgcttcatgat

SEQ ID NO: 137 - DNA, 1620 bp, Oryza sativa
cattggaggaggagatctctccctctcatcatcatcatcatcctcctcctccctatccccttctcccccctctctctctctctccaccccgcgcggcggccgcttccgatccctctccgaccgaccaagcgccgcctccaagaatggggagctcggagaagaacggaactgcttatggcgagtacacctatgctgaactggagagggagcagtactggccgtctgagaagctgaggatatcgatcaccggagctggtggtttcattggatcccacattgctcgccgtctgaagagcgaggggcattacatcatcgcctccgactggaagaagaatgagcacatgactgaggacatgttctgccatgagttccaccttgttgaccttagggtcatggacaactgcctcaaggtcaccaacggcgtcgaccatgtgttcaaccttgccgctgatatgggtggtatggggttcattcagtccaaccactctgtgatcatgtacaacaacaccatgatcagtttcaacatgctcgaggctgcacgtatcaatggtgtgaagaggttcttctatgcctcaagtgcatgcatttaccctgaattcaagcagcttgaaactaacgttagcctgaaggaatctgatgcctggcctgctgagcctcaagatgcctatggtttggagaagcttgcaactgaggagctctgcaagcactacaccaaggactttggcattgagtgccgtgttggccgcttccacaacatatatggcccctttggaacatggaaaggtggccgtgagaaggcaccagctgcattctgcaggaaggctcagacttccactgacaggtttgagatgtggggtgatggcctccagacccggtccttcacattcatagatgagtgtgttgagggtgttctgaggttgacaaagtcggacttccgtgagccagtgaacattggaagcgatgaaatggtaagcatgaacgagatggctgaaatcattctcagcttcgaggatagggagctgcccatccaccacatccctggacccgagggtgtccgtggccgtaactccgacaacaccctcatcaaggagaagcttggctgggcacccacaatgaagctcaaggacgggctgaggttcacctacttctggatcaaggagcagatagagaaggagaagacccagggcgtcgacatcgcgggttacggctcatccaaggtggtgtccacccaggccccggttcagctgggctccctccgtgctgccgatggcaaggagtaatttcaaagctgctacaccatgaagatcaatcagctcctctcagcttgatcgtggccataccttacttcgctacagatagctcacagaaatgaattcttcttggaaatcttgcaacctttcagaacaacaacagccgttcttcctgtcgttataactcatatgcagtacaccggtttcttgtgtttaaaaagctatactcgagatttcttcctcttttttttttcgcgtcgtgttggaaattcttcgtatggattacattttgtcatatgaacaatgaaacaatgggaatgctctgcattacctttatgaatagatgatgtgttcttcctactctcctctc

SEQ ID NO: 138 - DNA, 1574 bp, Oryza sativa
acacaccgagtcatcgctcgccggagttagagttcgtagcggcgaaggatatagccatatattatagatggcgattggtgttggtggctgctgcgccgtgctgctcgcggcggcgctgctcttctcctctccggccaccacatatgcttatgattccctggatccaaacggcaacatcacgataaaatgggatgtgatgcaatggactcctgatggctatgctgccgttgtcacactgtccaactaccagcaattccggcacatccagccaccggggtggcagctggggtggacatggcagcagaaggaggtgatctggtccatgtacggcgcgcaggccatcgagcagggcgactgctccatgtccaaggagggcagcaatgtcccccacagctgcaagaagcatcccaccgtcgtcgacctcctcccgggcgccccaatcgacctgcagatcgccaactgctgcaaggctggatcactgagcgcattcagccaggacccggcaaattctgccgcgtcgtttcagatcattgtaggccattctgggaacagcaatgagactgttagggtgccgaagaacttcagtcttatggcgcctggtccggggtatacctgtagccgtgctatgattgtgaagcctagtaggtttttaagtccggatgggaggagggcgactcaagttctgatgacatggaatgtgatctgcacatactcccaatttcttgcacaaaaggttccatcctgctgtgtttctctctcgtcgttcgacaatgacaaaactgttgactgcccaacatgctcttgtggctgccgaaatgaaaaatctactacaggaaaatgtgtaaagaagaatgcacctgatttgcaatccatcattcacggccctggcagatggacctggcagcctcttctccagtgcacttcacacatgtgcccagtgaaaattaactggcacttgatgctcaaagacaaggaacactacagagtgaaaatcactgtcactaacttgaactaccgcatgaatttcaccgaatggaacctggttgttcagtatcatcccatcctcgatatcacccagatatctggcttcaattacaagtcaatccaagtcggcaaaataaatgatactacgatgctatggggagtaaagccctactatgatttgctcatgcaagctggtccgcttggaaatgtgcaaggagaactgattgtgagaaaggatttcagggcttcttccactactaacaataacaagggaagggccttcccagtccgtgtgtacttcaacggtgataactgtgtgatgccgcctccggatgcatatccagttagtattacggcttagaggcgatcgtcaagatgattgtatcgcattactatatttatggggtcatgaataaagtgtattgtcttgcctattgaagattagaagtaactataattaaattgaatctccaactagtattaagattgtcagaggtctgttattttgcttgtagataaaattctgcctatgttaacttcgatggtgtcaaagatatcaaatccatagcagattcgtggcaggggccaaa

SEQ ID NO: 139 - DNA, 976 bp, Oryza sativa
cgctcttcctccctcctctccctgccattgctccgctcggctcgctgcgaggttggtgctccgcgggtccacgcggcgttgcgagagtgagagagaggacgaggtcctcctccttccgcgtcccccgctcgctgtttcatccgcttcttcctccctccatcttcgcttgtgagctcctccgcgcgtcgcgagccttactgaaacttctgatccctccgaaaccgagaaaagaggggaatctgtgaagagattttagcagcagtgcaatggaggtatttggaaaatccgtgattgctgagcccagcaatgtgatttacttgtccagtattcttaacacagaagggccaatccctagtcacaagtgtgacaagaattgccagaacgagcacgtctttggcaacatgtaccgttgcaaactgaccgggaccacgcacatctgcgacaaaaactgtaaccagaggatcctctacgacaaccacagctcactctgccgggtcagcgggcagctgttcccgctctcgccgctggagcagcaggcggtgagggggatccggaggaagcatgaggtcgacagcaacgaagggtgctcctttaagcgcaggcgaggtgcacaactgcatccatcccctttcgagaggtcctacaccgctgtgtctccaatcccaagccaagttggagacggcatggacctgagctagagataacgagaatccgtcttttcttgcccacagctggctaatgccgttgtttcgacccctttctccctttgacaggatggaactataagagcttccttctttatagacttacgaagggatatgagactctccttggatgcaccgaataaatgtctatgtagtatcagttctaatttatgggaccttgttgtaactcgtaattttggttgaaccgcctattctgaattgcatagtactttctgataatcatttgatgctatcgcttagattattttcct

SEQ ID NO: 140 - DNA, 2080 bp, Oryza sativa
cacgccgcacccgctctcctgtctcgaacgtacacacacgcatcccaaatggcccacgtcatggccgcctccgagctcgtcaccgccaccatcaagcgccccttccagaacgacgacgacaacagcagcaacggcaacggcaacgccgacgggaagcccaaggcgcggcgccgggaggccgacccggcggcggcgctggccgcggcgcgccacgagttcggcgagcacggcggggtgaacatgtccatcgaggcgtcggcgacgttcacggtgatggagccggacaccatgcgccgcctcttctccggggagctcggcccggagcgcggcgacctgtacatctacagccgccacttcaacccgacggtgctggcgctggggcggcagatggcggcgctggagggcaccgaggccgcgtactgcacggcgtccgggatgtccgccatctcctccgtgctgatgcagctcgtcggcgcgggggggcacgtggtggcgtcgcggtgcctgtacggcggcacgcacgcgctgctgtcccggttcctgccgcgcgcgtccggggtgcgcgcaacgttcgtggacgctgacgacgaggcggcggtgcgcgccgcggtgcgcccgggggagacgcgggtggtgtacgtggagacgatgtcgaacccgacgctggccgtggccgacatcccgatgctggcccgcgtcgcgcacgacgccggcgccaagctggtggtggacaacacgttcacgcccatggtcgtctcgccggcccgcctcggcgccgacgtcgtcgtccacagcgtctccaagttcatcagcggcggcgccgacatcatcgcaggggcgatctgtgggccggcgagcctggtgaacgcgatgatggacctgcaggagggggccctgatgctgctgggcccgacgatgaacgccaaggtggccttcgagctctcggagcgcctcccgcacctcccgctccggatgcaggagcactcgcggcgcgccgccgagtacgcgtcccggatgcgccgcctcggcctccgcgtcgcctacccgggcctccccgaccacccgcaccacgcccgcctcctcgccatcgccaacccgggctacggcgccggcggcatgctctgcgtcgacatgggcaccgaggaccgcgccaaccgcctcatgcaccacctccagaacaccacccgcttcggcctcatggccgtcagcctcggctactacgagaccctcatgtcgtgctccggcagcagcaccagcagcgagatgccgcccgaggaccgcgctcgcgccggcatctcccccggcctcgtccgcatgtccgtcgggtacaacggcacgctcgagcagcggtgggcgcagttcgagcgcgcgctctcgctcatgcagcagcagcagcagcagcatcccgaccgcgacgccgccgccaagtactgcaaggtgtgacgtcacgagccccgccattgatggtgcgcattagcgacgatccgatttgttgtatctgccccgtgttgctggtttgtatatatagtttattatgtaattactagtgctacctataagtaaggtttaagctgttaaactgagtactatctgatcgctctggttcagatagttgaatggcacagctaagctgcttgttctctgggaaactgagtgtattggaataagctggtgaaatgttatatggacaatgtttctgcagcaaccttctttctcagtaagattatggcacttcgtgcgtgtcacagtctatatatattcttcagactgaaacacttggctggaatatgtatttacagtgatgaattctcaattaggagaaatgcacacttctaattctctctcactgaattactgatggttggagcgatccttatatatatgtgtgctcatgcagtttggaatatgttctggaccattctcttcggagactccattgctgcagcttcgagctctgaaacttcagcagggctaagcctccagcccagtgctcccaagttatcctcgacgtgcctgactgttttgacacctggaataggaattgtgcccttgcagatgcaccaatttatggccacctgag

SEQ ID NO: 141 - DNA, 1344 bp, Oryza sativa
gaaataaaaacaaaaaaaaataattcctctcctcttctcatctcatctccctctcctctcctctcgccgtcgccgtcgccgtcgccgccgctcgccgccggcggggatagagttcgccgggatcgcctcgccgggagagttccctcaccatcccgcacctccgctcgcctggcctcttcctcccggaagtgtggtgtgctgcaagctcctgtctctcctacaaggtttcaaaaccaaaatatgcctgaagcacacggaaagctggggtgattaacgtctgtttcttttgactacaatcatcctgattctgcttctgtctgcaaaaacaaccaagccatgacgtctgtagttcatgatgtttcaggcaaccatggagctgatgagcggcaaaaacagcaaaggcaaggtgaacctgaggaccagcaagaagcctcagttactagtacagatagccatacaatggtagcaacaccttcaacagattatgcgacaccctatgcccatcacgatatggcccatgcaatgggccaaattgcttacgcaaatattgatccatattacggaagcctttatgcagcttatggtggacagcctatgatgcatccaccattggtcgggatgcatccagctggactaccactgcctaccgatgcaattgaagagcctgtctatgttaatgcaaaacagtacaatgccatattaaggcgtcgacaatctcgagccaaagctgagtctgaaaagaagcttgtcaagggccgtaagccatatctccatgagtcacggcatcaacatgccctgaaaagggctaggggagctggaggccgatttcttaattcaaaatcggatgacaaggaagagcattctgattccagttccagagataaacaggatggagttgcaccccgtgatagtggccaaccgtctacctctccgtcttcaaagggtgcatcatcagctaaacaaaataagaagtcaaaaaccagtaactaaacgggatttaagcacctggtgtgaaacatggaaacagttttgtacagtacatgctagtgatcgacaaagaatggtgtcattgggtgttgtaggataatgctccatagagaatatatagacagggcaacagattttgcagcctttggttcggtctgctcagtttctttaccttcttgtacaatgagtagttttcgtcagttgtgctttgtcatggggatagctgaatttcttcaggaagtcttgtagttttaaagagttcattagcttgccaattgtttgctttggattggattggtctcttactgcctttgcatcatcatctgcagtgcacagaataaaacattggctatgtgt

SEQ ID NO: 142 - DNA, 3146 bp, Sorghum bicolor
acgcagttcaagcacaaacaaacactagccgaagcataagccattccacaagcacctggtgatatcatctcatcatcagaaaccaagagagagatttcgtgcccgttgtagtagattgtgaggagtagcaaagcgcagcagccatgaatccggacaacttcacccacaagacgaacgaggcgctggtggcggcgcacgagatggcgtcggaggccggccacgcgcagctcacgccgctgcatctggccgcggcgctggcggcggacaagggcggcatcctgcggcaggccatcacgggggcgtcggggggcgacggagcggccggggagtcgttcgagcgcgtgctgagcaacgcgctcaagaagctgccgtcgcagtccccgccgccggactccgtcccggcgtccacggcgctgatcaaggtcatccgccgcgcgcagtccgcgcagaagaagcgcggggactcgcacctcgccgtcgaccagctgctgctcggcctggtcgaggactcgcagatctccgactgcctcaaggaggccggcgtgtccgcggcgcgggtgcgcgccgagctcgagaagctccgcggcggcgaggggcgccgcgtggagtccgcgtccggcgacaccaacttccaggcgctcaagacgtacggccgcgacctcgtcgagcaggccgggaagctggaccccgtcatcggccgcgacgaggagatccgccgcgtggtgcgcatcctctcgcgccgcaccaagaacaaccccgtcctcatcggtgagcccggcgtcggcaagacggccgtcgtggaggggctcgcgcagcgcatcgttcgcggcgacgtgcccagcaacctcctcgacgtgcgcctcatcgcgctcgacatgggcgcgctcgtcgcgggcgccaagtaccgcggcgagttcgaggagcggctcaagtccgtgctcaaggaggtggaggaggccgaggggaaggtcattctcttcatcgacgagatacacctcgtcctgggcgcgggcaggacggagggttccatggacgcggccaacctgttcaagccgatgcttgcgaggggacagctccggtgcatcggcgccaccacgctggaggagtaccgcaagtacgtggagaaggacgcggcgttcgagcggcggttccagcaggtgttcgtcgcagagccgagcgtgcccgacaccatcagcattctcagggggctcaaggagaagtacgagggccaccatggtgtcaggatccaggaccgcgccctcgtcgtcgccgcgcagctctccgcgaggtacatcatgggtcggcacctgcctgataaagccattgacttggtggacgaggcctgcgccaatgtgagggtgcagctcgacagccagccggaggagattgataacctggagaggaagagaattcagcttgaagtcgagctccacgcgctcgagaaggagaaggacaaggccagcaaagcccgcctggttgaggtcaagaaggaattggacgatctgagagacaagctgcagcccctgaccatgaagtacaggaaggagaaggagaggatcgatgagatcaggaagctgaagcagcgccgcgaggagctgcagttcagcctgcaggaggccgagcgccggatggacctggctcgtgtggccgacctcaagtacggcgcccttcaggagatcgacgccgcgatctccaagctggagagcgaaactggggagaacctgatgctcactgaaaccgtcggccctgaacaaattgcagaggtggtgagccggtggacgggtattccggtgacccggcttggccagaacgacaaggagaggctggtcggcctggctgacaggcttcaccagagggtggtcggccagacggaggccgtgaacgccgtcgcggaggcggtgctgaggtcaagggccggtcttggcaggccacagcaacccaccggctccttcctcttcctgggtccgaccggtgtaggcaagaccgagctggccaaggctcttgccgagcagctgttcgacgacgagaacctgcttgtccgcatcgacatgtccgagtacatggagcagcactcggttgctcgcctcatcggagcaccacctggctacgtcggccatgaggagggtggacagctgactgaacaggtgaggaggaggccgtacagcgtgatcctcttcgacgaggtggagaaggcccatgtcgccgtgttcaacaccctgcttcaggtcctcgacgacggcaggctgacggacgggcaaggcaggacggtggacttcaggaacaccgtgatcatcatgacatccaacctcggcgccgagcacctcctcgccgggatggtgggcaagaactccatgaaggtcgctcgcgatctggtcatgcaggaggtgaggaggcacttccgccctgagctgctgaaccggctcgacgagatcgtgatcttcgaccctctgtcccacgagcagctgaggaaggtggctcgccttcagatgaaggacgtggccgtccgccttgccgagaggggcatcgctctggccgtcaccgacgccgcactggacatcatcttgtctctctcttacgatccggtgtacggcgcgcggccgatcaggaggtggatcgagaagagggtggtgacgcagctgtcgaagatgctgatccaggaggagatcgacgagaactgcacggtgtacatcgacgccgcgccggccaaggacgagctggcctacagggtggaccggagcggcgggctggtgaacgcggagacggggttgaagtcggacatcctgatccaggtccccaacgacgccgtcaggagcgacgccgcgcaggccgtcaagaagatgaggatcatggaggaggaggacgaggacggcatggacgaggagtgagcgagagcagcgtgcaggtcgccggccggaggacgcggacatgcgacccggccctggttcggtggcgtcatcgtccagtgtcttctgaaatctgaataagcgtgtagataagtcgtgaacgtgtgaagagtgaagacgatgttgttttctgagttttaatttaatgacgttcttgtaacgcgactgtttgtcaagcatctgcgatggaatggatgaaagaacggaaatgctaaacaccacacgggtgttttagcacttgtg

SEQ ID NO: 143 - DNA, 642 bp, Sorghum bicolor
caccccaccaccagcaaccgcaaccggaaaatccccaatcccctcggcttcgcggcgaacatgtcggggcgcggcaagggcggcaagggcctgggcaagggcggcgcgaagcgtcaccggaaggtgctccgcgacaacatccaggggatcacgaagccggcgatccggaggctggcgaggaggggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggcttcggcggctaggccggccacgtctcgctgtcgctgtggatctagtgttgctccagttcgcaagttgtcagttgtgcctaggttgggaaaatgctagttactgtagaactgagcaatcatctgcatatgttgttgtctgtttcatattgaatcgtatcctgaagaattggtgatgatgatgacttgttcaggactcccaacatctgactgctttcgtgtgtagtagtgcgaaccatttcagttcttttgctgaacttcagacttcagttccatgggtttaac

SEQ ID NO: 144 - DNA, 727 bp, Sorghum bicolor
ctgctccctcgcatccacagcctctcgagctcgaagcgccgcagcagcaccagcccagcagccatggacgtgagcggagccggatccggcgggaaggcgaagaagggcgcgggcgggcggaagaccggcggcgggccgaggaagaagtcggtgacgcggtccgtcaaggccgggctgcagttccccgtcggccgcatcgggcggtacctgaagaaggggcggtacgcgcagcgcgtgggcacgggcgccccggtctacctcgccgccgtcctcgagtacctcgccgccgaggtgctggagctggccgggaacgcggccagggacaacaagaagacccgcatcatcccgcgccacgtgctcctggccatccgcaacgacgaggagctcggcaagctgctggccggcgtcaccatcgcccacggcggcgtcctccccaacatccacagtgtgctcctgcccaagaaggtcgccgagaaggccgcggccgcggccaaggagcccaagtcgcccaagaaggccgccaagtcccccaagaaggcatagaggggcctccatggagatgttcagtagatctgtagtaggtctgtagatggcacggtctctgagctctagtgtcgtcgttgttgttggaactgcttagaaggtctgtgcattttggttggaaggtgatttcagaaatcagagagttttgtacttgcaaaatgttcttcgatttcagaaaccagat

SEQ ID NO: 145 - DNA, 2579 bp, Sorghum bicolor
ccgtcccgtcgccgtcatcccagtccacgcccacgccaacgcacccgcatccctctctcgcctccgccgcaacgatgtcgggctgggacgagggcgccgtgttctatagcgaccaggcgcagttcccccgcggcggccccggcggcgacccagccgccgacctcacccgccactccgccctccgcaagttcaaggagttcctcagaggcttcaccggccccaccggcgacttcccctaccgtgagagcctagtacacaaccgcgaccatgtcaccgtcgccatcgaggacctcgacgccttcgatgccgagctctctgacaggatccgcaagtcgccggccgattatcttccgctgtttgagacggctgcggccgaggttctcgcaagcctccgttcgaaggtcgccggcgagaccggggagatggaggagcccgtcacgggagatgtccagatcttcctctcctccaaggagaactgcctgtccatgagatctgttggggctgattacatgtcgaagctggttaagattgcgggaatcacaattgctgcatcgagagtaaaagccaaggccactcatgtaactcttatctgcaagaattgccggagtgtgaggacagtgccttgcaggccaggcctcggcggggctattgttccacgttcttgtgaccatgttcctcagcctggagaagagccctgccccctggacccttggattgccgtcccggataagagcaagtatgtggatctccagaccctcaaactgcaggagaatcctgaggatgttccaactggtgagcttccaaggaatgtgcttctttctgtagataggcacctagttcagactattgttccagggactagattaactgttgttggcatctacagcgtctaccaagcatccgcaacccagaagggcgctgttggtgttaaacagccttacattagagttgtgggtttggagcaatctcgagacaataactcaaatggcccctcaaacttcactctcgatgaggaaatggaattcaaagaatttgcacagagaccagatgcatatgccaagctttgctcaatgattggtccttcaatttatggtcattctgatgtcaagaaagctattgcatgcttgttatttgggggatctaagaagaggctacctgatggtgtacgtttgagaggggatattcatgtcttgcttctgggtgatccatccacagcaaaatcacagttcctcaaatttgtagagaagactgcacctattgcagtctatacatctggcaaaggatcatctgcagctggtcttacagcatctgtaactcgggatggtagctcgcgtgagttttatttggaaggaggagccatggtactggctgatggtggagtagtctgtatcgatgaatttgacaagatgagacctgaagacagagttgcaattcatgaggccatggagcagcagacaatatctattgccaaagctggcattacaacagttctcaattcaaggacttcagttcttgcagctgccaatccaattgcaggacgctatgatgatcttaagactgcacaagataatattgatctgcagacgaccattctttctagatttgatctaatctttatcgtcaaagatatcagaatgtatgatcaagataagcgaatagcaagccacattatcaaggtgcatgccagtggtgctgcagcttcttccacaggcacagaggcaagtgatggagagaattggctgaaaaggtacattgagtactgccgtgccacatgcagaccacggctttcagaaaaagcagctgagatgctgcagaacaaatatattgagattagacagaaaatgaggcagcaagctcatgagacagggagggcagcagcgatacccatcactgtgaggcagcttgaagccatcatacgtttgagtgaatctcttgcaaagatgagattgacaagtgtggctacaccagaacatgtcgaagaggcattcagactgtttaatgtctccaccgttgatgctgcaagatccggaatcaacgagcatttgaacctgtcaccggagattgctaatgaaatcaagcaagcggaagcacaaataaagagaagaatgggcattggaagccacatatctgagcgacggctgattgatgaactaaataggatgggaatgaatgaatccattgtcagaagagcccttctgatcatgcatcaaagagatgaggtggagtacaagcgagagcgccacgtgattgtccgaaaggcttgaggtgcagagtccagtcagattcatgggtggcagacaacataaattgaaggcgtccttcctcttcagacgtgtgtataccttcactgaaactgcacctctgtccagaggacgaggcacgccttagttgatctctgacatgactgttgtaacctgcaaacgaatggatgcaacttgttgcttcgtggaaatgaagctgtgtagctgtaccgcagtagtttgttactgcctgtgatcttaaaccatctagtgtgtgagcattgtttcggaagtaaccaaaggttctgaacctgcattgtgctgtgtaaactcgtcaat

SEQ ID NO: 146 - DNA, 2030 bp, Sorghum bicolor
tttcaagccctcctcccctcttcctcccattagcagcagcagcgtcgaccagcagagcacaagccggcagcgattgagcgagggaggaacacgatgagcggcggcggtcaggatctgcagctgccgccggggttccggttccacccgacggacgaggagctggtgatgcactacctctgccgccgctgcgccggcctgcccatcgccgtccccatcatcgccgagatcgacctctacaagttcgacccatggcagctccccaggatggcgctgtacggcgagaaggagtggtacttcttctccccgcgggaccgcaagtacccgaacgggtcgaggccgaaccgcgccgccgggtccggctactggaaggccaccggcgccgacaagcccgtgggcacgcccaagccgctcgccatcaagaaggcgctcgtcttctacgccggcaaggcgcccaagggcgagaagaccaactggatcatgcacgagtaccgcctcgccgacgtcgaccgctccgcccgcaagaagaacagcctcaggttggatgactgggtcctgtgccgcatctacaacaagaagggcgggctggagaagccgtcggcggtcgccggcggcgaccacaagccgatgttcgcagcggccgcggtgagctccccaccggagcagaagccgttcgtggcggcgccgggcgggcttcccccattcccggacctggcggcgtactacgaccggccgtcggactcgatgccgcggctgcacgcggactccagctgctcggagcaggtgctgtcgccggagcagctggcgtgcgaccgggaggtgcagagccagcccaagatcagcgagtgggagcgcaccttcgcctccgaccccgtcaaccccgccggctccatgctcgaccccgtcgtcggtggccacgccggcgacccgctgctgcaggacatcctcatgtactggggcaagccgttctagacgaagacgacgacgcgatcgaaggtcatcaatcaaaggggggaatttatttaaaaaaaaagaaggcgctgcggttggttggttgatctgtcttgggcagcgcaatgcaatgcgacgcaaccgctcggtgtgggcttgactcaggcgagccgccattgttgacctcgttgaggaggagataggttatgaaactatagctggattggataaggcggcaatgagaccgtgtggccccgccggaagggagggagacggacggatggcacagtgcattgggtggtcgatcgtgcgcggcatgtgtgtgtgtgtgtgttcttgtacatatacatacagtacatgattggttcagtgcagggtttctgttccttcattggttagtagtaattctattttataaggtcctgtagttgcaatctccaatgggggtaggtagtgcaggctatatagatactccatttgtcatcgtcaagcttcgagtagcacagagtatattgtagctgttggctctttgaaaaaactgaaacgggaattatgttatttcgatcattttgctggtcgcgtctgaagaagtgctgttcgtctgtattcaactatcatgttcgcttggctgcctgaaaggcttgcagcggtgctgtatgctggagttgtgcttatggacgaagaaacgtttgtgaaccacacgttgaagggggcaaaaacgtgctgtggcagacaaaggtctgccgaacacactgaaaaccgtgagacactagtgaacacgttgaaaaacgagggggagatttgagagtcggcaggcagaaggtggtcaatccgcacgtgtaggcagggaggcggcgacggcggtgagtgggccggcgagcgggcggccaagcctggacttccacatgtcccgacgggatcgtcttcgggcctatcaccactgcacacgcccggcgaactgtcaaatctcatatcgtctctcctgtgtggctgggtgtgactgtggaacatgtcccaacgatttatggatacatcctattactagtgtggaacatgttttgttatttctaattctaatctaa

SEQ ID NO: 147 - DNA, 2236 bp, Sorghum bicolor
atcaccagtcagcagtcccaggtcatcatcgccgcaacctcgtacaatcacgaaagcacacgagtccacaacaaaactcgagtgttccagccccccacatcagcacccctctctccctgtttcttcacgtgccatggagaccctcctggtcggcaaccccgccaacggcgtggcgaagccgatgtgcaacggcgtcggcgctctgcccgtggccaactcccacgccgtcatcggcgcggcgccgccggcgacgacggcggccccggcgggcgccactctcggccggcacctggcgcggcggctcgtgcagatcggcgcctccgacgtgttcgccgtccccggcgacttcaacctcaccctgctcgactacctcatcgccgagccggggctgagcctcgtcggctgctgcaacgagctcaacgccgggtacgccgccgacgggtacgcccgctcccgtggcgtcggcgcctgcgccgtcacgttcaccgtcggcgggctcagcgtgctcaacgccatcgccggcgcgtacagcgagaacctccccgtgatctgcatcgtgggcggtcccaactccaacgactacggcaccaaccgcatcctgcaccacaccatcggcctcccggacttctcccaggagctccgctgcttccagaccatcacctgctaccaggccgtcatcaacaacctggacgacgcgcacgagcagatcgacaccgccatcgcgacggcgctgagggagagcaagcccgtgtacatcagcgtcggctgcaacctggccggcctctcccacccgaccttcagccgggatccggtgcccctgttcatctcccccaggctgagcaacaaggcgaacctcgagtacgccgtggaggcggcggcggacttcctcaacaaggcggtgaagccggtgatggtgggcgggcccaagatccgggtggccaaggccagggaggcgttcgccggcgtcgcggacgccagcgggtaccctttcgccgtgatgccgtccgccaagggccttgtgccggagcaccacccgcggttcatcggcacctactggggcgccgtgagcaccacgttctgcgccgagatcgtggagtccgccgacgcgtacctcttcgccggccccatcttcaacgactacagctccgtcggctactccctgctgctcaagcgggagaaggccatcatcgtgcagcccgaccgcgtggtggtcggcaacggcccggcgttcgggtgcatcctcatgtccgagttcctccgcgggctcgccaagcgcctcaggcgcaacaccacggcgtacgacaactaccgccggatcttcgtccccgaccgcgagccgctcaacggcaagcccgacgagccgctcagggtcaacatcctcttcaagcacatcaagggcatgctgtccggcgagaccgccgtcgtcgccgagaccggcgactcgtggttcaactgccagaagctcaggctccccgagggctgcgggtacgagttccagatgcagtacggctcgatcgggtggtcggtcggcgcgacgctcgggtacgcccaggcggccaaggacaagcgtgtcatcgcgtgcatcggcgatggaagcttccaggtgacggcgcaagacgtgtcgacgatgctccggtgcgggcagaagagcatcatcttcctcatcaacaacggcgggtacaccatcgaggtggagatccacgacggcccgtacaacgtgatcaagaactgggactacacggggctcatcaacgccatccacaacggcgacggcaactgctggaccatgaaggttcggacggaggcggagctcaaggaggcgatcgccacggcgacgggcgccaagaaagactgcctctgcttcatcgaggtgatcgtgcacaaggacgacaccagcaaggagctcctcgagtggggctccagggtctccgccgccaacagcaggccgcccaacccccagtgagctatctagctggctcatgctcatccatcggcctcttcactccagcgtttcctgcgctgcaacggcgcctccttcgtctgcctgccgtgaaaacgtccggttcattttcagtcagttattagttcgtacttccctgctgatggaagctgctgccaatctttatcctatttattatttcctatttgtaattcagttgtttggaattgagttctgttgtaaattttgcaagttgcatttcctgcattaataaaattcatggtcggaaaagatttc

SEQ ID NO: 148 - DNA, 1841 bp, Sorghum bicolor
atcatcgtctgcatcgctcgccctcatttcactgggagcatcgatctatctatcagcttgctcattggccatcttcgatcgtcttccatggagaggctcattgccggcctacttggcttcctattgattgcgtcagtaggaagccatgcagctcgtgctccggatcaatactggaagtctgctcttcccgacactcccatgccgacctccctctcccaactcctcaacaccccagccggaggcacgaccgtcaacgtcggctggggcggtgtccacgtcgatgctgggcacggtaagcccgggggtacgacggttgacgtaggcaagggcggcgtcggcgtcaatgttaaccctggcagcagcggcaggaagcccggcggcaccacggtcggcgttggtgggaaagggggagtcggcgttaaggtcaaccctggctatgggaagcccggcggcacgacggttggtgtcgggaagggcggagttggtgttaacgtcaaccctggctacgggaagcccggtggcaccactgttggcgtcgggaagggcggcgtcggcgtgaacgtcaaccctggcaagcccggcggcactacggtcggcgtcggcaagggcggcgttggcgtcgacgtcaatcctggctatggcaagcccggtggcaccacggtcggcgtcggcaagggcggagtgggcgtcaacgttaatcctgccaagccgggcggtaccggcacaaccgttggcgttggcaaaggcggcgtgggcgtcggcgtcaatcccgggtacggcaagcccggcggcaccacggtcggcgttggcaagggcggggtcggcgtccacgtgaacaacccgcgcaagaagcccgtcaacgtcaacgccgggcctttccagtacctgtacgccgcatcagagacgcagctgcacgacgaccccagcgtagcgctcttcttccaggagaaggacctccagcagcccggtaagaaggtgaccgtccagttcgccaacaccgcgaccgccggcgccaagttcctcccgcgaagcgatgccgaggccatcccgttctcctccgagaaggtccccgagatcctgagccgcttctcggtcgacccggactccgtcgaggcggcggagatggcgcagacgctgcgcgactgcgaggcgcccgcggccaagggcgagaagaaggcgtgcgccacgtcgctggagtccatggtggacttcgccaccaccagcctcgggaccagccacgtgagggccgtctcgaccgtcgtggccaaggagggctcgccgaagcaggagtacaccgtgaccggcgtcaagcccgcggccggcaccggccacgacggccgcctcgtggcctgccacgcggagccgtacgcgtacgccgtgttcgcgtgccacctgacgcagcagacgcgggcgtactcggtgtcgatgctcggcagggacggcacggccgtggacgctgtcgcggtgtgccacgccgacacgtccggctggaaccccaagcacatcgccttccaggtgctcaaagtgaagcccggcacggtgccggtctgccacttcctgccgcaggaccacgtcgtctggacccgcagcggctgaggctgctggatggctgccgtttgctctcgtcgcgccgcctgatggagtgatggtttcgttttcattgtattctagtagcctctgggcatactgtttatgtttccagtatagtgcttgatgtttgtatggatggtgtggccagccagtatcgaccacctgcttagattctgttgtatagttctaaataaacaggcatgtctttacggttactgctctgagcctgaacaaacttctgttgatccccg

SEQ ID NO: 149 - DNA, 1709 bp, Sorghum bicolor
agccacaaaattcatccaaaaaaaagtctaaaaaaaaaacttgcagcggcatccaccaccggagctgccatcatcggcccgtccctccgtgtcaaccccctcctcagaagttctatttgcagttcggcccctggccggtccgcccggccaccggaaggagccgctcgccggaggaaggcccccctgtctccttgccctgcggcgggttcatggggttctcgctgtaccccatgaagacgtccacgcggctgctctggagcactagcttcttccgccataagctcagctcctcctcctgcttcctctgagcccgccacgatcgtgttgtcggcggcggcggcggtccgctgctgctgcgcggtcctagcatccgttcaagtttgtgtttgtgtttgtgtttgtgttcgtgtgcgcgcacgcgcgtaccggcgtacgggtttcaagattgggttttgttgcgttcttggggagaggaagggactagggcgcgggcaagaatcagcatagcatggatccgagcgcggtcagtttcgactccggcggcgcgcggcggggcggcggcggcggcggcgcgcagatgctgctcttcggcggcggaggcagcgccaacagcaacggcttcttccgaggtgttccgatggcggtcctgggcatggacgacgcgacgcgcgtgggcaagcggcctttcttcaccacgcacgaggagctcctggaggaggagtactacgacgagcaggcgcccgagaagaagcgccgtctgacggcggagcaggtgcagctgctggagcggagcttcgaggaagagaacaagctggagccggagcgcaagaccgagctggctcgccgcctcgggatggcgcctcgccaggtggccgtctggttccagaaccgccgcgcgcgctggaagactaagcagctcgagaccgactatgaccgcctcaaggctgcctacgacgcgctcgccgccgaccaccagggcctcctggccgacaacgatagcctccgggcacaggtgatctccctaacggataagctgcaacgcaaggagacatccccgtcggcgaccactgctgcccaagaggtcgaccagccagacgaacacaccgctgcgtcaggcactgagaaactgctggtgcagcagctcaaggacgacctccacagcagcggcgacttcactggccatggtgccctctcttcagaggaagaggatggtggtgtggtcagcgacgagggctgcagctttgatctcccggatgccatgttcgctgccggggtcacccaccatggcgccgaggaggcgcagctggccaactggacatcctggttctggaactgatttccatcagtggagggatggctgcatcaagtgcaaagagcaaatcctctcctggcttcgacccttttctgcaccatataattactgtgttaattatgtgccgtgatgccgtcagatgttttcaagtaaatgaattgttactgatgttgtaagtttaagtttttgaagattttatatgttcatatataaataatatgctttgaacataagactcgaaaagtcgaaaataagtggacgtggagacctgttgtgcactacagcactagcagcccgcatgagtttttatgctgcttttagacatgaaaatgtatatccaacttgtgcttgtgaataagatgatgaaagtatatccaaccgctgtcccttgatttgg

SEQ ID NO: 150 - DNA, 1641 bp, Sorghum bicolor
atggccatggcgccagaccagcagcagccacctgcaggggcaggggcaggggcctcctcgacgacgggctcgacatctcctcgcctccgcgtacacgtacacgacaccaccctcgtgccgccgtctccgtcaccgccggagacttccctcccgctcaccttcttcgacgtcttctggctccagtcccatcccgtcgagcgcctcttcctctaccgcctcgcccacgacgctgacgtcgaagccatcatctccaacctccggagctccttgcacaaggccctcgccgccttctacccgctcgccggccgcgtccgcctcacccccggcacgtccgaccgctacgagctgcactaccgcccgggagacgccgtcaccttcaccgtcgcggagtgcgacgacgacgtggacggcgacgcgcacttcgacgccctcgccaccgacgagccccgggaggttgccaagatcgccgcgctcgtgccgacgctgccgcggggcggaaggctgctcgccgttcgggccacgctccttcccgcgcgccgcggcctcgccatcggcgtcaccctgcaccacgccgcctgcgacggctcgggctccacgcacttcctgcacacctgggcggccacctgcagaggtggcggcgccgaatcgccgccgccgcctgtcatcgaccggactctcctcgccgacccaaggcgcctgtacgacgcctttgtccaaaccgcgccgagcagtgaagagtatgagttcgtcaagatgtccgccgaccagctcttcgccacgttcacactgtccaaggacgacctcaagcgcgtcaaggacgccgtggccgacgaggctgcgcggcgcggcgtcgcgccgccccggtgctcgtctctcgttgccaccttcggcctcgtctggtcgtgctaccagcgaggcaaggagggaagcggcggcggcgccggagagggctcgatggcctgcatggccttccccgtcgaccaccggtcgcggatgaagcctcccctgccggagaagtacctgggcaactgcgtcggcccagcgttcgcgctggcaccaacgggcgagctggccgcggccggcgcaggagggctcttcagcgcgtgcgccgccgtcgcgtccgccatcgacgaagctgtacgcgacatcgggacgtcgagcatggacgcgtggatggaccgcatcagggaggtgctcccgatgggtttactcaccgtggccggctcgccgaggttccgcgtctacgacctggacttcggattcggccggccggcgaaggtggacatcgtgtccgtggcgaggaccggcgcagtggcggtggcggagagccggagtggcgacggcgggatagaggtgggggtctctctgcagccggcggctatggagaggtacaggaagtgcttcgcggatgctaccctgtggctccaccagaagacatgagagcgacagctcaatctaaatatgcagaaacgggttatttatggtatcgatcgtgtgatgaaaatctccgcctcccatccaaattattcaacgtttttagctttcctactagggctttgtctagtttaccaaaaaaactacaaattttgtaagattctctatcgcatcgatcttgcagtaaattttgcctgtaaatcacga

SEQ ID NO: 151 - DNA, 990 bp, Sorghum bicolor
gtcccgtgagccctgaccctctttatctctcactcactctctgctaacctctgattagttatctctatcaccagtagctgccgccttgctcgctcgctgccgatagagctgcggcagcacggccggccaccagcaccaccaccgcgtaacgaaacccaacgccgccggtcgccggccggccgtccatccgccgcaccggccatggccatggcgctggccctgggtggtggccaagacgcggagcggaaggtgaaggtagcggaggtggcgctgcgcgcgctgctgtgcgggctgggcgcgctggcggcggcgctggtggcgacggacacccagacgcggaccttcttctcgctgcagaagaaggccagctacacggacatgaaggccatggtgttcctggtggacgccgccgccgtcgccgccggctacagcctgctgcagctggctgcgcgctgctgcggcggcggcgccatgtccagcggccgcggcgacggcggcggacgcggccgggccctgtcctggtgcgtgttctcgtgcgaccaggcgctggcgtacgtgctcctggccgccgtcgccgccgcgctgcaggcctccgtcgtcgccaagcgtggccagcccgagttgcagtggatggggatctgcgcactctacggcgccttctgtaggcaggccggcgccggcctcgctaccgccgtcgtggctgggctcgccgccgtcctgctcgccttcctctccgcgttcaacctcttcaggctctacggcagcggcggcaccaagagctagtagctttgtgatgagcagaggccgttcttccatctgaccaccatctcttgcaaacaccgtagcgtagggctttgcttgatttggttgctactggtaattatatataggctggttcatgcatgtgaaagcaagatcgagtggtgctaataagatagccgtacgcactgctcaacgtcgaattgaaacaacttaaagaataaacatgaa

SEQ ID NO: 152 - DNA, 2186 bp, Sorghum bicolor
gtttactaataaattcttgttgggatatattcctccatttcccctcctcctcccaacaacaatctggtcgatctctcccgccaaacccaaaaccccccaaaaaaaaaaaacacccaacccaatccgatcccatagaaactctctcagtttcagttcgatcgatcgctcccgtctcgatcgtttgcacaaaaacatggccttcaacctggctcagtgcgccaccgctgcggcgtccgtcgcgccccgcacccctcgccctgctaggtccgcggtcgcggcgtccgtgtctgtctccacaaggaaggcggcggacggcaggctgcggctgcagcggcaggcgagctgcgagccgtcggtggcgccgtcgcgttcggtgttctgccgggccgcggtgtcggggaagagcgcggccgaccgggccgcctccaccaggaggaggtccggcgtgccggtgttcgtcatgatgccgctggacaccgtgaagaagtgcggcagcgcgctgaaccgccgcaaggcggtgcaggcgagcctgtccgcgctcaagagcgcgggcgtggagggcatcatggtggacgtgtggtggggcatcgccgagagcgacggccccgggaggtacaacttcgcggggtacatggagctcatggagatggcgcgcaaggccgggctcaaggtgcaggccgtcatgtccttccaccagtgcggcggcaacgtcggcgactccgtcaacatcccgctgccgcggtgggccgtggaggagatggagaaggaccaggacctctgctacaccgaccagtggggccgacgcaactacgagtacgtctccctcggctgcgacgccatgcccgtcctcaagggccgcacccccgtcgagtgctacaccgacttcatgcgcgcgttccgggaccacttcgccgactacctcggcaacaccatcgtggaaatccaggtcggcatgggccccgccggcgagctgcgctacccgtcgtacccggagagcaacggcacctggaagttccccggcatcggcgccttccaatgcaacgacaggcacatgcgtagcagcctgaaggcggcggcggaggcggccggcaagccggagtggggccacggtggccccacggacgctggcggctacaacaactggcccgaggacaccctcttcttccgcgccgacaacggcgggtggagcacccagtacggcgacttcttcctgtcgtggtactcgcagatgctgctggagcacggcgaccgcatcctgtcgggcgccacgtccgtgttcggcgcgtcgtcgcccgtggaggtgtccgtgaaggtggccggcatccactggcactacggcacccggtcgcacgcgccggagctgaccgcggggtactacaacacgcggcaccacgacgggtaccgccccatcgcggacctcctggcccgccacggcgccgtgctcaacttcacctgcgtggagatgcgggaccacgagcagccgcaggaggcgcagtgcatgccggagcacctggtccggcaggtgggcgccgcggcgcgcgcagcgggcgtgggcctcgcgggcgagaacgcgctgcccaggtacgacggcacggcgcacgaccaggtggtagccaccgccgcgcagcgcgccgccgaggaccggatggtggcgttcacgtacctgcgcatggggcccgacctcttccacccggacaactggcagcggttcgccgccttcgtgcgccgcatgaacggcgccgggtcgtgccgggaggccgcggagcgggaggcgcacggcgtcgcgcaggcaaccgggtcgctggtgcacgaggccgccgtcgcgctgcggagctgacccccaccggaagccgcctgcgatggatttgattgtgtaggggttgggagctcgggttcttgttgggtttttccttttggggtggggagagaggagagggagcgctgccgagagcgagcagagactctcgtgcagctcatcccgcgtagacgacgagattgtgacgaagccggggaaaagggaggggaggacaaaagattgttttttttttgtcacgtttcaggctccgaccatcaccggagtttgttcggggaatatatccatgcatttcctgcagaaatccgcagaaaatgccgtacgtgtgtcctgcactggctgattcggtgctgcttccatttcagtctactcc

SEQ ID NO: 153 - DNA, 1121 bp, Sorghum bicolor
gagcagtgtcatcgtccagaccatttacctgagtgctctgctctcgctggagcccgtggtgcacgctcatggaggccgctattcccaatcccagtgccctgaaaacaaggattgccgtggtcaccggcgggaacaaagggattgggctagaggtttgccggcagctggccggcgacggcgccaccgtggtcttaacagccagggacgagacgaggggcgcagccgctgcagagaagctcagagaagcagggctctccaatgttattttccatcagctggagattactgatgctccgagcatcgctcggttggctgagttcctcaagactcgttttgggaagctagacatactgataaataatgccgcaattggtgctgttgagtacgtccaagatcctgccgacagtccagcaagcgaggaaaagttcagtggcatggatcagggccaaaggcttgaatgcatgtttaaaggtgtccgggagacctacgacgctgcaagagaaggcgtgaagaccaactactatggcgtaaagcatgtgattgaagccttactgcctctgctgcaggcttcctccgatgggaggatcgtcaatgtctcctctgaatttgggctgctaaggctaatcaacaacgaggagctaaggcaggagctgaacgatgtggagaagctgaccgaggagaggctggacgaggtgctggccacgttcctaagagacttcgaggccggcgaggtggaggcgcgtgggtggccgatggctttctcggcgtacaaggtggccaaggtggccatgaacgcgtactcgaggatcctggcaagaaggcaccccgaactgcgcatcaactgcgcgcaccccggctacgtgagcaccgacatgaccatccacaccggacccctgacgcccgaggaaggcgcggccaacttggtgaaggtggcgctgctgccggaaggcggcccgaccggcgcatacttcgcgtggggagtggaggcgtcctttgtgtgaaaaagcaccatgcatcgttaatgttctgttcgttgttctccaactgcctgttatcaacgtttactgctgactcctttattcctctctaacgcttctgatacataagtcatagttgaaaat

SEQ ID NO: 154 - DNA, 1656 bp, Sorghum bicolor
ctcctcctcctcctcctccgcctatactatactaaactagtgccaaattgctcccgcattcccttccccttcctcctgcatttccgtcccatcggcggccctctcccaccctcgtggcgacggccaggcgaccgcagccgccgccgaggtcatcgccagcgaccaccgctccaccgggtacaacagatttatgcttggaacttctgcagaaaagcacacaacagtaatggggcacgaccatatttctcgtataaagatgcatatggcagaaggttcttttggtgacaggaaccggtgccagcaacccgggtgcaatgaggttgtcgatggaagggtagtgtactgcaaaactcacagtggggagttttcatgccaacagttcagtcacctccacagcggaatggagagctcaggtttatcggtgccccatgttaatgacaaccagttcaagggatctatttccattgcagtgccatgcactgagcaagagttacatgtcaagcatgaagggaatgatcgaggtaaactaaaggatagttctgggtacactttggatcagactgcacaatttgtcttctctggggcaggcttgctttgcaagaacgaaaactgcagcaagcaagcacatgagaactcgatctactgtaagttgcatagcggtgttagcaagggctgcatggtacggggttgtacgagaggtgcgcatggaggcacacctttgtgcattgggcatggaggtgggaaacggtgtgtgatccctcaatgcccgaatgcagcatgtggtcaaggccgtagtgaccgctgtgtaaggcatggcggtggtaagagatgtaaatttgaagggtgtgcaaagggcgcacaagggaacaccgattattgcataagacatggtgggggaaggcggtgcaaatttgaaggatgtacaaagagtgcacaaggacgcacagatttctgtattaagcatggtgggggcagtcggtgcaagttccaaggatgtggtacaagtgcaaaatggggaacggatttctgctctgtccacaggaagagtttgttgggcggtgacagtgccatccctgaagctttgcctgccccgtcagaaaaacgacgtcgtgccaagaagcctaaaaaggcagcgaagctgtctgagacctcccaagagaatgtcacaacagcagctattgctggtaacagcacgcaacacatgggcgttcttctcatagctacccctgttactaaccatgacatgttaaccaagggtgtgacagtggcggcgccagctgcaatagcgcccacgcagatagtggcgccacttgccatcaaatcaccaacaccatctggatcggtggctgcaggagcagagagggaggcgggagcaagcagggagatgctgggtctgtagaaagatggtggcagtgcataatttgggaggcttggagacacctggccagatagctctctaattattgctttttagactgagaaacctcgaaactttaggaaggttgcaatttgacaggcttgcaccgtcaactgactagttatgtcctgtgcctttctcatttgtaaatctgtaatgcgaatctctagttgttcttgtgtatgttctcttgtgccttgtaactttggacaataagcaataatattgtgtcattgcct

SEQ ID NO: 155 - DNA, 1478 bp, Sorghum bicolor
aacaacaccgcggaaaccatccacaggacacacagagccgagccacccaccatcgacagcacccagccgccggagcgcgagcttctttacacagcaggccggagaaacacaggcagccaaagccgccaccgcttttaccgaccgaccgatcggtgttgccgccgcctgtcgggttaagcaaccaaccagaccaagccatgggattgccggtgatgaggagggagagggacgcggaggcggagctgaacctgccgccggggttccggttccaccccacagacgacgagctggtggagcactacctgtgccggaaagcggcggggcagcgcctcccggtgcccatcatcgcggaggtggacctatacaagttcgacccctgggacctgccggagcgcgcgctgttcggggtcagggagtggtacttcttcacgcccagggaccgcaagtacccaaacgggtcccgccccaaccgcgccgccggcaacgggtactggaaggccaccggcgccgacaagcccgtcgcgccgcggggccgcacgctcgggatcaagaaggcgctcgtcttctacgccgggaaggcgccgcgtggggtcaagacggactggatcatgcacgagtacaggctcgcggacgccggccgcgcagccgcctccaagaagggatcgctcaggctggatgactgggtgctgtgccgcctgtacaataagaagaacgagtgggagaagatgcagctggggaaggagtccgccgccggcgtcggcaccgccaaggaggaggcgatggacatgaccacctcgcactcgcactcccactcgcagtcgcactcgcactcgtggggcgagacgcgcacgccggagtcggagatcgtggacaacgacccgttcccggagctggactcgttcccggcgttccaggacccggcggcggcgatgatgatggtgcccaagaaggagcaggtggacgacggcagcgccgccgccaacgccgccaagagcagcgacctgttcgtggaccttagctacgacgacatccagggcatgtacagcggcctcgacatgctgcccccgccaggggaggacttcttctcctcgctcttcgcgtcgcccagggtcaaggggaaccagcccgccggagccgccgggttggggccattctgaggctgaggcgagcgaggatggagccatggatcaggagaagaagacagcgttgcaaggttgcgaactctgtaaatacagcataggagtcgaacctgaacccgactctgaacctggtcggggttacagggttatgggtgtcggtgttagcgtacatggagccggccggcccagtgttggcgaggctcattctttagtttcactttcaacgcagaagacggtagatatatgtgtagctgttcactttcatcacttcctcttcaacagaaccgacgaaattttgctgctcttgttaacaacttacgagtactaccgtgtgtccgt

SEQ ID NO: 156 - DNA, 1263 bp, Sorghum bicolor
atcgctggagatcgagagaccgaagcagcagcagcacaagcatccgaggttccgaattgtccgtcgtgcaaacccagcagtcaagttcgactcagtcatccaacccccgatcgatcggatcagatccacaagcaattaagcaagccacgccgacatgccttcagtcgaggtgggcggcgccgccgggtggaggcccaagcacctccacaagcagtaccagcagaagcaccaccactacacccagcagcagcagcatcagccaccgtcccatccccatccccacccgccgccgcaacagcaaccgctggagatccgggaggtatgggcagacaacgtcgaccgcgagttcaagctaatccgcgcggccatcgagcacttcccctacgtgtccatggacacggagttccccggcgtgatccaccacccacccgcttccgtccaccactccacgctcaccccatcacagcgctacgccctcctcaaatccaacgtcgacgcgctgcacctcatccaggtcggcctggtcttcgcggcgtccccgtcctccccgccggcactcgcgttccagatcaacctccgcgagttcgacccgcgggtacaccgccacgcgccggactccgtccgcctgctcgcgtccagcggcgtcgacctcgccgcgcaccgcgccaggggggtttcggcccgcgccttcgccgcgctgctcatgtcgtcgggcctcgtctgcaaccctgacgtggcgtgggtcaccttctgctccgcctacgacttcgcctacctcgtcaaggtgctcatgggccggaagctgccccgggcgctcccggagttcctgcggtacgtcagggtctacttcggcgccgccgtgtacgacgtcaagcacatggctagggtcgccgttgactcctacggcgaggtcgcgctgctgggtgggctcgagcgcgtcgccggtgccctccgggtgcgccgcgccgccggacggggacaccaggccgcgtccgacagcgtgctcacgtgggacacgttccgggagatggctaggctctacttccccaaggaatgcagcctggacgtgtgcgccggcgtgatctacggccttgagctccgccacggcgacgccactaccaagcccaagccggctaaagtgcgcgctgcgctgcgctgctgagataataatgttgttatcatcatgtacagtacagaacctcccaaactggattttgggggaaataacagtaaagaaacaagagaacggttctttgattggtt

SEQ ID NO: 157 - DNA, 931 bp, Sorghum bicolor
ccctagaacccgcgccgccgccgccgccgccgccgccgccgccggtcctcctcactgctcgccgcgcgttgcaatgggtatcgacctagtcgccggcggccggaacaagaagaccaagcgcaccgcgcccaagtccgacgatgtctacctcaagctcctcgtcaagctgtaccgcttccttgttcggaggaccaagagcaacttcaacgctgtgatcctgaagcggctcttcatgagcaagaccaaccgcccgcctctctcgctccgccgcctcgtcaacttcatggagggcaaggagaatcagattgctgtgatagtgggcaccgtgactgacgacaagagggtctatgaggtaccagcaatgaaggtggctgcgctcaggttcactgagacggccagggcccggattgtgaatgctggtggcgagtgcctcacctttgaccagcttgcgctgcgtgccccgctgggccagaacacggttctgctgaggggacctaagaatgctagggaagctgtgaagcactttggccctgcgcctggtgtgccccacagccacacgaagccatacgtgcgctccaagggcaggaagtttgagaaggcaagaggaaggaggaacagcagaggcttcaaggtctaggttgtcgccatatctatgtattctgacctggttgaccatcttgtttgagtcatagagttggtatatgatattacaccccagttccaggacgtttgagagctctttgttgtttgtacaccagttcaggatctgcaaaaatttgctcgattggtttgcgccctacttgaagttccaagtgacaaaagcacaatagggtgcatctcattggatccattaatgtctgtttggagaacgtcccatgttatccttttgtgttcgagtcgcattcagttatcctacaaagatgaagttgtg

SEQ ID NO: 158 - DNA, 1263 bp, Sorghum bicolor
ggcttcccctccctccactctcgagaaggccgcagaaaaaccccaaatgtgagcgcccctggctcctcgcctccttcagccaaaaccctagctcgcatacgcgcccgagcaacgctttgtctgcgacgggcgcccgccctcctgccgccagaagcttccaggagcatcagcgatggtgtggttccaatgcgaggactgtggcgagaacctcaagaagcccaagctcgccagccacttccgctgctgctccgcgtacaagctgtcatgcatcgattgcggcgagttcttcagccaggagaccgtgcaggggcacacccagtgcatctccgaggccgagaagtatggtcctaagggacagaacaagccatccaatggtgtacagggtaaggcagataagccaaagccaaatgcagatgttgatatcaatgttgggctgtcgacacggcctccttggttctgtagcctatgcaagaccactaccacaagcaagcaaactctcttactgcatgctgatgggaagaagcatagggcaaaggcgaaagccttccatgcttctcagaaacaaacaaatggtgcagaacaaactccagatgtgaaggaagccggagctgtacccacaaaagaatctgttcaagtaaatggtggtatgagtggtgatcgtgaaagaaatgatgataaagatgctgcgaaaagaaaacgaatggatgacatgaccatagaggagccagataacacaaaaaaacagcatttaacgcagtctagagatgagaagtcagaaaacaaagtgaagagtaaggcagatgaactaacaagtggtgccgactgcaaaagtgttcagaaacaaaagatcaaatggaagaagattattactaaagcactgaagacgaacgcagatggagttatgaaactaaagaagctacaaaagctagtctccaaggagcttcaggaatgtggtgtctctaaagacgagggtctccatgctaccttgatggataaaatagcttcaagctccagattttctgttgatggcaagcatgttagactggtggctaagaatgaagaagaatcttagaaagaggttgtcagtcatttcttggcattgttcctggcctaattctttggtgtcaactttcagatggcttatagccaagttttggttaaattgagtgcatgaaccatcaattatatccatgacctgacggtatgggaattttgaatctgaattttcttggcaaccgttcaaaagtgaacttttaacacttt

SEQ ID NO: 159 - DNA, 1411 bp, Sorghum bicolor
ttggtatcaaacagcctactactccgtacttctttcgagctcactcagacatcaactggtgagcggtggtgtcgtggtgaccatggcgcctgccctcctcgccgccgtcgtgctggccgcggcggcgtcgctcgcggcccacgtcgcgctcaactgccccgtgaagccgctgccgtcgcctccgccgccacccactccgccgcccaacaacctcctccagaggctggagaggcttggggaaggggcgctggacgcgccggaggacgtgtacgtggacgcggcggccggcggggcgctgtacacggccaccagggacgggtggctgcagcggatgcacccgaacaacgggtcctgggagcggtggcgcttcgtcggtggcacggggctgctcggcatcacgccgtccgccgacggcaccatgctcgtctgcgacgccgacaagggacttttgagagtcggggaggaaggagtgacccatcttgcttcggaggtcgacggctccaccatcaggttcgcagacgcggcgatcgaaggctccgacggcacggtctacttcagcgatgccagcaccaggttcggcttcgacaggtggtaccatgacttcatagagtccagcgccaccggccgcctcctccggtacgacccgcgcagcggcaagacgtccgtcgtgctcgacgggctcggcttcgccaacggcgtcgccctgccgagggacgaggccttcgtggtcgtctgcgagtccagcaggttcaggtgcatgaaagtgtggctgaaaggggagaaggccggcaaggcagagacgttcgtcgaccttccggggtgtccggataacattcgcctcgggtcagacggtcacttctggattgccctcatccagctgaggtcgccatggctggatttcatcacccgctggaccttcacgaagagagtggtggcttcgttcaccgggctcatcgagtggagcaagggaacggcgaagggagccatggtggctcaggtgacggaggacggcaacatcgtccgcattctcgacgactccgaagggaaggtgatcaacttcgtgacatcggtgacggagttcaacggggacatcttcctcggcagcctcgcgaccaacttcgtcgggaaattatctctggcgcaggtgatacagcaggagcagtgagcagcacatctccagcccttggagcacgaggaaagtttacgtgcctgtttctgcaaacaattggatcttgtagtaaggctttcgaaaagaattcggatttctgtactgtaacatttttatttttatttgtcaaatattatccaattatggactaactaggtttaaaagattcatgtcgtgatttacagtgtgtaattagtttttattttcgtctatatctaatctaatacttcatgcacgtgtccc

SEQ ID NO: 160 - DNA, 1635 bp, Sorghum bicolor
gacgttttcggcccccaattcgaaagcctccctccccgtttctcccttccttgtctaggcggcaacgccccccgtgctttataaccgagcggcccctcccgcgtgaggcaaccgggacgagaccagcagacgggtcagcccatccgaactccgcttcttcctcctccggctttcgcgtgaggttgtgtgctgctgaggaggaggaggaggaggaggaggaggcagcgccatggaggcggagaagaagacgccggcggtgtccgatgtgggcgcgtgggcgatgaacgtcgtcagctccgtcagtctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggcttctaccagatctccaaattgagcatgattccggtcgtctgcctgatggaatgggtgctgaacagcaagcactacaccactaaggtcatatcggcagtgattgtcgtggccgccggtgtcgggatttgcacggtcacggatgtcgaggtcaatgccaagggattcatctgcgcttgcgtggcagtgttctgcacgtcgcttcaacagattacaattggctcctttcagaagaagtacaacattggatcatttgagctgctgagcaaaactgcaccaattcaggcactttcgcttgttatactgggcccctttgtggactactatctaaatggacggtcattgttgaactaccctttttcaggaggggcaactttcttcatactgctttcctgctccctggctgtcttttgcaacatgagccaatacctctgcatcggtcggttctcagcgacctcattccaggtcctgggccacatgaagaccgtgtgcgtgctgatcctcggctggatcctgtttgactcggccctcaccgtgaagaacatcctcgggatgctgcttgccgtgatgggcatggtggtctacagctgggccgtggaagcggagaagaaggcggcagccccgatcccccggaacaagagcgacatgctcgatggcgaggacgtacccctcaaggccagggtgagtggcgtgcccacgggcgacctcgaggacggcgagatgaagagctagctgctgcggccgccgctgctgattcgttcattcttcttgttcttttgtaactgtgcgcgcccactcgctcgctcgctcggtctatccaaagttgcttgttcgtcagtcctcagctatcgacactacactgttaattttggccctttgttggggggagtccgttcgtaggtgacgaagagaccacccccggtttcgacgtagatgaaacacatactggcagattgttaggatttctcaggcgggaaggtggagccattcattgtcaatttcgtggtggcatgttgttatagatggtgacaatactttagacttataagtaatggaaatacaggtgtttctacgtggtaagactgataggattcagccggcga

SEQ ID NO: 161 - DNA, 1743 bp, Sorghum bicolor
cgttttgtcaccggcggcgccgcctgctgcaacggcaacggcgccgtccgcgggccgcacgtggcgatgctagcgacgccgggaatgggtcacctgatcccgctagcggagctagcgaagcggctggcgtcgcggcacggagccacggcgacgctcatcacgttcgcgtccacggcgtcggcgacgcagcgcgcgttcctggcgtcgctcccgcccgcggtgacctcgctctcgctcccgcccgtcgacctctccgacctgccccgcggcgccgccatcgagacgctcatgtccgaggagtgcgcgcgctctgtcccggcgctcacgtccatcctcctcgacctcaagcggaccacggggggccgcctggcggcgttcgtggcggacctgttcggcgccgactccctggacgcggcgcgcgcggccggggtgcgacggcggtgcatcttcttccccaccaacctccacgcgctcacgctcatgctccacctccccgagctcgacgcctcggtgtcgtgcgagttccgggacctcccggagccgctgcggctccccgggtgcgtgcctatcccgggtcccgacatcctgatgccgctgcaggacaaggccaacccgtgctaccgctggatggtgcaccacggcggcaagtaccgggacgccgacgccatcctcgtcaactccttcgacgccgtcgagccgggccccgccaagatcctgcgccagccggcagcggaccaccgccccgtcgtgtacccgatcggcccgctcatccacgccgacggacgcaaggacgagaaggacgcgctgtgcctggagtggctggaccggcagccggcgaggtcggtgatgttcgtgtcgtttggttccggcggcgcgctgccgacggaggagatgcgggagctggcgctggggctggagctcagcgggcagcggttcctgtgggtggtgcggagccccagcgacgagggcgccgtcaacgacaactactacgacgccgagagcaagaaggaccccttcgcctacctcccggagggattcgtggaccgcgtcaccgccaccggcgtggggctggtcgtcccgtcctgggcgccgcagaccaaggtgctggcgcacgccgccacgggcgggttcctcacccactgcggctggaactccgtgctcgagagcctcgtctacggcgtgcccatggtggcgtggccgctcttcgccgagcagcggcagaacgccgtgatgctctccgacggcgtcggcgccgcgctccgggtacccgagtcgtccaaggggagggaggagatcgcggccacggtgcgggaggtgatgcagggggaagggaagggcgccgcggtcagggcgaaggtggccgagctgcagaaggccgccgctgagggcctccgcgacggcggcgccgccgccaccgcgctggccgaggtggtggaggggtggacgacgacaggtggacaagaggaggactaggtgatggtgaatggtgatgctgacgcgattggcgcctagcgatcctcctcgtcatccacctacttaggccgggcccaccgtttattttggcccttgtgtatgttgtgtccttggtcttgtctactcacatgctcgctgtatgaaaaaaatatgtaactatcatccaatccaatgcagtcctgctctttggcagtttagtagtagagtatagacagataggtaattcgtgtggtgatgatactataataagataagaaggctaccaatttt

SEQ ID NO: 162 - DNA, 1290 bp, Sorghum bicolor
ccgtccgtccctcgtttcctcctcccaccggaaacaatgctctccatgaccatgacagccatgccccaccgcctcgcccgcttcctcctcatcctgctcctcgccgccaccgccaccggagccggcgccgccaccccgcgccagctgttcctcgtgagccagcctcccgtcacgctcaccaaccaccacggccagctgctgacgggcaactactccgtcaacctgctctggtacggccgcttcacgccggcgcagcgcgccgtggtggccgacttcatcctgtcgctttccccttcggtgtcggggacggcgtccgtagcggcgtggtgggccacgacggcgcggtaccacccgggcgcggcgcggctgtcgctgggccggcaggtggtggacccgacgctgtcccttggccgccgcctctcggagtcctcgctggcgtccctggcgtcgcgcctgggcccgcaccgcggcaccgtggcggtggtggtgacggcggcggacgtgctggtggacgggttctgcctctcccgctgcggcctgcacgcatcgtcctcctcctccacccggaacgccaccagcagcagcgggcgcggtggccgcggtcggttcgcgtacgcgtgggtgggcaacccagcggagcagtgtcccggggagtgcgcgtggccgttccaccagccaccgtacggcccgcaggcggcgccgctggtgtccccgaacgcggacgtggggatggacggcgcggtgatcacgctggcgacgctgctggcgggcgccgtgaccaacccctacggcggcgggttcttccagggccccgcggaggcgccgctggaggccgtgtcggcgtgcgcgggcgtgttcggcaacggcgcgtacccggggtacccggggcaggtgcgcgtggacgccgccacgggagctagctacaacgccgtcggggtggcagggcgacggttcctgctgccggccatgtgggaccccgcgacggcgcagtgctccacgccgctcgtgtagacggtgaaggtggaagggacattgcagtcggtgcgagtgccagtgctggtgtcgtgttgccgtccggattctcgtgtcgtgctcacattgtatatatccattccgttcgtggtcacaacttgaaaaccaaaaaaaaataaaacgttgtgaacaaaatcagcagcaggttggttaatgtgatgtaccagtattactgttgtgttggcagtcatcatgagtacgtactcagtaataataataataaaaacactgactgtgtgtgtaggtttacgtataggc

SEQ ID NO: 163 - DNA, 2605 bp, Sorghum bicolor
gagacgcagacggccatatgagcaagcgtcgtccgtccttggcgtccccatcatggctcggctcgggcgccaccaccaccactacactagcagcacgccatatgcctccgtccaagctatataacccggcgccgctgtacgccgcttcctccatctgctagctggccggccggccagtggaaacagcacccagagctcgctcgcctctgcccctgcccctgcccctgcccctggccgcccgagatccggcagtgccgtccgtcgcgcggtcgcgccggccaaagggagcgacccctatccatggaccccgccgcccgcggtggcggccacagcatcgcggaggaggcggcgcggctgtgggctgacttccccgtgcgcgtggactgggcggccgtggcggcgcaatgcgcgtcgctgtgggcgcacgcgcgggcgctggtgctcgtgccggcggtgcggctcctggtgttcctgtcgctggcgatgaccgtcatgatcctcctggagaagctcttcgtctgcgccgtctgcctcgccgtccgcgcgttccgcctcggcccgcaccgccggtaccgctgggagcccatcaccgccgccggcagcaacggtgccgccgccggagacgacgaggagtctggcggcggcggccacggcgaagccaagtaccccatggtgctggtgcagatccccatgtacaacgagcgggaggtgtacaagctatcgatcggggcggcatgtgcgctggagtggccgacggagcgcttcgtgatccaggtgctggacgactccacggaccccgttgtaaaggatttggtggagatggagtgccagagatggaagagcaaaggtgttaacataaagtacgaggtcagggggaaccggaaggggtacaaggccggcgcactcaaggaaggattgaagcacgactacgtcaaagactgcgaatacattgccatgtttgacgctgacttccagcccgagtccgattttctcctcaggactatcccgttccttgtgcacaacccggagattgcccttgtccaaactcgctggaaattcgttaattccgatgagtgtctgctgacaagattccaagaaatgtcgttagactaccatttcaagtacgagcaagaggcagggtcctcggtgtattcattctttggcttcaatgggacagctggtgtctggaggatttcagcgatcgatgatgccgggggctggaaggaccggacgacagtggaagatatggacctggctgtccgtgcgatgctgcagggatggaaattcgtttacgtcggtgacataaaagtcaagagtgaattgccaagcacattcaaggcataccggtttcagcagcacaggtggtcatgtggaccggcaaacttgttcaagaaaatgatggtagagattttagaaaacaagaaagtgtcactgtggagtaaaatccacttatggtacgatttcttcttcgttgggaaggttgctgctcatacggtgacattcatctactactgctttgcgatccctgtgtctgttttgctgcctgagattcagatccctctctggggagttgtctatgtcccgacagccataaccctcttgaaggctcttggcacaccgagttcatttcacctggtgatcctctgggttctgtttgagaatgtcatgtcgttgcaccggattaaagctgcaataagtggtcttctggatgctggtggacgagtcaatgagtgggttgtcactgagaagttgggtgacaccaacaaggcaaagcctggcaccaatggatcagatgctgtaaaggtgatcgatgtaaagctaacagaaccccttattccgaagctagtgaagaggcgagcaagattttgggagaggtaccactgctcagaacttttcgttggaacctgcatactaatgtgtggtttctatgacttgcttcttgcaaagaagggatactacattttcctcttccttcaaggcacggctttccttgttgctggttttgggtatgtcggaacactacctccttgcactgcataagctgtcatggacaactgatacacctgcttaccagaaactgagcaagcaaagctcctctctcttgcacatatggaactacggaattcaatgatagttgagcattattcccatcagtcttggccagacatgatccactgccaagaaggttcagataccatcatcattctcctgtcactcttgatcagattgagacaaccattctttattgccaagaaggccattcaaatagtgtcgccatttcaaatttataataacagtgtttagtgaagcatcatgacaaaaaaaaatgattggtgcagcagcattttgttcaaatctgaacatctggtagagatgcagttcacagtcgtgaaagaattgcagctgctgtaaatggaatagcactagctgccaatttctgtagatctccgaacttgtagtttttttgaatttattgatattactcagttcagatccataatggaagattgtgggcttcctcagttcataacttgtgtaggcttaaaacttgtaaatgtaaattgttattaacactaataattttgttgaatccgggcagttcttg

SEQ ID NO: 164 - DNA, 2175 bp, Sorghum bicolor
gttccaagtccctcggcagtcagcaccgcatctgtctcgcgctccggctctctgtgactctgtcccctcacggccgtagccctttccaagggatatcggagggagaggagggggaggcgggagcagtaggaaggggcgttcgtgtcgtgggtggagaagatggagaacctgaggaggctcctgaatccgctggtgctcaacctgcagaagatggagctggagctcacctgccccgtctgcctgaagttgctcacctcgccgacaacgctgccgtgctaccacacatcctgcagcaagtgtgcccttacaccgacttcaaaaggttacagctgcgccatttgcaaatctggctattgttctcaagatttaaggccagcttctcatctcgagtcgatagtgagcattcacaggagcctcagctctaccgtatgcaccatgattgaacagcaggatgctcaagttaacattcctgttgcaaagacagcatctcatggaacaccagagtcaggaaacagaagtggggtgatggagaaatatgaccagatgaaatcttacaaccctgttgcttcaaagctagtatatgatcagtcaactggacctgcatttgggaacatggagggtgttcaagcaaaagatcctgcagtagagaacaatgctggtgctgcagctgttgcaccaacggctatagtacaaaagggtcattctgggtcacaatcttctgacggccctggggatttggattgtgacagcaatgaccttgaaggagaactgataacaagcagatcacttcttcaaactgcattgaaaagagagacaaatgtaatggatgaccataccagagaattgaagaggcaaaaatcaaatgaccaggttcaaagacaaacaaccatggccagtgcttggaaatgtgagttctgtcattcttcccaagtcactgagtgtactggacctttgtcacattatctgaatggggagccaatagaagctgatcaagcttggaaatcaagtgttcatcatgtccatgagaaatgtgttgaatgggctcctcaagcattctttactggtgacattgcaaataacttggagcctgagttggcccgtgcttctaagatcaaatgcagtgtttgtggcttgaaaggtgcagcacttggctgccttgtgaagagctgccgcaatagttttcatgtcccatgtgcctacaacatcaaaggctgcaaatgggatcaagagaacttcgttatgctgtgttctacacattcttcaaaaaagttgccttgtgaaagatcaaagtcaaaaaagaaggccaagttacagcaaccatcttctgacactgatggtctgaattcaccctctccaatgcaaagggatgaactttggactgcctcaccttttctgactagtggatgggtgatatgtggatctgccctcattggccatgagaaggaaatcttggatcaatttgagtgtcacactggcatcactgtaactaacacttggagttcggatgtgactcatgtgattgctaatacggatgaacgtggggcatgtgctaggacactcaaggttctcatggcaattttagctgggaagtgggttctcaatgtgaactggctgaaagactgtattgaggctaggaaaccaatcccagaagagccctatgagataagctgtgatgttcatggctctgttaatgggcctcgctcaggaaggcttcgagcaatgcagcaggcaccaaacctgtttgctgggttgaccttctatttcagtggccatttcatgccgggatacaaggccaaccttgaagatttgattgccgcaggagggggttccattttggagaagactcagctctcttgtgcatccttgattctttacagcatggagccaccacaaggaaacagtcccaacacccttgagaccatcaataagagaatagctgaggctcaagaactggcagccacggttggctgcaaagccattcctcatacatggcttctggattctattgcatcctgcaatttgagcgtgtgatgctgtactgcctaggttcaaactcaaacataggaatgtgatatctgttctgcttttttttcttttcaaaaaggagattaggatgtgattgacatgttgtcttgatccaaaatatctttaaatgttgtagcatgaaagcgcaat

SEQ ID NO: 165 - DNA, 3799 bp, Sorghum bicolor
gcctcgccgaccggatcctcgatgcccacgtcttctcccccggcggctcggcggggaccctcgccgggagcgtcaggtaccaccgcgacgccggcaggaggatggtgttcctgcacctcgcgccgctccagacggcggttggaggctgcggcgacggagacctaccggagatgctcttcatgttctctgtctgccatgtaattatatttctgcaagatggcttcaggtttaacacacaaaccttaaagaagttccgactgctgcaatcttcaaagcatgctcttgctccatttgtcaagtcattggtagcagctgcgatgcctgccaaaactgttgcctctgacaccccaacaagagcaacccacagggcttcctccatctcccctccagcacgccgtggaggtcacgccggtcgtcagtcctcggccatctcacttatgtccgggaccagttcaaatccttctgtactgccaggccaatgcattcctgtattgctctttgtctttgaggatgatgtgcttgatgtttcaagtgctgcagcaagttctgatgatatgggtgattcatcttcatcaaatcagtgttctacctctgatggattatcaaaacaaagtttagcttcaaaaagttctggttcagtggttatgcttgcccgggcagcaaacaaatctgagggcaattcagcgaaaaagctacactcgtcattggagggacagatccgtgtcttgctcaagaagtgcagggtacttgcaggcatggagccagggcatattggcccgaggggtgtaagtaacatgagtcatcatttacccctgttctcgcttgatacctcgagggttgttgcactgttggaacggtacatcaataagaaacaggagccactggacatcattgcaggattatttgaagattctttgtgctccaaattgtcattggatattctttcactggaaaacaactaccacccaacaaaccatgatgactttcagttgatcaaggattttatatttcggcagtctgatgccctgagaggtagagggggatattcaagcaatgcaagtgccgggtctgtttctggtgttggcatggtggctgctgctgctgcagcagcagcagcatcagctgcatctgggaaaccagttaatgcacctgatctccctacttttgataaatggttgtccataagtacctctattctaactgcactgttgagtggaagaaatgtgctgagtggtcagtctgaaagcaagactcatacaagtcctattgagaagaatgaccaacttcctgctgcaggatctaatgctattgagatcgcattatcgtgcttggaaagtaataatggtctgaacatgaaattttcttcatcatggtgccaaagggtgcttccggctgctaaggagatttacctgaaaggtttgcctgccttttaccccacaagcatgcatgaagtgcagctacagaaggcattgcggtcctttggctcgatggttaaaggaccagcagtcagggtattcttaaagaagctagaagatgagtgccgggcaatatgggaatctggaaggcagcaatgtgacgctgttagcctaactggcagaccatgtaagcaccgcaggcatggcgatttctcttcatcagatgcaatgaaacaacattctagtggatatgtattcctccatgcatgtgcttgtggccggtcacgtcgccttagagatgatccttttgactttgagactgccaatgtgtcttttaattgtttccaaaattgtgatgatctactacctacccttgcgcttccaagaggcagtgatgctggttcgttttcagtatcttcttggcgcttggtgcgtctcggaggagccagatattacaagccaacaaaggggcttctccaaagtggatttagctccaaggagaggtatcttctaaggtggattatatctgttggtaaggggcaagtgagaaatggcattcgttctaatactgttacttcatccacaagatctggtatgaaccctcagactcccccaatagtcactggtgaagtaaaatctgctgtaacccaagtcacagcacaaattaaatctgcaaagctcgaaagttctggaaaacaacctgatatggaaccaatgagcaactcaggtattaattttggtaaaggtctgccaaattttactatgaaaaaaccctttgctgaagttgttgctggcaccacatcaaaagattccgagtttcctgctcttcagcagatgaggccaccgaaacctggtggtcgaaaagatgagcgccaaatgaatataggagaccatcctaatggccgaggtcatgcggctgtcagccaagggcctgtagctgaaactgaatctgcgaaagcaagcagaaacaagagtagtgaaaattctgatgggaagccctttttacagatagggagcaatatagtaccagtgattgttggaaatgagactagagaaactagtcagcaggtacaacagtttgttgtgtatgttggatttgagcatgagtgtccctatggtcatcgcttcttactgtcagagaaacatatgaaggagattgattcttcctgtttgttgtatcaaagacctcatgtaaacaaagaagcagaaggcaagcatgcacaaaagttgctccaaaatgcatctggtttaattgcatctgcagtggacataaacagtgcacagaaaaacagtaagccattgcaatcatcagggagaaacagccagcagcaatcactgcagctgagggttgatgcagagacttcacaaccttctccttggctttcagatccacagaatggcaaaaggggggagcactattttccaagcattacaattgatgatggcggagaagcattttcactgatgaacagaaacttgccaatatatatgcactgtccacattgcaagatctcagaaaggaaggaacatcaagatgtaaagtttgctggtgccgtgtcacaacttcaacggattttcattgggtcatgcttgccatcgaatgtctctgatcatgatcgagaaggatcattcagtattgggtgccgagttatcctcccacctgagagctttcttacaatgaggcttccttttgtctatggtgttgagacaaaagagggaagtacatttcccctcaaaaactttgagcaacaaccagaactcacagcatggcttgttggaggcacagccttgcaaatcgtatcggtaggggacgtcaccgagaaagaaaccgttatgaagtgatagacatgtcatctaaagctttactggttttaacatgttctagtcacgtgtcagtgatgtgccattggatgcaggatggatgattatattcctgtctgaggttttacttgtactcctgaacttgtgctgctaagctgttgatacaactattgcttcctttcactgtgctccaagcattttggaatagaagtttcgctgatatctacctggatggtgtatatagatgcacgcagaggggacaggccacaggcaattgcgccgttcttgtcttgtatacgaatatttgccaccgtgccaggaggtaaagtttagctgggtctgttttttttaggactagtggatcaatccgattccttgacagaggcctttgggctgggagcttctgtagtaagattattagttcagttgagctgtgtagtgcaatattttttggccagttgatgtgctgttttattcctttgcgtgttgagaaatcgggccttggaatataaaaaacgagaagaaggaattttctgaatgatcttgtggcaaacggttgcttg

SEQ ID NO: 166 - DNA, 2063 bp, Sorghum bicolor
gaggcgcccccagaaacctgccctccgcctccctcacggctccctccgcgcagccaggaacagctctgccgttcccttggaagaaaaacttcaagggcagcagcggcggcggctggcaccacttctcctaatagcttcaaggcagcaccgcgacacggctaaggcaatttcataacatcggccggcctttcttcctggcttgagctatctttgcaggaaatatcaattcatcagaaaagcaaaatgcgtagcagaaagcccttggggattcaactttttgagtgtgcccgggggagtcccatctccttcagatcatgtcaggctcttgtactagttctgacgttcttatcatacgccagctaccatgccactagaaaaaccacaagcattgttaagagtgttcttgatcctaagacaaacctaggtatgttgcattggcccagtcatctctaccttcaaaatttgaaaggtgcagagaacaataatgcgactctctccggcggttgggctccgttcaacgctgaagatggcactgtattgcttggggagattgacttggcttttcttggtgtatatgcaattgggatgttctttgctggccatttgggcgacagggtggatctgaggatcctgctgactataggaatgataggaactggattgttcaccgccgcctttggagccggctactggttcaatgtacacagcttctactactttctgggcatgcagatggtgtctggcctgtttcagtcatctggatggccttcagtggttgcagtagttggtaactggtttgggaagagcaagaggggactgataatggggatatggaatgctcacacatctgtaggaaacatatctggctctctgattgctgctgccatgctgaagtatggatggagctggtcctttgtggtgcccggtatcatgatcgcactggtcgggctcacggtgttcctcttcttgcctgttgggcctgatgtgattggaatccaggaggatctccatttgaaggactctgagaagagtgacatggacgctcccttgttggaacgacgctcatcagatgtaaaagaaaaggcagtgggatttattgaggcgtggagaattcctggtgtagcacctttcgccctctgccttttcttctgcaagcttgtggcctataccttcctgtattggcttcccttttatatcagccacacagctatcggtggacaatacttgtcagactcggaagccggggtactgtcaactctgttcgacgtgggtggcgttgttggcggcatcctcgcgggccacatctccgaccacctggacgcccgggcgctgacggcagcgagtttcaccttctcggcgataccggcgctcttcttctaccgcatctacgggaacgtctcgctggcgtggaacatcgcgctcatgttcatcaccgggatgctggtgaacgggccctacgcgctgatcacgacggccgtgtcggcggacctcggcacgcacagctccctcaacggcaactcccgcgcgctggccaccgtgacggcgatcatcgacggcacggggtcgatcggcgccgccgtcggcccgctgctgacggggtacatctccgccaggagctggagcgccgtgttcacgatgctgatggcgtcggcgctcgtcgcggggctgctgctgtcgaggctggtggtggcggaggtggccgccaagatggagtcccggaggacgcccgcccacgccgctagcgacctgcccgtgtccaccatggacgaaccgtagaccacgagaccacctgtgattttaggcctcagggtgaggggagcaggtgcgcttctgtcccagaactgtgggatcttgctcctggtgtgccgtgcttcttgttcgtcatggtatatatgtatatggaaatggaatgcaatgtggttgcagcgcgccagcccgggcgtttctatctctgctctgttagggagctgcacatactgcaattccactagccatagttagacgaccttgtattattagcgaaagcaaatccaagaatgagagtacaacaaggttgcacaact

SEQ ID NO: 167 - DNA, 1333 bp, Sorghum bicolor
aaaaaaaaaacctacccaaccgccggtcatggcgtctgcggacgccggcgagacgtccaccccggggcccgcggcgagggagaagcccatcgtcgtccggatcaagcgcaagccctcgcagacccgcccagacgccttctggctcgagattaatgagaggccggccaagaaggcgatgctcgatttctcccgcctctccatctccgaaccctcctcatcgtcctcctctgccagtgccaaagcttcggaggaaccacgagttaagaagcttcttgtccaacacatcgagacagtacaccattctgaagctgttgaagatgttttacaatctcttttgcttgctgactcaaatgccaaggagataaagagcaagacaaaggagtggaatgacaaaatcaagcaagacaataaaccagagcagctacgatcagcagccagacagaggcatgaggatatgggaagaaatgctcggtttgcacaaatatggaagagtcgaaaaggagaaaaggatgatgctgatgattcattgagagaaatatgccacctttatgatgctgtccaagtagatcctgatgatgagaagcatccagcagaaccacggcaagtcttgatttctgacaacttatcaggtcatttggaatgtagagttgcattgtttcatgttccttacaatattccctgcaggattacctctttcgaagagggtgctgttctatgcaactttcttccgcttctacgcaagtacttgccatcaactgcagaggaaattgaggcagatataatttcattggcacaatcagaagattctgaagtctatgatatctatactgtcaaggaggtggatgatacaaacatggaggccacgtcagcagcttcatatccaaggttacaagtggatgatggagaagacgaatgctacgaagattgcccgtatgacacagatgattcaaatgctgaagacaatccgcttttcgattatcctgatgaattttccgaggacgaggatgatgatcgcaacgatgaggatccttttggagacgaagaagggtctgacaccgattacgagaaggaagaagtagaggtggaagaggatgagtaatattgaagggaagttgtgatgaaatgtggggactagcctgtgggctgaacgtaatgtttgacaatgagataggttcggagctgactgatgaatgtttgtgttgcttatgctgactaagaaatggacatgtcttgacgttgtgtaccagttagcattgcaaatcatgtgcactgcccggaggaagaattatttaaaatatatatatatttggaagtgtcagctagacacaagcga

SEQ ID NO: 168 - DNA, 1631 bp, Sorghum bicolor
ctctccctctctttctcttcacccccaaagtccccgccgcctgccagcctgtgcctgcccaaaagcaaaaatggcgccttcgccgcgccggcccgtgctggtgctgctcctgctgctcgcgcttctctgctcccacgtcgcgctctgctcctccgccgagccggggaagccaaagcccaagcccaaggtctccggcggccgcaaggcgctgctggcggacgacgacggcgaggaggtgcccgccgccaagccggccaagacggccgcggcagggaagaccaagaagaagctgctcgccggcgacgccgcttccaagaaccagaccaaggttgccaaggctaagaagccagagtcagccgctgccgccgcggcgaaagggaccaccaagaagcctgctggcaaagcggctgcgggtggggatgccgccattgccaaggtctccaaggcccccaaggtccctaaggcggaaaaggcggataaggccaaggtcccgaagccggacaaggctgcggcggcggctgctggtgccaaggccaagggcgccgattcaaccaagcctgccaaggtttccaagacgggcgccaaggcggtaaagccacccaagacgggcgccaaatctgaggttgccgccgtggctgggaaggcgaagaaaccggcagcggccaattcgaccgcggatgccggtgccaagccggtcaaatccggcaagaaggcggcgcaggtggttgccgacgcgaagccgaaggtgaatgccaccgtcgtgagcaaggaggagtcggcggcgacggaaacggcggaggtggaggttgaggaggacgtggtgttcgccaaggaggcggaggagggcacggacgacctcatctccgagttccgggacctgcccagtcggctgcaggagacgctgatgcccgacctggcgcgcctctcgcaccactccaaggcgtacctgtcagcggcgaacgccgggatcgccgacggcgtgcgcccgatccttggcggccggtgggcggcagtggccgcctccgcggcgtcggtggcggtgctcctgctgccgctcttcatgctcaccgcgctggtgcggcgcatgggcccgtacctgcctctcctccaccgtgcgctgctgctggcgcaggcgtacctcgccatctacttcgccacgctcgcgctcgccgcggccgccacggggctggagccactgcgcttcttccacgcggcctccccggccgcctacgcctggacgcaggccgcgcagtccctcggcttcatgggctacctcgtgctacagatggtggacctcgtcgccgtcttctccggcgccgcctcccccgaggacgacggcaatggggacgccgccaaggcgctcggcctcgcgcagatggtggtgggcctcgccgtcggcctgcactactacgccgctgtcttccaccgcgccgcggcgggggaggcgccccgtgccaactggcgtgtctacgccgtgtacgcggcctgctttgcgatcgtctgcgcctgcgcgcgcgccgagaggaggaagaaggcctacctcgcgggcaccgacggcgccgccgaggagtggaagaagagctgagctgctcatctcctctcgggaaacatggctagatcagaatttggga

SEQ ID NO: 169 - DNA, 1672 bp, Sorghum bicolor
agtgtcagcctcactgaacaggtccagcagtctccagagtccagactgcatccaggatccagcagcaacagcacatgaccaaaatccttgagaatctcttggctctatatatctgatttctgagactaattgatcgatcatgaaaaaagaagcacatgcgtgttgatttagcatagccatcgcgagagagatagggaaggaagacgatggccggcggtggtgaagcgccgttgctggaagggaagcccagggtgtacttcgacggctgccccgggtgtgccaatgaccggaggaaggcggagaacctgggaattccctacggccaattcttccatatctggatcatcatcctcgtctcctgtttgccaatatcattgttgtttcccttcatatatttcatgataagagacttgcatattgctgaaagggtagagggtattggattctatgccggttttgtaggtgcttcatatatgcttggtagagctctaacttccaccgcttggggaatgatagcagatcgtattgggaggaagcccgttatcattctttcaattatctccacgcttttgttcaacactttgttcggattgagtgtaaattattggatggcgatagcaacaagattccttcttggttctttaaatggtttacttggcccaataagagcttatgctgttgaagtatgccgaactgagcatcaagctattggactgacacttgttagcacatcatgggcaataggtcttattattgggccagctattggtggatacctcgcacaggagacattgcataagcataaacttcacaaaactgaagatcaaggaatcgaagattttgctgagcaacaaaatagttcaactacaaataagagcttgcttaagaattggccattgatgtcatcaattatcttattttgtgtcacctcttttgatgatatggcttacacagagatattttctctatgggccgaaagcgacaaaaagtatggaggactaggtttctcatctgaggatgtcggtcaagtgcttgcagttacaggtgctagcatccttttgtaccaaacatttgtttatccacgtattgtaaaagttcttggaccagtcaatgcttcccgtattgcagctattttgtctatggtgctccttttcacttatccaccaatgacacatctatcaaaaccatggttatcagttgtagtgaatattgcatcaatgttgaaaaacaatttagttgttaccgttgtaacatgctcttttattcttcagaataattcagtgcctcaagagcaaagagcaactgcaaatggcttagcaactacattaatgtcctttttcaaggcatttgccccagcaggagctggtattgtattttcatgggcacaaaaacgccaacatgctttcctctttccaggtgatcaaatggtgttcttccttctggacattgtgatctttgttgagctcatatggacattcaagccatttctagccattccggagcaaatccccagaagttagccttcatgcatcatctctactggtgttttattgtggatgggtcaatatcagataacaattgggatacctatttcttgtgcaatgtgatggaattatattgatatttccaatgtatatatacatggtgtttgtatagcaatctaagtattccc

SEQ ID NO: 170 - DNA, 1896 bp, Sorghum bicolor
cgccatccgcatccgctcccccgtgattcgttcgtgagaccctcttctgcaacccatctccgatcacgatctatcccctcccaggatcccactccaatcactcaaggtcgtcgcctcgcacgccgctacccatccctgcaccttgcggccgcacacgccgttgttccccgtctccggatctcgtgtccctgccacaacaccatcccctgccttgccgtggatctccccatctccaaatcccatgcccagccttgccgcggacagcagaggacgcacagctcgtggatccagggacagcggcgttcgtcccaccgcccgcaccttccgtcgagccgccgagcgtcggcgcccgcgaatccgcctatccgacgccggctacgctcgtaagagggaggaggagccgcagctcgtggatccagaggcagcggcgagcgacagcacgcgtgaatccgccttctccgctatgcctctcccaccttgcgtcccgtgctctaggaaagaggcagcggcgttcgagtggaggagacaatggaggcagagcggcgtaggagagctgcgtctcaaggtggagcagcgtccgagcggaggaggcggcggaggcagagcggcttcccaggtacggagccgaagcggcaacaatggcatcagcgcctgcgtcacgaacaagcgttgctcaggtgccctgccccggtgagctcctccctctgttgcctctatttttgactgatgagaaatttgctgatttgggattggtaagagacaaaaatgagattgggattgtgtttatggttcacatcgcccgcgccatggccctactgaatccaaggcctcggccaccttctgatggaggtctgtgatcatcttttcctcactagcctgcatgtctggatccatggcggagagggattggagcagtgacattgattcgatctgagaaacgttggctgctttaattcatgaacatgtgtgttggtttagcccaccactaaaccaatgaggagtgttttaagtgagaagacgtcatataggtcctggcgggggtcatcacatcttgttatctccaataatagaagtgtgttagggattttgtttcgacaaaaaacttcattttataagctaattttgaggactatcatcaactgcgacaacatcaaggagttcattgctctatgtgaagtactagagcttattccacaggatgagcttgaattgtctaggcagaagcagcctgatactatggcaaacaggagagcacagaaggttgccaggttcaaacgtcaaaaggctgcagaaacgaagctccaagagatcagagagagaaaagaaaggcgtggacgctcattgagagcagctgctttatctgccccaattgaagctggagaggaagatgacctggaggatgatggagaggaagaaagagaggcttggttagctaccatctcattggctctctgcaaggcgtttgatcttctcgacatgctaaagaaggaagaagaaatgcttctagctgtaaaggaaaggaaggcaaaggtttggtatgaccacctagcagtggtactacctctcagagatgcaactctagaaaccagttcaggagtcaatatcctttttgtgttgaccagttcagcaaggacttatacatatttgcatggaaaactatttcaatggttactgattaagcaatatactggttgagagtggtagatatgaaatttaggatgtaaacttcaaaggaaacaatgttgattccggcgcatgaatgaaatggatattggagatttcttttaaatattatcttagccgtattatagaaatgtctataaagtagagtttgtgagtttgtgatgccacattttccgtgactgtgttgatttcataaactttatattttgagat

SEQ ID NO: 171 - DNA, 520 bp, Sorghum bicolor
gtttctggaggtaccaagcatcaccagggcggcaatggcgcctcccatctcagcatcacaaagcacaatcaccattctgaagatttttccaaaacctcctgcacctgataccagcagcaataacttcactgttggggccaaattcgacaacaggagggcacttttatgtggcttggtcgctgctgctgctggcaccgtgctgagccctgacatcgccggtgctgcttcgaagaggcggcctccaccaccagggccggcagaggagaagaaagacccgaatgttagcggtgtgcaggctaaggtgcttgccagcaggaagaggaaggaggccatgaaggaagctgtggccaagctgagggagagaggtaagccagtcgataagtgaaggccagattgccagaaccagtagcctcattatggctcgagaaatgtaacttactgataataatataattgttactcgtttgatgtgtacagttgagaataaaatacaactatcttgcttggatgcattttgttc

SEQ ID NO: 172 - DNA, 1446 bp, Sorghum bicolor
acgcactcatcacttcaccactcaccaccaccgacacacgatctaaacgtagtacagcgtcatagagcacaagcaagaacttgatcggccactgagacaagccaatccaatccccccactcgattagctagctagatcagccattgatcgattgacatcgtcatggaggtttgcaatcttggcaataatgccatggaggctcagcagcagcgcgagcagagccaagccgggggctgcaccgacgacgacccggcggcggtgctgacgtgcctcacattcctggagcagaagatcgcgcacctccgcgccatcatcggcgcggcgccgcgcccgccgcggcagatggtgtcggccgagctcagctgcatcgccgtgcagctcgtctccatctccaagagcctcgccgcgaccggtggcggcggggccgcggcggcggaccaggacgacggcgccgcccgatcgccggccccgaacgacggcgacagcgactcgtccgaccatgacctcctccacgccgaggacgactacggcgacggcgacggcgacagcgatggccgcatgccaccggccggctcctacgaggtgatcgagctcggcaaggaggagatcctggcgccgcacgtgcactcgtgcaaggtctgcggcaagggcttcaagcgcgacgccaacctgcgcatgcacatgcgcggccacggcgaggagtacaagacggcggcggcgctcgccaagcccgcctccgcgccgtcgtcctcgctggcccggtgcttctactcctgccccttcgtcgggtgcaagcgcaacagggagcaccggagcttccagccgctcaagacggccgtctgcgtcaagaaccactaccgccggagccactgcgacaagagctacacctgccgccggtgcaacgtcaagcgcttctccgtgctcgccgacctgcgcacgcacgagaagcactgcggccgcgaccgatgggtctgctcctgtggcacctccttctccaggaaggacaagctcttcggccacgtcgccgccttcgacggccacgcgcccgcgctgccaccggaggacgacgacgctgttaccaatgctgtcggcctcggaactggctctggtcgcctgacgacgatggacaccgaggcagtgagcagaatggcgagcatggagttcttcccggacgccgtgctcgatggtctcgtctgttctgacatcaagggcttcgcgctcatggatggtggacaaggacaatatctggaggacgacgacggacgagggtcgctctcaccattgccaatggggctcgattcctgtgattttgatggatttgatctctttggggcaccagcaattgatttctgaactcaggagaaaacaaaaaagaaaaatgaaaactgatttgtcctcactcaattggcattttggcctacaaaaactaaagaatgatttgtcctc

SEQ ID NO: 173 - DNA, 582 bp, Sorghum bicolor
cccttgccgcgccacgccaggagcctgtccatggacagcctcatcggcaagctcaacttctccgccggcgcgacgggcgccgccagcggcgtcattccggggcccaacatgttcaagctcgagttcggcagcggcgagttcacccccggcgagatgaagaagatcatggccgacgacaagctggccgagatggcgcttgccgaccccaagcgcgtcaagagggtgctcgccaacaggcagtcggcggcgcggtccaaggagcggaagatgcgatacattgcggagctggagcagaaggtgcagatcctgcagacggaggccaccactctctccgcccagctcacgcttctccagcgtgactccgcggggatcgcgacgcagaacaacgagctcaagttccggctgcaggccatggagcagcaggcgcagctgcgtgacgcattgaatgaggcactgacaggcgagctccaacgcctgaaagtcgcgactgcagagctcggggattcttgctcgtccaacaatctagcccagcagatccaaatcagcgttcaggagcagatgtttcaactgcatcagcatcag

SEQ ID NO: 174 - DNA, 1943 bp, Glycine max
aaacatgggagaggagaatgttaaacaaccgttgttggagaggaagtactacaaggactgcccaggttgtaaagtggatcaagccaaagagttgagtgagggaaagggtgtacctgttaaaaatctttttatcatgtggatggtggtgctgtgtgctgcactgcctatatcatctctctttccattcctctatttcatggtaagggatttcaatattgcgaaaacagaagctgatattagttcttatgctggttatgttggctcttcattcatgcttggcagatgtttgacatctgtattatggggaattgtagccgatcgctatggccgaaaacctgttatagttatggggattattgcagttgtcattttcaacacattatttggccttagcacaaatttttggatggctgttatcatgagatttcttctgggaagtttaaatggtttgcttggaccagtgaaggcctatgcctctgaactttttcgagaagaacaccaagctataggactctcaactgtcagtgcagcttggggcataggtttgatcattggcccagcattggggggctatttggctcagcctgtagagaagtacccacatatatttacaaaggattctttttgggataagtttccatacttcttgcccaaccttataatttctgcattcgcatttgtagtagctattggctgtatctggattccggaaacacttcacaaccacaattgtagcaatgaatccacagacgatgccaaagctttagaaagtggaaacagtggagctggcaatgaaaagataatccaaaagaatgataacctcctcctgaattggcccttaatgtcatctatcattgtttattgtgttttctcacttcatgatattgcgtatcaagaggttttctcattatgggccgtcagtcctcaaaggctggggggtttgaactttacaaccgataatgttggtgatgttctttcaatatcaggtcttgcacttattatttaccaacttaccttatacccatttgtggaaaaagctagtggacctattgttattgcccgcttctcagggatgttaaccataccacttttgcaaagctaccccttcatagcattgttgtcaggcttggcactatacatagtgataagtattgcttcaattctgaagaatattatgtccgtaagtgcacctcttcatttatttaatcatttattagaacaacaccaaaggggggcagctaatggcatttctatgacagccatgtctcttttcaaagctattggccctgctacaggtggtgcagtattaacttggtcacaaaagcggatggatgcttcattcctcccaggcacccatatggtgttctttgtactgaacatagttgaagcacttggaatactaatgatgttcaaaccattccttgttgaaaagaagaaaacacactcagatcagttacactgataccaatcaattttgttcaaggcatgtagcatcggagctgctgtctaatattggggacaatgatggtaactttgtcatcacggggaccaatgatgattgtaactaaattaatggcaccaattcaatatgtagcttgccataaaaaaaacgtagaaacgtcacagaaaaaagaacaaaccaagctaatccaagtgaaaaaaagagtaccgaatattgtttttttaaaattgaaggtgatatcactatattccccttccccttcctggattgaatcccaactttgaacagtaacattgaaatcgttaaattgttagaggtttgtcatctttgatttgggaaaaaggaattattgtttgtgaaggaagaaactgctaatgttgtgtaaggttacccgtccttgtattcaagataaagagaatctctgttaagcaagaaaaacaagaaagaggaaataattaatatatttctgtcaaatttattc

SEQ ID NO: 175 - DNA, 1564 bp, Glycine max
gcggcacgtgtggcggtatcggctataaataaaggggtctctcttatgttctaagtttgaagcggcgccaccatagttggtgtagctagcgagggagggatatagggggaagcgtttattcattcattaagatggcatcggagcttcaattgcccccaggcttcagattccatccaacggaccaggagctggtgttgcactatctctgccgtaaatgcgcatcgcagcctatcgccgttcccatcatcgccgaaatcgacctctacaaatacgacccctgggacctacccggattggcttcctacggagagaaagagtggtacttcttttcaccacgggaccggaaatacccgaacggttccaggccgaaccgggcggcgggaaccggttactggaaggcaaccggggcggataagcccattggccaccccaaaccggttgggataaaaaaagctttggtgttttacgcagggaaagctccgaaaggggacaagagcaattggatcatgcacgagtatcgtctcgccgatgtagatcgctccgttcgcaaaaagaacagcctaaggttagatgattgggtgctttgccgtatttacaacaagaagggcacgatcgagaagttccaaccaagcagcgatgttgttgttagccgaaaaatggaatcatcggagatcgaagacaggaagccggagattctgaaaagcggaggaggttgtcttctgccgccggttccgccgccgcaagcgaaggcggcggtgaagaaggattacatgtacttcgacccgtcggattcaatcccgaagctgcacacggactcgagctgttcggagcacgtggtatcgccggaattcgcgagcgaggtgcagagcgagccaaagtggaaggagtgggagaaaagcctcgagtttccgtttaattacgtggatgccactctgaacaacagcaacagcttcacgacgcaattccagggcaataatcagatgatgtcgccgctgcaggacatgttcatgtactggcccaacaagcccttctgaacaaaccgatccacgccgcccattcgcatttgcacggtagcacgagactcaaggtctatgagtgtgcctgtgcgaccacacacagacgattatttatcaagttagcttagctagggcaaagaaagataaaaacattgaagctggaaacgcatgtgtttgttgggtccaccgtctgcaccggttctttttggtgttttgctatgtgacgacgacgacgacgatgacgatccaacggtgcatgtttgttgacctgtccctagtagtagtagcatgtgtacagctattgtatgtagaatgtagataggtacactactacacgttgttgtcatgtgatcatagaagctctcttaccgggaaaaataaaaattgatagaaggatggaaggtgtatttggaccttccctaattaatatttgttgaattattatcattagtatgtgttacatctaatttagtaggtgctcctttctcttgttttttaggtcctttttaatcgagtatcgtgatatcctactgtgtgtttactttttt

SEQ ID NO: 176 - DNA, 1833 bp, Glycine max
gaacctctataaacaaattttcaaaccttaacaccttacgaaaatcaactaaagaaaaccattgatggcgctccctcactccatctctgccttagccaccacactcacactctcctccccaataaccaaaccccataaagttaacccctttcccttttcctcgaaccgaaattcacaatttttaacgaaacaaacgcgacccagaagcagaagaaacctctccctaacccctgcacgcgttgcggcgccaccctcaacggttgaagccgatcgattatacccagaggccgaaaataacgaaactgaggaagagtttagcgacgagagctcttcctctaaattcacttggagggatcactggtaccctgtctcgttaattgaagatctgaaccctctcttgcccacaccgtttcagcttctgggtcgtgaaatcgtgctctggtacgacaagtccatttcccaatgggttgcttttgatgacaaatgcccccatcgtcttgcccctttatctgaagggaggatagatgaagatgggaagttgcagtgttcttatcatgggtggtcttttgatgggtgtggatcttgtgttaagattcctcaggcttcatctgaaggccccgaagcacgtgctattggatctcctaaagcatgtgccactaggttccctaccttggtgtcccagggtttgctctttgtatggcctgatgagaatggttgggagaaagcaaaggcctccaagcctccaatgttgcctgatgactttgacaaaccggagtttgccacggtcaacattcagcgtgatctgttctatggttacgatactctcatggagaatgtctctgatccttctcacattgagtttgctcatcacaaggtcacgggaaggagagacagagccaaacctctgccattcaagatggattctcgtggttcatggggcttctctggagctaatgaagggaacccacagatcagtgccaagtttgttgcaccatgttatatgatgaacaagattgagattgataccaaactccctgtagttggtgaccagaaatgggtagtatggatatgttccttcaatgtccccatggcacctggtaagactcgctccattgtttgcagtgctcgaaacttcttccagttctcagtgccagggcctgcctggtggcaagtcgttcctagatggtatgagcattggacttcaaataaggtatatgatggagacatgattgtccttcaaggtcaagagaaaatcttcctttcagaaaccaaggaaggtggtgacattaacaaacagtacacaaacatcaccttcacaccaacacaggcagatcgctttgtcttggcattccgaaattggctgaggcgacatggcaatggccaaccagaatggtttggaaacagcagcgaccagccattgccatcaactgtgttatcaaaacgtcagatgttggatagatttgaacagcacactctcaagtgttcatcatgtaaagcagcatatgagggattccaaacatggcagaaagtcctaattggggcaacagttgtgttttgtgcaacatcagggatcccatcagatttccagttgcgtgtacttttggctggactcgcagttgtcagcgcagccatagcttttgccctaaaccaactccaaaagaattttgaattcgtggattacgtgcatgcggaaatcgattaagcacgtccctccaaaggaacttcaactagttagttgtaaatagagttgaagacaagtacatgtacactagtattttgatgaaaagagctcaaatctacctaaccttagtgttatcattaaattcaacgaat

SEQ ID NO: 177 - DNA, 1244 bp, Glycine max
atttcatcaaacaaacaaagccttcaacaatcaaaagcaaagaagtgaagagagagagaaagagatcattctagagacagagagaaaaattagcttcagtagatattagtggtgggtttgggtttcaagagaggagacatgcctaacttgaacccaacacttcaagtacttgcttcttcatacccttaccagatcccaaaggtcttgatctaattttaagtgattcttctgatgactatattgaaggttacatgaagccatttctctttttaaatcttcccaacaccgagttcaattcttcacaagttgattgtaatcactcaatggctcattcttcttatccctacggcgatccaatttttgcttatggaccacaagctattagtcatccccaaatgatacccccgatgctgggactagcatccaccagagtggctttgccacttgatcttgcagaagatggaccaatttatgtcaatgcaaaacaataccatggtatactgagaaggcgtcagtcacgagcaaaacttgaggctcagaacaaacttatcaaaaatcgtaagccatatcttcacgagtctcggcaccgccatgctttgaatagggttaggggatccggggggcgatttctcagcaccaaacagcttgcacagtctaatgcagaatttgtcactggtgcacattctggttctgaccctaccaacagatatcaaaaggaacatctatcagaggtggaaagtcattcctcaaaagatggagataattcatctttcatcacaacctgctccgaccggccatgtttatctggcaacaatgtcaattttcggcagcaggagtgcatgtttctggggaattctgcaaacatgggtggatcaccacagttcagtgggggactcacctttggcggagcaaagcagcgcacatcagttgtccggtgagagaagaaactgatcgaaaccgacttcaccggtcaggcaaatcatccttggcttagtcacttttgtctgtgtctttatgtgttcgtactaaatgctcattttgagagacttttttcagtctgcattagcactataagacctttccaattgctttggcatgtattttaaagttgctattgtactggattttgaactggattggaatagtcttttgcatggaacttgtatgtttgtgttagttactgttgaatttccttgcttcaaaatatgtgatttctaatagtggattatttactcttttgggtt

SEQ ID NO: 178 - DNA, 1496 bp, Glycine max
gttgtgaaaatgaatggttggtttgtgtaggatgctttgcttgaaaggatggggtgcacttactctgtgtataggaagaaaaaatcaagcttccctgaagtggtggtctttgttccatcaacaagaattccggttcaatctgatctccaaaggatggtcaagggtgtaattccaagggatcttgctgataaattaacttcactaaggaatcagatagtgttgattgcagaggatactggtgggtcagctatagctgaattgcggcgagctttgaaagaatatttgtctgttctgattggacttacaaagaaagagtatggtcctgaaggactaatagatttcaagtggaaaaatttagaagatgggagacaagatagcagtatatcaaatacctggtttgaggtgctatcttcagttcaccttatggctatgctgacactctctgacgctgactcactgatgattccaaaggatccctcagggtctggattcagggttgtatcttcagatagcaagagggaagcaattgatttgttactcaaggcatcaggatacctggagttctgtgtaagggatgttcttactcggatacctgctgaaacaaagaaaacttttccccacgacttacaggaaggtgtattggaggctattgctattcaaacactaggccagggaactgagattcaacttggtcttgcggtggaaagtcagaaggcaactttgtctgtgaagaggaggttggcatgtgaacagctgatttactttactcaggcttatcactgcttgtcaggatgcgacatcaaccaagggcatggaaggaagcaaattcgatttatcaaatggaagttccttgaagccaaggctgcagcctactactaccatggtctgatccttgacaagggtagtgaaccaagcatccacattggttctgtgtcttgttttcttgctgcagaagagcttctggctgaaagcaagaaggcctgcttaagcttttgtcttgcacctccagtgacaagggctcctccactctggggtgctatgaaatttttacaccagaaaattcctgaagttgcatcaaggaagtcccagatgtatggttacctctgggagcaagagaagggtcttcaatcattgccagaccttcctgagttccaattatcattacgtccagatgactatgaattgcctgaaattgatccggcatgggatagtgaaaactgggaatctcttgggcagccattgaaggagcaccttagagatagtgatgagcatgatgagaatccaactgattgagaaatttgaatggtcttctttcttttgtattttgtagttgaatacatgcttgagtgtcagcactcttttatacatgctaatattatcatagaatatcagggttagtattcattataacgattatatgactccctaagttacaaaatcttagtgaatgacaaacttatctctatattcaacaataagatatagccttattaatc

SEQ ID NO: 179 - DNA, 1416 bp, Helianthus annuus
ggcggggatatcaaattactcctagaatcagttgtagtttcggtttcagcttctctccaatgaggttctttcttctccacgtttgtacacttttttcggtagcacttataggaagtcatgcagtgactcctgaagtatactggaagtctgtgttaccaaacagtcctatgccaaaatcaatcaaagatcttctatatacagaatggaatgacgagaaaagcaccgcagtgggggtaggaaaaggcggtgtaagcgttcatacaggaaaaccaggaaaacgaacagatgttggtgttgggaaaggcggtgttggtgttcacaccgggaaaccaggaaaacggacagatgttggtgttgggaaaggcggtgtcggtgttcacaccgggaaaccaggaaaacggacagatgttggtgttgggaaaggcggtgtcggtgttcacactggaaaaccaggaaagggaacccatgttggtgttggaaaaggtggtgtaaatgtgcacacccgccacaaagggaagccagtttatgtaggtgtgcgtaaaggacctaatccttttgtttacaagtatgctgcatccgagaatcagctcaaggataatccaaatgtagcattgtttttcaaggagaatgatttgcatcaaggcaaagaaatgaacctacacttcactaaaaacgacgaaaaagctacgtttttacctcgacaaatcgctgattcgatacccttttcgtcgaacaagcttccacaaatctacgaagagttctcagttaaacctgactcgatggaagccgagatcatgaagcaaacacttagcgaatgcgagagtacaggcatcgaaggtgaggagaaatactgcgcgacttcattagaatccatggttgattttagtacaaccaaacttggtaaaaatgtgaaagcgatttcaacagaggttagcgctaaagaaagtaccccgttacaaaagtacaaaatcgaagtcgctaaaaagcttgcagcaaataaagctgtggtttgccataagcaaaactacgcatacgcggtcttttattgccataaaaccgctagtactcaagcttatgcggtttctatggttggtgcggacggtacaaaggtgaacgcggttgcagtttgccatactgacactgcaaaatggaacccaaaacatttggcgtttcaagtgcttaaagttaaaccggggactgttccgatttgccatttcttacctgaagatcatgttgtttgggttccatacaaataaacttagcaagaaaaagacagaatacggtttatggttggtgtctagcgaccctatttatggtgttgttgcttcctttgtttatcagtatttgtaaagtaatgaaataagtactacatgcgttttacttaatcaagggtatcctaattattgtactaaaaaa

SEQ ID NO: 180 - DNA, 1415 bp, Solanum lycopersicum
cataaaagttatgttacgttacaaaaataataaaatcgtgtatcccaatgacttttgcgatggcaaaaaatgtctgaatccactttttatgttcccacgtatattcttgagattgtacatatactatagttttgactcataaataattcaagaacacacagcacattctcaagaaagggaaaaaaaatgtctagtcttaaagttccagcatcagttccagatccttatgaagatgctgagcaactcaaaaaagcttttaaaggatggggcacaaatgaggaacttattattcagattctggctcataggaatgcagcacaacgcaagttaatccgagattcttatgctgctgcttatggagaggatcttctcaaggacttggattctgaactgacaagtgattttcagcgtgtggtgcttctctggactttgagtcctgctgagcgcgacgcctacttggttaatgaggctaccaaacgtctgactgctagcaattgggttatcatggaaattgcttgtaccaggtcttctgatgatctttttaaggcgaggcaggcctaccatgctcgatacaagaaatcacttgaagaagatgttgcttatcatacaagtggggatttccgtaagcttttggttcctcttataactgcattcagatatgaaggagatgaggtgaacatgacattagcaagaaaggaagcaaatatactgcatgagaagatctctgacaaggcttacaatgacgaggagatcatccgaatcatttctactaggagtaaagcacagctgagtgctacgttcaaccactacaatgatcaccatggccatgaaatcatcaaggatctggaagctgatgatgacgatgagtacctgaaactactcagagcagcaatagaatgcttgaaaaccccagagaaacactttgagaaagttcttcgattggctatcaagaagctgggtacagacgaatgggatcttactagagttgttgccactcgggctgaagttgacatggagcgtatcaaagaagagtaccataggaggaacagtgttacattggaccgtgcaattgctggagacacttcaggagactatgaaaaaatgcttctggctctgattgggcacggagatgcttgaattacatgtgctgaaaccttaagataataaaaaaaactctacttattttctgaagtttgaatttgcttttatgatgtatggtgtgtactctcagagtttggttctgtgtttatatgaactaaaaacactcgggagttgagttgtgttttgttttcgccttcacttttcatttcggacttctactggttttgcctgctaaataagcatagcttcaactttggcttgaacggatcttgtttctttataactcagaaatagattatgtatcttggttcgta

SEQ ID NO: 181 - DNA, 1300 bp, Solanum lycopersicum
ggaaattgaagatgctattagaaccactagtcacaatcctttagcatcaacacaaaatcttgaatgatcactttgtttgaagaatagggcaaaaaacctaaatcaagaatcatcaatggcttccaccattagctacacttcactttgttctttacttaaactcaaccaaaccaaccaaaaaaccccattttccccttccctttcttctccttcttctttggttaaaatcaagaaccagttgtgttttagcagcaatttttgtagccacttaaataaagcttcaatctttatggttaaagcttcagaaacagaagcaactcagtcagaaaaagaagaagaagacaaatatgaagaatatgaagttgagattattcagccttatggacttaaatttactaaaggtagagatggaggaacttacattgatgctattgctcctggtggttttgctgataagactggaaaatttactgttggagataaagtcattgccaccagtgcagtgtttggagaggaaatatggcctgctgctgaatatggaagaacaatgtatactatcagacagagaattggacctttgctcatgaagatgcaaaagagatatggtaaggtggaagaagtaggtgaattgacagaaaaggaaattatcagagctgagaggaatgctggtttcattagtgacagagttagagaaattcaagtaacgaatgctcggaggaagaaagaacaaaaggagcaaagagaaagagaacttcgcgaaggactaaaactttctaagaatggcaaatacgaagaagcactcgaaaagtttgaatctgtgttaggatcaagaccaactggagatgaacttgctgtagcaagttacaatgttgcatgttgttattccaagcttaatcagcttcaagcagggttatctgccttgaaggatgcaatggaagcaggatttgaagatttcaagagaatcaggacagaccccgatcttgctaatctaagaacgtctgaggatttcgagacactcatgaaaaagtttgatgaatcgtttatcaatgagaatgccatcaacgcgattaagtccctatttggcttcaacaagaaatagaagcagcagcacatccataaactggtgatatccaaggcaaaagatatgatgactatgctccttttttttggattttgtttataggtgagttttatagatatgaaattacttctgatcatcaatttttttttcatttcaattgtattatactatggttaatctcgtgtaattataaggttcgtattctggataaaaaaaaaa

SEQ ID NO: 182 - DNA, 840 bp, Solanum lycopersicum
ttgcaccagcaagatatatttattcccctacctatgaaaaagtagtcatcatttttcttcaagctaaagaagagaatagatccaactatgtcaaataggcaactttgttcattagatagtgagaaatcacatttgatgaatacttgtaatttgttgactcaatttttcaatggaaaagcaaatatcaatgatctaaatcttacaattagtaacaatggagaagccaaagcctcagcaacaaaggatttgttaaccaacatggaagaattatcaactaagacaacagaacaagaccagaaattaatagatcatgttcctaaaagtgcaataaataaagccagcggcagcaaagagataccacataaggagcaaaagctagcccaattatctatattctatgggggtaaagtggtggtttttgatgattttccagcagagaaagccagagcagtgatgttattagctagcaaaggaatctctaacaactcttgtgccatttttcaaacccccaccaccactcagactaatggatccaacaactttgatttacctattgcaaggagatcttcactttataggtttcttgagaagagaaaagacagggacacggctagagcgccataccaaatgcataatccattgcaatcatcttcaaggactcgtggagatcattttgatctcaatttctagttataactcaactcttcgattcgaagatattgttagtaactaggacaacttgatataacgaattatttatatattgttgtacgtcaatatttttttatgatataaaaaagttatatgttattagtatagaaaacttgactgattctcatt

SEQ ID NO: 183 - DNA, 1572 bp, Solanum lycopersicum
gttctttttcatcccccattcagtacgtagcacacagaaaaccagaagaaaaaaaaaaataaaggttcaagaaaatatacagctgctatatacaacacaaaatgagcttgttcagattttttgcttccaccatacttttactattcttgatttcttgcttcagcttcagctcaacagatgcctttgatccacttgatccaaatggaaacattactataaaatgggatgtgatcagctggacacctgatggatatgtggctgtggtgacaatgtacaattttcaacaatataggcatattcaagcaccgggctggagtttgggctggacgtgggcaaagaaggaagtcatatggaccatgatgggagctcaaacaacagaacagggagattgttcaaaatataaaggaaatattccacattgccgtaagaaagatccaacagttgttgacatgctgcctggaactccttacaaccaacagattgcaaattgttgcaagggaggagtgatcaactcatggggacaagatccggcaaccgctgttagctcgtttcaagttagtgttggtgctgctggaacaaccaataaaacagtgcgagtacctaagaacttcacattaaaggctccaggtcctggttatacttgtggacctgctaaaattgtgaaatcgactaagtttgtctccgcagatgggagaagagtgacacaggctatgatgacttggaatgtcacatgcacttactcacagttcctagctcaaaagactcctacatgttgtgtgtccctctcatccttctacaatgacacgattgtgccctgcccgacgtgcacttgtggctgtcagagtaatggcactcagcgcgggagttgtgtagatccagaaacgccacacctagcttcagttgtatcagaccatgggaagaacaattatgttcctttggtacaatgcacaaagcatatgtgcccaattaggatacattggcatgtgaaactcaattacaaggaatattggagagtgaagatcactataacaaacttcaattacaggatgaattatacacaatggaacttagttgtccaacatccaaactttgacaacctcactacattattcagctttaattacaagtcactgactccgtatggatcaatcaatgacactgctatgctatggggtgtgaagttctacaatgatctgctcatgcaagcaggtccttcaggaaatgtccagtcagagctactattccggaaggatgcatcaactttcacttttgagaagggttgggcttttcctcacagaatttatttcaatggagacaactgtgtgatgcctcctcctgatgcatatccattcttgccaaatgccggttcacgatgggaggcgtctctgattacattagtggtgacattgatgtcttcaatggcagttgtccttacatacatttaaaaaattatcatctgtgtatagttcaatgtatatctgttttagtttgttatctctgggttgacatccgtgttattgccaagattggtgtgtgagttggtatggctgagcaatggccatgcgttctgac

SEQ ID NO: 184 - DNA, 1028 bp, Solanum lycopersicum
agccatggtgaacaaaaagcagtagagataaacactactactaaaaaccctccaaaaaaaaatgatgatgatcggccgatcacctcccaccgtccaaatccctccttgggacgtcaccgatgatccaacggttgatgtttattccccattctccgttagccctgattctgctttcgatgctttgacggcgttgcagcgttacctgccatcaaatggtaacgatgtgatttttgactctgatgggttggatattccggtggatgcattttcatgtgataatttcaggatgtatgagtttaaggtgaggaagtgtgcacgtggaaggtcacatgactggacggagtgtccgtacgctcatcccggtgagaaagctcgccggagggatccaagaaagtatcattactcaggtacttcttgtcctgattttcgtaaaggtcagtgtaaaaaaggtgatgcatgtgagtacgctcacggcgtatttgagtgttggctacaccctgctcgctatcgtacgcagccttgtaaagatgggacccactgccgccggcgcgtctgcttcttcgctcacaccccggaacaactccgtgttttgcctcagaacagtccgaggagcttcaacgagtcgtctgattcgttcgatggatctccgggtcgggtcgggtttgaatctttttcgtcttctccacctcttgaatctcctccgatgactccacgtgggctggcggagtcgatgcgtaatatgcagattgggatggtgagaggtatgcgtagtatgcaaatgggttctcctgcgtttggttcacctcgtagcccatcaatactccgacccggattcatgagtatgccaacaactccgacccgtagtggagcgtcggtgtttgatcactgtgaagaagagccggcaatggagagggtagaatccggccgagatctccgagcaagaatttatgctaaactaagcatggagaactctcttgattccggtgcaccggatgttggatgggtttccgaactgctaaaatgaatgc

SEQ ID NO: 185 - DNA, 1662 bp, Solanum lycopersicum
gatttctacgtttctcttctctcttctctctctgtgtttactgcacttaatttttccggcaatggttctgtaaactgcatatttttctgagtgaggacttaaaaattaaaggcctcttcagtttctgaagttgtcttgcttgttataaaagtgtgaatggcagaagtctgttttggagttgtgactgaaactgattcatcatcaccgtgtgaatcaagttcacgggcggtgaggaggaggagaatggagcttcgaaaaataaaggtcatagctggagtaacgcaacccgaaacagagaatggaattaaacgtccaaaaatgaaacttatttctggttctgtttcaaggatttgtgataacgctgtggaaagttctagcaccgacgatgatgaagaacaactgagattagtagagacgaaagggtcaccgccaactattattttgactccatatttgggtcctttgaattctactctccttgttcaatcagtggcttacccaaagtttggcttcgcctctgtttgtggaaggagaagagatatggaagatgcagtcgcaattcatccttcattttgccaaatggaacaaggaaacagtggagaattacattactttgccgtttacgatggtcatggctgctctcatgtggcgaccaagtgtaaagagaggttacacgagctggtgaaggaggagctggagaacacagaaggagatcatgaagagtgggagcatttaatgaaccgaagcttcaatcgaatggacaaagaggtgattgaatggaacaagagcgtaaccggagccacatgccgttgcgaacttcatacaccggaatgtgacgccgttggttcaacggcggtagtcgcagttgttacgccggacaagattattgtcgcgaattgtggtgattccagagctattctttgccggaatggcaaagctattcctctttctaacgatcaaaaaccggatcgtccggatgaacttaaccgcatccaggaagctggtggcagagtaatctactgggacggccctcgtgtttcaggcgttttggctatgtcaagagccattggtgataattatttgaagccgtatgtgatctgcgagccagaagtgacgataactgatcgaacgtcggaggatgactgtttgattttagcaagcgacggattatgggacgtagtctcaaacgacactgcatgtggcgttgccgggatgtgcctgaaagggaatgcatcgccggcgtcaatgccggaaattggaaccgacggcgaggtgaattccgaccagtgttgctctgatgcgtcggtgcttttgactaaactagcccttgctaggcggagctacgacaacgtcagcgttgtcgtggttgatttgaagaactacaagtagacagcattgaaactttttcttttttgcagccttttatgtaacattttagtgtgtttattttggatggtgtttgaggttgtattcagttttttagattagttctttagacggttgaaattggaaaaaaatgatttggggaaaagaggggatttcctcaaatgagagttttaggttttgttaaccttgttctgcaatggtttaaattatccaagggatttagtatgtacagattaagactataatttcaattatcaagtttccaaatgccaaaat

SEQ ID NO: 186 - DNA, 1631 bp, Solanum lycopersicum
aaagaagaacacagtgaaaaatccctcaccttccccactcccaccactttttctctatgatacacacaaataaataaataaattaggcctagatatctacttctatatatatatatatgttgatacagatgtatgtataatcttgagaatctttagtgaaaagaacttcctttttagcttaagcatatgtatgtaatagacacaagctaaacttgtgagtttttcttgaaaggggtttttctttaactgctgtcatccccagaaaaagaaagatcataattacttggggcaagtctaataatgcctactattgctaaacatgatggtcggcagctggagactgggctgcgaattacctcactatcaactacccaaatgcaaccatggtggcacggttatggtgataatactatgcctttggctagtgagaatgccgttgcccaggagaaatctgaaggtggcaaccaggataaagaaacaaaggctctagccatggaatctggatcagatggaaataacgagcaatacaagcagcacctcaagcattttgcacccacaactgctgccatcatggctgagcagcagaaggaactcacaggtcattcagctatgttggcgtcatatccatatccagatatgcagtatgggggaatgatgacttatggcgcacctgtacatccccacttatttgaaattcatcatgcccgaatgcctttgcctctcgacatggaagaggaacctgtctacgtgaatgcaaaacagtaccatggaatattaaggcgaagacagataagagctaaagcagagcttgagaggaaagctattaaagcgagaaagccatatctgcatgaatctcggcatcagcatgctatgagaagggcaaggggaactggaggccgctttctgaatactaaaaagctcaatgacatggactgtacaccaacggagactcaaaaatatggggcaaccattgcaactcactctggcaactcttctggttccgggagttctgatcaagggggaaaggaaggatctacagttcaagacatgcacaaaggacacagccagagtttcacaactggcaatggccatggttcatctgtgtatttttccgcgagcagtggaagtgagcaagggaatggccattacggtcatggaagttggagcctgctggtcaatcaggcttctcagggggcagcttccagcaattaagaagctactctccaatggtggaggggtcagcccagcatggttccgtctcttgcgtcgttcatgcaggcaatgctgaacatacatgcaaggtggcatggggctatgctcaggcaattcattcttggcttggttacttgtactatatgagcggcgatgaggaagaaaatagcatatggcgagtatgataccttacaaattcgccatttattcgtatttcctctcaccctgtatgtaaataaggaaaaatatatgttggaatgtaggactagaagcagtttggaatctgatacttcatagtactgcatcatcttgattgtgtgtggctatttgttggatgggtttgtaaaattgacaatctcaaaagttgtttttatgctgtttgcttgattttccaatgaggatttgcaatcctttcctcc

SEQ ID NO: 187 - DNA, 1698 bp, Solanum lycopersicum
ggaggctatatttcattggtcattgccatgtaattccaattttttttccacttgtaaatcattctgttgccttctctctctctctttcttctctccctctgcttgaaattgtactgacatggctgctactaaatggggtttctctaattgactgtacaatcacacaaagcttaaagttttcatcttggtacaactattacttcactaggaacataattcctttagattttcaagagaaaaggtgtgagttgctcttgtataaccatgaatactactatattttccaaaggaaatgaacgggttgtccagaatcaatctgttggaacattgtgctctgctccttggtggagtaatggttttatgtctcaatctgtggcttatgctgagccttttggacaattgaaatctgcatctgtggagcagcagcctaaggggaatgcaacagagttcactatttcctctggtgattgcaaatcttcggcaaatgggcaaaaacttccgaacattcaggctgcttcctctgttcgtgcagctaatatggactatcgaggtcactttgagctaggttttggtcagtccctgatttatgcaaaacatccttatggagagcaatgcattgggttattttcggcttatgctcctcaactttcgggccgcattatgctaccattgaatttggcttctgatgaaggtccgatattcgtaaatgccaagcagtatcatgggatactaaggcgtcgaaagaccagggctaaggaaatggagaaaaaagctcttaaaccacgcaagccgtacttgcacctctctcgccatctccatgctttgcgccgacctaggggctgtggtggtcgtttcttgaacacaaggaatatgaatggaactatgaaggctggaaaaaccaacaatatgttcaagacaggcgatgttcaaaacttttaccccaccggatcccagaattctgaagtgctgcagtctgatagcagcaatttgagctcaccaaaagaaacatctggcagtaggttcttcgattcatcaggggtcgctaacatgtactctagtgacaatcttgatccttttctgttccaaaacctgaggcctccggtccaggcaataccggacatgatgaatactggacacggtattttcgtgtctggtaagtgggtttgcacagcagatagctgttgcaacctcaaagtatgatagccttggcttgagaaagaggtcaggtgtcacgagttgagcctcacctcatccgtgctacaacctaatgcatacacatttggttgctgcaattgccggaccatccttggctatcatgggcagttcatccttggcttagcgttaacgcggtgcctatatcgttctattgctatcaagcaacgtggatggtaagaggcactaaagccttaatgctactttattttcagcactttgttggataaataagcttgttttcgatgagatgatgacgatgacgaccctgtcgatcgggggtctctgatgttgcagtgtgtttggattactgttttgtgatgttggtttgtgaaaactacaatgatgtatgattgaacttgatccaaataatgtgcaaattggtgtgttttcagaaaaaaaaaaaaaaaaaaaaacaaaaaaaaccctgtcatgccgttacgtagcgtatcgttcaccccaagggccaattcgcggccgctaaat

SEQ ID NO: 188 - DNA, 1667 bp, Solanum lycopersicum
gctttctcttcctcgtaaaagctttgtatatacgacgtacaaagtttataaataaaaaatggcgagcgaagaaaggagggagacgctactaaataagagagaagagaaacactactacgaaaattgccccggttgtaaaatggatcttcacaaagcgggtcaaacgggtttacccgttaaggagcttttcactatatgggttgtcgtgcttggtacagcacttccaatatcatctctctttccatttctttatttcatggtaagggactttcacattgcaaagagagaggaagatattggttcctatgcaggttatataggttctgcatttatgtttggaagaactttaacatctgccttttggggtgttgtggctgaccaatatggacgaaaaccagttataattttcggcacttctatagtgattattttcaatactttttttggtcttagtgccaacttttggatggctgttgtaacaagatttcttcttggtagtttaaatggtttgcttggaccaataaaggcatatgctgctgagatttttcgtgaagaatatcaagcactaggaatgtcaacgattagtagtgcatggggcattggattgattattggtccagctttaggtggttttcttgctcagcctgcagagaaatatccagacttgttctcaaagggttcattatttgggagatttccctatttcttgccttgcctatgcatatcagtgttcgccttggttgtggctgttggttcattttggattccggaaacattacataaccatgattcagaaaggccgcgtccagattcttacaaggctctggaggctgcatcagatacaaaagacggaaatgaatcagccccaaaagaaaatctttttaagaactggccgttgatgtcatctatcatatcatactgcgttttcgctcttcatgatatggcgtactcagagattttctcattatgggctgttagccccagaaaatttgggggcttaagttattcaactgctgatgttggtgaagtactatcaatatcagggtttggccttctagtctttcaacttacattgtattcatcggttgccaagtatattggccctgtcatgactgctcgagctggaggagttttgtcaattgttttactgacgacttacccttatatcgctatgctgtctgggactaccctctccgtggtgatgaatgtcgtatccatgatgaagaatatcttatccatttccatcataacggggttgttcatattacaaaacaaagcagtggaccagcgacagcgcggagctgctaatggtcttgccatgacaggaatgtcattttttaaagctcttggaccagctgggggaggagcactcttttcttgggcacaaaaaaggcttcatgcttctattcttcctggtaatcatgtggtgttctttgtgttgaatatgattgaggcaattggtgtgttgctgactttcaaaccattccttgttgaagcacaaaatactaattaatcaaacgaaaatttatgtatgattatttttttaatattctattttacgtgttataacgattagaaattaaaaaaagggtgtcctattgtaaccaattcaattcgaatgaaattcatctacacagatagaagcaatgccaacttctcttccccta

SEQ ID NO: 189 - DNA, 965 bp, Solanum lycopersicum
ttttcgggggttttgtgcttttgtaagtttgagaaagaggaaaaagaaaaatgggaaggggtagggttgagctaaagagaatagagaacaagatcaacaggcaagtgacctttgctaagagaagaaatgggcttttgaagaaagcttatgagctttcagttctttgtgatgctgaggttgctctaatcatcttctctaataggggaaaactctatgagttctgcagtagttctagcatgctaaagacgttggagaggtaccagaagtgcaactatggagcacctgaaccgaatatatcaacacgagaagcactggaaattagtagccagcaggagtacttgaagcttaaaggacgttacgaagcattgcagcgatcacagaggaatcttcttggtgaagatcttggtcctttgaacagcaaagaacttgaatcacttgagagacaacttgatatgtcgctcaaacagatcagatcaactcggactcagttaatgttggatcaacttacagattatcagagaaaggaacatgcattgaacgaagccaacagaaccttgaaacaaaggttgatggaaggaagccaactaaatctgcagtggcagccaaatgcacaagatgtgggctatggccggcaaacaactcaaactcagggcgatggcttctttcatcctttggattgtgaacctactttgcaaattgggtatcagaatgatccaattacagtaggaggagcagggcctagtgtgaataactacatggctggctggttgccttgaaggctcacgattctgatcataacattattataaatatgctcaatggttttcctatcatcataaacattgaatatctcctaatttctgtatgttgtttgagaaaatgtttcatcctggacctaacggggatccataagacaatcccgttattgttagtaaatcataaactagatttctttgagtgcttaa

SEQ ID NO: 190 - DNA, 1326 bp, Solanum lycopersicum
atttgcttctcctcctctgttttctacgttgcaactttcaaaaacacctctttctctctgagtaattacaaaaacaaattaaatcaattctttttcttgaagacaaagtaatggtggaattgcaatttcctgctggatttcgattccatccaactgatgaagagcttgtgatgcattatttatgtcgaaaatgcgacgcacagccaattgctgttccgattatagctgaaattgatctctacaagtacaatccatgggatctacctgatttggctttgtatggtgagaaagagtggtatttcttttcgccgagagatcggaagtatccgaacggttcacggccgaaccgagctgcggggagtggatactggaaggcgacgggtgcggataagccgattggtcgtccaaagtcgatgggaattaagaaagctttggtgttttacgcaggaaaagctccgaagggagaaaaaacaaattggattatgcacgaatatcgacttgctcatgttgatcgatctgctcgtaacaaaaacaacagcctaagactcgatgattgggttttatgtcgaatctacaataagaaaggtacaattgagaagaatcaactgaatatccgaaaaatgaacggtgaaatgtcgccggcggtgagtgaaggtgatgtaaagcctgagatcgtgccgatttcagtttcaacaaacccatcttcgacgtcttatcacgtttacaatgacttcacgtactttaattcaccagattctcttacgaaacttcacgccgattccagctgctcggagcacgtaccttcgccggagttcacatatgagaaggaagttcagagtgagccgaagccgaaaccgagtgagtgggaaaaaactgcccttgattttccatttaattacacagatgccactgcttctgagttgcagagttgttatgagatgtcaccgctacaagatatattcatgtatctgcaaaagccgttttgagtgggcctcgcattgttgttcgcacgtgcgaatgagactgaagtcgatgacttggcacgtgccgatgatttgtaggaattgaaatattagtatttttgggttttttcatttgctttcacattagctatttttttttgttttggagaaaaaaaagcatatttggtcgtatatagttttattttttcgaagaaggaagaaaaattagtagaaaacaaagttgtgaaatgatatatttattggatttattagaatacttgtggaagttttggattagtactcataatttcatgtatgtatatgatttagaggtattacaaatgagctcaattagattttcttc

SEQ ID NO: 191 - DNA, 2278 bp, Solanum lycopersicum
ataaagttttataagttcacaacattttttttgttatataaaaataatctctagccatttttttttcactaaaatttctccattacaaatcaaaccattttttgttgatccaatggcatcatcaattgtacaaaatggacatgttaatggagaagctatggatttatgtaagaaatcaattaatgttaatgatccattgaattgggaaatggctgctgaatcattaagagggagtcatttggatgaagtgaaaaagatggtggatgaatttagaaagccaattgtgaaacttgggggtgaaactttaacagttgcacaagttgcatccattgcaaatgttgataacaaaagtaatggggtcaaagtggaactttctgaaagtgcaagggctggtgtgaaagctagtagtgattgggtaatggatagtatggggaaaggtacagatagttacggtgtgactactggatttggtgcaacatctcatagaagaactaaaaatggtggtgcacttcaaaaggaacttatcaggttcttgaatgctggagtttttggaaatggaacagaatcatctcatactttgccacattcagcaacaagggcagctatgcttgttaggatcaatactctgcttcaaggctactctggcattagatttgaaattttggaagcaattactaagttgatcaacagcaacattaccccgtgtttgccccttcgtgggacgatcactgcatcgggtgatcttgtcccgttgtcatacattgctggtttgctcactggcaggcctaactccaaggctgttggacctaatggtgagaaacttaatgctgaggaagcgttccgcgtggctggtgttactagtggatttttcgagttgcagcctaaggaaggacttgcacttgtgaatggtactgcagttggttctggtatggcatcaatggtactgtttgagtccaacattcttgctgtcatgtctgaagtcttgtcagcgattttcgctgaagtgatgaacggaaagcctgaattcactgactatttgacacacaagttgaagcatcaccctggccagattgaggctgctgctattatggaacacattttggatggcagctcttatgtcaaggcagctcagaagctccatgaaatggatcctcttcaaaaaccaaagcaagatcgttatgctcttcgaacatctccacagtggcttggacctcaaattgaagtcatccgtgcagcaactaagatgattgagagagagattaactcagtgaacgacaacccattgatcgatgtttcaagaaacaaggccttacacggtggaaacttccaaggtacccctattggtgtctccatggataatacaagattggcccttgcatctattgggaaattgatgtttgcccaattttcggaacttgtcaacgactattacaacaatgggttgccatctaatctcacagcaggaaggaatccaagcttggattatggactcaagggagctgaaattgcaatggcttcttactgctcggaacttcaattcttggcaaatccagtgactaaccatgtccaaagtgctgagcaacacaaccaagatgtgaattccttgggcttaatctcagcaaggaaaacagctgaggctgttgacatcttgaagctaatgtcatcaacctatctcgtggcgctttgccaagctatcgacttaaggcatttggaggaaaacttgaagagtgctgtcaagaacacagtaagccaagtagctaaaaaaactttgacaatgggtgctaatggtgaacttcatccagcaagattcagcgaaaaagaattgctacaagtcgtggaaagagaatatttgtttacctatgctgatgatccctgcagctccaactaccctttgatgcagaagctgagacaagtccttgttgatcaagcaatgaagaatggtgaaagtgagaagaatttcaacagctcaatcttccaaaagattgtagctttcgaggacgaattaaacgctgtgttgcctaaagaagttgagagtgtaagagctgtttttgaaagtggaaaccctttaattcctaacaggatcacagaatgtagatcatatccattgtacaggttggttagacaagaacttggaacagaactattgacaggtgaaaaagttcgatcgcccggtgaggagattgataaggtattcacagcattttgcaatggacaaatcattgatccattgttggagtgtctcaaaagctggaatggtgctcctattccaatctgctaa

SEQ ID NO: 192 - DNA, 1449 bp, Solanum lycopersicum
gctaagctcattctcactttcttatacaacgctattaccgtcgacgttcctaattttttactaatcatcatggcacgcttggcaccagaaggagctcaatttgatgctcgacagttcgattctaagatgaatgatttacttgccgctgagggaaaagatttctttacttcatatgacgaggtgtatgacagtttcgatgctatgggtctgcaagaaaatcttctcaggggcatttatgcttatggttttgagaaaccatctgccattcagcagaggggtatcgtaccattttgcaagggacttgatgtaattcagcaagctcaatctggcacagggaagacagctactttttgttctggaattttgcagcaacttgattatggtttaattcaatgccaatcattggtgttggcacctactcgagaacttgcacagcagattgagaaggttatgcgagcacttggtgactatcttggggttaaggtccatgcttgtgtaggtggcactagtgtcagggaggatcaacgcattctcgcagctggtgttcatgttgttgttggcacccctggacgtgtgtttgacatgttgcgaagacagtccctccgtcctgattgcctcagaatgtttgtgctagacgaggctgatgaaatgctgtcacggggttttaaggatcagatatatgatattttccagatgctgcctaccaaagttcaagtcggagtgttttctgcgaccatgccaccagaagcccttgacatcacaagaaagttcatgaataagcctgtgagaatcttggttaaacgtgatgaattgacacttgagggtatcaaacagttctacgtcaatgtagataaggaggaatggaagcttgagacgctctgtgatctatacgagacacttgccatcactcagagtgttatctttgtgaacactaggcgcaaggtcgattggttgacggacaaaatgcgaagccgtgaccacacggtttcagctacacatggagatatggaccagaacactagagacataatcatgcgtgagtttcgctctggttcttcccgtgtccttatcacaactgatctgttggctcgtggtatcgatgtacaacaagtatcccttgttatcaactatgatctcccaactcagccggagaattatctccatcgtattggaagaagtggaaggtttggaaggaaaggagttgcgatcaactttgtgacaacagacgacgaaagaatgttgtttgatattcaaaaattctacaatgtggtcatcgaagaactcccttcaaacgtcgctgacctcctctgaaaacttcatctttataaggtgagtaccaagcttatagtatagaagaaatcattttaaactaccattattatctatcgtcaaaaacgcacccctggcattaatgttgctaagaattttgcagtcagtatgtagtaaggt

SEQ ID NO: 193 - DNA, 822 bp, Solanum lycopersicum
ttcccatggggatccgatgacttgaatgttatctgcagtagccaaaaacaaagtaaaaaattaaacagtgttttttaaaaaaaaagaatttttgatcaaagatggcacaatacggcaatcaagaccaaatgcgcaagactgatgaatatggaaaccatgtccaagaaacaggagtctatcaaggtaccggtactggcggtatgatggggggcacgggtactggcggtatgatggggggcactggtggagaatatggaactcaaggcatgggtactggtactcatcaccatgaggggcaacagcagcttcgtcgatccgacagctctagctcgtcggaggatgatggagaaggtgggaggagaaagaagggtttgaaggagaagataatggagaagatgcctggacaacatgaaggtgagtatggacaaacaacaggtgaagagaagaaaggaatgatggacaaaatcaaggacaagatccctgggatgcattgaacacctttgttttcatctccatcttatcttatgaataaataaggtagtgcttgattctatttcatgcactaattagtagtaatcgttatgccagtaattatctaattacgtacactcttgtgtttaaagtcgtgtaaagtgtgctgacgctatatacatgtgtgtgtatattggcggccatgccctgccccttctgtatttttaaaacaagaatattgcttccatgcttggaaagcaatgatcatgttgatgtgtgttatggtgtcccgtgtttaatgatgttttggaaataatataacttgtgctatatttcttttgaaaaaaaaaa

SEQ ID NO: 194 - DNA, 1672 bp, Triticum aestivum
cggcagcggcggcagcggcacgtcgtcgtcctcctccccctcgccgtccgcgcgtccgtccaacagaggctgggaaccttaaagcggaacagggttcatggagggtggaggcgcaagaaatgtttctgcagcggcagcacagacaaaggaaagtgcggatgatggctcctgcaagccactgcctccttgctgtgtcaaggcgcaggctgctgtggcggaatctgaggccaagtgccacgctaccgtggtgtctgggtggttcacaggaacccggtcacgctctggcaaaccaagcaaagcgcagtacttcaacaatccaatgtggcctggggaggctcattcgttgaaagtagagaagattttgtaccaggggaaatcgccataccaagaagttttagtatttgagtcttcaacctatgggaatgtccttgtgcttgatggaattgttcagctcactgacaaggatgaatgtgcataccaggaaatggttactcaccttgcactgtgctcaattccatctcctaaaaatgttttggttgtcggaggtggtgatggtggtgtactacgagaaatagccaagcatgattcagtggagagtatagacatatgtgagattgatcagctagttattgatgtttgtaaagattttttcccacgtctatatgttggatataaagaccctcgtgtcaaacttcatgttggtgatgctgtggagttcttgagaaactctccagaaggaaaatatgatgccattattgttgattcatcagatccaattgggccagctcaggaacttgtggagaagcccttttttcagacaattgctagggctttaaagcctggcggtgttctttctaatctagctgaaagtatgtggctgcacacacatctaatccaggatatgctttctatctgtcgagaggtattcaagggtggcgtgcactatgcctgggcaagtgttccaacatatcctagtggtgtcattggatttttgctatgtgcgaaggaaggtccaccggtggacttcttaactcctgtgaatccaatcgagaaaattgaaggagctactaaagatggacgagagatgagattttacaattcagagattcataaggctgcttttattctgccaacgtttgtaaagagggagctggaggcatataactcttccactgaaaaggagagaccggagaagccaaccgcaaaaccagtgaagatgaaggtaatgcgggacagcgctattaccgcttcctagaccgcgggcggaccacctgtgtgctatccatcttccccgatgagacccgccgcacctgtatatccacgttccacgcctgtcctttgctaccaaattttattcaatagttacatgattgtgtggtgctctagcatagttgcgtgacacaactgagggtgtaatatcactaaatgtgtatggtgtgttgcagttggtgaataaaggagcaaacagaaggggatgtgtgatgtgtttcccttatctgtaacatgtatgatgtttcattgttgcgtgagttctcgtggtgcaagtaccaggacctgctatgttatgagcttctaacgtgctcccccgttcactattataagatgttctgacttcttttgtctgaatcaaatgtatatagacacattgtaatgtgtcattccagtttgtatg

SEQ ID NO: 195 - DNA, 634 bp, Triticum aestivum
aagcagtgaaagagaagaggctaatcaagctcaacagccttcttttccagagagtgtgctgtgtacgtagcagagcgaagagttagagccatggctggggtggtcggcgtctggttcgccaagttcggccgggaggcggcgccggcggtagaggcagaggccgaggtcgtcggacggcgacaccagggcgacggcctgctcgaggtggaggccgtgaagacggtgcagatccaggagaggaggaggaggaacagcgccgtcctcgccaactccgaggacacggtgtgcatgctcatggaccgcttcgccccggcctgatgcgccggtgaaccggcggtgtccgtacgtacgtgtaaattccagggcacgtacgtaggggcgcgggcacaagggaggagccataccttgatgtgcgggttcctcttgtacataagctctttttcatcgctaatcgagtgatagtagtagtagtgctcatgcctcccgttaaaaaaaagataaataaataaagcgcccagtcgaatcaactgtatcatatcatgtactcctatgtagtatgactgtatcctttgaatggattcgtttggtttctatggcatctctgttgctgctgctgctttttcttagttggtgt

SEQ ID NO: 196 - DNA, 740 bp, Triticum aestivum
agcagtagccaaatcttctacctagttactagctctctctagctacatccttcagctagccaaatcccaggcatggacggaaagaagaagcccactgctgcgactgggagctccatcgtcgacgacctcttcggccccaaggacggcgccgcctcctcctccgccggctacttcagcaccgtcttcccaactccatctggggcgacggggaaagatgcgtcgctccgggcagcagcagccgctgggaataaatcatcgtcggcagggcatcagcagcaaggaaagcagcacgggggctcacctgagtcgccttacttcggctcctcttccgtccactatggcggccgggacttctacgccggcgccgaatctcagcgccaatatccggccgccgctgccgcaccggcacccaagcacaaggacgacggcgacacatcggcagccacccggggtgactggtggcaaggttccctctactactagcactagcaggaaagagagactggtgtgagatgagcgagatataaataaaatgtacagctagctacctcataatagcatgcttcatcattgttatttcactgggtggagaagatggtcggtccagcgatcatcagcttaactaattattaagctattgttatgttagagcttgtgtgtgtctacctagttgggacatgggtgtgtactactgtgctcttgtaatatgccttctcacactaatatatggtcgtgcgctt

SEQ ID NO: 197 - DNA, 1450 bp, Triticum aestivum
cacgcgttccgcgcccaccacaatctcaacagccatcggaatcaacagcagcagcggagcgatttcatcgactaacaaatcagcggacatggggatgccggcggtgaggaggagggagagggacgcggaggcggagctcaacctgccccccggcttccgcttccaccccaccgacgacgagctggtggagcactacctgtgccgcaaggcggccgggcagcgcctcccggtccccatcatcgccgaggtcgacctctaccgcttcgacccgtgggcgctccccgaccgcgccctcttcggcacccgcgagtggtacttcttcaccccgcgcgaccgcaagtaccccaacgggtcgcgccccaaccgcgctgccggcaacggctactggaaggccaccggcgccgacaagcccgtcgcgccccgcggagggcgcaccatggggatcaagaaggcgctggtgttttatgccgggaaggcgcctaagggggttaagaccgactggatcatgcatgagtaccgcctcgccgacgccggccgcgccgccgccagcaagaagggctcgctcaggctggacgactgggtgctctgccggctctacaacaagaagaacgagtgggagaagatgcagctccagcagcaggggggagaggagatgatggtggagcccaaggcggagaacacggcgtccgacatggtggtcacctcgcactcccactcgcagtcccagtcgcactcgcactcgtggggcgaggcgcgcacgccggagtcggagatcgtcgacaacgacccgtcgctgttccagcaggcggcggcgttccaggcccagagccccgccgccgcggcggcgcaccaggagatgatggccacgctgatggtgcccaagaaggaggcggcggaggaggccggcaggaacgacctgttcgtggacctcagctacgacgacatccagagcatgtacaacggcctcgacatgatgccgcccggggacgacctgctctactcctccctcttcgcctcgccccgtctccgggggagccagcccggcgccggcggcatgccggccccgttctaagcagagccgagacagagaccgtcagagacagagatcgacagaagcggaacggatgacttcttcgccgcgagcaagatcgctcgcggaccagtgtaaatacagcataggaaacgggagggaggatgcgtcgtcgtgtctgagagccggcgtggcgcggtcgccggcgccggggcgtgccgctgtacatggagagcccggtgctggggcctggccggctgggttgattcttttgttcttactactactttgtactctcaatgcggatgtagctctttcttctcactcctcggtagtagaatcgaccgaccaaatacatatgtagctctgttccttccttctcttcagtagaaatcaaccaaattttgctgttatgctgct

SEQ ID NO: 198 - DNA, 2088 bp, Triticum aestivum
tcttccgcaagtttgacggcttggcctgggacatcgagagggctcagccgccggtggatctgtggaggaagttcgtgtactgtacctcgctctccggatccattcttggttcggttgatcacatgaagcaggaagatttcaacaaggtcattagtcctatatcggtcgcacacttctcgcagtacaagctagtggatttgctactcaagaaactggatggcgttggctttcagacgtgctttcctgatgagcttggcggtagctccactcaagatttgctgctggaaaacaagatactgatggggcacgagtgtagttccattcagctgaccgatgatggtattttggttggagcatcgtttaacaatggggggagggtgcacgagaggaagcttcactgtggccttcttctaggggcagatggcgctaggagcaaagtgcgtgagttggctggtatatctatgaaaggtgaaagggacttgcagaaattggtcagtgttcattttgtgagcagggatcttggaaagtatttatctagtgagaggcctggcatgctgttctttattttcaaccctgatgcaattggtgtgcttgtggcacatgacctggagcatggggaatttgtgttgcaggttccattttatccacctcagcagatgtttgaggattttaatgcaaaggtgtgcgagcaaattattgtcaaattggttggatgggagccagcagatattcaggttttagacataaaaccatgggcaatgcatgctgaagttgcagagaaatatgttggctgcgacaatcgtgtaatcctagttggtgatgctgctcaccgctttcctcctgctggtggttttggaatgaacactggtgttcaggatgcacataatttggcttggaaattgtgtttacttctgaatggcatcgctgacccatcaattatacaaacttatgagtcagagcgtaaacctgttgccacttttaacacagaacttagtttggaaaacttcaaggcagcaatgtctattcctgctacccttggccttgatccaacaattgcaaactcagtgcacagagtaatcaacagcagcctaggatcaatcattccaagaaatttacagaaggtggttctggaaggattattttccattggtcggacacaagtctcggactacattttgagtgagaacaatccccttggatccttgagactggcaagattgagaagtattcttgatgaaggaaaaagtctacagctgcagttccctgcagaggatcttggcttccgatatggaaaaggagccctagttgctgaagattgtgctgagagcacttatcaagcagaagaactgaagcattctaagaggtcatcaggagagtacattccttctgctaaggttggttcacggctaccacacatgctggtgagaccactgtccgcttcgagtgagggtgtgttctcaacactggacctagtaagtggggataaaattgagtttgttatcatcattgcaccactgaaagagtcatataagcttgcccaggctatgctgatgatagcagatgaattcgagctatcagccaaagtttgtgtcatgtggccacaaggttcaagggacgtggaagcgaaagggagcatatctgagttggcaccctggacaaactatgtcgatgtcgaggaaataccaagggcaactgtgaactcatcatggtgggagatgtgtcaggtaaataacaaaagtgttattttggttaggcctgatgagcacatagcatggagagcagaacctgacatggtgagagatgcttattcagacgttaggagagtcttttctcaaattttgagtttaaataggccccaggtgtaagaatgcccagatatacattcagtgactgactgggttccagtgtcaataagtataacttagaacctcggccactagacgtgacactgcattatttgcatgtacatgaccgtcaggtttgtttgttgatatcttctcacacatgttggttacattatcatacatttgacatgaacttccccagagatgttacatcaatgtgaataaaattatttttgttacttca

SEQ ID NO: 199 - DNA, 765 bp, Brachypodium distachyon
atgtcgtcggcggtagaagccatgtcctgctccaaggtcgatgtcgcggcggtgccggaggaggccaaggagcgcgtggtggtgatggagcacggcatcaacggaggaggcgccgacgccgccgcgaccaacgggaagcgcggcgaggcgcaatgtggccgcaaggacgacggcggcgaggaggaagacgacgaggacggggagaaggtccccgaggccatcgagctcggccccatcctcagcatcaaggaccagctcgagaaggacaaggatgacgacagcctgaggaggtggaaggagcagctgctgggcagcgtggatttgaactccgtgggagagacgctggaaccagacgtgaagatcatgagcctatccatcatatccccggggcggcccgacatcttcctgccgctgccggtggagcccaacggcaagggggtgtggttcaccctcaaggaaggctccctgtacaagctcaagttcaccttctccgtcagcaacaacatcgtctccggcctccgctacaccaaccgcgtctggaagaccggcatcaaagtggacagcaccaaggagatgctcggcacgttcagcccccagcaggagccgtacacgtacgtgacgcctcaggagaccacgccgtcggggatgttcgcccggggatcctactctgccaggaccaagtttctcgacgacgaccggaagtgctacctggagatcaactacacgttcgacatacgcaaggactggccgtcgtcgagctgagcc

SEQ ID NO: 200 - DNA, 1134 bp, Brassica napus
ttaaacacagaaccaaactccctaaaggttcggtcttttctccttctctctccgaatagatcccaaaaaaaaacacatttcggaaacaaacttctcaaggcttttgaaggggaggagggggaagacgagtttgatctgattttgattgatgtctggagctgtatctggttccagggacatgggtttcgtcgacaacaacaacaacaagaaagatggagacgacggtaacacttccaaaacggcgtcgtctcatcaacacgagggcaccgacgacgagggcgctggatccttggggaggcaaatgagcgaagcctctcttagcgcagctgaggaggaagaagacgatgactccaaattacaattgggtcctcagtacactatcaaggaacatctcgagaaggataaggatgatgagagtctgaggaagtggaaagaacagctccttggaagtgttgatgtcaccaacattggagagactcttgaccctgaagtgaagatcattagcctggtgatcttatcgccaggaagaccagatattgttctaatggttccggagaatgggaacccaaaggggatgtggtttactttgaaagaagggagcaggtactgtttgaaattcacgtttcaggttaaaaacaacattgtctctggtcttaggtacaccaatactgtttggaagaccggtgttaaagtggatagaggaaaggaaatgcttggaacctttagtcctcagtcggagccatacaaccacgtgatgcctgaagagaccactccttctggcatgtttgctcgaggatcttattctgctagaactaagtttcttgatgatgataacaagtgctacttggagatcaactacagcttcgacatccgtaaagaatggcctgctgtttgaaaactcaagaacaagtcacatgagatgatgtgttgtcagtagaagttgtgtttgttttttcactccctatctcctttttctcgtcgttggacatattattgtgaatcgtttttttggtcatcattgtagaacaagagcgacatttatttcctctttggtcttgattttaagaaagacgatgtttgttctccaagtctattgtctttcagcttctaaagttgttgcggaagaatgtctgt

SEQ ID NO: 201 - DNA, 1068 bp, Zea mays
cttcagattctcgacagtccgcgttaaataggccgccccgctcgccttccactcctcgttcccacacccctcaccgcgtccgcctcccctaccatctagggtttctagggttttcgaggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttacggcggcggcggtgaccgcggctacgggggaggaggcgaccgtggctacggcggcggcgaccgtggttacggtggaggtggcgaccgcggctacggcggcgaccgtggctacgggggaggcggcggctatggcggtgggtacggtggaggcggcggtggaggcggccgcggctgcttcaagtgcggcgaggagggccacatggcaagggactgctcccagggcggcggctacggagggggaggcggcggcggccgcggcagcgagtgctacaactgcggccaggagggccacatctcccgcgactgccccaacaaaaggcgttaggcgcggcgccaccgtcgcgtcggatccggcggagtcccatgtcgcctctcgccgcttccctacccctccaaaggtatcgctcggctgactcttgcgtgaagtcgtcggagcaaactatctatcagtagtactagcagtgtcgtttcgttttggtctgtcgtggcgtggtagtaagaaatgcaagtgagcagcaccagtatctttccgtttgaatcagttgtaaggcagtcatggtcatggttggctctgccggatctatctgtcatgaactatctatattatatcattatcaatgttatgcaatgagtctttgg

SEQ ID NO: 202 - DNA, 1697 bp, Oryza sativa
ggcatactggcatcgccttaactaacgcgctacagttgtaccactgccgctgcgcgcaggtcgtgacgctcacgtcgtcgccactagtccactccctcgcttcgcatctcgcctctggtgatgagagcggacagagccgagctgagggaattaaaacccccttatcctctctctgcccccgggctgccattgctggatccaaccatctgcccccgccacgcctcgtctcgcgctagccgtctcgcgtgcgtgcgcgcgcgtcgcgccgcgccctcgttttggagccttgcgccccgctactttccccttgtcccgaacccggaatccgcctcggcgagcgtccttgctttgcttctttggtatctgtgctcccgtttgctttgccttgccacgctccttcctcctcctcattgtctcctcccgtggttcggctcattctgttcttgggttgacgcgggctgcgtgcgtgcgtgcgtgcgtgcggaggcgatgtcgtcggcggtggatgccatctcctgttccaagggcatcgcggccccgccgacggaggaggcgacgaaggagcgggtggcggtggtgggcaagaacggcggcgtggagcacggcggcgacgccgcgacgatgaacgggaagcagtgcggcgaggcgccgcattgccgcaaggagagcaacgaggaggaggaggatgacgaggagaaggcccccaaggccatcgacctcggcccgcgtgtcagcatcaaggaccagctcgagaaagacaaggacgacgagagcctgaggcggtggaaggagcagctgctcggcagcgtggatttgaactccgtaggagagacgttggagcctgacgtgaagatcatgagcctggccatcctctcgcccggccggccggacatcttcctgccgctgccggtggagcccaacgccaagggcgtctggttcaccctcaaggagggctccctctacaagctcaagttcaccttctccgtcagcaacaacatcgtctccggcctccgctacaccaatgccgtctggaagaccggcatcaaagttgacagccacaaggagatgctcggcacgttcagcccccagccggagccgtacacgtacgtgacgccggaggagaccacgccgtccggcatgtttgcgaggggatcctactcggccaggacgaagttcctcgacgacgaccggaaatgttacctggagatcaactacaccttcgacatacgccgagagtggccggcgttgagctaatgatcagctgagccgtttttccggtggtggtcgccgagtagaagggtgaggcgccggccggccggcattcatgctgtgtgttactgtcgtcaccgttgggagcagaagtggacattttttttttcgtctcgtttgcgtcttatccactcatttttttttttggtttgattcaccctagggttcttttgtatattgttgccctgtctgtcccggttgtttgctgtgttaacgccgtgttagacgtacgctttgtcagttcaagttgatgttatgctatgtgttatgtcagtgtgcgtgtttgagcttctgtcactctgtcagggtcctgtttcgatcgaactgcctgtttgagttcagagcaacgcagctgcatttcttgtaaacactgggactgtatctgacgcttcccttacaaatttcccattctgtgtgcttctctctgc

SEQ ID NO: 203 - DNA, 1930 bp, Oryza sativa
acctctcacactggactagagacagcaatggcgttcgcggcgaccaagccgagcaagtctccccttctcatcctcctcgtctccggcgtcgcgttcctgctcctcgcctccgccgccgagtgctacggcggcggccgccacgatgtgacgcggtcggccgtggcgcggcgctccggcgtcgggagccggcggcagtacgtgcgccaccgcctgaccggcggcgccgtggacgttccgcacaggtacatgctcgccgagaagggcagcaactcgactcgcgctaaccacacctcgccggcggcgtcgaactcgacgccgtcagcgacgacgacggaggcgccggcggcggggaagcaccaccgcagccacaagcaccgggtgcggaactggatcatcgggttcgtggtcgggtccctcgccggcgtcgtctccgggctggcgatgtcggtgctgttccggatggcgctcaactgcgttcggggggggtaccggagcaagtccgacacggtgatcttcatcccgaagctgatcaagagcaaggagcacctggcgttcctggagaaggaccaggacgggctggcgtcgctcgccgtgatcgggcgcggcggctgcggcgaggtgtacaaggcgcagctcccgccggagcgggaaggcgacgcgccgcggttcatcgccatcaagaagatcaagaagcgctccggcgacggctccggcggccagaacaacaacctgagcgacgaggagagccggcagcttgacaagtggacgcggcagatccagtcggagatccgcaccgtgggccacatccgccaccgcaacctcctcccgctcgccgcccacgtcccgcgccccgactgccactacctcgtctacgagttcatgaagaacggcagcctccacaacgcgctcaaggccaccaccaccgacaccacgacgaacgactacaacgacaacaacagcggcgagcatccgccgccgtcgccggcgctgccgtggccggcgcggctgcggatcgcggtggggatcgcggcggggctggagtacctgcacgtgtcgcagcggccgcagatcatccaccgcgacctgaagccggcgaacatcctcctggacgacgacatggaggcgcggatcgccgacttcggcctcgccaaggcgatgcccgacgcgcacacccacatgacgacctcgaacgtggccgggacgctggggtacatcgcgccggagtaccaccagactctcaagttcacggccaagtgcgacgtgtacagcttcggcgtcatcctggcggtgctgggcaccgggaaggagccgacggacaagttcttcgcgcagcaggtggtggacgacgtcgggatcgtgcggtggctgcggcgggtgatgcaggaaggggaccccgccgcgcaggccggggtcatcgacgccgccatcgccggcgcgggccacgacgagcagatcctcctcgtcctccgcatcgccgtgttctgcaccgccgacgaccccaaggaccgccccaccgccaaggacgtccgctgcatgctctcccagatcaagaactagcaagcaaattgctcgtgcttcgcgtgcgcgaggcgtcgtgaattctgccgtgttaggcagcaagcgtgtccacggattcctcagtgtggaatactggtagtgcttagtgctggacttgttgggtcgtcgtcgatcaggtcaaaggtgggtggggcccagttgatagggaccgtggcacaattatttatagcgggaaagggaagtcagtgaacgacgctgtgcttgccgtgtttacacaagtgctgcgcttgttaattaagtgaacagtatatacacaggaggattagactaatgaatgtgtttggtaggttaatttatgaatggatggtgtgttgacggttcttaatatgattatcttgacttattccaaaga

SEQ ID NO: 204 - DNA, 1684 bp, Sorghum bicolor
atgcagatggactcctacaattacgccagcttcttccacgacgaggctgcgttctacccgcacgtcgccgtgccgccctcctccccggagctgcccttcggcctcattgcctcgccaggggagatggagccggagccaccgttcgcgccgccgatgccgaccgcgttccaggactacgactaccccggggccgccgtgggagtcggggcgggagcgccgttcgggggccccagcgtgcacaggcaggtgatggacgcgctgggcggggacggacagcgtgagcagagcatggcaatggcagaggatggtgaggaggagcaggagcaggagccgcggcggcagcggcagcggcagcagccggcgggcgccgccgccgccgccgtggagagcagccgcgggttccgtcacatgatgcgggagcggcagcggcgggagaagctgagccagagctacgccgacctgcacgcgctggtggcgtcccggtccaggggcgacaagaactccatcgtgcaggcggccgccatctacatccacgagctgaggggcgcgcgggagcagctgcagcgccggaacgaggagctcaaggcccgcatcctgggccacgacgccaggcagcagtgcgtcaaggtgcagttcgaggtggacgagccggcgtccgccatcgactccatgatcggggcgctcaggcgactcaagggcatggacgtcagggccaggggcatccgctctaacctctccggacgcaggctgtgcacggagatgaatgtcgaaaccacgattgcggccggcgaggtggaaaaggccgtggaggaggctctcatgcaggaagtggagaggaagcagcagcagcagcttggggctgggagcgccgctgccgcccctggttttgcaggccctcaggcatcatcacacgtgcaaaacgtgttctgacacgcgatcctccctcaagcccataaagaacaaacatgaactccaagcctcatttattgattctttttaagaaccggatgtgcaaaaaaaaatgagcatccacgtccctggctctattaattaagtacagatcagtgttttttaggagtatcacagccagcctccaagtggcatttgtgagcacgtgtatgaaatcgtaggactcgttgttacaacagagaaaaaaaagagacgtgcagacatgtgatcaaaaagctcgaaaggggctggaggaagcgggcgagaaatgaggtcgaggaggggcagggcacgttcccgtcccggtcgtgcggccgtgccgtgtgggctctgtgctctgtagattccgagtcgcggcggcaaaccggaaccagaaccaccggtgtgctctccttggtttctactccagctgctacaactacaactggtggtcttgtcaaaaaaactacaactggtgtggcctttttgtttatcgtgtggctgtaaaccgaagccatcggcatcagggtcagggggggcaccagcctcgcctgtcagcgtcgtgcttagttgaccggagcagatttttttggtttgggattaaccacttcctggaaatttcacgtgagttagctggttagaattgggctctgaattgtgcgctgcagtgacgtacgtcgctgacactgatatgtacttctatgttattgttaattatatccctcaatggagctctaatcatcgtgtacttgttctt

SEQ ID NO: 205 - DNA, 1336 bp, Sorghum bicolor
cacgctcatgccagtgacgccaaccatggagatcgacctgcacgacgtgcgcgcggcgcgcgtgctgggccgcggcgccatgggcacggtcttcctcgccgtggacggcgccgccagcagcggggaggcctacgcgctcaaggtcttcgacaagcgctcccctgcggcgtcgaggccggccgcgggcgccgacgcggcgcggcgcgcgcggtgggaggtgtccgtgctgtccaggctcgcgcacccgcaccttccgtccctgctcggctgcgccgagacgcccgacctgctggcgtgggcgctgccctactgccccggcggggacctcaacgagctccgccacgcgcagcccgaccgcgtgttctcgcccgcggccatccggttctacgtcgccgaggtggtgtccgcgctcgccgagctccacgccaccgggatcgcgtaccgcgacctcaagcccgagaacgtgctcctccgcgccgacggccacgtcatgctgaccgactttgacctctcgcggcagctccctccgaggtcccccgccgcgtccacgtccacgtcgacctcgtcgtcgtgctcggcgacatcgtccccgccgccgcctcaggcccagagccacagacggttgaagaacatcttcaagaggagcgagtccgcggtgaccgcgtctacttccggacaggaggaggaaccgcgcaacctcgcctggtacctggacagaagcatcgaaggcggcgtcgaccagatcaagaaggcgaaatcggccagggtatcgccgatggaacgcgccaagaagctctcgagcttcttgtccgccgcagcgggagagcggtcgttctcgttcgtgggcacggaggagtacgtggcgccggaggtggtgcgcggcgacgggcacgagttcgcggtcgactggtgggcgctcggggtgctcgtctacgagatgtgccacgggcggacgccgttccggggccggaaccggaaggagacgttccggaacgtgctgctccgggagccggagttcacggcggacgcgcggcggcggtggccggagctcacggacctcatcgcgaggctgctggagaaggatccttcgcggaggctgggcttcgccggcggcgccgacgaggtccgggcgcacccgttcttcgccggggtggcgtgggacctgctaggggaggtgtcccggccgccctacatccccgcgccggccgatgacattgtctcctgcgacgggttcagcgtggtggagtacttcgataagcttcaccagcctccgctgtcgccggcggagcactcgcccgaggacgacctcttgccggagttctgacaccggttgtaa

SEQ ID NO: 206 - DNA, 2273 bp, Glycine max
aatgcgaagcaaaagtgagtgtaacaatggctgagaaaatgaaaactcactactttcctctcttttcattctttttcttcttcttcttaatctccatcaacgccaaacttgatctctacccttcagactacaaggcactcctcactctgcagaaggacctccgagtcaacggtcaactcgcggcggcaactgaggcgtgcgaaacggagggcgtgctctgcgagcggaggcggctctccggcaaggaaacctacgcgctccgaatcaccagactcgtcttcaaatcgaacaacctaaatggtgttttgtctccttccatcggacgcctcacggagctcaaggaactctctctctccgacaaccaactcgttgaccgagtccctccccaaatcgttgactgccgaaagctcgaaatcctcgacctcgccaacaacatcttctccggcgaggtcccctccgagctctcctccctcacgcgcctccgcgtgctggacctctccaccaacaggctctccggcaaccttaattttctcaaatactttcccaatttggaaactctttcagtagccgacaacctcttcaccggaagagtccctccctcggtccgctccttccggaacctacgacactttaatttctccggcaaccgcttcctcgacccctctctacaatcatcctcaccagacacaattctctctagacgttttctatcagaagacggtgatggtgatgttcctgcacctgctcctgcacctaataactcacagaagaagaaatccaatgcttctactcatgctgctgctgctgcacctggtcctgcacctaaccataccaataagcacaagcacagtaagagaaaactcttggggtggattctggggtttgtagcaggggcactggggggaaccttatcaggattcgtgttttctttgatgttcaagctcgctctcgcgttgatcaaaggaagaggaaggaaagcggggcctgatatctatagtccattgatcaagaaagcagaagatttggccttcttggaaaaagaagaaggaatcgcgtcgttggagatcatcgggcgcggtggctgtggagaggtctacaaggcagagttaccgggaagcaacgggaaaatgatcgctataaagaaaatcgttcagcctccgaaagacggtgctgagttagcagaagaggacagcaaggttctgaacaagaaaatgaggcaaattcgatcggagatcaacaccgtgggacaaattagacacagaaaccttctgcctctgctggcgcacgtgtctagaccggaatgtcactaccttgtgtacgagttcatgaaaaatggaagcttgcaagacactctgagcaaggtcgagaggggcgagagcgagttggattggttgtcaaggcacaagatctccctcggtgtggctgctgggcttgaataccttcacatgaatcacaacccacgaatcattcatagagatctcaagcctgctaatatccttcttgacgatgacatggaggcaagaattgctgattttggactcgccaaggctatgcccgattacaagactcacataacaacctccaatgtggctggcactgtgggctatattgctcctgagtatcatcagatactcaagttcactgataagtgtgatatttacagttatggagtgattcttggtgtattggtcattggtaagcttccttctgatgatttctttcagcacactgaagagatgagtttggtcaagtggatgaggaagactttaagctccgagaatcccaaggaggcaattaattcaaagctgctggggaatgggtatgaggagcagatgcttcttgttttgaagattgcatgcttttgcactatggatgatcccaaggagaggcctaacagtaaggatgttaggtgcatgctgtcacagatcaaacactgaatctgctgtatgtttaagtatgtgaaatattgtgtaccatatttgtgccaaagtgtgcttgtttaagaatatagttgataactagaggatcaatgttggttcatagggtaaataatgaaccgatgtaatcttgtttcctttatcacggattgctgaatttctttggaaaaagaaaaattcagcactgcgatgatctatgtataatctagtctgtcacaactagtttccactttacatgtttatggatacaccctgaaaataaaatagttttacgttgtttccattgttcttatttgagtactgttattgttaaaagatatataagaacaaaacaaa

SEQ ID NO: 207 - DNA, 1111 bp, Panicum virgatum
cgcgtccgctctccctctcccccacagcaggctagctagggttttctggggtttgcgagggggttgctccggtccggcgggaggggggagatggcggcggagcgggctcaggggacggtgaagtggttcaacgggaccaaggggttcggcttcatcagccccgacgacggcggccaggacctcttcgtccaccactcctccgtcaaggccgacggcttccccaacctcaaggacggtgacgccgtcgagttcaccgtcggcgccgacaacgacggccgcgccaaggccatcgacgtctccgcgcccggcggcggcgcgctcgccggcggggagcgcccggacaacggctacggcggacgcggtggcggcggctacggcggcggaggcgaccgcggctacgggggaggcggcgaccgcggctacgggggaggcggcgaccgcggctacggcggaggcggcgaccgcggctacggtggaggaggtgaccgcggctacggcggaggcggcggcgaccgcggctacgggggaggaggtggcttcggaggaggcggcgaccgtggctacggcggcggcggcggaggcggccgcggctccgggtgctacaagtgcggcgaggagggccacatcgcacgggactgctcccacggcggcggcggctacggcggaggcggctacggcggaggccgcggctctgggtgctacaactgcggtgaggacggccacatctcccgcgagtgccccaacaagaggcgctaggcacgacgcctccacgttggacgcggtccggctccaacctcctggctcttgcatcaagtcatggccatctatctatcagtagtagtagtctttcgttctcgttctcgttctcgtcgttcgctcgtgtcgtagtaggaagaagaagaaggcgtgtggagaactggtgatgaggtggatccgcctgtttcggagtagcaatctatgtttctgttttgcatcagctgtgaggctgccatgatcatggatggcactgccgatctaccaaattatctatctatcaatggtatggaatggagtagtaatctatttgcactccgattatagtagtatgcatgaatgcctttgtgatcgactc

SEQ ID NO: 208 - DNA, 1200 bp, Triticum aestivum
accgagaattgcccggcgcgggacggattcgcggcaatggcgaggtgttcctgagaatttggccttcttggagcttggggaagggaaggattggcgtccgcttcgcggcggggaattgcttgctctctctctcgttctctgtgccgggcatggcgtcgagggacttcttgggcaggttcggcggggagaagggcgcgtcgtcggacaaggcggggggcggcgccggcgagccggacgaggtggtcgagcttagcctgggcctgtccctgggcggctgcttcggcgccaactccggccgggacgccaagaagccgcggctggtgcgctcctcctccctcgccgccatgtgctcgctcccgggcaccagcgacgacatcgccgccgcgacgcccccgccggcgccgctgatgcgcaccagctcgctccccaccgagaccgaggaggagcggtggcgccggcgcgagatgcagagcctcaagcgcctccaggccaagcgcaagcgcctcgagcgccgcacctccatgaactccggcaagtccggcggcagcagcagccgggacgacgcccaggagccgctctaccccagcgcgttccagctccgccgctccgtcgtcgaccaggggaacgcctcctcaagcatgccggagcaaggtagcggtgatggcgctgaggcgaagagcacatcgagcatggagatatcttctgataataataacaatgccagcaaccagaacaagtccctcccgccgccggcaccatctccggccgggaagctgccgaacggcatcgtcaaggagcaaccgccgttgcggaccctccggtcgctgacgatgcgcacgactagcaccggcgacctgcggaagagcatgatggaggacatgccgatggtctcgtccaaggtggacggccccaacggcaagaagatcgacggcttcctgtacaagtacaggaaaggggaggaggtgaggatagtgtgcgtctgccacggcaacttcctcacgccggcggagttcgtgaagcacgccggcggcggcgacgtcacgaacccgctcaggcacatcgtcgtcaaccccgcgccgtcggtcttcttgtaatgccgccggaatgtacctagggggagagacgctcttttcctctctttccttttttactctgaatttttagctatcattacagtgtattatgtttagcggcctgcct

SEQ ID NO: 209 - DNA, 991 bp, Triticum aestivum
caagcaaagcacacagcacccagcagcaactcgtcgacgcagagcggaggagcgaaggaggccggccggcgagatcgacgcaaatgcagatggactcctactacttccacgacgacgcccacttcttcgccggctgcggcgtccccggctcgccggacctgcccttcgccgacctcattgcgtcgctgtcggagccgctgcctgaggtggcgagccagagcgcgttccgggagtaccgcggcgtcgggctggagcttccggggacggcgcggggagggacggggaacgggatcaacatccaccggaggatgatgggcgtgctgggcaggatggtgccggtcaccgaggaggaagagagaccgcagcaacagcaccagcagcagcagcagcaggcggccggcgccgtcgagagcagccgcgggttccggcacatgatgcgcgagcgccagcgccgcgagaagctcagccagagctacgccgacctctacgccatggtctcctcccgctccaagcaggacaagaactcgatcgtgcagtccgcggccgtctacatccacgagctcaaggtcgccaaggagcagctccagaggaggaacgacgagctcaaggccaagatcctggggcacgacgcgcagcagcagtgcgtcaaggtgcagttcgaggtcgacgagccctcgtcctccgtcgactccatgatcggggccctcaggcgcctcaagagcatgaatgtcaagaccagggggatccactccaccttgtccggccagcggttgacgacggagatgaatgtcgaaaccacgattgcggcctgcgaggtagaaaatgcagtggaggaggctctccaggaagtagagaggaatcagctgcctgacagcgaggccccgtttcccggaagcaggagcgcctggcctcaaacatcacacgtgcaaaatgtgttctgagatggttctgagcacgagggccatgagacccatttgttcattgttctttc

SEQ ID NO: 210 - DNA, 823 bp, Brachypodium distachyon
ccaaacccaatcgagcctcactcgctcgacacctcaccccctcccgaaaccctagcgcggcgaacgagcgaatggagcccaaatccaccacccctccgccgccggcccccgtgctgggcgcgcccgtggggtaccctccggccgccgtctacccgccctccgccgccgctgccggctacccgcacgcgccggcgctctacgcccccccgcctcctcctccccccgccgccgcgtcgcagcaggccgccgcggcgcagcagcagcagctccagatgttctgggcggagcagtaccgcgagatcgaggccaccacggacttcaagaaccacaacctgcccctcgcccgcatcaagaagatcatgaaggccgacgaggacgtgcgcatgatcgccgccgaggcccccgtcgtcttcgcccgcgcatgcgagatgttcatcctcgagctcacccaccgcggctgggcgcacgccgaggagaacaagcgccgcacgctgcagaagtccgacatcgccgcggcaatcgcccgcaccgaggtcttcgacttccttgttgacatcgtgccgagggacgaggccaaggacgccgaggctgctgccgttgctgccggcatgccccaccctgctgccggcatgcccaccgccgactccatggcctactactacgtcccgccgcagtaactgtactatgttctattagccagttttaattatgttcagatcgtgctgttgttttagtgctcctatgtttgtttgttcgccgcataataactacgtgatgatgttgtgatcatttgaggggccttctctctctggtataagcgatt

SEQ ID NO: 211 - DNA, 905 bp, Brassica napus
gaaaacacacaagtgaacaacatcttgtaataaaaaaagttaaatccacaagaacatccattacaagaaatcgtgtaaacacaatcttgtcttaagagtcactgcgaattgtctaaagcccctaacgaatcccaattccgagtttttaggagtaaaatggcggatacgccttcgagtccagccggagacggcggagaaagcggcagcggatcggttagggagcaggacaggtaccttccgatagctaatataagcaggatcatgaagaaggcgttgcctccaaacggcaagatcgggaaagatgctaaagacactgttcaggagtgcgtctctgagttcatcagcttcatcaccagcgaggcaagtgataagtgccagaaggagaagaggaaaactgtgaatggtgaggatttgttgtgggcaatggcaacgttggggtttgaggattaccttgaacccttgaaggtataccttgcgaggtacagggagttggagggggataataaggggtcagggaagagcggtgatggatctaatagagatgcagctgctggaggtgtttccaatgaagatatgccgagctggtgaaagaagtcgcaagtaagctctctagagataaagaacaacgccaaaatgatcagggaaacttagagatcagtgtggtgtttgacaataaagttagagatccggttttagttggttgtagttgaagatttctcttattagatatgacaactctttgaaagaaggaaaaaaagtttgtccacaagctctctcatctcttagcttcgtttatggatttcaaaacttgaatatgaatggactcacttgtgcttccaagtaagcaagaggaggttgtaacttacattgtcctcattaacttcacgtagaatgtcgtttaaatg

SEQ ID NO: 212 - DNA, 1226 bp, Populus trichocarpa
ggaaaataaaatccagcaaatcacaaactactatctccttcccctctcttccctctcctcttttctccatcgtcagatctaaaaacttttcattctttctttctctgtttctccctctctccctccaactctcgcgccaaatacaaaaccaccctctcctctccctctttctttctccaggttttcttagtgagatggcggataatccgacgagtccggcggcggggagccacgagagtggtggtgaacagagcccgcggtcaggggtgagagagcaggatagatacctgccaattgctaatataagtaggatcatgaagaaggcgttgccagctaatggaaaaattgccaaggatgctaaggatactgttcaggaatgtgtttctgagtttattagcttcgttaccagcgaggcgagtgataagtgtcagaaggagaagagaaagacaatcaacggggatgatttgttgtgggcaatggcaacattaggattcgaggagtatattgatccacttaaggtgtacctggctaggtaccgggagctggagggtgatgcaaagggatctgctagaggtggagatggatcttctaaaagggaagcagttggaggtctgcctgctcaaaatgcacagtttgctcttcaaggatccatgaattatataagcccacaaggacagggacagcatatgatccttccttccatgcaaggcaatgagtaggatttggctttgcttttgtcaattcaatgaattctagtgctggcagaactttttagtttcaacacttgtagagtcttttgcattagttgatctgattgaaaccaaagcgctatgcattttggcggctttggtatttggttattgttggaggtggtttaaatgtggttggtgccgtcatcagcagagcagcttactggtcagattaagttatgtaaatttgccctttatctaatatatactcttccgagtattgctaggatggtttcttggagcatctgaaagcatacctcataggcctgtcgatgttagcctctgatttttcggaatgttaacatgttatatgcttatcaattgtcaaattaatggacctatgctgaaatataacgatcagaaagggaggaattgttttgctcaagaaattcatttcctgtagtcgcatattccctttataattgatctcgtttgcaagctcttgggtcccaatcagattgggtacccaaacttttt

SEQ ID NO: 213 - DNA, 1065 bp, Glycine max
gggggacaagaatgttaagtaaaaatagtggagtatcttctctgctttctgtgttattgtctggcttttggagccgatccaaccaatcatcgctggcgccaaatacaaaatctcatcccttcccctttctcttactgactctctttgtcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatagtttagatgcttctacgcatcttatttatttcccttgaatgcttgtacgcatggaatgggtggaaacaatggtttggtgatttaatatttaggttctcgtttagaaggcatcagtgtcagaattttgttacggtactaaggtagatttttattaatacattatacatgtcatatttagctgcctgaccaactcaagggagagatgtgtttggggttattgcatgtgattcgccatgtagcttgtcatggtgagaagcacttgctttgagtgttttctttagattattatataatatataatatttgcagacactgcatttgttagtttatttagtttaggccatacagtttgcttctctcttaatgatgtaaaaaatattcact

SEQ ID NO: 214 - DNA, 1816 bp, Zea mays
attttttccagcagcaacagcaaacactgacgaactgagccctatctatatcaacctcacatggcctcccataccatctggcatcggtccaactattcagtccaattgccacacactgcctgacgcaagctcgctcgtccaagtccgacgttgataccattggccgctgcgccgccatggccgtgtcgccggaccagcagcagccacctgcaggggtagggtctcccttgccgtctcctcgcctccgcgtccgcgtccgcgacaccaccctcgtgccgccgtctccgtcaccaccggagacctcgctcccgctcaccttcttggacatcttctggctgcactccccgcccgtcgagcgcctcttcatctaccgcctcgcccccgacgctgacgtcgacgccatcatctccagactccgggactccttgcaccaggccgtccgcgccttctaccctctcgccggccgcctccgcctcacccccggcacgtccgaccgctacgagctgcactaccgcccgggtgacgccgtcaccttcaccgtcgccgagtgcgacgacgatgacgcggacgcgcacttcgacgccctcgccaccgacgagccccgcgaggttgccaagatcgccacgctcgtgccgccgctgccggagcgcggcgggctgttcgccgtccaggccacgctccttcccgcgcgccgcggcctctccatcggcgtcaccgtgcaccacgccgcctgcgacggctcgggctccacgcatttcctgcacacctgggcggtcgcctgcagagccggcgcagaagcgccgccgccgccgccgcctgtcatcgaccggtcactcatcgccgacccaaggcgcatgtacgacgtcttcatccaaggagcgccgagcactgaagagtacgagttcgtcaagatgtccgccgaccagctcttcgctacgttcgcgctgtccaaggacgaactgaagcgcatcaaggacgctgtggccgaggaggctgcgaggcgcggcgtcgcgccgccccggtgctcctctctagttgccaccttcggcttcgtctggtcgtgctaccagcaagccaaggaggccagcagcggcgccggagagttccctatgacctgcatggcctttcccgtcgaccaccgctcgcggatggagcctcccctgccggacaagtacctcggcaactgcgtcggcccagcgttcgcgctggcaccaacaggcgagctggcccaggccggcgcaggcgggttctttagcgcgtgcgccgccgtcgcctcctccatcgacgaagctgtacgcgacatcgagacatcaaacgtggaggtgtggtttgaccgcatcagggatttaatcccgatgggttttctgaccgtggccggttcgccgaggttccgcgtctacgatatggacttcggattcggccggccggcgaaggtggatgtcgtgtccgtggcgaggaccggcgcagtggcggtggcggagagttgggatggtaacggcgggatagaggttggggtctctctacagccggctgccatgaagaggtacaggaagtgcttcgcggatgctatcgcgtggctccaccagaggacatgagagcgacaactcgatctaatcaaatatggagaaacgggtcttttacggagtctatcatgtgatgaaaaatcaacttgcactttcttccttttaaattatactaccatattctagcttttcaactagataaaccttttctattcgtttagatatgcacactatctagatatgttataaaacacgattatgcatttaaaattatttaaaaagcttacacttta

SEQ ID NO: 215 - DNA, 2179 bp, Zea mays
ggcagcaggccaagcgcaccaccaccaccacagacatcatcagatcaccacccagtgcagcaaaagaaagaaagaaagaaagaaaagaaaaaggcaggcgcgccaaaatggacaacggcggcagcaacggctccgccaccgcctccgcctgctgcaacggcaaaattaaccgcgggccgcacgtggcgatgctggcgacgcccgggatggggcacctgatcccgctggcggagctggcgaagcggctggcgtcgcggcacggcgccacggccacgctcatcacgttcgcgtccacggcgtcgcccacgcagcgcgcgttcctggcctcgctcccgcccgcggtgtcctcgctgtccctcccgcccgtcgacctctccgacctgccccgcgccgccgccatcgagacgcgcatgtcggaggagtgcgcgcgctcggtgccggcgctgacggccgtcctcgccggcctcaggcggagcacggccggccgcctggcggccttcgtggccgacctcttcggcgccgactcgctggacgcggcccgcgccgcgggggtccgccgcaggtgcatcttcttcccatccaacctgcacgtgctcacgctcatcctccacctgccggacctggacgccgccgtgcccggcgcgttccgggacatgccggagccgctgcgcctgcccgggtgcgtgcccgtcccggggcccgacgtgctcatgccgctgcaggacaaggccgacccctgctaccgctggatggtgcaccacggcgccaagtaccgggacgcgcacgccatcctcgtcaactcgttcgacgccgtcgagccgggccccgccaaggtcctgcgccagccggagtcgggcggccccagccgccggtggcccgcggtgtacccgatcggcccgctcatccacgccgacggcgggcggaaggacggcgcgtcgtcgtcgccgtgcctggagtggctggaccggcagccgccccggtcggtggtgttcgtctcgttcgggtccggcggcgcgctgccggcggagcagatgcgggagctggcgctggggctggagctcagcggccagcggttcctgtgggtggtgcggagccccagcgacgggggcgccgtcaacgacaactactacgacgcggagagcaagcgcgaccccttcgcctacctccccgagggcttcgtggaccgcacctgcgccgccggcgtggggctggtggtcccgtcctgggcgccgcagacccaggtgctggcgcacgccgccacgggcgccttcctcacccactgcggctggaactccgtgctcgagagcctcgtctacggcgtgcccatggtggcgtggccgctctacgccgagcagaggcagaacgccgtgctgctctccgacggcgtcggcgctgcgctccgggtgcccgagtcgtccaagcggagggagattatcgcggacacggtgcgcgaggtgatgcgcggggaagggaagggcgccgcggtcagggccaaggtggccgagctgcagaaggccgccgccgaggggctccgcgacgggggagccgccgccgccgcgctggccgaggtggtacaggggtggacgacgacgacaggtggaggagagaaggactaggtggtggtgactggtgatgccgacgcgattggcgcctgccacctgccgcctgccgcctggtgccacagcgatcgtcctcatccagaccaactccaacttgggccgggccaaacgattcgtttgttccttgtccttgtgtataactttggttcacatgctttgcttgctgtatgtaatgtgacctacaggcctgcactttggcacgtagttaattagtagagtactcctagatagctgatctgtgtcatgacgatacgatgtagaagaaggctaccgcttttaattaatttggcactttgtaacttacaactatactgttgggccaggagcattattctcccgaagatcctcatatactagaggagtaatgctgaagattggcttcagcctatgccgttgacagacgtggacacaaagacaacaacttgaaacaaatattgtgcgtgtataaaagagtgaggtaaagtaatatcccttaagataggatcatgtgctttatgtttaactcacgtcccatgttatcctcaattatattttatgttccatatgattgtttacccttc

SEQ ID NO: 216 - DNA, 1534 bp, Zea mays
cggcaacgcaaccaaaccgctctcgctctcggctctcggctctccaccagtctccgctctctggacgccggaaatgcagatggactcctacaactacaactacgccagtttcttccacgacgaggctccgtccttctacccgcacgttgcggtgccgccctccccggagctgcccatcggcctcattgcctcgccaggggagccggagccgcccttcgcgccgccgatgccggcctcgttccaggactacacgggcgccgtgggcgtgggcgtaggggtgagagcgccgttcgggggtgccagcgtgcacgggcaggcgatcgacgcgctgggcgggggcgacgggcagcgcgagcagagcatggcaatggcggaggacggggaagagccggcgccccggcggcggcagccggcgggaggccccgccgccgccgccgtcgagagcagccgcgggttccggcacatgatgcgggagcggcagcggcgcgagaagctgagccagagctacgccgacctgcacgcgctggtggcggcccggtccaggggcgacaagaactccatcgtgcaggccgccgccgtgtacatccacgagctcaggggcgcgcgggaccagctgcagcgccggaacgaggagctcaaggcccgcatcctgggccacgacgccgggcagcagtgcgtcaaggtgcagttcgaggtggacgagccggcgtccgccatcgactccatgatcggggcgctcaggcgcctcaagggcatggacgtcagggccaggggcatccgctccagcctgtccgggcgcaggctgtggacggagatgaatgtggagaccacgatggcggccgacgaggtggaaaggggcgtggaggaggctctgctgcaggaagtggagaggaagcagcagcagcagcttggagctgggagcgccgcccctggttttccaggcccgtcatcgcacgtgcaaaacgtgttttgacacgcgatcctcccccacaacaagaagcgaaaaagaaacatgaaccccgagcctcatttcttgattcttttttctttaagaaccggatgcgcaaaacgagcatccgcgtccctggctctattgatttatttttaagtagaaatcggtgctgtttgtgtacaagtgttgtcgcagcctccaagtgggattttgagcacgtgtataaagttatagggctcgtgttcttacaacacacacacacaaaaaaaaaaagagacgtgcggacagtgaggactgaggacatgtgggcagggatcaagtgggccggaggaagcgggcgagaaatggggtcgagggacaggcacgttccggtcgtgccgtgtggagattcctagccgcggcggcaaccggtcaccagtgtgctctcgttgtccttggtctctactactcctgctacaaatggtgacgcctttattttatcgtgtggagtggatgtaaatggacgccaccacaataaattagagtactaaattaattttagtttaaaaataaataaataaaaatagagtatgattctaatcc

SEQ ID NO: 217 - DNA, 556 bp, Sorghum bicolor
ccactatggcggatctagaggatcttggaagagctcgaggatgtggtggaccctatggcccggcgtcctcacggggactccctctctctctctccatccaggagacggccggtgctgggcgacgaggctggacgaacgacggcgggggcggcacgacgcgacaaggacgagtggtgcgacgtggccagaccagatgcacagaggtcgggcgacatcgatttgacggtgccatgcatggttgctgcagctgacaccgagtgaaaacatgaggatcatcatgttctttaggaagtttttgcagtgggcagatggatcagaggagaaaggcgtcataacctgatgccacttgctagctgagaatgtgtctcctttcttttttttcatctgtttcttttattttatcttgaagaacaggagggcaatgctatcttagtcttctattccttttgctacttcattcttttcgtttggttgtggtcagtttacttttgtatgtaattgtactgcttttatatgtaattgtagtgggttattatatattgcaatcacatgtgct

SEQ ID NO: 218 - DNA, 557 bp, Hordeum vulgare
acggttcatcccgtactcacagttcccaccaagaatggtgcgcaaggactgctgcacatactcgacgactccagcaatgagcgtgcctaaaacactgcagaatgttcattcgtgcgagaactggctgccaaggagggtgatgagcgcgtggcgcatcgctgggatggttcatgcgttggagggatgggacgagcatgagtgtggagacaaggtgctcgacatggacaaagtttggtctgctgcacttctgcatgggtttcgccccgttactgaggattgatgggtctggttgcattgcaagtcgagtgaataagcgctacgcagatgaagatgccgtatgctcgctggagccatgctaaggaagatgaagaagcagacgtattggctagcagaagagtataattaagtactagtttgatccaccaaggttacttggttagcgtaccattactgcattattcgtctcctatggtatgagttgatgacttggttcagcctagtagtatttgtaatgctatcaataaataagtaaatgtactacgacggtctattggtct

SEQ ID NO: 219 - DNA, 866 bp, Hordeum vulgare
gcccggtgacctcacaagcaccggcgacacctacgggcaccaggaagacaccaaaatgactggcatggggaggcatagcgccccggccaccggcggctcctatgggcagcatgcacacaccggagagaccggcacggggacacacggcaccggcgagaagaagggtgtaatggagaacatcaaggaaaagctctctggtggccatgatgaccaccagcagacaggtggcatctacgggcagcaagcacacgtcggcacggggacgcatgacacgccggccaccggcggcacctacgggcagcacggacacaccggagtgaccggcactgggacgcacggcaccggcgagaagaagggtgtcatggagaacatcaaggagaagctccccggtggccacagtgaccaccagcataccactgagacctacgggcagcatcggcacactggagtggccggcacggagacgcatggcaccacggccactggcggcacctacgggcagcaggcacagaccggcacgactggcgctggcacacacggcaccgacggcacgggcgagaagaagagcctcatggacaagatcaaggacaagctgcctggacagcactaagcttggtccgcccgccccggctacctctcaagaataataagatggcgaagttccaccgtatgcacattcacctagctcactttcgttggtggagcgaatgtatcttggcttaagttttcacggacaacagtgtggcaacagttttcgttcgtttacagtttgcatactgtgatgtgcagatttcctttacttcaatccgtgtatgtatgttatggcatctaatatatataagtggggtattaccttaaaaaaaaaa

SEQ ID NO: 220 - DNA, 1837 bp, Hordeum vulgare
tgtagatattcccgagtgagaggctcagcgcaagatggagcaccaggcacacgtcgccggcgagaagaagggcctcatggagaagatcaaggagaagctccccggcggccacggtgaccacaagcaggccgctgacacccacggccagcaggggcacgccggcacggggacgcatggtgccccggccactggtggcgcctatgagcagcagggtcgcaccggagtcaccggcacggggttgaatggcgctgatgccggcgagaagaagggcctcatggagaagatcaaggacaagctccctggtggccacggtgaccagcagaccacggctggcacctatgggcagcagggacacaccggcaccgcggcgcatggcaccccggccggcggcggcacctatgaccaggagggacacaccgggatgtctggcatgggggcgcacgacacccacgccacgggcggcgcctatgggcagcatgcacacaccggagggaccggcacggggacgcacggcaccggcgagaagaagggcgtcatggagaacattaaggacaagcttcctggtggccacggtgaccatcagaagacgagtgacacgtacgggcaccaggaagacaccgaaatgactggcatggggaggcatagcacccctgccaccggcggttcctatgggcagcatgtacacaccggacagaccgacatgggaacacacggcaccggcgagaagaagggtgtaatggagaacatcaaggataagctccccggtggtcatgatgaccaccagaagactgctggcacctacgggcagcagggacacgtcggcacggggacacatggcacccccgccactggcggcgcctacggacaacatgaacacaccggagcgaccggcactggaacgtacggcactggcgagaagaagggcatcatggagaacatcaaggagaagctccctggtggccacggtgaccatcagaagaccggcgacacctacgggcaccaggaagacaccaaaatgactggcatggggaggcatagcgccccggccaccggcggctcctatgggcagcatgcacacaccggagagaccggcacggggacacacggcaccggcgagaagaagggtgtaatggagaacatcaaggaaaagctctctggtggccatgatgaccaccagaagactgctggcacctacgggcagcagggacacctcggcacggggacacatggcacccccgccactggcggcgcctacgggcagcatgaacacaccggagcgaccggcactgaaacgtacagcaccggcgagaagaagggcgtcatggaaaacatcaaggagaagctccccggtggccacggagaccaccagcagacaggtggcacctacgggcagcaagcacacgtcggcacggggacgcatgacacgccggccaccggcggcacctacgggcagcacggacacaccggagtgaccggcactgggacgcacggcaccggcgagaagaagggtgtcatggagaacatcaaggagaagctccccggtggccacagtgaccaccagcataccactgagacctacgggcagcatcggcacactggagtggccggcacggagacgcatggcaccacggccactggcggcacctacgggcagcaggcacagaccggcacgactggcgctggcacacacggcaccgacggcacgggcgagaagaagagcctcatggacaagatcaaggacaagctgcctggacagcactaagcttggtccgcccaccccggctacctctgaaaaataataagatggcgaagttccaccgtatgcacattcacctag

SEQ ID NO: 221 - DNA, 388 bp, Hordeum vulgare
cggcacgaggccacggccacggcgtactcacgcacgggtcggtgctcgaccaggcggtgttcgtccgggaggaggacatggaggacgtggagaggcccgccgccgtcgacatggccaacgccaacgcagacgtcaacggcagcatcaagaacttctagtgtcggtttcagtttcaggcgatctgtcggtcctctgtactttcaggttcagtaagctaagtttagtgctggcgccactgcctccgtagtggtgcactctagaagagaataagcccccaatccgtctctgtagggtagtgtttcactggtgcagttaatcagtaatgctcatgtattaataaccagtttggtactagtatcaataaagaagttagcctcatgttgctctt

SEQ ID NO: 222 - DNA, 1828 bp, Brachypodium distachyon
ggattctcgatccattccaatcccccgtttcccgttctctcttctctctagtggtgtcttctctgagggaggaggcgtttccatttgcatggacaagggccacctcgggggtggcggaggaggaggagggctggtcgctctggacgcgtcgccgcggcctctcgggttcctcaacttgctatcgccggcgccgtcgttccacaggagcatggaggcggacgacgttggcaccggcgccggtggcggcggcggcggcagggggcggaggtccgtcgaggtggacttcttctcggacgagaagaagaacatgaagaagagccgggtctcggccggcggcaccgatgcggaggggcacaaggacgccggcgccggactcgccatcaagaaggaggacctcaccattaacctccttccggggaggagcgaccggtcgatggtggtcgacgacgacgcggcgtcccggcccgacaacgacaagaacggcaggcaagacaccaacgagctcgcggcgatgcaggcggagctgggccgcatgaacgaggagaaccagcgcctgcgggggatgttgacccaggtcaccaacagctaccaagcgctgcagatgcatctcgtcgcgctcatgcagcaaaggacccagctacttccgacccaaccgcagcaacaacaaccgcctcccactcacgaggatggcaagatcgagggtgctatcgtgccaaggcaattccttgacctgggcccttccggcgccggcgcaggcagcgaggtggccgaggagccgtccaactcgtccacggaggtcggcagcccgcgccggtcgtcttccaacgggaacgaggaccctgagcgcagcgacaacccggaaggcccgtcaaccgcgggatggttgccgggacgggcaatgaaccagcagcaactgggagcggcggccaagggccacgaccagcaagcccaggaggccaccatgaggaaggcccgcgtctccgtgcgcgcgcgatccgaagccccaattatcgccgatggatgccagtggaggaagtacggccagaagatggccaagggaaacccttgtccacgcgcgtactaccgctgcaccatggccaccggctgcccggtgcgcaagcaggtccagcgatgcgccgaggaccggaccatcctgatcacgacgtacgagggcacccacaaccacccgctcccgccggccgccatggcgatggcgtccaccacgtcggccgccgcgtccatgctgctctcgggctccatgcccagcgccgacggcagcgcgggcctcatgagctccaacttcctcgcgcgcaccgtgctgccgtgctcctccagcatggccaccatctcggcgtccgcgccgttcccgacggtcacgctcgacctcacccacgctccgcccggcgcgcccaacgccatgccgctcagcgcgctgcggccgccggcgccggcccccgggcagttccaggtgccgttgcccggcgccggcggcgggatggccgggccgacattcgcgatgccgcagcagatgctgtacaaccagtccaagttctccggcttgcacatgtcgtcgtcttccgacaccgcggagttcgcgcagccgaggccgcagatgggccagctctccgacaccgtcagtgcggcggctgcggcgatcaccgctgacccaaacttcacggtggcgctggccgcggccatcacgtccatcattggcggccaacacgcggccgccgctgccggcaacaacaacggaagtaacaacaacgtcacgaccaccagcaacaacaccaccaccaccaccagcaacaacaccaacagcgagacccaa

SEQ ID NO: 223 - DNA, 1208 bp, Brachypodium distachyon
ctccccaggccatcttccgctcactcgaaaatagtaccctcctctccctccggcgctcctctctcttctcttctcccttctttgttaccggggctcgctagcgcatcgaatcggaggaagaacgtacggctcgaagcttggtgtttttacgcctctacggttagaacaaatggatccatggatcggcagccagccatccctgagccttgacctgcacgtcggcctgggccaccaccaccgccaccaggcgcagccggtggtggcgctcgtcaagcccaagatcctcgtcgaggagaacttcttgcccctcaaaaaagaccccgaggttgcgggccttgaggcggagctgcagcgggtgagcgaggagaaccgccggctgggggagatgctgcgggaggtggcggccaagtacgagtccctgcagggccagtacagcgacatgaccaacgccgccaacaactacagccacccgtcctccgcgtccacggagggcggctccgtgtccccgtcgaggaagcgcaagagcagcgacagcctcgacggccacacgccatccccgccaccgccgccgcagctctccttcgtcccggagcagcaggcggagtgcacgtcgggcgagccgtgcaataagcgtgtccggccggcggcggcgtcggaggagtgcaagcccgtggtgtcgaagcggtacgtgcacgccgacccctccgacctcagcctcgtggtcaaggacggctaccagtggcggaagtacgggcagaaggtgaccaaggacaacccttgcccgagggcctacttccggtgctccttcgcgccggcttgccccgtcaagaagaaggtgcagcggagcgccgaggacaggaccgtgctcgtggcgacgtatgagggcgagcacaaccacggccagccgccgccggcgcagccacagcagcagcagcagcacgatggcaagaacggcgccgcgaagccgccccaggcacccgtggctgcggctgccgcgcttcaccagcaacatcagcagcagaagcaggaacaggaagcggcagtcgtgaatggcgaggcggccgcggcggcgtcggagctgatcaggcggaacctggcggagcagatggcgatgacgctgaccatggaccccagcttcaaggcggcgctcgtcaccgcgctctccggccggatcttcgagctctcgcccaccaaggacctcaactaat

SEQ ID NO: 224 - DNA, 656 bp, Brachypodium distachyon
cccagctgatcaagccatggccatgagggctctcgcactgccccactcacaaagctccacatttgggcttcaccagagcttgccatccttcaagccaagcagcgccagtacaagatcagtcagggcctatgcaaaatcagatgaagaggaggagaaggtgcccaagcagtccttgtttgggagcatcacagaggcgctggacttctcgcaggtccgctcggagaaggatgcggagctgctgtatgaagccagggattccattaaagaagaagggaagatgacaagggagcagtatgctgcccttcggaggaagattggtggcacctacaaggatttcttcaagtcatatgttgatgttgatggggaatatgtggaggaaggttgggtggataagacctgcaaagtttgcaagaaagacacaaggggggagccacggcaagttgacaagctaggaagatatgttcatgtcgcttgcgcggagaactcaaaaccgacaaacttcttcgccaaactcttcggcggatgaacttcttttgtactaccaaacgcatcgttttgtgtcgtggttagataaatagatgggtgttatagcctcaagggattagaacagtattatgtgccatttgaaatcctatttaaggagcatatgcacattc

SEQ ID NO: 225 - DNA, 1135 bp, Gossypium hirsutum
ctgcctgttagtcccgaatcagtcggtgcttatagagaagaagatgaagtggattcacttaggaagagcgaagaggaagagggagttacggagcctctattgggctcaaatacggagctcaaggaaaaagctgtagggttcattgaggcttggaaaattcctggggttgctccttttgctttctgcctcttctttgccaaattggtcgcttacacatttctctattggcttccatactacattagccatacagcgattgagggtaaatatttatccaatgaggcggctggaaacttgtcgacattttttgatattggaggggtgcttggaggaatcttagctggacacatttctgatcgtctagatgcgagagccataactgcggcaacttttatgtattgtgctatccctgctctgtatttctaccgtagttacggacacgtttccgtggtgatgaatgtagctctcatgttcatctgcggaatgttcgtaaatggcccctatgctcttataacaactgctgtctcagcagacctgggaacacacagttcattaaaagggagctccaaggcattggcaacggtaacagcaatcatagatggaacaggctctgttggtgctgcaatcggaccattattaactggttacatctctgcggagagctggagcgcggttttcacaatgctcatgggagcagcactagttgcagggctactgttgacaaggcttgtagtggccgaggtggcagctaggatttccgaatcaaggtcacaaggaggatcacaaacaggatctgaagctccagaactggatgtatgattgattttgtaggggcaacataagctccacctgtataaatagtgtgtgattttcatatttttctttgctgtagttataaaatgaagagaggaaaagctttctttatgacttggcaaggagaagatttttttagccttctccatgattctagttatgattaccgtggagtttttatttttattttttattataggaattatttggagggagaagttggagtaaaagaaaatagaagagtaatgagagaggattttctctgccaatctgtatgtacattctgtatgttacactatattaattgatgaaggcatcattc

SEQ ID NO: 226 - DNA, 2753 bp, Oryza sativa
gttctccacttctcctcctccctctctctctctcgcagcagtacacacaagcgaagcaaaagcgcggtgcggagaagtctccccgccggggaggcccgttcacaccggtgattgggttggagcaattaaagctttcctcctagtcaaccccagctcctctgcgaggaaagaattgatctcttttataatcctgggctctcactgttcgtttgcttcttcgtttcgcctgccaaactttccgagaagcggagcagcagttgaggagaaacgacggggagaagcggccgaggaggtctggagaaaaggctcagcgggcgttgtaatattagagctcagaggacaccattgacaagcagaggaattaggttctacatcaacctgataaattgtgcatcgtgtgatgttctgggcgtttcttgcttcatggcaagcgtaaacactggaggtttacgcctggtgagatgcccaaagtgttataacattctaccagaacctcccagtgttgaggtctacaagtgtggtggttgtgacaccatacttcgagttaaaatccgtcccagcaatggacaaaatgtagcgacgaaacaagtccggcaagactccgatgatttttcggttgctaccaccgcgagcaatggagtgcatcctcaaaagaaggatattgctttcagtggtgctaccatggacagatcccgtacccctgatgctccgagcactgacacagagcatgccagtaatggcacgagcagcaacgataatggccatgctatgtcagttgagaataatgcttctgaagttgcagatactgacaacaaggaagattgcaatttggatggccagaacactagtggaaggatcgaaggcccttctgaagaaataccacccaatgcaaatggcatggatatcgattccgacagagaggaaacctacaatgtggaaggaattgctgagaattcagaggattgcagggtaagaggaggtggagatattgatacagaatgcaacctgagtttacctgagcacgaattgcccttacatcaggagagcaagtcagactccgagctgaaggaagcaaccaaaaccgaagacgaggcaaccaagaaaggccatcttgtgagggtgcaatcccgttcttgcgatcttcgagagtcgcatcgcgcgtcggccggtagctcaatggatttccactctgccaggacttccctccagtccaagagcttcagggcgagcgagccgctccaatcgaagatcatgaagacagtggacgagctgagaggtgacctctctgaatttttcagcaaacctgaagaagaaggagaagacgacgacgatcgcaagccaaaaacagcagcttaccctcctcgtccttcaaagcaagacggctacagcaagcctcgtgcgccgttcacttccagtgtgccactcacggcttaccaccctgcagctaagcattccggccatgtatctcgcctgagcaggtcaggccaagtccctcctcctcctcatcatcatcgtgagctttcctcgctgcgatatcgccggcggcgcagggcctactcgtgctgccacagcgaccagatggagacgatgaggcgaccgtgctcccacgactgctgccattaccatagctgccggccaccaccatgtcaccaccatgaccggccatggaagagccaagaaggcgcgatgcaaaggccgccggtgcaggagacgacgaggcgccgggctccgcccaggcaccactgccggccggtgctgcgcggcgcgccgttcgtcgtctgctccggctgcaaccggctggtccagctgcccaccgacttcgccgtcccgagcaaaggcacgcgccggctgcagtgcggctcctgctcggagatcctctcctactcgtacagggacccggccaagaagaagctccagtctccgtccggcgacggcgaggagtgccagtacagcaccgacgactacgagatccatcaggcggccggcgacgccgacccgttctcgtactcggaggagtacggcgtgatcagctactccaccgaggaggagcagcagccgctgcacgtgtcgaggaactcgtcgttcgacaccgtcgacgacgagcggagcgccaagctgcaccggctgatggggtactcgtcggcgagcgagctgctgcggctgcggcgctcccccgacctgtacgagagcttcggagagcggacgcccgctgcaagaacgagtgacacgaagggcaaggccatctgcgtagctgacgaagaggagcatcccagcgcgaaggtgagaagaggccgtggcttgccgctcccagggatcctgaagaaggggatccatggactggaatccctgaagctcaggtagtcactcgtcaggtcatagcggatgatgtacactactctattttttgaggattaactgattatggccagtttagggaattcagaaacgggcttggttattagggtgctgggatagtgggtaagatgctgataggtgtgatagttcattgtatttgatcattagtttgtgtaaaggttggttttctgtggcaattttgtgtgctttttggtggtggtgtgtgatttgcagtattgttgattgtataggctaaaaaggctacgacctgtgtgcaaattagctgttgtaactattttgagtttttttttaatcttgatagaggagtttttcttccttctgaaatggaaaaggattgccacttttgattatgaatgtttgaagctgctgtacgtatc

SEQ ID NO: 227 - DNA, 1323 bp, Oryza sativa
accaccactcgcagccgtttccacttcaccattcaccaacgcaaacgcaaacgcaacgcagcggcggtagacgaagcagcagcaggtagcggttcttggtcggttcgccatggcagcggcggcggcgaggtacgacgtggagaagggagggaggaagagggagggggaggaggagaggtgcggttcgccggcggcggtggcgcagtacccgcagcgggagggggagagggagtgggtgccgtggctcgtcccggccatcctcgtcgccaacgtcgtcgtcttcgccgttgccatgtacgtcaacaactgcccctcccacgcctctcgcggcggcgcgtgcgtccggattcctccgccgcttctccttccagcctctctccgagaacccgctcctcggcccctcctccgccacaagatgggagcactggtatgggacaaggttgttcatgagcatcagggatggaggctagtgacctgcatctggctgcacgccggtgttgttcatctgcttgccaacatgctaagcctcgtgctcatcggactcaggctcgagcagcagtttggatacatgagaattggcatcatctaccttgtttctggcattggaggcagcgttctttcatcgctgttcatcagaaacagcatctccgtcggtgcttctggcgctctctttggtcttcttggagccatgctgtcggagcttttcaccaactggaccatatacacgaacaaggctgcagctctagtgacgctcttgatcgtcatcgcgatcaacctcgccatcggcatcctccctcacgtcgacaacttcgcccacatcggagggttcttgactgggttcctcctcggattcatcttcctgatgcgcccacactacggatggatgcagcgatatgtcctgccttcctctgtcaagtacacctccaagaagtacctggcttatcaatggatcttgctggccgtggcctcggtcctagctgtcatcggattcgccgttgggctgtcgatgctcttcagaggggtgaatgctaatgaacgctgccattggtgccactacctgagctgcattcctacctcgagatggacctgcgggaactgaagatttagtagaaacgcaacaaactgaagacattaaggagatttattgaaagtgtttgatgcacagacatacaattttactgtatataacttatacagacataccctcccaggggtttagtcagttcacttgattgattcattctgttcgtttgtctgaattatttggaatagaaacatcttctccttgctcgcataggagtgattagcgatcttgagattcga

SEQ ID NO: 228 - DNA, 1891 bp, Sorghum bicolor
gccatgatgatgatgggcgagggagtgagcgtgccgccgtggacccaccacgtccccgtgagcggcgtcgacgtcggcggcggcgacgagatgacgccgtacctgctcgcggcgctgcgccagtacctgccgtgcaacgacgccgccgctggcgccgaggcggacgacgaggacgcggccgccatggccgcgggcgtcgacggctacggctgcgacgagttccgcatgtacgagttcaaggtccgccgttgcgcccgcgcgcgcagccacgactggaccgagtgccccttcgcgcacccgggggagaaggcccgccgccgcgacccgcgcaagtaccactactccggcaccgcctgcccggacttccgcaagggcgggtgcaagcgcggcgacaactgcgacttcgcgcacggcgtcttcgagtgctggctccacccggcgcgctaccgcacccagccctgcaaggacggcaccgcctgccgccgccgggtctgcttcttcgcccacaccccggaccagctgcgggtgctgcccaccacgcagcatcagcagtccagcccccgcggcgccgcggcgtgctccccgctcgccgactcctacgacggctccccgctgcggcgccaggcggtcgagagcttccgcaccaagagcatcatgtcctcgtcgccgaccagcaccctcatgtcgccgcccaagtcgccgccgtcggagtccccgccattgtcgccggacggggccgccgcgttccgccgcgggtcctggccgggcgtggggtcccccgtcaacgacgtgctcgccacactccgccagctccgcctcagcaaggcgaactcgtccccgtcgggcgggtggggcggctacccggcatccgcggtcggctacgcatcgcccacggcgggtgggttctacagcctgccaaccacgccgacaaccctggccaccgcctccggctacatggccaacatggagccgcttgacgtcagcttctgcggcgacgaggagcctgtggagagggtggagtccgggcgggccctccgcaccaaggtgttcgagcggctcagcagggatggcgctgtttccggcgacgccaccgccggaatcagtggccctgacgtcgggtgggtctccgacctcatcaactgaggcggctgccggtcgttcttgcttcaatggcaatgtcattgggggcatggaggtgaaaggcggtggtaagccgtaacagagaaggatggcatcaagaaaaaaaatggttccctgtttagcttttgttgcttccagttaattccgctaatcccctgtacatatctatcgcgctgtgaattttctccggttggttggtagacggaggatgctaggtggtggtggtggaaggtggggtggatccgttttggggttcttgaggtagcggaaaatatccgttcaagaaaatagaaaaaaaaaatgtagatgtagtagccggcggaggtggtggtttgtgtcctcttctgggcatagggtgttggaggaaggcgaagcatggcggtggctggtggtgacgacgaagaagactgccggatttgccgcgcgcacggcggccgctgcttggtgatttctgtgattacggagcgtgcatgctagtttgatgttgtgtcaagttgatcgtttgtgcattagtaggcatcggctagatggcgattgcaacctgcttgtggattactacccccattttgttaatgtaatctgttttatcaagacccagcaagcattccctacagcatattttgtacttaatattgtagtagtagtaggtgctgaaatctcattcacccgctattggaggtgaatttcccatgtaatcttttgctcaagtaaatggtttaatgaaatctatgtctattattaatatcgccct

SEQ ID NO: 229 - DNA, 1378 bp, Sorghum bicolor
aacttccatttatgcacaggcgcactctggccatcggaaagtaaaggcccaggcagtgccgtgactgactcgagacgcaggagaaggatcgagaccaggcggtggcttcccgggggcaggatcgtcgcgaccacgaaagatgtcttactcaagaggatccagtgaaaggtatggatctcgctcaccttactcgagaagcagctattcaaggtacagaagtcgctctaggagtgtggactcaagcgatgctgaaaaccctgggaacaacctgtacgtgactggtttgtcaactcgtgtaacggatcgagatctggagaagcacttttccactgagggagaggtgattgatgcaagcgttgtgcatgatccttggacaagggaatcacgagggtttggttttgttaccatggctactgttaaggaggcagatcgctgcatcaaatatctggaccgttctgtgttggaaggtcgggtcataactgttgagaaggcaaagagaagacgaggtagaaccccaacacctgggaagtatcttggcacaaaatcttcacgtggacggaggtactccccaagctactcacctgttagaagggaccgttacagttcccgctactcgcctgatcggagggaccgttacagttcccgctatcggagggaccgttacagttcccgctactcacctgaacgtgacctgtcttattctcctgatggtagaggccggtcatactctccatatgacagaaggcgatcatactctccccacggcaggcatggatcttattcccctgacgatcggcgtcgatcatactcaccttactacagaaaccgatatcgttcaaggtctccataccgctacagaagacggaggtcaccttctgtttcgccatactacagccggcaccggtatagatctgtctccaagtcacccagtgtttctccaacaaggaccagagagcggagctattcccacagtttatcgccacagagaagctactctcgcagccattccccagaatcggagagatcaacgagctactctcctaagaaagggagtagaagggaaccctcatgtagcagatattctggcaagaggcgtcgttcaagggaaagctactctcatagccgcagttcatactccaggtccgtgtctagggagcgctcagcttgatctgcgaggtgtatcgtcctaggttgttataagatgccctgtatccgtatttgacagaactgatgtgttttcatgatcattatatgctggctattgtgaacttgagaacagcatggatgtgtgcattgtactgtattatgttatgttcattttgtatgagacagtgaaaaatttctgatgctatcttgctattgttggttcgttcttggt

SEQ ID NO: 230 - DNA, 1310 bp, Sorghum bicolor
gactcgagacgcaggagaaggatcgagaccaggcggtggcttcccgggggcaggatcgtcgcgaccacgaaagatgtcttactcaagaggatccagtgaaaggtatggatctcgctcaccttactcgagaagcagctattcaaggtacagaagtcgctctaggagtgtggactcaagcgatgctgaaaaccctgggaacaacctgtacgtgactggtttgtcaactcgtgtaacggatcgagatctggagaagcacttttccactgagggagaggtgattgatgcaagcgttgtgcatgatccttggacaagggaatcacgagggtttggttttgttaccatggctactgttaaggaggcagatcgctgcatcaaatatctggaccgttctgtgttggaaggtcgggtcataactgttgagaagattttgttgacagcaacagggtagatgttggtagctgctctgcaacaaactgatacaacctaacaccaaaccatgccacctcagccaaagggcaaagagaagacgaggtagaaccccaacacctgggaagtatcttggcacaaaatcttcacgtggacggaggtactccccaagctactcacctgttagaagggaccgttacagttcccgctactcgcctgatcggagggaccgttacagttcccgctatcggagggaccgttacagttcccgctactcacctgaacgtgacctgtcttattctcctgatggtagaggccggtcatactctccatatgacagaaggcgatcatactctccccacggcaggcatggatcttattcccctgacgatcggcgtcgatcatactcaccttactacagaaaccgatatcgttcaaggtctccataccgctacagaagacggaggtcaccttctgtttcgccatactacagccggcaccggtatagatctgtctccaagtcacccagtgtttctccaacaaggaccagagagcggagctattcccacagtttatcgccacagagaagctactctcgcagccattccccagaatcggagagatcaacgagctactctcctaagaaagggagtagaagggaaccctcatgtagcagatattctggcaagaggcgtcgttcaagggaaagctactctcatagccgcagttcatactccaggtccgtgtctagggagcgctcagcttgatctgcgaggtgtatcgtcctaggttgttataagatgccctgtatccgtatttgacagaactgatgtgttttcatgatcattatatgctggctattgtgaacttgagaacagcatgga

SEQ ID NO: 231 - DNA, 1109 bp, Sorghum bicolor
aagcacggcgccgcgtcggtggccggccgcaggagggagatggaggacgccgtgtccgtgcgcgaggcgttcgcgctcgcggagggctcccacggcgggaggcgcgacttctacggggtgttcgacggccacggctgctcgcacgtcgccgaggcgtgccgggaccggatgcacgagctgctcgccgaggagctcgctgtcgccgccgccgccgacgacgtctcctggaccgcggcgatggagcgcagcttcgcccggatggacagcgaggtgatgtcggccggcggggccagcggcgcctgcggctgcgacgcgcacaagtgcgaccacgtgggttccaccgccgtggtggccgtcgtggaggagcggcgcgtggtggtggccaactgcggcgacagccgcgccgtgctgtgccgcggcggggacggcgcgccgccggtgccgctgtcgtcggaccacaagcccgaccggcccgacgagctggcgcggatcgaggccgcgggcgggcgcgtcatcttctgggagggcgcgcgcgtgctgggcgtgctcgccatgtcccgcgccatcggggacggctacctcaagccgtacgtgtcgtcggtgccggaggtgacggtcaccgaccggtccgacggcgacgagtgcctcatcctggccagcgacgggctgtgggacgtggtcagcaacgaggccgcgtgcgaggtggcgcgcgcctgcctccgcaggggccgcgccaagtggtgcgccgaggccgccgcgctgctcaccaagctggccctcgccaggcgcagctccgacaacgtctcggtcgtcgtcgtcgacctccgccggaggaatcatcactagttggatctgtgcagtcgccagttttagtagtactagtagtacaaggtaggatgatggatggtgcacaaaaggatttcgcgggtgacgggtgtgtactaattgggttttttttcctttctttttcatcaaaaaaaaaaaatattttttttgctgtactctccctgaatcaaaaagttcagaggagcacttagattagttattatggtggaaccggaatttgatccggataccatttggaatgaaaatgaagtgttgcataaaaa

SEQ ID NO: 232 - DNA, 2228 bp, Sorghum bicolor
atggcaaacacagaaggttttcgccttgtgagatgcccaaagtgtctgaacattctcccagaaccgcccaaagttacagtctacaagtgcggcggatgcggcaccacccttcgagctaaaatccgtgccagcaatggccaacatgtggctgcaaaacaagtccgccaggactccgacagttattcggttgcaaccgccgtgagcaatggggtgcctcctcaaaacaaagaccaaggctccattggtgctgtcacagagaatttttccttcaatgctgacgctccaagcaccgagcatgacagcaatggaacaaggagcagtgaaaatggtgatgatatgctggctgggcagaatgctgtggtggttgaggatactgagaacaaggacaatcgcaatttcgaagaccaggatagcagttcaaggatggaaggtcctgctgatcaaacacgcctgaatgcaaatggcatgtatttaaattccggtgaaacagaaaaccacaccgttgaacaacctatggagaattcagagacttaccgagtaagtggacatgatgatactgaatgccacttgaacccctctgaaaacaaaccgatttcttctgagataagcaaagcagccgtcagtatgcaagatcctgagcagaaggaagcaggcgaatccgaacatgcggcaaacaagaagagttatcttgtgagggtgctgtctcggtcttgtgatcttcggtcatcaataaactcgattgatttccactctgcacggacttcgcttcaatccaaaagcttcagggctagtgagccccttcagtcgaagatcatgaacacaatggatgaactgaagggtgacctttctgaattgttcaataaacctgctgcagactgcaagccaaaggcacacaaccctccacgcccttccaaacaagatggccacatgactcgtgcagccaccacaaccagcgcacctcttgcagcataccatcctgctgccaagtattctggctatgtgtctcgcctaagcaggtctggccaggttcctcttcctcctcgtggactgccgtcgctgagatatcgccggcacagggtttattcattccatcatcacagcatgcaaacggaaatgagaccttgccgtcatgagtgctgccatagctgccagccaccctgctacagatcctgcaaccaagaatcttcagcgatgcacaggccaccgatcatggagatcaggcgtcgtcctcctcccagaaatcactgcctgccagtgctacgtggcgctccgttcgtcatctgctccaactgcgtcagtctggtccagctgcccaccgacttcgccgtccctagcagagggacacgccgggtgcagtgcggctcctgctccgaagtcctctcctactcctacagggaccccgccaggaagaggctgcagtcaccatttgggggcgatgagtacagcactgatgagtacgagattcaccaccaggctgccgctgccggcggcggcttcgagcaagcagatccggtgtcctactccgaagagtacgggctctcgttcggcgtcagccactcgactagcaccgaggacgggcagccgctgtacgtgtcgaggaactcgtccttcaacaccgtcgacgaaaggatgatgggcaaagacggcaagcttcaccggcttatggggtactcgtcggcgagcgagctgctgcggcggcattcgcccgacctgttcgagagcttcgacaggcgcacgcccaccatcgaaagaacgcacgtcgtcgacaggaagggtaaaggcgtctgcgtggcagaaaacgatgccggcgagcgagacggtggtgcggtggtgaagagatcgaaggcgaggagtggtggcttgccgctccatgggatcctgaagaaggggatccatggcctggaatcactcaagctcaggtcgtagctcatgatcttcgttaggcggtggcgaggctcaggcgatcgagtttaggagagagtagcatacacgacaggtttagagtttagtggttggcgttctgaggtgtgcttactgcttagttgctagcttgtgtgtgagtttgtttgcaatccatctgtgtgtggagttggttgatttgcaaattttgtgtgatcttcgatgtgtgtaaggtttgcacgccacacatgctcgatgctgtggatgtgcatatatttgattggtgatttgtgcgcgattaattcatcatcgattcatcggtttggctc

SEQ ID NO: 233 - DNA, 1209 bp, Solanum lycopersicum
cccggacaggtacccttattgctgttgttggcgtggtagtattccttctcttgccggttaatcctgaatctgtgggagctaataaagatgaagatgaagtgttctctcctagaaaagaaggcgaggaagtaaccgagcctttcttgagatcagacggagaagaggaatcagccgtgggttttattgaagcatggaagattccaggggtggcgccgtttgcgttttgccttttctttgcaaagttggtagcatacacatttttgtattggctgcctttctacattagccacacagctatagaaggaaggtatttatccaatgaggaggctggaaacttgtcgacattgtttgatgttggaggggtagtaggtggaatcctagcaggttacatatctgaccgcttagatgctagagctataactgctgccagcttcatgtactgtgctatcccggttctctacttctatcgcagctatggacacgtctccatgaccataaacatcatcctcatgttgatcaccggagtattcgtgaatggtccttatgcattgatcacaactgctgtttcggctgacctgggaacacatagctctttgaaaggcaattcacgagcgcttgcaactgtcactgctattattgatggaactggctcaattggagcggccattggaccacttctaaccggttacatttcaactaacagctggagtggtgtatttacaatgctaatgggatcagcttttatagctggtttgtttctgaccaggcttgttgtagctgaagtgggtgccaagattcaagaattagggtcccaaggatcatcacctacatcaaggtcccctgactttctagtgtgaaaataataattgtggtatattcttttattgctttttgtgaatccatttcgaagcctcgattcgaatgttagcctaggatcatagagatatatagagttggagatgcatttcttgtataaagtcaagaaatgaaagggtttctagtatccttgtgtacagtgtgggagtgagtttaaaaggtgggggatcactcccaatatcatgaaatagcatttccacgtatgtacattctcgtgtgccagaaaaggatcaaatacatcatttttagtatagtgggaacctgggttattgggcgttttgtatatcatctttttattattatgattattgaataaagccagtgcattctctc

SEQ ID NO: 234 - DNA, 1845 bp, Solanum lycopersicum
ccaaaacgtcatgcctaacgtgaagagtccccacctacttacgatccgtcgccgtttcctactgcagctcagatttctctatcataacatttgccatttccagcctgcaaagcacatcaaccatagtatcatggattcacagtcgtcaccacatggctctattatcttctccaccgtcggcagaaccaattatggcttcgacatcttctccatcaaatctccattttcttttctcaattctccggtagaacatcgcctcacagacggtacctccatcaattacaacggacagtttgtcgatgaagatcaaacacttgtattcgtctcggagagatcaggtgctcctcgcatttacttgagacacccctcctctcaggtacagatggaacaacttcctactcccattgatagcctatttctcgaccgtccatttcttcgaaataaacaactctactatatttcagctcatcagcaacccaaacaagttttcaccagctcgtccgctctttactctaccaatatagaagataatagtaacatcatccgcttgactccgtacggctgtgttgattatagtccggcgatttcgcagtctggacacctgattgcggttgcatcgtacggagaccgtcgttggcctactggtgaattccatgatctgactactgatattgttgttttccctgaatctgacccagaaaagcggatagttgtgtgccaacacggtggctggccaacttggtctggtgattcgactatctattttcaccgacaagctgatgatggttggtggagcatttttagagtagatttgcttgaagattcactcaatctgcgtactgatccgattcgagttactcctcctggtgtgcattgctttactccagcggcctcacacagctccaaatcaatgattgctattgctaccagaagacaggggacgaagtatcgccacattgagattttcgatgtggagtctcacaagttctattcggtgaccgagttgcttaaccctaccactcaccattacagtccattcttctctcctaagtcgtcgtttctcagttatcaccggttccgaggtgaatcatcatcgggagatgcaacaattccttccttggccccgataatttctccagaaaaaggactgagaatgctgaggcttaatggatcatttccttccttctctccctcaggtgactttattgcgtttaatcatgatttcaatcctaattcaggcctcaaaatcatcaaatcagacggttccaagaagtggacattgttcagaggccgtacagctttctgcaactcctggtctccagccgaacccaatgtgatttttacgtcaatcggacctgtattcgactctgtaaaagcaactgtccaaatagcacgagtttcattcaattcattaaatctaactaacgatgattgcagagaaattccagtagaaataaaagttctcacaaaagaggagacgggaaataatgccttcccttcctgctcgccagacggaaagcacattgtattccgttcaggccgtgcagggcacaaaaatctgtatattatggattctgttaagggagagctggagggtggaggaattcgtcagctaacagaggggccatggattgatacaatgccaagctggtcacctgatggaaagctgattgcattttcttccaacaggcacaatccggataatgtcacttgcttcagcatttatgtgattcatccaaacggcacaggtcttcgtaggatccacgtggcagggccagagggatctgatgaagtagataaagagaggctaaaccacgtatgctttagtaaggactgtgaatggct

SEQ ID NO: 235 - DNA, 808 bp, Solanum lycopersicum
ggtcaatctccaatattcccccaaaatggatgggagcaattattacttgatgaataggagccacattccagcatttggtagctgggactgtaacaatgattttccaattcctttcactcagtgctttgaatctgctaaaaaagttgggttgctcagatacagctactctgatgaccgtgatttgtatgtcgccggagatctataccagaatgatatcctcactccggccatgatcgtcgttcctcgtcgtaagagaaaatcaagtattagtgatggagttggaaaagcaagaaaggagaggtgggtggtgtgcaattgtgaatatgaaaatgatgaagagaaaaaggacataactattgttccacctccacctccacctataagagcatccaaagcagtagatgaagatctctacaagatttcccctcaattgctccactataagcctacaaggaaaggtgttaggagattcttttcgagctgcttgctgccaacttgtgcttcttgatcctcaaataacacaagattgtcaacattatataggactagtagtatcgtattaatagttgctatgtgtctaatattaatttagtgtttggagtattttcttggggttttagcactaaattggcttataaactcagagattatgccagcccaagaaaacaattatcaatcattagcttaggatggtcaaaattaagagaattccttctctattctattgctagtatgtttccctttggaagtatttttcgtctcaattgctctgctagctaatgcacttctgttttgcttcctgggaacc

SEQ ID NO: 236 - DNA, 326 bp, Sorghum bicolor
ggccatgctagttattatcaatttgctgtcctgtttaactggactattgatggagataagagtgtgcgtccaaacagttggcctgtgcccaaggcattttggtgccctgctgagtatgttgacatggtgggtcaatcgtgtgttcaaaagcgaggcaaacgcagccgccccagaattagagttattaatggaagggagtaccgatatgcgtagagcatttctatttccttctttgttctgtatatattcgtgttaatgaacctgtttgagctggtttctgaatcaaagatcatttttatataatatattagagtttgttcacgtgt

SEQ ID NO: 237 - DNA, 531 bp, Sorghum bicolor
tagaaggctgtgcaccgccgcctgccccaaggtcagaggttttgaagaacacacgggtgaagttcaacctgtacccagggacatccttaggtggtggaggtggaggtgcaagtggaagtggaggtggtggtactgcaggtggacatgatggacactctcgtgaagctatgctattaggttacgttgttgaatcaccgtcttcatctgattcatcatcagattcagattccagccaaccggacagcccatgccagtccgatctatttgccgaaccaactttgagagtatcaactagcgacactgtttcccaagtacctgagacgccactaggttcaggagagacagaactcgttcccgcctacaactactaaatgtgcttgttatgcatttgaacttgagatgtatttgaacttgtgatgtggttgatacttgggatgtatttgtgaacttatggttgtggactttggtttgactattgtgaacttgttatgtatttgaactatagatgtatctgtaatgaatgtttatggt

SEQ ID NO: 238 - DNA, 2088 bp, Sorghum bicolor
agggttttatctctcccgccgccgcctcgacgctcctgtgccgccggcaacgagcccgaagaagcctcgcgaagacatggcggggaagaagcgcaagtccgggtccgagaagccggcgaagcaccgcctcccgctgggagccgatgccgacgcggttgccgaggcctcgaagcgccgccgctcgggcgccgccaagcagcaccaggcggacgaggaggcgtccatcccgccctccctcagcgccaagatcctccgcgaggcgcgcaagcagcagcaggaggagatgcgcgccgacgactccagcgacgagcagcggccctctgctgccgaggcggccgcggggccgtccacgtcgtcctcgttccccgtccccgccgcggatggcgaggaggaggaggacgacgacgtcgacgagttcgacgggtttgacgcgcagaccgagtacgacggcggcgaggtggagatcaacgaggaggatgagagggcccttgctgccttcatgtcaaaggacaaagctgccgagcgcacccttggtgatatcatcctccagaagatcatggagaaggacgccgaggttgcaactgaaggacgacctcgtgtaaaattggacaacagcattattgagctttataaagaggttgggaagttcttaagccggtacacgagtgggaaaattccgaaagccttcaagcgcataccatcgctggagtgctgggcagatgttgtgcagctaacggagccagagaattggtctcctaatgccgtgtatcaagcaactcgcctcttctcttcgaacatgaacacaaagaacgctgagcggttctatgaagccattttgctacctcgtgttcgtaatgacataaggaagaacaagaggctgcattttgcactctaccagtcgctgaaaaaggccctttataagcctgcggcatttaacaagggaattttgctgccactctgtcgggaaaggaattgcaccctccgtgaagcagtgattattgggagtattatccagaaagtctccattccatttctccatgcaagtgtagctctagtaaaactagcagagatggagtactgtggcactacaagttacttcatcaagctatttctagacaagaaatatgctttgccgtaccgcgcgcttgatgcagtgcttgctcacttcatgcgttttcttaatgatgagaggaccatgcctgttatatggcatcaatcactgcttgcattcgtggaaagttatgttcatggctggattgattgccggtgttcatttaccaagtgtctgtgctcactctttcactgctttagtcatgtattttacactaaaaatttcatggcagatacaagaatgagttagagaaaaaggataaggagaaccttgcacgtttgttggatcaccagaaacactatttggttactccagaaattcgaagggaacttcgagggagctgcaacaggggtgaaaaagatatgaatttgcagacttatatccttgcagtgcagcttgttacattctttagcttgcatacatataccatgttagctgaacaaaaaaaatgtttcaatgattgcaattggaattttgattccagtctggttatttccttaacatgttttcttactgtcacctatctccgtcattaccaagcctatcgaggaagacaagtgggacgtaccacaagtgccaatggaggaagattagccatattctccagtgtcaatttttacacttaaatgatttttggggcaaacttctaaagatattgctgtgattttttggtcataaacttgtagtgccaatattataaaatgggtacccagtagatagggccccaatgttctgggaaggtattttgcaatcagaatgcgattcacacagtagtttgttttgattggaacttggaacctgaagatcagttggcgcatttcaaggggtcattcagcatggatatgtggtatactgcctttctcagaggtggataagaaatagttgggtttttttgatcctggtattttgtaaccgtgatagaactaaattatgtcgtacttgaaccagaaatggaaatgaatgatcacgagttcgtt

SEQ ID NO: 239 - DNA, 754 bp, Sorghum bicolor
atgttcccgtgccgccctctggctccgcggcccccgccgcgtgccctttccctcttgcggcttcctccgtcgtcgctgcggccgccgccgtcgtctctgcgcgtggtgcggtgcatggcgaaggagcggcgggtgcggatggtggcgaagcagatccagcgggagctcgctgacatgctcacccgcgaccccgtcctgcagcgcgccgtgctccccgaggccgcgctcggcgccgaccgctacctctcgtcgctcactaccatcgccgacgtcgagctctccaacgacctccaggtgtgcaaggtgtacgtgtccgtgtttggggacgagagggggaagaaggtggccatcgaggggctcaaggccaagaccaagtacgtcaggagccagataggcaagcggatgaagctgcgcctcacgccggagataaggttcatcgaggatgagtctatggagcgtggaagcaggatccttgctatacttgacaaactaaaggaggaaagggagcaacaagaaggaaaagatggagaggaagatgtagaaggttcatatatatcagaagaagaagatggtgactgggatgcagatgacccagatgaggaggatatcatttatgtaaaatagcctatcgtattctgggaacttggtcatcattcatccagagcacagcagttctcttcggagtttaatccagtgaagttcagaactcactgcttacctgcttgtcgaagcactccaaagtatatcagcactt

SEQ ID NO: 240 - DNA, 1512 bp, Sorghum bicolor
actgcgagcactcgctccaaccgtcgccgatctccaggcgcagcggcgatgagctccggaaaggcgcagcagcggccacacgccgtgctcatcccgcagccggcgcagggccacgtcacgccgatgctgcacctcgccaaggcgctgcacgccagggggttccgcgtcacctacgtcaactccgagtacaaccaccgccgcctgctccggtcccgcggccaggactcgctcgccggcaccgacggcttccgcttcgaggccgtccccgacggcctgccgcagtccgacaacgacgacgtcacgcaggacatcgccgcgctctgcctgtccaccaccgagcacagcgccgcgccgttcagggacctgctggcgaggctgaacgccacgcccggcagcccgccggtcagctgcgtcatagccgacggcgtgatgagcttcgcgcagcgggtcgccgaggagatggggatcctggccttggttttctggaccaccagtgcgtgcggcttcatggggtacctccacttcgccgagctcatccgacgagcctacgtgccagaaagtgacctgtcgaacgggtacctggacaccgcgatcgactggatccccggcatgcccggcatccgtctgaaggacatccccagcttcatcaggacgacggacccggacgacgtgatgctcaacttcgacggcggcgaggcgcagaacgcgcgcaaggcccgcggggtcatcctcaacacgtacgacgcgctggagcaggacgtggtggacgcgctgcgccgcgagttcccgcgcgtgtacaccgtcggcccgctcgccacgttcgcgaacgccgcggcaggaggcgggctggacgcgatcggcgggaacctctggaaggaggacacgagctgcctccggtggctggacacgcagcgaccgggatcggtggtgtacgtcaacttcggcagcatcacggtgatgaccgccgctcagctcgccgagttcgcctggggcctggcgagctgcggctcgccgttcctgtgggtcatcaggccggacctcgtgtccggcgagaacgccatgctgccggaggggttcgtcacggacaccaaagaaaggggaatcctggcgagctggtgtccgcaagagctggtgctctcgcacccgtccgtcggcctgtttctgacgcactgcgggtggaactcgacgctggagagcatatgtgccggcgtgccgatgctctgctggccgttcttcgctgagcaaccgacgaactgccggtacgtgtgtgacaaatgggggattgggatggagatcgacagtgatgtgaggaggcaggaggtggcgcggctcgtgcgcgaggcgatggacggggagaggggcaaggcgatgagattgaagtcgatggtgtggaaggagaaagctcgacaagcagtggacgaaggtggatcctcgaggaaaaacatggaccggatggtcgagttcctgctcgctgggaatgatgttcctagctgaatttattgaaaaaatgct

SEQ ID NO: 241 - DNA, 597 bp, Sorghum bicolor
cgaagtttatgcttcaggttatcagcgtgcttcacatcgttcatctaaaattctgcaaaacagaagaagaggaaaaagagccacaatagtaacagtaccacaaatattttgccctaaaggtcataaatgcatacattatgttattaagggctcaagatcatctgaagttgagggcttgtggaaaagtcctcctcaagaattctcttatctccagtatcctcaagagggatggtgatgataaaattaaaattgtagacctatatcccacacatgacaagaatgaaattagaaccattgagaaatgggttttatcgtacctggaccatgacatgacacttaaggtgaggtggctgtgaggagattgttgttggtggcacgctaggagcaccttgaaatagaccggcaactgggtgacgttgagggatgaatattgaggcaagagagaggtgatgaagttgcactttgttacttagatcctttgagaaataaagttgtaggcatccgaattgcctagctcttgaaaactatttctacttatgtggaaggcaaagtgtgtctctattgctacatgttcaaataaaaagtttcctttgatga

SEQ ID NO: 242 - DNA, 1536 bp, Solanum lycopersicum
catggagaagaagggtcatgcagtgtgtgtaccatttcctgcacaaggtcatgtaataccattcatgaaattagccaaattattgcactccagaggtttctatgttacatttgtcaacactgaatataaccatagacgtctaatccgatcccaaggtcctgactttgtgaaaggcttccaggatttccaatttgaaactatcccggaagggttgccaccatcagatcgcgatgcaactcaagatcctgcttccttatgtgactccataagaaaaaactgctcgactccttttcgggaattattatcgaagcttatttcatcacccaaagttccaccaatttcttgtgtaatatcagatggtgtgatgagctttgctaataaggctgcgcatgaatttggcatccttgatgtccaattttggacagcctcagcttgtggttatatgggataccttcaattggatgaactaacaaaaagaggcattatcccgtttaaagattacagttttatggaggatggtacactggatagagttgttgatggaattccaggaatgagaaacattaggttcaaagacttgccaagctttatcatgactactgatccacatgatattttgttaaactacttaagggatgaagcacaaaattgcttgaaatcttctgcgatgatcatcaacacgttcactgaattggaacgccaagtccttgaagcgattgaagctagacacccaaatatttatgttacaggtccactttccttgatggaaaaaaccatcccagaaaatgaattgagctcatttaggccaagtttatggaaagaagaattccattgtcttgagtggctgaataaacaggaaccaagttctgtagtatttgtgaattatggatgtgtcacattgatgtcagacaatcacctaaaagaatttgcgtggggacttgcaaatagcaaacacccattcttgtggattgttaggcctgacatagtgatgggtaattcagccgtattgcctgatgagtttcttggagagattaaagacagaggattattagcaacctggtgcccacaagatcaaattctttcacacccgtctattggcgtatttctaacacattgtggatggaactctacgatggaaagcctaagttcaggagttcctctaatttgctggccattctttgctgagcagcaaacaaattgtagatatgcttgtgtagagtggggaataggtgttgaggtcaataaagatgtcaagcgtcaagaaatcgaagcaattattaaggatatgttagaaggtgaaaaaggtaaggagttgaaagacaaggcgttggagtggaagaagaaagcagcagaagcaactaacattggagggccttcatggaaacactttgatacattcttggaaagacttctccttaatagggaatagtatttgttggatatactattaaccattggttaagcaatagtattttatttaatcatgtgtgaaagactttatattttatctcatttatcataataaagtttttattt

SEQ ID NO: 243 - DNA, 1204 bp, Triticum aestivum
gcgaagctggccgagcaggcggggagatacgatgatatggtggattttatgaagaagcttgctaggatggatgtggatatgagcgttgaagagaggcatttattttcagttggttttaagaatacaattggtgcaaggagggcatcatggagaatcctttcttcacttgagcaaaaggtggcagcgggtgagcaggctggccggatgataagtgtctacagaacgaaagttgaggatgaactaaggatggtttgcaatgaaatattgtcaatcatcgctattcattgccttcccttggctaatgcgggtgaaaacgttgtgttctttcataaaatgaaaggtgactactaccgttacctggctgaatttagcactggggttgaaaagaagtctgctgctgaccaatcactcatggcctatcagcatgccatggttgttgcctccaccgagctttcgcctgctcatccaatcaggcttggccttgcgctcaatttctcagtgttcttttatgacataatgaactgtcatcagagagcttgccaagttgcaaaacaagcatttgatgaggctactactgagattaattccgctggtatggatggcaacaacgatagcacactaatgatgcagcttctgaacgacaacctagcattgtggaagtcagaactaactgaaggtgaaacctcgaaggatagcgacatcgatatggaggagggataactggaatgtgctgaaggctcccctgcatgcatgtgtgcaaaatgaccagaacataatggtaccaaacctgctggacactgttggtttttgtgacaatgcgctgatacaattttccgacattttagcagggataactggaatgtgcttcaaggctccctccctagcacgtatgtgtgtgaaataaccagaacatagtgctaccattgaaatcgccccaaagtgccttgcctactgtgcagcttgttagtagttctggggtcctcgcttggtgttttcctaggctttccacagtatggattggtaaccatgtgcccagctttgctcatgttttgagagcttggagcagtgaccatccatctttgatgcttttgtttctagttttcctccatgcgtattaagcgttgctgtatactggcgagctatatgtaactagtagtatctcagctatcaatgacgaaaactgtcatttttttcaaaaaaaaaa

SEQ ID NO: 244 - DNA, 1682 bp, Hordeum vulgare
cagcttcactccacagcgtctcggcgagggtttcggcggcggagaggatatggccgggaagaagagcgccgcggtgacccccgcgccctccgacggcgaggagagcgccggcgttcccagctccgctgccaagcgccagtccggcagacataagaaggaccccgccgccgccagccccggctccactgccaagcgcgcggccgggaggcctaagaaggtcgccggccccgccgagggctcagctatgaatcccgcgaagggcgacatgggggaggaggagaagggggcgaccccgaagaagaaggagaagggggcgaccccgaagaagggggagaaggcggcgaccccgaagaagacggagaagaagggggagaaggcggcgaccccgaagaagacggagaagaagggggagaaggcggcgaccccgaagaaggcggagaagaagggggagaaggcggcgaccctgaagaaggcgggggagaaggcggcgatcccgaagaaggcgggggagaaggcggcgaccccgaagaaggaggaggagaaggcggcgaccccgaagaagacggagaagaagggggagaaggcggcgaccccgaagaaggaggagaaggcggcggccccgaagaaggaggatgaggagaaggcgacggccccgaagaagaaggagaagggggagaaggctgctgccaagaagaaaaaggacaagggggagattgcggcgtccctggacaaggaggagatgggggacacgctaggcggcgaccccgaagaagacggagaagaagggggagatgggggacacgctggccaacatgaagaagaagaagaaagagaaggaggagatgggggacacgctggccaacatgagaaagaggaagcacggcgatctggaatccccaaaggcggcgaagaaacacaagggcaaggcggcaggagcggcgccggcggcaaccgagcccggcacctgcagcttcccgatggcgcgggtgcgggtgctgatgcgggacaaggacgccaccatccgatctaacaccgagaccgtcttcctcgtcaacaaggcctcggagttattcttggaggcatttgtggaggatgcttatcagaatgccctgaagggacgcaaaaagtcaattgcctacgataacctttcggcgggtgtgtgcaatgagaaacggtacaagtttctatcagatttcgtgccgctgagggtgaccgctggagatgcactcaaggctgtggtggagcggtcttagacagaggaggtgtcagtcctagaccatgagggagacacgcatgatcgccataggttctcttgtcgtgcgctaagctagcctgtgctgttttgtagggagggagacggtggaggtagggttgtctgggctactatgttcttctatagtaggttaggttgagaccagcgtagtttatggagaatgtatgttgtgcgaatttatggagaatgtaggctgagaccagcgtagttcatggagaatgtatgttgtgcgaatttatggagaatgtaggctgagaccagcgtagttcatggagaatgtatgttgtgcgaatttatggagaatgtaggctgagaccagcgtagttcatggagaatgtatgttgtgcgaattggagcggcaacccacccaccccttgtggcaatgcatgttgatgtgtgtctggtctga

SEQ ID NO: 245 - DNA, 1172 bp, Hordeum vulgare
aggatatggccgggaagaagagcgccgcggtgacccccgcgccctccgacggcgaggagagcgccggcgttcccagctccgctgccaagcgccagtccggcagacataagaaggaccccgccgccgccagccccggctccactgccaagcgcgcggccgggaggcctaagaaggtcgccggccccgccgagggctcagctatgaatcccgcgaagggcgacatgggggaggaggagaagggggcgaccccgaagaagaaggagaagggggcgaccccgaagaagggggagaaggcggcgaccccgaagaagacggagaagaagggggagaaggcggcgaccccgaagaagacggagaagaagggggagaaggcggcgaccccgaagaaggcggagaagaagggggagaaggcggcgaccctgaagaaggcgggggagaaggcggcgatcccgaagaaggcgggggagaaggcggcgaccccgaagaaggaggaggagaaggcggcgaccccgaagaagacggagaagaagggggagaaggcggcgaccccgaagaaggaggagaaggcggcggccccgaagaaggaggatgaggagaaggcgacggccccgaagaagaaggagaagggggagaaggctgctgccaagaagaaaaaggacaagggggagaaggcggcgaccccgaagaagacggagaagaagggggagatgggggacacgctggccaacatgaagaagaagaagaaagagaaggaggagatgggggacacgctggccaacatgagaaagaggaagcacggcgatctggaatccccaaaggcggcgaagaaacacaagggcaaggcggcaggagcggcgccggcggcaaccgagcccggcacctgcagcttcccgatggcgcgggtgcgggtgctgatgcgggacaaggacgccaccatccgatctaacaccgagaccgtcttcctcgtcaacaaggcctcggagttattcttggaggcatttgtggaggatgcttatcagaatgccctgaagggacgcaaaaagtcaattgcctacgataacctttcggcgggtgtgtgcaatgagaaacggtacaagtttctatcagatttcgtgccgctgagggtgaccgctggagatgcactcaaggctgtggtggagcggtcttagtag

SEQ ID NO: 246 - DNA, 699 bp, Hordeum vulgare
gcacgaggctcagtcagcacgccatggtgacgatgaagcgatgcatggttcctaccatcctgctgatgcttgggctgcaggcagcccagctcgtcgccggcgacgatgtgggcgccattctcctgccgagccaagcccaaggcgaagcagccatggcggcggccaagaagaggccatggaagtgctgcgacgagcccttctgcaccaggtcgttccctcccatctgcacctgcatggaccaggtcttcaagtgccccaaaacctgcaagtcctgcgggccgtccgcggctgacccgtcccgccggatctgccaagaccagtacatcggcgaccctggacccatctgccggccgtggaagtgctgcgacaagcctacctgcaccaagtccaacccgccgacgtgccgctgcggcgacgaggtcgacaagtgtgctccgacgtgcaagacctgcctgccgtccaggtcgcgcccttcccgccgcgtctgcatcgacagctactttggggccttcccgccaccgtgcacgccccgagaggccgtcgccgccggcggcaagtagctaccgcgcgcgcgtacgcgctggtcacccgatcgatcagcgtgccgttgatcgaatcgccacgtcgtctgtactgcgacctcgcttgcagcagcagcgctctgcagtggttgacaatataataaacatgtttctgaac

SEQ ID NO: 247 - DNA, 1507 bp, Gossypium hirsutum
ccattggcacctgctgataatgataaacgaaatcaaattccgtttatgacagcaagtgatggaatcaagcagcgaagtgttgtttaccagggatcatcttctttaactggtcccgttgttattgaagatgttgtttatgaaaatactgatgatgatgtcagtcactctttacccttccgccgccttgtcttcgaaagaactgagggcctggtacagtctgaagctttgctaactagggatggattgtttgacaaaagtgtttatggaacagagaagaagaaagccagttcatcttccaaatccaaacgaagaggagccctcaaaagaaataatgaatcaagcagcaaaatgaaggtgtatcatggatatttggccagttcttatcatacagcaatcatttctgggttttctctgatttcatcctatttggaaagtgtggcatcatcagggaatagggttaaagcagttgtgataggtcttggtgcgggcttacttcctatgtttcttcatggatgtatgcaatctatgcaaattgagggagtggagctagatcctgttatgcttaaccttgcaagagactattttggttttactgaagataaacgaatgaaggtacatattgccgatggcatccagtttgtccgggactacagaaacttatatgcagctggcaatgaagtgctcctttcttccaatggaagttgcaaactttcagatgctgaaagcagaagtaccgctattgacataattattgttgatgtggactcttcagactcaagctctggactgagatgtcctgctgctgattttgtggaagagtcttttcttcaaaacgtaaaagatactctttccgagcaaggtctctttgttattaatttggtctcaaggtctcctgccatcaaggatgcagttgtctcaaggatgaaagaggtttttagccacttattttgcattcagctggagggagaggtcaacctagtacttttcggtctttgttcggagtctcacattgaggaggattgcatacctgatgctgcccttaaacttgataaattgctcaagtccgaacatcccgagataagccagagcatcacagatgcagcaaagaagctcaaacgtttaaagtgaagaccgtttgataacaaagtttcccctttaatgtattctcaagtaactcgagagcaagcttttgcagattttgaagcaaatggcattgaaactgggtgactgaagattgcgccacagaatgagaaaagtccgaggtgggtttttatttcctttctttgaatggtatgcattctgcatcatctccagtttggttgctcgatgtcttaatacttctgtcttgcatcgtttttgcatacattttaagcattacagtcgggggcccgaatttgaaatataccctcttcaatatgtaatagtattaacctgtaaatcacaccactgggtgtacaaaattagacaggatttttatttgacttaatcgattcattgagatttgagg

SEQ ID NO: 248 - DNA, 1265 bp, Zea mays
cgcatagccgcatatatttggcagcaggagcggcctctcacttgcttcgacgtatttctctatctatctatacggttcaagggaccgaagaaggtagagagagaaacttgaaggggagaggaaggagatacaggttcatgttcatttaggtgtcagttcatctgatttctcagaagcaaaatgttgtttggagctcagtgacaccatcttgtaatgcatgtgccttttacgggaaatggaggatcattctgtccatcccaagtctaagtctaaccatggctccttgtcaggaaatggttatgagatgaaaaatccaggccatgaagtttgtgatagggattcatcatcagagtctgatcgatctcacccagaagcatcagcagtgagtgaaagcagtctagatgaacacacatcaactcaatcagacaatgatgaagatcatgggaaggataatcaggacacattgaagccagtattgtccttggggaaggaagggtctgcctttttggccccaaaaatagattacaacccatcttttgcttatattccttatactgctgatgcttactatggtggcgttggggtcttgacaggatatgctccacataccattgtccatccccagcaaaatgatacaacaaatagtccggttatgttgcctgcggaacctgcagaagaagaaccaatatatgtcaatgcaaaacaataccatgcaatccttaggaggaggcagacacgtgctaaactggaggcgcagaacaagatggtgaaaggccggaagccataccttcatgagtctcgacaccgtcatgccatgaagcgggcccgtggctcaggagggcggttcctcaacacaaagcagcagccccaggagcagaaccagcagtaccaggcgtcgagtggttcaatgtgctcaaagaccattggcaacagcgtaatctcccaaagtggccccatttgcacgccctcttctgacgctgcaggtgcttcagcagccagccaggaccgcggctgcttgccctcggtgggcttccgccccacagccaacttcagtgagcaaggtggaggcggctcgaagctggtcgtgaacggcatgcagcagcgtgtttccaccataaggtgaagagaagtgggcacgacaccattcccaggcgcgcactgcctgtggcaactcatccttggcttttgaaactatggatatgcaatggacatgtagcttcgagttcctcagaataaccaaacgtgaagaatatgcaaagtccttt

SEQ ID NO: 249 - DNA, 1184 bp, Zea mays
aagaacaccgcaagtggagtgatgcagccgagggggccagaccagaggaagggacggcggggaggtggcaaggcgcagagagcaggttcgcttggcggacgcaccgagggaggcgtgtgggagccatgcttcttccctcttcgtcttcgtcttccgcttccgcttccaaaggtaactcctttgggaaaaccgttaacgatcatctgaggtcaactttgagttttgataacaagcaacctccatttgcgagtcaaaactttgactacggtcaaacaatagcttgcatttcatacccgtacaatcgttctagatcaggagatgtttgggcagcctatgagtcacgcaccagcactgccactgtgttccgttcccaaattgctggtgggggttcatccacaagaattcccttgcctttggaattagcagagaatgaacccatatatgtgaatcccaaacaatatcacgggatacttcgcagaagacagttacgtgccaagctagaggctcagaacaagctagtcagagcccgaaagccttaccttcatgagtctaggcatcttcatgcaatgaagagggcacgaggttccggtggacgattcctcaacactaagcagctccagcagtctcacacagccctcaccaggtccaccaccacaagtggcacaagctcctcaggctcaactcatctgcggcttggtggtggcgcagccgcagctggagatcgatctgtgctggcacccaaaacaatggcctcacaagacagtagcaagaaggccgtttcttcagccctcgccttcactgcgactccaatgctgcgcagagatgacggcttcttgcagcacccaagccatcttttcagtttttctggtcattttgggcaggcaagcgcgcaagctggcgtccataatggaagtcagcatagggttccagttatgagatgaccggtttgcgaaccatagctggtgatccaggcgtctagggtcaacttcgctgtggtgtcttagtctctcaggcaattcatccttggcttaatttctggctttttattagaaggtaccaaaatgtgttccataccgttgtggccacagagcccataaaccagggggtttgatggttggcactcctacccaaactattgttgcagtggtgtttgttagaataaaccttgactattattctgtaca

SEQ ID NO: 250 - DNA, 1250 bp, Oryza sativa
gttgcatggacaagggccacctcggtggtggcggaggaggaggaggtgggctgctcgctctggacgcgtcgccgcgcccgctcggcttcttgaacctgctctccccgccgccgttccacaggtcgaccatggaggccgacgacagcggcggtggcggcggcagggcacgcaggtccgtcgaggtggacttcttctccgacgagaagaagaacatgaagaagagccgtgtctcgggcggcgtcgccgccgaggcggacgacgccaagggacccgccgccgccggcctcgccatcaagaaggaggacctcaccattaaccttcttcccgccgggaacaacgcgaggagcgaccggtcgatggtggtcgacgacgacgcggcgtcgcggccggatcacgaggagaagagccggagcagcaacgagctcgcggcgatgcaggcggagctgggccgcatgaacgaggagaaccagcggctccgggggatgctgacccaggtgaccaccagctaccaggcgctgcagatgcatctcgtcgcgctcatgcagcaaaggcctcaaatgatgcagcctccgacccagccggagccacctccgcctcaccaggatggcaaggccgagggcgcggtcgtgccgaggcaattcctcgatctgggcccgtcctccggcgccggcggcgaggcggcggaggagccgtccaactcgtcgacggaggccggcagcccgcgtcggtcgtcgtctaccggcaacaaggaccaagaacgtggtgacagcccggacgcgccgccgggcgcgccgaacgccgtgccgctcaacgccgcgcggccgggcgcgccggcgccgcagttccaggtgccgctgccaggcggagggatggcgccggcgttcgccgtgccgccgcaggtgctgtacaaccagtccaagttctccggcctgcagatgtcctccgattcagccgaggccgccgccgccgccgccgccgccgcgcagttcgcgcaaccgaggccgccgatcgggcagctgcctggccctctctccgacaccgtcagcgcggcggcggcggcgatcaccgctgaccccaacttcacggtggcgctcgcggcggcgatcacgtccatcataggcggccagcacgcggcggcagctggcaacagcaacgcgaacaacaccaacaccaacaccacgagcaacaccaacaacacaagcagcaacaacacgacgagcaacaacaccaacagcgagacgcagtaataa

SEQ ID NO: 251 - DNA, 1890 bp, Sorghum bicolor
atcatcgtctgcatcgctcgccctcatttcactgggagcatcgatctatctatcagcttgctcattggccatcttcgatcgtcttccatggagaggctcattgccggcctacttggcttcctattgattgcgtcagtaggaagccatgcagctcgtgctccggatcaatactggaagtctgctcttcccgacactcccatgccgacctccctctcccaactcctcaacaccccaggcttcagcatgtagatactataacacctcttccctgcttatatacgcagccggaggcacgaccgtcaacgtcggctggggcggtgtccacgtcgatgctgggcacggtaagcccgggggtacgacggttgacgtaggcaagggcggcgtcggcgtcaatgttaaccctggcagcagcggcaggaagcccggcggcaccacggtcggcgttggtgggaaagggggagtcggcgttaaggtcaaccctggctatgggaagcccggcggcacgacggttggtgtcgggaagggcggagttggtgttaacgtcaaccctggctacgggaagcccggtggcaccactgttggcgtcgggaagggcggcgtcggcgtgaacgtcaaccctggcaagcccggcggcactacggtcggcgtcggcaagggcggcgttggcgtcgacgtcaatcctggctatggcaagcccggtggcaccacggtcggcgtcggcaagggcggagtgggcgtcaacgttaatcctgccaagccgggcggtaccggcacaaccgttggcgttggcaaaggcggcgtgggcgtcggcgtcaatcccgggtacggcaagcccggcggcaccacggtcggcgttggcaagggcggggtcggcgtccacgtgaacaacccgcgcaagaagcccgtcaacgtcaacgccgggcctttccagtacctgtacgccgcatcagagacgcagctgcacgacgaccccagcgtagcgctcttcttccaggagaaggacctccagcagcccggtaagaaggtgaccgtccagttcgccaacaccgcgaccgccggcgccaagttcctcccgcgaagcgatgccgaggccatcccgttctcctccgagaaggtccccgagatcctgagccgcttctcggtcgacccggactccgtcgaggcggcggagatggcgcagacgctgcgcgactgcgaggcgcccgcggccaagggcgagaagaaggcgtgcgccacgtcgctggagtccatggtggacttcgccaccaccagcctcgggaccagccacgtgagggccgtctcgaccgtcgtggccaaggagggctcgccgaagcaggagtacaccgtgaccggcgtcaagcccgcggccggcaccggccacgacggccgcctcgtggcctgccacgcggagccgtacgcgtacgccgtgttcgcgtgccacctgacgcagcagacgcgggcgtactcggtgtcgatgctcggcagggacggcacggccgtggacgctgtcgcggtgtgccacgccgacacgtccggctggaaccccaagcacatcgccttccaggtgctcaaagtgaagcccggcacggtgccggtctgccacttcctgccgcaggaccacgtcgtctggacccgcagcggctgaggctgctggatggctgccgtttgctctcgtcgcgccgcctgatggagtgatggtttcgttttcattgtattctagtagcctctgggcatactgtttatgtttccagtatagtgcttgatgtttgtatggatggtgtggccagccagtatcgaccacctgcttagattctgttgtatagttctaaataaacaggcatgtctttacggttactgctctgagcctgaacaaacttctgttgatccccg

SEQ ID NO: 252 - DNA, 1598 bp, Sorghum bicolor
ttcccttccccttcctcctgcatttccgtcccatcggcggccctctcccaccctcgtggcgacggccaggcgaccgcagccgccgccgaggtcatcgccagcgaccaccgctccaccgggtacaacagatttatgcttggaacttctgcagaaaagcacacaacagtaatggggcacgaccatatttctcgtataaagatgcatatggcagaaggttcttttggtgacaggaaccggtgccagcaacccgggtgcaatgaggttgtcgatggaagggtagtgtactgcaaaactcacagtggggagttttcatgccaacagttcagtcacctccacagcggaatggagagctcaggtttatcggtgccccatgttaatgacaaccagttcaagggatctatttccattgcagtgccatgcactgagcaagagttacatgtcaagcatgaagggaatgatcgaggtaaactaaaggatagttctgggtacactttggatcagactgcacaatttgtcttctctggggcaggcttgctttgcaagaacgaaaactgcagcaagcaagcacatgagaactcgatctactgtaagttgcatagcggtgttagcaagggctgcatggtacggggttgtacgagaggtgcgcatggaggcacacctttgtgcattgggcatggaggtgggaaacggtgtgtgatccctcaatgcccgaatgcagcatgtggtcaaggccgtagtgaccgctgtgtaaggcatggcggtggtaagagatgtaaatttgaagggtgtgcaaagggcgcacaagggaacaccgattattgcataagacatggtgggggaaggcggtgcaaatttgaaggatgtacaaagagtgcacaaggacgcacagatttctgtattaagcatggtgggggcagtcggtgcaagttccaaggatgtggtacaagtgcaaaatggggaacggatttctgctctgtccacaggaagagtttgttgggcggtgacagtgccatccctgaagctttgcctgccccgtcagaaaaacgacgtcgtgccaagaagcctaaaaaggcagcgaagctgtctgagacctcccaagagaatgtcacaacagcagctattgctggtaacagcacgcaacacatgggcgttcttctcatagctacccctgttactaaccatgacatgttaaccaagggtgtgacagtggcggcgccagctgcaatagcgcccacgcagatagtggcgccacttgccatcaaatcaccaacaccatctggatcggtggctgcaggagcagagagggaggcgggagcaagcagggagatgctgggtctgtagaaagatggtggcagtgcataatttgggaggcttggagacacctggccagatagctctctaattattgctttttagactgagaaacctcgaaactttaggaaggttgcaatttgacaggcttgcaccgtcaactgactagttatgtcctgtgcctttctcatttgtaaatctgtaatgcgaatctctagttgttcttgtgtatgttctcttgtgccttgtaactttggacaataagcaataatattgtgtcattgcct

SEQ ID NO: 253 - DNA, 1795 bp, Sorghum bicolor
ttggtggagatggagtgccagagatggaagagcaaaggtgttaacataaagtacgaggtcagggggaaccggaaggggtacaaggccggcgcactcaaggaaggattgaagcacgactacgtcaaagactgcgaatacattgccatgtttgacgctgacttccagcccgagtccgattttctcctcaggactatcccgttccttgtgcacaacccggagattgcccttgtccaaactcgctggaaattcgttaattccgatgagtgtctgctgacaagattccaagaaatgtcgttagactaccatttcaagtacgagcaagaggcagggtcctcggtgtattcattctttggcttcaatgggacagctggtgtctggaggatttcagcgatcgatgatgccgggggctggaaggaccggacgacagtggaagatatggacctggctgtccgtgcgatgctgcagggatggaaattcgtttacgtcggtgacataaaagtcaagagtgaattgccaagcacattcaaggcataccggtttcagcagcacaggtggtcatgtggaccggcaaacttgttcaagaaaatgatggtagagattttagaaaacaagaaagtgtcactgtggagtaaaatccacttatggtacgatttcttcttcgttgggaaggttgctgctcatacggtgacattcatctactactgctttgcgatccctgtgtctgttttgctgcctgagattcagatccctctctggggagttgtctatgtcccgacagccataaccctcttgaaggctcttggcacaccgagttcatttcacctggtgatcctctgggttctgtttgagaatgtcatgtcgttgcaccggattaaagctgcaataagtggtcttctggatgctggtggacgagtcaatgagtgggttgtcactgagaagttgggtgacaccaacaaggcaaagcctggcaccaatggatcagatgctgtaaaggtgatcgatgtaaagctaacagaaccccttattccgaagctagtgaagaggcgagcaagattttgggagaggtaccactgctcagaacttttcgttggaacctgcatactaatgtgtggtttctatgacttgcttcttgcaaagaagggatactacattttcctcttccttcaaggcacggctttccttgttgctggttttgggtatgtcggaacactacctccttgcactgcataagctgtcatggacaactgatacacctgcttaccagaaactgagcaagcaaagctcctctctcttgcacatatggaactacggaattcaatgatagttgagcattattcccatcagtcttggccagacatgatccactgccaagaaggttcagataccatcatcattctcctgtcactcttgatcagattgagacaaccattctttattgccaagaaggccattcaaatagtgtcgccatttcaaatttataataacagtgtttagtgaagcatcatgacaaaaaaaaatgattggtgcagcagcattttgttcaaatctgaacatctggtagagatgcagttcacagtcgtgaaagaattgcagctgctgtaaatggaatagcactagctgccaatttctgtagatctccgaacttgtagtttttttgaatttattgatattactcagttcagatccataatggaagattgtgggcttcctcagttcataacttgtgtaggcttaaaacttgtaaatgtaaattgttattaacactaataattttgttgaatccgggcagttcttg

SEQ ID NO: 254 - DNA, 2041 bp, Sorghum bicolor
aaaggatcccctccgtccaagctatataacccggcgccgctgtacgccgcttcctccatctgctagctggccggccggccagtggaaacagcacccagagctcgctcgcctctgcccctgcccctgcccctgcccctggccgcccgagatccggcagtgccgtccgtcgcgcggtcgcgccggccaaagggagcgacccctatccatggaccccgccgcccgcggtggcggccacagcatcgcggaggaggcggcgcggctgtgggctgacttccccgtgcgcgtggactgggcggccgtggcggcgcaatgcgcgtcgctgtgggcgcacgcgcgggcgctggtgctcgtgccggcggtgcggctcctggtgttcctgtcgctggcgatgaccgtcatgatcctcctggagaagctcttcgtctgcgccgtctgcctcgccgtccgcgcgttccgcctcggcccgcaccgccggtaccgctgggagcccatcaccgccgccggcagcaacggtgccgccgccggagacgacgaggagtctggcggcggcggccacggcgaagccaagtaccccatggtgctggtgcagatccccatgtacaacgagcgggaggtgtacaagctatcgatcggggcggcatgtgcgctggagtggccgacggagcgcttcgtgatccaggtgctggacgactccacggaccccgttgtaaaggatttggtggagatggagtgccagagatggaagagcaaaggtgttaacataaagtacgaggtcagggggaaccggaaggggtacaaggccggcgcactcaaggaaggattgaagcacgactacgtcaaagactgcgaatacattgccatttttgacgctgacttccagcccgagtccgattttctcctcaggactatcccgttccttgtgcacaacccggagattgcccttgtccaaactcgctggaaattcgttaattccgatgagtgtctgctgacaagattccaagaaatgtcgttagactaccatttcaagtacgagcaagaggcagggtcctcggtgtattcattctttggcttcaatgggacagctggtgtctggaggatttcagcgatcgatgatgccgggggctggaaggaccggacgacagtggaagatatggacctggctgtccgtgcgatgctgcagggatggaaattcgtttacgtcggtgacataaaagtcaagagtgaattgccaagcacattcaaggcataccggtttcagcagcacaggtggtcatgtggaccggcaaacttgttcaagaaaatgatggtagagattttagaaaacaagaaagtgtcactgtggagtaaaatccacttatggtacgatttcttcttcgttgggaaggttgctgctcatacggtgacattcatctactactgctttgcgatccctgtgtctgttttgctgcctgagattcagatccctctctggggagttgtctatgtcccgacagccataaccctcttgaaggctcttggcacaccgagttcatttcacctggtgatcctctgggttctgtttgagaatgtcatgtcgttgcaccggattaaagctgcaataagtggtcttctggatgctggtggacgagtcaatgagtgggttgtcactgagaagttgggtgacaccaacaaggcaaagcctggcaccaatggatcagatgctgtaaaggtgatcgatgtaaagctaacagaaccccttattccgaagctagtgaagaggcgagcaagattttgggagaggtaccactgctcagaacttttcgttggaacctgcatactaatgtgtggtttctatgacttgcttcttgcaaagaagggatactacattttcctcttccttcaaggcacggctttccttgttgctggttttgggtatgtcggaacactacctccttgcactgcataagctgtcatggacaactgatacacctgcttaccagaaactgagcaagcaaagctcctctctcttgcacatatggaactacggaattctctcgagaaa

SEQ ID NO: 255 - DNA, 3768 bp, Sorghum bicolor
gcctcgccgaccggatcctcgatgcccacgtcttctcccccggcggctcggcggggaccctcgccgggagcgtcaggtaccaccgcgacgccggcaggaggatggtgttcctgcacctcgcgccgctccagacggcggttggaggctgcggcgacggagacctaccggagatgctcttcatgttctctgtctgccatgtaattatatttctgcaagatggcttcaggtttaacacacaaaccttaaagaagttccgactgctgcaatcttcaaagcatgctcttgctccatttgtcaagtcattggtagcagctgcgatgcctgccaaaactgttgcctctgacaccccaacaagagcaacccacagggcttcctccatctcccctccagcacgccgtggaggtcacgccggtcgtcagtcctcggccatctcacttatgtccgggaccagttcaaatccttctgtactgccaggccaatgcattcctgtattgctctttgtctttgaggatgatgtgcttgatgtttcaagtgctgcagcaagttctgatgatatgggtgattcatcttcatcaaatcagtgttctacctctgatggattatcaaaacaaagtttagcttcaaaaagttctggttcagtggttatgcttgcccgggcagcaaacaaatctgagggcaattcagcgaaaaagctacactcgtcattggagggacagatccgtgtcttgctcaagaagtgcagggtacttgcaggcatggagccagggcatattggcccgaggggtgtaagtaacatgagtcatcatttacccctgttctcgcttgatacctcgagggttgttgcactgttggaacggtacatcaataagaaacaggagccactggacatcattgcaggattatttgaagattctttgtgctccaaattgtcattggatattctttcactggaaaacaactaccacccaacaaaccatgatgactttcagttgatcaaggattttatatttcggcagtctgatgccctgagaggtagagggggatattcaagcaatgcaagtgccgggtctgtttctggtgttggcatggtggctgctgctgctgcagcagcagcagcatcagctgcatctgggaaaccagttaatgcacctgatctccctacttttgataaatggttgtccataagtacctctattctaactgcactgttgagtggaagaaatgtgctgagtggtcagtctgaaagcaagactcatacaagtcctattgagaagaatgaccaacttcctgctgcaggatctaatgctattgagatcgcattatcgtgcttggaaagtaataatggtctgaacatgaaattttcttcatcatggtgccaaagggtgcttccggctgctaaggagatttacctgaaaggtttgcctgccttttaccccacaagcatgcatgaagtgcagctacagaaggcattgcggtcctttggctcgatggttaaaggaccagcagtcagggtattcttaaagaagctagaagatgagtgccgggcaatatgggaatctggaaggcagcaatgtgacgctgttagcctaactggcagaccatgtaagcaccgcaggcatggcgatttctcttcatcagatgcaatgaaacaacattctagtggatatgtattcctccatgcatgtgcttgtggccggtcacgtcgccttagagatgatccttttgactttgagactgccaatgtgtcttttaattgtttccaaaattgtgatgatctactacctacccttgcgcttccaagaggcagtgatgctggttcgttttcagtatcttcttggcgcttggtgcgtctcggaggagccagatattacaagccaacaaaggggcttctccaaagtggatttagctccaaggagaggtatcttctaaggtggattatatctgttggtaaggggcaagtgagaaatggcattcgttctaatactgttacttcatccacaagatctggtatgaaccctcagactcccccaatagtcactggtgaagtaaaatctgctgtaacccaagtcacagcacaaattaaatctgcaaagctcgaaagttctggaaaacaacctgatatggaaccaatgagcaactcaggtattaattttggtaaaggtctgccaaattttactatgaaaaaaccctttgctgaagttgttgctggcaccacatcaaaagattccgagtttcctgctcttcagcagatgaggccaccgaaacctggtggtcgaaaagatgagcgccaaatgaatataggagaccatcctaatggccgaggtcatgcggctgtcagccaagggcctgtagctgaaactgaatctgcgaaagcaagcagaaacaagagtagtgaaaattctgatgggaagccctttttacagatagggagcaatatagtaccagtgattgttggaaatgagactagagaaactagtcagcaggtacaacagtttgttgtgtatgttggatttgagcatgagtgtccctatggtcatcgcttcttactgtcagagaaacatatgaaggagattgattcttcctgtttgttgtatcaaagacctcatgtaaacaaagaagcagaaggcaagcatgcacaaaagttgctccaaaatgcatctggtttaattgcatctgcagtggacataaacagtgcacagaaaaacagtaagccattgcaatcatcagggagaaacagccagcagcaatcactgcagctgagggttgatgcagagacttcacaaccttctccttggctttcagatccacagaatggcaaaaggggggagcactattttccaagcattacaattgatgatggcggagaagcattttcactgatgaacagaaacttgccaatatatatgcactgtccacattgcaagatctcagaaaggaaggaacatcaagatgtaaagtttgctggtgccgtgtcacaacttcaacggattttcattgggtcatgcttgccatcgaatgtctctgatcatgatcgagaaggatcattcagtattgggtgccgagttatcctcccacctgagagctttcttacaatgaggcttccttttgtctatggtgttgagacaaaagagggaagtacatttcccctcaaaaactttgagcaacaaccagaactcacagcatggcttgttggaggcacagccttgcaaatcgtatcggtaggggacgtcaccgagaaagaaaccgttatgaagtgatagacatgtcatctaaagctttactggttttaacatgttctagtcacgtgtcagtgatgtgccattggatgcaggatggatgattatattcctgtctgaggttttacttgtactcctgaacttgtgctgctaagctgttgatacaactattgcttcctttcactgtgctccaagcattttggaatagaagtttcgctgatatctacctggatggtgtatatagatgcacgcagaggggacaggccacaggcaattgcgccgttcttgtcttgtatacgaatatttgccaccgtgccaggaggtaaagtttagctgggtctgttttttttaggactagtggatcaatccgattccttgacagaggcctttgggctgggagcttctgtagtaagattattagttcagttgagctgtgtagtgcaatattttttggccagttgatgtgctgttttattcctttgcgtgttgagaaatcgggccttggaatataaaaaacgagaagaaggaattt

SEQ ID NO: 256 - DNA, 855 bp, Sorghum bicolor
gcttcggaggaaccacgagttaagaagcttcttgtccaacacatcgagacagtacaccattctgaagctgttgaagatgttttacaatctcttttgcttgctgactcaaatgccaaggagataaagagcaagacaaaggagtggaatgacaaaatcaagcaagacaataaaccagagcagctacgatcagcagccagacagaggcatgaggatatgggaagaaatgctcggtttgcacaaatatggaagagtcgaaaaggagaaaaggatgatgctgatgattcattgagagaaatatgccacctttatgatgctgtccaagtagatcctgatgatgagaagcatccagcagaaccacggcaagtcttgatttctgacaacttatcaggtcatttggaatgtagagttgcattgtttcatgttccttacaatattccctgcaggattacctctttcgaagagggtgctgttctatgcaactttcttccgcttctacgcaagtacttgccatcaactgcagaggaaattgaggcagatataatttcattggcacaatcagaagattctgaagtctatgatatctatactgtcaaggaggtggatgatacaaacatggaggccacgtcagcagcttcatatccaaggttacaagtggatgatggagaagacgaatgctacgaagattgcccgtatgacacagatgattcaaatgctgaagacaatccgcttttcgattatcctgatgaattttccgaggacgaggatgatgatcgcaacgatgaggatccttttggagacgaagaagggtctgacaccgattacgagaaggaagaagtagaggtggaagaggatgag

SEQ ID NO: 257 - DNA, 1561 bp, Sorghum bicolor
atggcgccttcgccgcgccggcccgtgctggtgctgctcctgctgctcgcgcttctctgctcccacgtcgcgctctgctcctccgccgagccggggaagccaaagcccaagcccaaggtctccggcggccgcaaggcgctgctggcggacgacgacggcgaggaggtgcccgccgccaagccggccaagacggccgcggcagggaagaccaagaagaagctgctcgccggcgacgccgcttccaagaaccagaccaaggttgccaaggctaagaagccagagtcagccgctgccgccgcggcgaaagggaccaccaagaagcctgctggcaaagcggctgcgggtggggatgccgccattgccaaggtctccaaggcccccaaggtccctaaggcggaaaaggcggataaggccaaggtcccgaagccggacaaggctgcggcggcggctgctggtgccaaggccaagggcgccgattcaaccaagcctgccaaggtttccaagacgggcgccaaggcggtaaagccacccaagacgggcgccaaatctgaggttgccgccgtggctgggaaggcgaagaaaccggcagcggccaattcgaccgcggatgccggtgccaagccggtcaaatccggcaagaaggcggcgcaggtggttgccgacgcgaagccgaaggtgaatgccaccgtcgtgagcaaggaggagtcggcggcgacggaaacggcggaggtggaggttgaggaggacgtggtgttcgccaaggaggcggaggagggcacggacgacctcatctccgagttccgggacctgcccagtcggctgcaggagacgctgatgcccgacctggcgcgcctctcgcaccactccaaggcgtacctgtcagcggcgaacgccgggatcgccgacggcgtgcgcccgatccttggcggccggtgggcggcagtggccgcctccgcggcgtcggtggcggtgctcctgctgccgctcttcatgctcaccgcgctggtgcggcgcatgggcccgtacctgcctctcctccaccgtgcgctgctgctggcgcaggcgtacctcgccatctacttcgccacgctcgcgctcgccgcggccgccacggggctggagccactgcgcttcttccacgcggcctccccggccgcctacgcctggacgcaggccgcgcagtccctcggcttcatgggctacctcgtgctacagatggtggacctcgtcgccgtcttctccggcgccgcctcccccgaggacgacggcaatggggacgccgccaaggcgctcggcctcgcgcagatggtggtgggcctcgccgtcggcctgcactactacgccgctgtcttccaccgcgccgcggcgggggaggcgccccgtgccaactggcgtgtctacgccgtgtacgcggcctgctttgcgatcgtctgcgcctgcgcgcgcgccgagaggaggaagaaggcctacctcgcgggcaccgacggcgccgccgaggagtggaagaagagctgagctgctcatctcctctcgggaaacatggctagatcagaatttggga

SEQ ID NO: 258 - DNA, 659 bp, Sorghum bicolor
gaggatgagctagaattgtctaggcagaagcagcctgatactatggcaaacaggagagcacagaaggttgccaggttcaaacgtcaaaaggctgcagaaacgaagctccaagagatcagagagagaaaagaaaggcgtggacgctcattgagagcagctgctttatctgccccaattgaagctggagaggaagatgacctggaggatgatggagaggaagaaagagagtatgctgcaggcttggttagctaccatctcattggctctctgcaaggcgtttgatcttctcgacatgctaaagaaggaagaagaaatgcttctagctgtaaaggaaaggaaggcaaaggtttggtatgaccacctagcagtggtactacctctcagagatgcaactctagaaaccagttcaggagtcaatatcctttttgtgttgaccagttcagcaaggacttatacatatttgcatggaaaactatttcaatggttactgattaagcaatatactggttgagagtggtagatatgaaatttaggatgtaaacttcaaaggaaacaatgttgattccggcgcatgaatgaaatggatattggagatttctttctgccgttattaaatattatcttagccgtattatagaaatgtctataaagtagagttt

SEQ ID NO: 259 - DNA, 1204 bp, Sorghum bicolor
atcgtcatggaggtttgcaatcttggcaataatgccatggaggctcagcagcagcgcgagcagagccaagccgggggctgcaccgacgacgacccggcggcggtgctgacgtgcctcacattcctggagcagaagatcgcgcacctccgcgccatcatcggcgcggcgccgcgcccgccgcggcagatggtgtcggccgagctcagctgcatcgccgtgcagctcgtctccatctccaagagcctcgccgcgaccggtggcggcggggccgcggcggcggaccaggacgacggcgccgcccgatcgccggccccgaacgacggcgacagcgactcgtccgaccatgacctcctccacgccgaggacgactacggcgacggcgacggcgacagcgatggccgcatgccaccggccggctcctacgaggtgatcgagctcggcaaggaggagatcctggcgccgcacgtgcactcgtgcaaggtctgcggcaagggcttcaagcgcgacgccaacctgcgcatgcacatgcgcggccacggcgaggagtacaagacggcggcggcgctcgccaagcccgcctccgcgccgtcgtcctcgctggcccggtgcttctactcctgccccttcgtcgggtgcaagcgcaacagggagcaccggagcttccagccgctcaagacggccgtctgcgtcaagaaccactaccgccggagccactgcgacaagagctacacctgccgccggtgcaacgtcaagcgcttctccgtgctcgccgacctgcgcacgcacgagaagcactgcggccgcgaccgatgggtctgctcctgtggcacctccttctccaggaaggacaagctcttcggccacgtcgccgccttcgacggccacgcgcccgcgctgccaccggaggacgacgacgctgttaccaatgctgtcggcctcggaactggctctggtcgcctgacgacgatggacaccgaggcagtgagcagaatggcgagcatggagttcttcccggacgccgtgctcgatggtctcgtctgttctgacatcaagggcttcgcgctcatggatggtggacaaggacaatatctggaggacgacgacggacgagggtcgctctcaccattgccaatggggctcgattcctgtgattttgatggatttgatctctttggggcaccagcaattgatttctgaactcagg

SEQ ID NO: 260 - DNA, 1102 bp, Helianthus annuus
gttcatacaggaaaaccaggaaaacgaacagatgttggtgttgggaaaggcggcgtcggcgttcacaccgggaaacctggaaaacggacagatgttggtgttgggaaaggcggtgtcggtgttcacactggaaaaccaggaaagggaacccatgttggtgttggaaaaggtggtgtaaatgtgcacacgcgccacaaagggaagccagtttatgtaggtgtgcgtaaaggacctaatccttttgtttacaagtatgctgcttccgagaatcagctcaaggataatccaaatgtagcattgtttttcaaggagaatgatttgcatcaaggcaaagaaatgaacctacacttcactaaaaacgacgaaaaagctacgtttttaccacgaaaaatcgctgattcgatacccttttcgtcgaacaagcttccacaaatctacgaagagttctcagttaaacctgactcgatggaagccgagatcatgaagcaaacacttagcgaatgcgagagtacaggcatcgaaggtgaggagaaatactgcgcgacttcattagaatccatggttgattttagtacaaccaaacttggtaaaaatgtgaaagcgatttcaacagaagtaagcgctaaagaaagtaccccgttacaaaagtacaaaatcgaagtcgctaaaaagcttgcagcaaataaagctgtggtttgccataagcaaaactacgcatacgcggtcttttattgccataaaaccgctagtactcaagcttatgcggtttctatggttggtgcggacggtacaaaggtgaacgcggttgcagtttgccatactgacactgcaaaatggaacccaaaacatttggcgtttcaagtgcttaaagttaaaccggggactgttccgatttgccatttcttacctgaagatcatgttgtttgggttccatacaaataaacttagcaagaaaaagacagaatacggtttatggttggtgtctagcgaccctatttatggtgttgttgcttcctttgtttatcagtatttgtaaagtaatgaaataagtactacatgcgttttacttaatcaagggtatcctaattattgtactaaaaaa

SEQ ID NO: 261 - DNA, 801 bp, Solanum lycopersicum
attagaaccactagtcacaatcctttagcatcaacacaaaatcttgaatgatcactttgtttgaagaatagggcaaaaaacctaaatcaagaatcatcaatggcttccaccattagctacacttcactttgttctttacttaaactcaaccaaaccaaccaaaaaaccccattttccccttccctttcttctccttcttctccttcttctttggttaaaatcaagaaccagttgtgttttagcagcaatttttgtagccacttaaataaagcttcaatctttatggttaaagcttcagaaacagaagcaactcagtcagaaaaagaagaagaagacaaatatgaagaatatgaagttgagattattcagccttatggacttaaatttactaaaggtagagatggaggaacttacattgatgctattgctcctggtggttttgctgataagactggaaaatttgctgttggagataaagtcattgccaccagtgcagtgtttggagaggaaatatggcctgctgctgaatatggaagaacaatgtatactatcagacagagaattggacctttgctcatgaagatgcaaaagagatatggtaaggtggaagaagtaggtgaattgacagaaaaggaaattatcagagctgagaggaatgctggtttcattagtgacagagttagagaaattcaagtaacgaatgctcggaggaagaaagaacaaaaggagcaaagagaaagagaacttcgcggaggactaaaactttctaagaatggcaaatacgaagaagcactcgaaaag

SEQ ID NO: 262 - DNA, 1168 bp, Solanum lycopersicum
ggaaatattccacattgctgtaagaaagatccaacagttgttgacatgctgcctggaactccttacaaccaacagattgcaaattgttgcaagggaggagtgatcaactcatggggacaagatccggcaaccgctgttagctcgtttcaagttagtgttggtgctgctggaacaaccaataaaacagtgcgagtacctaagaacttcacattaaaggctccaggtcctggttatacttgtggacctgctaaaattgtgaaatcgactaagtttgtctccgcagatgggagaagagtgacacaggctatgatgacttggaatgtcacatgcacttactcacagttcctagctcaaaagactcctacatgttgtgtgtccctctcatccttctacaatgacacgattgtgccctgcccgacgtgcacttgtggctgtcagagtaatggcactcagcgcgggagttgtgtagatccagaaacgccacacctagcttcagttgtatcagaccatgggaagaacaattatgttcctttggtacaatgcacaaagcatatgtgcccaattaggatacattggcatgtgaaactcaattacaaggaatattggagagtgaagatcactataacaaacttcaattacaggatgaattatacacaatggaacttagttgtccaacatccaaactttgacaacctcactacattattcagctttaattacaagtcactgactccgtatggatcaatcaatgacactgctatgctatggggtgtgaagttctacaatgatctgctcatgcaagcaggtccttcaggaaatgtccagtcagagctactattccggaaggatgcatcaactttcacttttgagaagggttgggcttttcctcacagaatttatttcaatggagacaactgtgtgatgcctcctcctgatgcatatccattcttgccaaatgccggttcacgatgggaggcgtctctgattacattagtggtgacattgatgtcttcaatggcagttgtccttacatacatttaaaaaattatcatctgtgtatagttcaatgtatatctgttttagtttgttatctctgggttgacatccgtgttattgccaagattggtgtgtgagttggtatggctgagcaatggccatgcgttctgac

SEQ ID NO: 263 - DNA, 1052 bp, Solanum lycopersicum
ggaggctatatttcattggtcattgccatgtaattccaattttttttccacttgtaaatcattctgttgccttctctctctctctttcttctctccctctgcttgaaattgtactgacatggctgctactaaatggggtttctctaattgactgtacaatcacacaaagcttaaagttttcatcttggtacaactattacttcactaggaacataattcctttagattttcaagagaaaaggtgtgagttgctcttgtataaccatgaatactactatattttccaaaggaaatgaacgggttgtccagaatcaatctgttggaacattgtgctctgctccttggtggagtaatggttttatgtctcaatctgtggcttatgctgagccttttggacaattgaaatctgcatctgtggagcagcagcctaaggggaatgcaacagagttcactatttcctctggtgattgcaaatcttcggcaaatgggcaaaaacttccgaacattcaggctgcttcctctgttcgtgcagctaatatggactatcgaggtcactttgagctaggttttggtcagtccctgatttatgcaaaacatccttatggagagcaatgcattgggttattttcggcttatgctcctcaactttcgggccgcattatgctaccattgaatttggcttctgatgaaggtccgatattcgtaaatgccaagcagtatcatgggatactaaggcgtagaaagaccagggctaaggaaatggagaaaaaagctcttaaaccacgcaagccgtacttgcacctctctcgccatctccatgctttgcgccgacctaggggctgtggtggtcgtttcttgaacacaaggaatatgaatggaactatgaaggctggaaaaaccaacaatatgttcaagacaggcgatgttcaaaacttttaccccaccggatcccagaattctgaagtgctgcagtctgatagcagcaatttgagctcaccaaaagaaacatctggcagtaggttcttcgattcatcagggatcgctaacatgta

SEQ ID NO: 264 - DNA, 1002 bp, Solanum lycopersicum
gctttctcttcctcgtaaaagctttgtatatacgacgtacaaagtttataaataaaaaatggcgagcgaagaaaggagggagacgctactaaataagagagaagagaaacactactacgaaaattgccccggttgtaaaatggatcttcacaaagcgggtcaaacgggtttacccgttaaggagcttttcactatatgggttgtcgtgcttggtacagcacttccaatatcatctctctttccatttctttatttcatggtaagggactttcacattgcaaagagagaggaagatattggttcctatgcaggttatataggttctgcatttatgtttggaagaactttaacatctgccttttggggtgttgtggctgaccaatatggacgaaaaccagttataattttcggcacttctatagtgattattttcaatactttttttggtcttagtgccaacttttggatggctgttgtaacaagatttcttcttggtagtttaaatggtttgcttggaccaataaaggcatatgctgctgagatttttcgtgaagaatatcaagcactaggaatgtcaacgattagtagtgcatggggcattggattgattattggtccagctttaggtggttttcttgctcagcctgcagagaaatatccagacttgttctcaaagggttcattatttgggagatttccctatttcttgccttgcctatgcatatcagtgttcgccttggttgtggctgttggttcattttggattccggaaacattacataaccatgattcagaaaggccgcgtccagattcttacaaggctctggaggctgcatcagatacaaaagacggaaatgaatcagccccaaaagaaaatctttttaagaactggccgttgatgtcatctatcatatcatactgcgttttcgctcttcatgatatggcgtactcagagattttctcattatgggctgttagccccagaaaatttgggggcttaag

SEQ ID NO: 265 - DNA, 2279 bp, Solanum lycopersicum
ataaagttttataagttcacaacattttttttgttatataaaaataatctctagccatttttttttcactaaaatttctccattacaaatcaaaccattttttgttgatccaatggcatcatcaattgtacaaaatggacatgttaatggagaagctatggatttatgtaagaaatcaattaatgttaatgatccattgaattgggaaatggctgctgaatcattaagagggagtcatttggatgaagtgaaaaagatggtggatgaatttagaaagccaattgtgaaacttgggggtgaaactttaacagttgcacaagttgcatccattgcaaatgttgataacaaaagtaatggggtcaaagtggaactttctgaaagtgcaagggctggtgtgaaagctagtagtgattgggtaatggatagtatggggaaaggtacagatagttacggtgtgactactggatttggtgcaacatctcatagaagaactaaaaatggtggtgcacttcaaaaggaacttatcaggttcttgaatgctggagtttttggaaatggaacagaatcatctcatactttgccacattcagcaacaagggcagctatgcttgttaggatcaatactctgcttcaaggctactctggcattagatttgaaattttggaagcaattactaagttgatcaacagcaacattaccccgtgtttgccccttcgtgggacgatcactgcatcgggtgatcttgtcccgttgtcatacattgctggtttgctcactggcaggcctaactccaaggctgttggacctaatggtgagaaacttaatgctgaggaagcgttccgcgtggctggtgttactagtggatttttcgagttgcagcctaaggaaggacttgcacttgtgaatggtactgcagttggttctggtatggcatcaatggtactgtttgagtccaacattcttgctgtcatgtctgaagtcttgtcagcgatttttcgctgaagtgatgaacggaaagcctgaattcactgactatttgacacacaagttgaagcatcaccctggccagattgaggctgctgctattatggaacacattttggatggcagctcttatgtcaaggcagctcagaagctccatgaaatggatcctcttcaaaaaccaaagcaagatcgttatgctcttcgaacatctccacagtggcttggacctcaaattgaagtcatccgtgcagcaactaagatgattgagagagagattaactcagtgaacgacaacccattgatcgatgtttcaagaaacaaggccttacacggtggaaacttccaaggtacccctattggtgtctccatggataatacaagattggcccttgcatctattgggaaattgatgtttgcccaattttcggaacttgtcaacgactattacaacaatgggttgccatctaatctcacagcaggaaggaatccaagcttggattatggactcaagggagctgaaattgcaatggcttcttactgctcggaacttcaattcttggcaaatccagtgactaaccatgtccaaagtgctgagcaacacaaccaagatgtgaattccttgggcttaatctcagcaaggaaaacagctgaggctgttgacatcttgaagctaatgtcatcaacctatctcgtggcgctttgccaagctatcgacttaaggcatttggaggaaaacttgaagagtgctgtcaagaacacagtaagccaagtagctaaaaaaactttgacaatgggtgctaatggtgaacttcatccagcaagattcagcgaaaaagaattgctacaagtcgtggaaagagaatatttgtttacctatgctgatgatccctgcagctccaactaccctttgatgcagaagctgagacaagtccttgttgatcaagcaatgaagaatggtgaaagtgagaagaatttcaacagctcaatcttccaaaagattgtagctttcgaggacgaattaaacgctgtgttgcctaaagaagttgagagtgtaagagctgtttttgaaagtggaaaccctttaattcctaacaggatcacagaatgtagatcatatccattgtacaggttggttagacaagaacttggaacagaactattgacaggtgaaaaagttcgatcgcccggtgaggagattgataaggtattcacagcattttgcaatggacaaatcattgatccattgttggagtgtctcaaaagctggaatggtgctcctattccaatctgctaa

SEQ ID NO: 266 - DNA, 462 bp, Solanum lycopersicum
tcagctacacatggagatatggaccagaacactagagacataatcatgcgtgagtttcgctctggttcttcccgtgtccttatcacaactgatctgttggctcgtggtatcgatgtacaacaagtatcccttgttatcaactatgatctcccaactcagccggagaattatctccatcgtattggaagaagtggaaggtttggaaggaaaggagttgcgatcaactttgtgacaacagacgacgaaagaatgttgtttgatattcaaaaattctacaatgtggtcatcgaagaactcccttcaaacgtcgctgacctcctctgaaaacttcatctttataaggtgagtaccaagcttatagtatagaagaaatcattttaaactaccattattatctatcgtcaaaaacgcacccctggcattaatgttgctaagaattttgcagtcagtatgtagtaaggt

SEQ ID NO: 267 - DNA, 1351 bp, Sorghum bicolor
acacagcccgcgcgctcacgctcacgctcatgccagtgacgccaaccatggagatcgacctgcacgacgtgcgcgcggcgcgcgtgctgggccgcggcgccatgggcacggtcttcctcgccgtggacggcgccgccagcagcggggaggcctacgcgctcaaggtcttcgacaagcgctcccctgcggcgtcgaggccggccgcgggcgccgacgcggcgcggcgcgcgcggtgggaggtgtccgtgctgtccaggctcgcgcacccgcaccttccgtccctgctcggctgcgccgagacgcccgacctgctggcgtgggcgctgccctactgccccggcggggacctcaacgagctccgccacgcgcagcccgaccgcgtgttctcgcccgcggccatccggttctacgtcgccgaggtggtgtccgcgctcgccgagctccacgccaccgggatcgcgtaccgcgacctcaagcccgagaacgtgctcctccgcgccgacggccacgtcatgctgaccgactttgacctctcgcggcagctccctccgaggtcccccgccgcgtccacgtccacgtcgacctcgtcgtcgtgctcggcgacatcgtccccgccgccgcctcaggcccagagccacagacggttgaagaacatcttcaagaggagcgagtccgcggtgaccgcgtctacttccggacaggaggaggaaccgcgcaacctcgcctggtacctggacagaagcatcgaaggcggcgtcgaccagatcaagaaggcgaaatcggccagggtatcgccgatggaacgcgccaagaagctctcgagcttcttgtccgccgcagcgggagagcggtcgttctcgttcgtgggcacggaggagtacgtggcgccggaggtggtgcgcggcgacgggcacgagttcgcggtcgactggtgggcgctcggggtgctcgtctacgagatgtgccacgggcggacgccgttccggggccggaaccggaaggagacgttccggaacgtgctgctccgggagccggagttcacggcggacgcgcggcggcggtggccggagctcacggacctcatcgcgaggctgctggagaaggatccttcgcggaggctgggcttcgccggcggcgccgacgaggtccgggcgcacccgttcttcgccggggtggcgtgggacctgctaggggaggtgtcccggccgccctacatccccgcgccggccgatgacattgtctcctgcgacgggttcagcgtggtggagtacttcgataagcttcaccagcctccgctgtcgccggcggagcactcgcccgaggacgacctcttgccggagttctgacaccg

SEQ ID NO: 268 - DNA, 2244 bp, Glycine max
gctgagaaaatgaaaactcactactttcctctcttttcattctttttcttcttcttcttaatctccatcaacgccaaacttgatctctacccttcagactacaaggcactcctcactctgcagaaggacctccgagtcaacggtcaactcgcggcggcaactgaggcgtgcgaaacggagggcgtgctctgcgagcggaggcggctctccggcaaggaaacctacgcgctccgaatcaccagactcgtcttcaaatcgaacaacctaaatggtgttttgtctccttccatcggacgcctcacggagctcaaggaactctctctctccgacaaccaactcgttgaccgagtccctccccaaatcgttgactgccgaaagctcgaaatcctcgacctcgccaacaacatcttctccggcgaggtcccctccgagctctcctccctcacgcgcctccgcgtgctggacctctccaccaacaggctctccggcaaccttaattttctcaaatactttcccaatttggaaactctttcagtagccgacaacctcttcaccggaagagtccctccctcggtccgctccttccggaacctacgacactttaatttctccggcaaccgcttcctcgacccctctctacaatcatcctcaccagacacaattctctctagacgttttctatcagaagacggtgatggtgatgttcctgcacctgctcctgcacctaataactcacagaagaagaaatccaatgcttctactcatgctgctgctgctgcacctggtcctgcacctaaccataccaataagcacaagcacagtaagagaaaactcttggggtggattctggggtttgtagcaggggcactggggggaaccttatcaggattcgtgttttctttgatgttcaagctcgctctcgcgttgatcaaaggaagaggaaggaaagcggggcctgatatctatagtccattgatcaagaaagcagaagatttggccttcttggaaaaagaagaaggaatcgcgtcgttggagatcatcgggcgcggtggctgtggagaggtctacaaggcagagttaccgggaagcaacgggaaaatgatcgctataaagaaaatcgttcagcctccgaaagacggtgctgagttagcagaagaggacagcaaggttctgaacaagaaaatgaggcaaattcgatcggagatcaacaccgtgggacaaattagacacagaaaccttctgcctctgctggcgcacgtgtctagaccggaatgtcactaccttgtgtacgagttcatgaaaaatggaagcttgcaagacactctgagcaaggtcgagaggggcgagagcgagttggattggttgtcaaggcacaagatctccctcggtgtggctgctgggcttgaataccttcacatgaatcacaacccacgaatcattcatagagatctcaagcctgctaatatccttcttgacgatgacatggaggcaagaattgctgattttggactcgccaaggctatgcccgattacaagactcacataacaacctccaatgtggctggcactgtgggctatattgctcctgagtatcatcagatactcaagttcactgataagtgtgatatttacagttatggagtgattcttggtgtattggtcattggtaagcttccttctgatgatttctttcagcacactgaagagatgagtttggtcaagtggatgaggaagactttaagctccgagaatcccaaggaggcaattaattcaaagctgctggggaatgggtatgaggagcagatgcttcttgttttgaagattgcatgcttttgcactatggatgatcccaaggagaggcctaacagtaaggatgttaggtgcatgctgtcacagatcaaacactgaatctgctgtatgtttaagtatgtgaaatattgtgtaccatatttgtgccaaagtgtgcttgtttaagaatatagttgataactagaggatcaatgttggttcatagggtaaataatgaaccgatgtaatcttgtttcctttatcacggattgctgaatttctttggaaaaagaaaaattcagcactgcgatgatctatgtataatctagtctgtcacaactagtttccactttacatgtttatggatacaccctgaaaataaaatagttttacgttgtttccattgttcttatttgagtactgttattgttaaaagatatataagaacaaaacaaa

SEQ ID NO: 269 - DNA, 1210 bp, Populus trichocarpa
ggaaaataaaatccagcaaatcacaaactactatctccttcccctctcttccctctcctcttttctccatcgtcagatctaaaaacttttcattctttctttctctgtttctccctctctccctccaactctcgcgccaaatacaaaaccaccctctcctctccctctttctttctccagtgagatggcggataatccgacgagtccggcggcggggagccacgagagtggtggtgaacagagcccgcggtcaggggtgagagagcaggatagatacctgccaattgctaatataagtaggatcatgaagaaggcgttgccagctaatggaaaaattgccaaggatgctaaggatactgttcaggaatgtgtttctgagtttattagcttcgttaccagcgaggcgagtgataagtgtcagaaggagaagagaaagacaatcaacggggatgatttgttgtgggcaatggcaacattaggattcgaggagtatattgatccacttaaggtgtacctggctaggtaccgggagggtgatgcaaagggatctgctagaggtggagatggatcttctaaaagggaagcagttggaggtctgcctgctcaaaatgcacagtttgctcttcaaggatccatgaattatataagcccacaaggacagggacagcatatgatccttccttccatgcaaggcaatgagtaggatttggctttgcttttgtcaattcaatgaattctagtgctggcagaactttttagtttcaacacttgtagagtcttttgcattagttgatctgattgaaaccaaagcgctatgcattttggcggctttggtatttggttattgttggaggtggtttaaatgtggttggtgccgtcatcagcagagcagcttactggtcagattaagttatgtaaatttgccctttatctaatatatactcttccgagtattgctaggatggtttcttggagcatctgaaagcatacctcataggcctgtcgatgttagcctctgatttttcggaatgttaacatgttatatgcttatcaattgtcaaattaatggacctatgctgaaatataacgatcagaaagggaggaattgttttgctcaagaaattcatttcctgtagtcgcatattccctttataattgatctcgtttgcaagctcttgggtcccaatcagattgggtacccaaacttttt

SEQ ID NO: 270 - DNA, 1816 bp, Zea mays; identical to SEQ ID NO: 214

SEQ ID NO: 271 - DNA, 2179 bp, Zea mays; identical to SEQ ID NO: 215

SEQ ID NO: 272 - DNA, 1783 bp, Zea mays
cctgctccccccctccccccaccccccagccttcgcggcaccggcagacggggaggaagcaccgccgcccgcctccgcgggagagcaagcgggagaagacgaaccggatctggaagcgaacctaagctgcgcggtttgtcattgaaaacagtgcgaagagtgagatgggtgaagctctgctaagagattcttcaggtttcttcttggggatggaatcattgccgtgtccatcttggtcagttgagttggagatgggtgcaaccctgaacaaggaattgagaactcgagattgttcgtggggctggaatgttgggcccatctgttccagatggactcctacaactacaactacgccagtttcttccacgacgaggctccgtccttctacccgcacgttgcggtgccgccctccccggagctgcccatcggcctcattgcctcgccaggggagccggagccgcccttcgcgccgccgatgccggcctcgttccaggactacacgggcgccgtgggcgtgggcgtaggggtgagagcgccgttcgggggtgccagcgtgcacgggcaggcgatcgacgcgctgggcgggggcgacgggcagcgcgagcagagcatggcaatggcggaggacggggaagagccggcgccccggcggcggcagccggcgggaggccccgccgccgccgccgtcgagagcagccgcgggttccggcacatgatgcgggagcggcagcggcgcgagaagctgagccagagctacgccgacctgcacgcgctggtggcggcccggtccaggggcgacaagaactccatcgtgcaggccgccgccgtgtacatccacgagctcaggggcgcgcgggaccagctgcagcgccggaacgaggagctcaaggcccgcatcctgggccacgacgccgggcagcagtgcgtcaaggtgcagttcgaggtggacgagccggcgtccgccatcgactccatgatcggggcgctcaggcgcctcaagggcatggacgtcagggccaggggcatccgctccagcctgtccgggcgcaggctgtggacggagatgaatgtggagaccacgatggcggccgacgaggtggaaaggggcgtggaggaggctctgctgcaggaagtggagaggaagcagcagcagcagcttggagctgggagcgccgcccctggttttccaggcccgtcatcgcacgtgcaaaacgtgttttgacacgcgatcctcccccacaacaagaagcgaaaaagaaacatgaaccccgagcctcatttcttgattcttttttctttaagaaccggatgcgcaaaacgagcatccgcgtccctggctctattgatttatttttaagtagaaatcggtgctgtttgtgtacaagtgttgtcgcagcctccaagtgggattttgagcacgtgtataaagttatagggctcgtgttcttacaacacacacacacaaaaaaaaaaagagacgtgcggacagtgaggactgaggacatgtgggcagggatcaagtgggccggaggaagcgggcgagaaatggggtcgagggacaggcacgttccggtcgtgccgtgtggagattcctagccgcggcggcaaccggtcaccagtgtgctctcgttgtccttggtctctactactcctgctacaaatggtgacgcctttattttatcgtgtggagtggatgtaaatggacgccaccacaataaattagagtactaaattaattttagtttaaaaataaataaataaaaatagagtatgattctaatcc

SEQ ID NO: 273 - DNA, 539 bp, Sorghum bicolor
gttttagtttcccccctatatagaagcttaaagctgaagacggatttttctgccacttaattacattaggaaactaagcttaaagctgaagacggatcttctgccacttaattacattaggaaactaagagccacagacagctgatatcactaagaatgatgccttcttcctgtggggttgtttttacttcctccacttgttgtaccaagttaagatgatctacttgaacctgataagtttcatccgggaagcacttttcggccaattgagtaagcatcatgctgtcttttgtctctagggttgtttcccagttctacctgtgtactgccaactttgctggacctggtttaccgtgatatgctgtttcttgcaacctttcctgtgcagcttactcgaggtgcctagctgttcatttcttgttatgtgcatgtctattgccttgttcttcctagatgagacagatatgtggaccggtactaaatgcccatggattgtaactttgatgtgtaaaatggcgttcaatgatttctgagttctg

SEQ ID NO: 274 - DNA, 469 bp, Sorghum bicolor
atatatatatgtctcattgctgcctttagatatttgtttttaccacctaccatgcttgtattttttgtgtgtttgtttatcaaatgcacctctagtatatgcgatagcttcgtgtcatagcctatctgaacaatatattatctgaaacttatttgcttagtatgacttattctgtctatcaaggaaaccttctgctactaagtacaataatatatttgcaggctcgaataattgattgacatgctattgattgtcactaattaatttttatctccctcatgtataattgcagtgggcagatggatcagaggagaaaggcgtcataacctgatgccacttgctagctgagaatgtgtctcctttcttttttttcatctgtttcttttattttatcttgaagaacaggagggcaatgctatcttagtcttctattccttttgctacttcattcttttcgtttggttgtggt

SEQ ID NO: 275 - DNA, 882 bp, Hordeum vulgare
ctcagcgttaacaggccaagatgaagctcgtcgtgctctcggccctgctcctgctttctctcgtcgccgtctcctcggcggaggaattcgatttcttctaccttgtgcagcaatggccagggtccttctgtgacacgaagaaggggtgctgcttcccggacaccggcaagccggcgacggacttcggcatccacgggctctggcccaactacgccgagtgcaagacccgcggcgagctcgacggcgccttggagatggtgaccaggcggaggaagaagtgctggccggagtcctgcaacagcgagcgcctcaagctctgggagatcagggacctggtgacggagctggacgccaactggccgacgctggcgtgcaagggcgggaagagcttcgagttctggacccacgagtgggagaagcacggcacctgctccaacctggaccagcacggctacttcgcgacggcgctcggcttcaaggcccgccacaacctcaccagcatcctcgccgacgccgggatcgtgccgtccgacaccgagacctacttcctcagcagcatcagggacgccatcagggaggggaccgggttcacggcgaacctggagtgcaaccgtggcgtcgacggcgagacgcagctgttccaggtgtaccagtgcatcgaccgcgacggggagaacctcatcgactgcccgctgccgatgcagggcaactgcaaagacagggtccagctgccggccttctgattaaatttgagttctaattgaacatccattgccgccgcccgtcggggtgtggcggctgattggctcgacgcggccggccatctgcacggcgcgcggctggattacgtgatggatgtacctttgtgttggttatcggttc

SEQ ID NO: 276 - DNA, 1454 bp, Hordeum vulgare
aaaggatcctcacgctttcggttcctaatccaaccacctccaccatcacctccgtgctccccgtgccacgcttcccctgtccgtccgagagctccaccagctagcagccatggacggcaagggctacaccacaccgccgaccgcgcctgcgccacaggccgaggcaggagcgcctcacttctatcccccgacggagcacggcaccgcgccacagccgggatcgcaggtctcctatcccccgatgccaaaggccatggatggccaggacgccgccgcgccacagccgggagcgccgccgcacccgtcctccccactcacgcagcaggccatggagctagagggcaagtacgccgccccacagccgggcactggagctacgccgtcccccccgacgcagcaagccgtggacggcaaggacgccgccccgacaccgcccgccgagtcggcgcggtggggtacgaggcagatgggtccgccagcggcgccgggggcgcatcccgagaaccagcaggcagcgcagtggacggccacgcgcggggaccaggagctgccgccgtacgtcatcatgggggcaccggagccggcgccggcggcgtcggcgcggcggactgacaaggaggccagggacagccccatggagcacatcctcgacttcttcaacacctggagccgcaaggccgaggagctctcctccaacatctggctcaacctgaagacggcgccgtccatgtcggacgcggcgatggggaagctgagcctgggggcgaaggcgatcacggggggcggcttcgagaagctctacaagcagaccttcggctccggccccgacgagcacgtgaagaagacgttcgcctgctacctctccacggccacgggccccgtcgccggcacgctctacctcaccaacaccaacgtcgccttctgcagcgaccgcccgctctccttcgccgcgccgtccggccagaccgcctggagctactacaaggtcatgatcccgctcgccaagctcgccgccgtcgagcccgtcacggccaaggagagcccgcccgagaggtacatccacatcgtcaccgtcgacgcgcacgacttctggttcatgggcttcgtcagctacgacaaggccgtgcgccatctgggcggggcagtctcctcgtcgcagcaccacggcgccgcgccggcgccggcaccggcctacgagtgatcggctgattgccgccgtgtacgtgtgtccgtggctctctgcttttgattgccgtgtgtgtgctctgctttttgcgcggatctgtttagtgagtgcttgtgtagtggatgtccgtgtgattatgtattgttgtctatacgcttttgtcgaaatttaacgcgttcttcttaatttccttcaaatattcctctccacctcttgtacggtatatttgtgttactcggagttgggcactgtatttgaactcgagttt

SEQ ID NO: 277 - DNA, 1985 bp, Hordeum vulgare
ataagctagcaagccgctccaaggccccaggacgccatggccacaaaccctggcctcttcagcgagtggccatggaagaagctcggcagcttcaagtacgtggtgctggcgccatgggtggcgcacgtcatccagcaggtggcgaccaaggggtggcgcgaggccgacctgggctacctggtgatcctcccgtcgatgatgctccgggtgctccacaaccaggcctggatcacggtgtcccgcctccagaacgcgcgcggcaagcggcagatcgtcgaccgcggcatcgagttcgagcagatcgaccgcgagcgcaactgggacgaccagatcatcctgagcgccatcctcttcttcctgggcgcgctgcacctgccgggcgggcagaacctgccgctgtggaggacggacggcgccgtgctggtagcgctgctgcacgccggccccgtggagctcatctactactggttccaccgcgcgctgcaccaccacttcctctacacgcgctaccactcccaccaccacgcctccatcgtcaccgagcccatcacctccgtgattcatccatttgccgagctcgtggcctacgaactgctcttctcgatcccgatgatcgcctgcgctctgacaggaactgcttccatcatgacgtttgagctctacatgctctacatcgacttcatgaacaacatgggccactgcaacttcgagcttgtgcccgcatggctcttcaaatggttccctcccctcaagtatttcatgtacacaccatcgttccattctctccaccacacccagttccggacaaactactctcttttcatgccgctctacgactacatatacaacacaatggacaagtcgtcagataagctgcatgagaaatcactcgacaacaagcaggaagccatagatgtggttcacctcacccatctcaccagcctgcagtccatctaccacatgaggcccgggttcgccgagttcgcctccaagccgtacgcctcaaagtggtacatgcgcatcatgtggcctctatcgtggctctccatggtccttacatgggtgtatggttcttggttcaccgttgagaggaatgtcatggagaaactaaggatccagtcatgggccataccaagatacaatttccattatgggttgaactgggagaaggaaacaattaataacctgattgggaaggcaatatgtgaagctgacaagaagggagctaaagttgttagtcttggactcctgaatcaggcccagagcctcaacggaagtggagaactttatctacaaaagtacccaaagttggggttaaaattggttgatggaaccagtctagctgctgcagtggttgtcaacagtattccacaaggcacggatcaagttgttctttcaggaaacatttcaaaggtggcttgcgctgtggcagcagctctgtgcaagaaaaatatcaaggtcacaataacaaacaagcaagactatcatttccttcagcccaaaatgccagaagatgcagctgacaacctaatattatcaaaaaccggcatcgctaaggtgtggataattggagaaggtgtagatgccgctgaacagttgagggcaccgaaaggaacacggttcatcccgtactcacagttcccaccaagaatggtgcgcaaggactgctgcacatactcgacgactccagcaatgagcgtgcctaaaacactgcagaatgttcattcgtgcgagaactggctgccaaggagggtgatgagcgcgtggcgcatcgctgggatggttcatgcgttggagggatgggacgagcatgagtgtggagacaaggtgctcgacatggacaaagtttggtctgctgcacttctgcatgggtttcgccccgttactgaggattgatgggtctggttgcattgcaagtcgagtgaataagcgctacgcagatgaagatgccgtatgctcgctggagccatgctaaggaagatgaa

SEQ ID NO: 278 - DNA, 1442 bp, Hordeum vulgare
cagatatgcagcgtctcgcctcctcccggcggctcctccaggccgcgctcgcccccggccgggcgcattccagcctcaccgccgccgcggtcgccgccgcgccggagaatggcgccggcgcccccaagatgccgccgttcgcgtacacgccgccgccgtacgacgggccgcgggtggcggagatcgcccagaagcgggcccagttcctcagcccctcgctcttccacttctacgaccgccccttgaacatagtcgatggaaagatgcagtacctgtttgatgaggatggtcgccgctaccttgacgcttttggtggcattgctaccgtttgttgtgggcactgccaccctgatgtgattgaagccatagtcaaccaggcgaagaagatacaacactccacagttctgtatctgaatcatgcaattgcagactttgctgaggctttggcggccaaaatgcccggtgatctgaaggttgttttcttcacaaattctggcacggaggcaaatgagcttgcactgatgatcgcacggctttacactggttgccatgacattatttcgcttaggaatggataccacgggaatgcagctgcaacaatgggtgccactggtcaatgcaactggaaattcaacgttgtacagacgggagtgcaccatgcacttaatccagacccatatagaggcgctttcgggtcagatggagagaaatatgccagagatattcaggaaaccattgactatgggactacaggaagagttgcagggttcatttcagaagccatacagggagttggtggaattgtggaactggcgccaggatacttacctgtggcctacgatatggtaaggaaagctggtggcctctgcattgctgacgaagttcaggcaggagttgcgcgaactggaagccacttctggggatttgaagggcacggcgtcatcccggacatagtcacaatggcaaagggtatagggaatggaataccgataggagcggttgttacaacgcctgagatcgctaaggtgttaacccgcaggagttacttcaatacctttggtggcaaccctgtcagtactgctgccggccacgctgttctcaaagtgctggagaaagaaaagctccaggaaaatgcgttcgttgttggctcctacctgaaggatcaacttaacgctctgaaagagaagcatgacatcatcggcgatgttagggggaaaggcctccttcttggtgttgagctggtgaccgaccggcagaagaaaaccccggcgaaggctgagatcgcgcaggtcatgagccacatgaaagatatgggcgtgctggtggggaagggcggtttcttcggcaacgtgttcagggtgacaccgccgttgtgcttctccaaggaggactccgacttcttgatcgaggtgatggacatcgcgctgtcgaagctgtgataa

SEQ ID NO: 279 - DNA, 1037 bp, Hordeum vulgare
cagctcgagcaagaaagaagtagtagtagcagtgattaagatttgattcgtgaaaatgttggccatcttccagaagcaggtggcgcacgcgccgcaggagctcaacagcccgcgcgggagcaccgccaagcccaagaaccccgacgagatcctccgcgacttccacgccgcccacccctccgacgccttctccacctccttcggcggcggcgccgccctcgcctgcgtcgccgcgcagccacgcaacctcgccgccggcggataccagaggatgttctgcgggctggacgacatctactgcgtgttcatggggacgctggacaacctgagcagcctgatgcggcagtacggcctcaccggccggtccaccaacgaggcgctgctggtcatcgaggcgtaccgcaccctgcgcgaccgggggccctacccggcggaccaggtggtgaaggacctctcgggctccttcgccttcgtcgtcttcgacaaccgcggccggtccgggtccggggcggcggtgttcgcggcgcagagcacggacggcggggtgccgctgcactggggcgtggcggcggacgggtcggtggtgatctgcgacgaccgcggcgtggccaaggccgggtgcgggcggtcgtacgcgccgttcccgccggggtgcatgttccacagcgagggcgggctcaagagcttcgagcaccccatgaaccggctcaaggcgttcccgcgggtggacagcgagggcgtcatgtgcggcgccaacttcaaggtcgacgccttcaccaagatcaactccatgccccgcgtcggcagcgccaccaactgggccgccacctgggacgacgccgccatctgatctcatccacccggcgccggcgacgcccgcctagattgctcgtcggacttctgaatgacgaacctgggcttgctgcattttacttgcttttttccctttctattggcaacgtatgtacatcctgatctgatctcagccgtgcgcgtgtgtgggtgtgggcgcgctgacacatacggttgtttgcttg

SEQ ID NO: 280 - DNA, 678 bp, Hordeum vulgare
tctctgcttcacgatcttctccactgagctcgcgaggaggagagccgcatcgatctattcccgaccatggctgcgcgagcgctgaccgccgccgccggccgccgggtggccggccggaccgggacgacgccgcttctcgcctcgtgcaggaacggggccagcatgagccactcctcggccacggccggcgcgcggcgggaggaagagccgtacaaggacgtgcatggcccggcggcggcggcagcgatgacgggggcgcaggtggaggcggcgctgaaccgcaagaacgtggaggtgctccagggcgaggaggaggaggaggagcacgtcgccacggtgctgccggacgagaccgtcagcatccctgccggtgacggcgaggaggacgcgtcgtgggtgcccgaccaggacacgggcgtcttcggccccgcccacgtcgacgccacccacggcgacggcggggcagcgcatcccgccccgccgcacctgttcggaggcgccacggccacggcgtactccacgcacgggtcggtgctcgaccaggcggtgttcctccgggaggaggacatggaggacgtggagaggcccgccgccgtcgacatggccaacgccaacgcagacgtcaacggcagcatcaagaacttctagtgtcggtttcagtttcaggcgatctgttag

SEQ ID NO: 281 - DNA, 2031 bp, Brachypodium distachyon
aaaggatccgattctcgatccattccaatcccccgtttcccgttctctcttctctctagtggtgtcttctctgagggaggaggcgtttccatttgcatggacaagggccacctcgggggtggcggaggaggaggagggctggtcgctctggacgcgtcgccgcggcctctcgggttcctcaacttgctatcgccggcgccgtcgttccacaggagcatggaggcggacgacgttggcaccggcgccggtggcggcggcggcggcagggggcggaggtccgtcgaggtggacttcttctcggacgagaagaagaacatgaagaagagccgggtctcggccggcggcaccgatgcggaggggcacaaggacgccggcgccggactcgccatcaagaaggaggacctcaccattaacctccttccggggaggagcgaccggtcgatggtggtcgacgacgacgcggcgtcccggcccgacaacgacaagaacggcaggcaagacaccaacgagctcgcggcgatgcaggcggagctgggccgcatgaacgaggagaaccagcgcctgcgggggatgttgacccaggtcaccaacagctaccaagcgctgcagatgcatctcgtcgcgctcatgcagcaaaggacccagctacttccgacccaaccgcagcaacaacaaccgcctcccactcacgaggatggcaagatcgagggtgctatcgtgccaaggcaattccttgacctgggcccttccggcgccggcgcaggcagcgaggtggccgaggagccgtccaactcgtccacggaggtcggcagcccgcgccggtcgtcttccaacgggaacgaggaccctgagcgcagcgacaacccggaaggcccgtcaaccgcgggatggttgccgggacgggcaatgaaccagcagcaactgggagcggcggccaagggccacgaccagcaagcccaggaggccaccatgaggaaggcccgcgtctccgtgcgcgcgcgatccgaagccccaattatcgccgatggatgccagtggaggaagtacggccagaagatggccaagggaaacccttgtccacgcgcgtactaccgctgcaccatggccaccggctgcccggtgcgcaagcaggtccagcgatgcgccgaggaccggaccatcctgatcacgacgtacgagggcacccacaaccacccgctcccgccggccgccatggcgatggcgtccaccacgtcggccgccgcgtccatgctgctctcgggctccatgcccagcgccgacggcagcgcgggcctcatgagctccaacttcctcgcgcgcaccgtgctgccgtgctcctccagcatggccaccatctcggcgtccgcgccgttcccgacggtcacgctcgacctcacccacgctccgcccggcgcgcccaacgccatgccgctcagcgcgctgcggccgccggcgccggcccccgggcagttccaggtgccgttgcccggcgccggcggcgggatggccgggccgacattcgcgatgccgcagcagatgctgtacaaccagtccaagttctccggcttgcacatgtcgtcgtcttccgacaccgcggagttcgcgcagccgaggccgcagatgggccagctctccgacaccgtcagtgcggcggctgcggcgatcaccgctgacccaaacttcacggtggcgctggccgcggccatcacgtccatcattggcggccaacacgcggccgccgctgccggcaacaacaacggaagtaacaacaacgtcacgaccaccagcaacaacaccaccaccaccaccagcaacaacaccaacagcgagacccaatgatcaatcagtttcttcaattcacccagctgatcggtgatgagttcagaattcagataggttccaagttatacatgcctgcttcgattcctcttctttgttcaggattaggttcttgagatgtttctttggtttttgttaccctccgggacaggtccgggctcgaccatggacgatatacagtcactcgagtat

SEQ ID NO: 282 - DNA, 1283 bp, Brachypodium distachyon
gaagaacgtacggctcgaagcttggtgtttttacgcctctacggttagaacaaatggatccatggatcggcagccagccatccctgagccttgacctgcacgtcggcctgggccaccaccaccgccaccaggcgcagccggtggtggcgctcgtcaagcccaagatcctcgtcgaggagaacttcttgcccctcaaaaaagaccccgaggttgcgggccttgaggcggagctgcagcgggtgagcgaggagaaccgccggctgggggagatgctgcgggaggtggcggccaagtacgagtccctgcagggccagtacagcgacatgaccaacgccgccaacaactacagccacccgtcctccgcgtccacggagggcggctccgtgtccccgtcgaggaagcgcaagagcagcgacagcctcgacggccacacgccatccccgccaccgccgccgcagctctccttcgtcccggagcagcaggcggagtgcacgtcgggcgagccgtgcaataagcgtgtccggccggcggcggcgtcggaggagtgcaagcccgtggtgtcgaagcggtacgtgcacgccgacccctccgacctcagcctcgtggtcaaggacggctaccagtggcggaagtacgggcagaaggtgaccaaggacaacccttgcccgagggcctacttccggtgctccttcgcgccggcttgccccgtcaagaagaaggtgcagcggagcgccgaggacaggaccgtgctcgtggcgacgtatgagggcgagcacaaccacggccagccgccgccggcgcagccacagcagcagcagcagcacgatggcaagaacggcgccgcgaagccgccccaggcacccgtggctgcggctgccgcgcttcaccagcaacatcagcagcagaagcaggaacaggaagcggcagtcgtgaatggcgaggcggccgcggcggcgtcggagctgatcaggcggaacctggcggagcagatggcgatgacgctgaccatggaccccagcttcaaggcggcgctcgtcaccgcgctctccggccggatcttcgagctctcgcccaccaaggacctcaactaattaatccccatgctccactccactccagtccagcttggggcggccgattagttcgccattgctgcctgcctgcatccacctccgtcaaatcgacggacaacgaagacgcgatcgattccatcagggatccagctgcagctgctctacacagaccagatcttttcttggacgaacacgaagtcaaggcaaatg

SEQ ID NO: 283 - DNA, 639 bp, Brachypodium distachyon
gcttcttctactttgtggtgaaggaaaactgaatcccggtcccagctgatcaagccatggccatgagggctctcgcactgccccactcacaaagctccacatttgggcttcaccagagcttgccatccttcaagccaagcagcgccagtacaagatcagtcagggcctatgcaaaatcagatgaagaggaggagaaggtgcccaagcagtccttgtttgggagcatcacagaggcgctggacttctcgcaggtccgctcggagaaggatgcggagctgctgtatgaagccagggattccattaaagaagaagggaagatgacaagggagcagtatgctgcccttcggaggaagattggtggcacctacaaggatttcttcaagtcatatgttgatgttgatggggaatatgtggaggaaggttgggtggataagacctgcaaagtttgcaagaaagacacaaggggggagccacggcaagttgacaagctaggaagatatgttcatgtcgcttgcgcggagaactcaaaaccgacaaacttcttcgccaaactcttcggcggatgaacttcttttgtactaccaaacgcatcgttttgtgtcgtggttagataaatagatgggtgttatagcctcaagg

SEQ ID NO: 284 - DNA, 1035 bp, Brassica napus
ttggcctcttcgtctttgttttgctatttactccattttctcaaatatttaaaacagtatttttgcttcctttattttcttgtaatggctttctctccgatcaactgcctcattttcgatttggatgacacattataccctctgaaaacgggaatagctccagccgtcaagaaaaacatcgacgattttctaatggagaaatttggattttctgaaagtaaagcttcaagtctaagagttgaactcttcaagagttatggaagtactctcgctggtctcagggcattaggtcacgatgttcatcctgatgaatatcacagtgtcgtgcacggaaggttgccgtatggttcaatccaacctaacagcaaactaagaaaccttctgaacaaaatcaaacagaaaaaaatcatttttacgaattcagacaggaaccatgcgatgaaggttcttgagagattgggtttagaagattgtttcgaagagattatctgtttcgagacaatgaacccgaatttattcggggcaaccacccgaccggatgagcatcccgtcgttctcaagccttcgttgaccgcaatggatgtttgcattcgtgcagccaacgttgatcctcgccgggcggtgtttttggatgacaatgtccacaatattaccgcgggtaaatctgtggggcttcgcacagtcctggtgggaagatcagaaaagactaaagatgcggattacgcggtggagactgtaactgagatagctacggcggtgccggatatttgggcgacggctacagccggatgtgatgacggcggtgagaggatcagccgcagcaagagtgagctggaaggtatggcttcgatcacagccgtcggtgcttgacgtatcgagttggcgaatcgtgaccgttggatattttaacatttagtggttgggattgtacagatggcgttaaatgttgataacgcatgtgaaaaaaaataatagaggtggtggaggatattaatattcatcccatctggaccccaaatgtgaatacgcaatgaa

SEQ ID NO: 285 - DNA, 1180 bp, Vitis vinifera
aatacagcgattgcggagccagttttttttagagagaaaaagaggggaacaatggcgaatgaagatctggagaggggaggtggaatgaagaacaggggcaacaacggccacccaccgggctactactcctctacgtactatgcggaggcttccgagactcactggacttcgtggttgattcccatgtttgttgtagcgaatgtcgctgtttttgtggtggtcatgtatgtcaatgactgccctaagaagaataccgggattgagggggcttgtgttgctaagtttcttcggaggctctcgtttcagcctctcagggagaaccctctctttggcccctcgtcttctacattggaaaaactgggaggtcttgagtggaacaaggtagtttatggggatcaaggatggagactggtcacttgtatctggttacatgcaggtgttatacatctgctcgcaaacatgttgagcttagtctttattgggattcgcctcgagcaacaatttggatttgtgcgtattggaataatctacttggtgtctggatttggtgggagcattctctcttcccttttcattcaacacaatatctctgtgggtgcgtctggtgctctgtttggacttcttggagcaatgctttcagagcttattaccaactggagtatttataccaacaaggctgcagctctgttcacacttgtcgtgatcattgccattaatttagcagttggaattcttcctcatgttgacaattttgcccacattggaggattcttgacgggattcctccttggcttcatgttgttgctccgaccccagtttgggtgggtgaagcgccagcatcgtccagctgatgcccgtgtcaaatccaagcacaaggtttatcaatacgtgttctggttggttgcgatggctttactgattgtcggatttactgttgggttggtgatgctgttcagaggagagaatggaaatgatcattgtagctggtgtcattacttaagctgtgtgcctacctctaaatggaaatgtgacaactgatggaacagaacagttttcaacatcttactaatttcacacttgtgtgtcttccttcatcagcttccttccttcattcttttcttgttttatttttatattttttaatttttttcacactggtgtgctttcttgcgtgtaaatt

SEQ ID NO: 286 - DNA, 1057 bp, Vitis vinifera
tgcctttggtttattgtcagcttctagatagtcacaacttttgtctgaagatactatgacagaaatgatggccaatcattctgactctcaacattttgagctgaaaaacctgaaagaaatgattttcaatgtgaatgaaagagacgttgttaagtcatgtgctcagcattccaatggagagtgtatggagatcaaagagccaactgatcatgtagagatcacagaaaaggaattgctagagaaaggctatatgcagtacggatgtccacattatcggagaaggtgccgcattagagctccatgttgcaatgagatttttgattgtcgccattgtcataatgaagcaaagaatagtattaaggttgacaaggcacagagacatgacattccacggcaccaagtccagcaggtgatatgttcactctgtaacactgaacaagaggttcgtcaagtttgtattaactgtggtgtatgtatggggaaatacttctgtgagacctgcaaactattcgatgatgatacatctaagaaacagtatcattgcaatgggtgtggaatttgcagaattggagggcgagagaacttcttccactgttacaaatgccgttgctgctactctgttctgctaaagaacagccatccttgtgtggaaggagcaatgcatcatgactgccctgtttgctttgagtatttattcgagtcaacggatgatgtgactgttatgccgtgtggacatacgattcaccaaaactgtttgaaggagatgagggaacatttacaatatgcatgccctctctgctccaagtctgtttgtgatatgtccaaggtgtgggaaaaatttgacatggagattgcagctataccaatgccagaaccttatcagaacaaaatggtttggatcctttgcaacgattgtggaaaaacctcgaaagtgcatttccatgtcctggctcagaaatgcctaaattgcaagtcatacaacactcgccaaaccagaggctgagatagtggcaacaaccctcaaccggagatcacaatgatgacccacactcagtag

SEQ ID NO: 287 - DNA, 1352 bp, Oryza sativa
ttacacatcgcaccactctctcttactcgtccatacgccgagtccacgagatctcgccgtagtccatacaccggttgatcggaggtcgtgttgccgccggcggtggccatgatgatgatgggggaaggagtcagcagcgtcccgccgtggtctcacctccccgtgagcggagtcgatgtactcggcggcggtggtggcggtggggatgagatgacgccgtacgtgatcgccgcgctgcgggattacctgccggcgaatgatgtcggggtgggggctgacgaggaggaggaggccgcggcgatggccgcggcggtggacgcgtacgcgtgcgacgagttccggatgtacgagttcaaggtgcggcggtgcgcgcgcgggcggagccatgactggaccgagtgccccttcgcgcacccgggggagaaggcgcgccgccgcgatccgcgcaagtaccactactccggcaccgcgtgcccggacttccgcaagggcgggtgcaagcgcggcgacgcctgcgagtacgcccacggcgtgtttgagtgttggctccacccggcgcgctaccgcacccagccgtgcaaggacggcaccgcctgccgccgccgcgtctgcttcttcgcccacaccccggaccagctccgcgtcctcccggcgcagcagtccagccccaggagcgtggcgtcctcgccgctggccgagtcctacgacggctcgccgctgcgccgccaggcgttcgagagctacctcaccaagaccatcatgtcctcgtccccgaccagcaccctcatgtctccgcccaagtcgcccccgtcggagtccccgccattgtcgcccgacggtgccgcggccatccgtcgcggatcttggcccggcgtcggctcgccggtgaacgacgtcctggcctcgttccgccagctccgcctcaacaaggtgaagtcgtcgccgtccggcgggtggagctacccttcgtcgtccgccgtctacgggtctcccaaggccgccaccggcctctacagcctccccaccactccactggcttccacggcaacggtgaccaccgcctccagcttcatgcccaacctggagccactggacctcgggctcatcggcgacgaggagccggtccagagggtggagtccggaagagccctccgggagaaggtgttcgagcgactgagccgggatggtgccatctccggcgacgccacagccttcgccaccgccggtgttggcctcgacgttgattgggtgtccgacctcatcaactgaggcttccaagtcgctattggaagccccttttgtgagcatcaaggatgatggcatggaggaggagaaggtggcggtaagaagaa

SEQ ID NO: 288 - DNA, 2019 bp, Oryza sativa
agcgagaagcatccatcggaattctcgtcgaccaccgcaaccgccatgggcggcgcccacagccgcgaggacctcgacctcacctcctccgacgacgaggacgacgacgaggagtacgacgcccagaccgccacctccgccgcctctcgagaggacatcctccggacctctaccccctcctccctcgagttcctcgacgcgaagctgaaagcgctcgatctcaagtaccaggcgccgaacgcggcgaagctgtacctccacgtcggcggcgcctccgcctccgcgcgctgggtgccggccgagcggcgggcgacctacgccttcgtcgacaaggcgacggcggcgggcgacagcgattgtggcggcccgaggtgggttctggaggttggtccgggtcccagggtctccgcccccgtcggcccggcgctacagctcaaggcgctccccgcgcagcgccgggccgatttcgccgcgggcggctccgtctgggcgctgcggctgccgaccgacgccgccttccgccgattccggcaggagtacgaccggtgcctgttcgagaacacgtatggcgtcgaggccacggatgagggccggaaggaggtgttcggcgctgacttcgccgcgtgggcgcgccccggtgagtccgacgacgccgtctgggccgacgcagaggactccttcacccctcccgttgcgaccccggcgagagacctgctcgaggagttcgaggaggaggccggggacggcagcatccagagcctcgcgctgggcgcgcttgacaacagcttcttggttggagggtcagggatacaggtggtcaagaatttccggcatggcgtgcacggcaagggcgtctctgtgaggatatctgatggccgtggtggtgggaacgcgtacatgacaccgcagaaggctctgcttatgcgtggcgagacgaatatgcttctgatgagccctggagagactggcactcgccattccaatggcgtccatcatgttgatatagagactggcaaggttgtggctcagtggaggtttgagaaggatggaactgacatcacaatgcgagacatcgccaacgacagtaagggcgcgcagctggaaccctctggatcaaccttcttaggattggatgacaaccggctatgccggtgggatatgagggattccaggggcagggtgcaaacaattgggagctcatctgagtcaccggtgctgcaatggtcgcagggccatcagttctcaaggggcaccaatttccaatgctttgcaagtacaggggatggttcgattgtggttggttctgtggatggcaagattaggctctattccaagagttcgatgcggatggcgaagacagcattcccagggcttggatcaccaatcacacatgttgatgttacttatgatgggaagtggattctgggcactactgatacatatttgatcttgatctgtaccatctttaaggacaaggatggtaaagagaagacaggattcagtgggcgtatgggaaataggattgcagcaccaagattgctgaagctctccccattggattcaattttggcagggtccgagaacaaattccatggcgggcagttctcttgggtaacagagaatgggaagcaagaaaagcatcttgttgcgacagttggcaaatttagtgtcatttggaactttcagcaggtgaaggacagcaaccatgagtgctaccgcgatcaggaagggctcaagagctgctattgttacaaagttgtcctgaaagacgaatccattgttgacagccgtttcatgcacgagaaatttgcaacaaccgactcccctgaggctcctctggtggtggcaacacccatgaaagtcagctccttcagtttagccaatagacgattacactgacagtcttattttgctttgcgtatcatggtgggagaatctactggtttttgtgtagctcactgctgttcctttcgtggtgcgagaatctacaggttcactgctgttcctattggttcatag

SEQ ID NO: 289 - DNA, 1606 bp, Oryza sativa
aaaaggcctctatttatatccggcctcgtcccatctccaccctttcctcaggcaggcgcacatctagcccctgcccccctcctttccccaccctaataataatatttttttccaatccccgaattccccccccaagaactccctcgatccaaaaggcaccgccgattttggtaatctagaaggttctagacgggcgaggaggatgcgggtgctggaggacgacatgttcccgtcgacgccggggaaggtgaagatcgagagggcgacggcgatgaaccgccagctccaccgctgcttcgcgtcgaccagcaccatgttcctctgggcgctcttcctcgtcgccatgaccgcgtcgtacctcagcttccagtccttcgtcgacacctcgtccaagtacttcgccgcctcctggggcgggctgcactgggagcgccagatccgcgcgtccgccgcgccgaggcggccgcccgggtcggcggcgggcgcggggatgtcggtgctcgtgacgggcgccgccgggttcgtcggcacgcactgctccctcgcgctccgcaagcgcggcgacggcgtcgtcggcatcgacaacttcaactcctactacgacccctcgctcaagaaggcgcgcaggtcgctgctcgcctcgcacggggtgttcgtcatcgagggcgacatcaacgacggccgcctcctcgccaagctcttcgacgtcgtgcccttcacgcacgtgctccacctcgcggcgcaggcgggcgtgcgctacgccatggagaacccggcgtcctacgtgcactccaacatcgccggcctcgtcaccctcctcgaggcatgcaaggacgccgacccgcagccggccatcgtctgggcctcctcctcctccgtctacggcctcaacgacaaggtgcccttcacggagagcgaccgcactgaccagccggcgtcgctgtacgccgccaccaagaaggccggcgaggagatcacccacacgtacaaccacatctacggcctctccatcaccggactccgcttcttcaccgtgtacgggccatgggggcggccggacatggcctacttctccttcacccgcaacatcctgcaggggaagcccatcacggtgtaccgcggcaagaaccgcgtcgacctcgcccgcgacttcacctacatcgacgacatcgtcaagggctgcctcggctcgctcgacacggccgggaagagcaccggcaccgggggcaagaagcgcgggccggcgccctacaggatcttcaacctcggcaacacctcgccggtgacggtgcccaacctggtgtccatcctggagaagcacctccgcgtgaaggccaagaagaacgtggtcgagatgcccggcaatggcgacgtgccattcacgcacgccaacatctccctcgcgaggcagcagctcggctacaagccgaccaccaacctcgacgtcgggctcaagaagttcgtcaagtggtacctctcctactacggctacaccaggggatccaagaacttgtgactataatccgccctaattcttctgctaattcttttctttttctttcttctttttttcttcttattctctggccatccagtggagctcttt

SEQ ID NO: 290 - DNA, 2053 bp, Oryza sativa
aattgtgcatcgtgtgatgttctgggcgtttcttgcttcatggcaagcgtaaacactggaggtttacgcctggtgagatgcccaaagtgttataacattctaccagaacctcccagtgttgaggtctacaagtgtggtggttgtgacaccatacttcgagttaaaatccgtcccagcaatggacaaaatgtagcgacgaaacaagtccggcaagactccgatgatttttcggttgctaccaccgcgagcaatggagtgcatcctcaaaagaaggatattgctttcagtggtgctaccatggacagatcccgtacccctgatgctccgagcactgacacagagcatgccagtaatggcacgagcagcaacgataatggccatgctatgtcagttgagaataatgcttctgaagttgcagatactgacaacaaggaagattgcaatttggatggccagaacactagtggaaggatcgaaggcccttctgaagaaataccacccaatgcaaatggcatggatatcgattccgacagagaggaaacctacaatgtggaaggaattgctgagaattcagaggattgcagggtaagaggaggtggagatattgatacagaatgcaacctgagtttacctgagcacgaattgcccttacatcaggagagcaagtcagactccgagctgaaggaagcaaccaaaaccgaagacgaggcaaccaagaaaggccatcttgtgagggtgcaatcccgttcttgcgatcttcgagagtcgcatcgcgcgtcggccggtagctcaatggatttccactctgccaggacttccctccagtccaagagcttcagggcgagcgagccgctccaatcgaagatcatgaagacagtggacgagctgagaggtgacctctctgaatttttcagcaaacctgaagaagaaggagaagacgacgacgatcgcaagccaaaaacagcagcttaccctcctcgtccttcaaagcaagacggctacagcaagcctcgtgcgccgttcacttccagtgtgccactcacggcttaccaccctgcagctaagcattccggccatgtatctcgcctgagcaggtcaggccaagtccctcctcctcctcatcatcatcgtgagctttcctcgctgcgatatcgccggcggcgcagggcctactcgtgctgccacagcgaccagatggagacgatgaggcgaccgtgctcccacgactgctgccattaccatagctgccggccaccaccatgtcaccaccatgaccggccatggaagagccaagaaggcgcgatgcaaaggccgccggtgcaggagacgacgaggcgccgggctccgcccaggcaccactgccggccggtgctgcgcggcgcgccgttcgtcgtctgctccggctgcaaccggctggtccagctgcccaccgacttcgccgtcccgagcaaaggcacgcgccggctgcagtgcggctcctgctcggagatcctctcctactcgtacagggacccggccaagaagaagctccagtctccgtccggcgacggcgaggagtgccagtacagcaccgacgactacgagatccatcaggcggccggcgacgccgacccgttctcgtactcggaggagtacggcgtgatcagctactccaccgaggaggagcagcagccgctgcacgtgtcgaggaactcgtcgttcgacaccgtcgacgacgagcggagcgccaagctgcaccggctgatggggtactcgtcggcgagcgagctgctgcggctgcggcgctcccccgacctgtacgagagcttcggagagcggacgcccgctgcaagaacgagtgacacgaagggcaaggccatctgcgtagctgacgaagaggagcatcccagcgcgaaggtgagaagaggccgtggcttgccgctcccagggatcctgaagaaggggatccatggactggaatccctgaagctcaggtagtcactcgtcaggtcatagcggatgatgtacactactctattttttgaggattaactgattatggccagtttaggga

SEQ ID NO: 291 - DNA, 1154 bp, Oryza sativa
aaaggatccttccaaattccaattgctcatcgcgcttcgaaatcgttgccgagatccatccaatctttgagttaagacatgccgtcagagttcgtcgccgccaggaagaagccgccgccggagttgttgttcgccgccggtcggaagaagcagcagccgccgccgcctggcatggcgttcgtgccgtcggagttcgccgccgccggcgttggcaggaagaggcagcctgcgccgccggtggagatacgccgggtgtgggcgcacaacgtggaggaggaattccggatcatccgcaacgcgatcgatcacttcccgtacgtgtccatggacacggagtttcccggcgtgatccaccgcccgaccaagcaccccgccctgctcaccgccggcgaccggtacgacctcctccgccgcaacgtggacgcgctccacctcatccaggtgggcatcaccctcgccgcgtcccccaccgcggcgcccgcgctcgccttcgagatcaacctctccgacttcgaccagcgcgtccaccgccacgccgccgagtccgtccagctgctggcggagcacggcgtggacctcgccgcgcaccgcaggcacggcgtcagggcgagcgcgctggcgccgctgctcatgtcgtcgggcctcgtctgctcccacggcgccgtcaagtgggtcaccttccactccgcctacgacttcgcctacctggtcaagctcctcatggggcggaagctgccgaggtccatggccgagttcctgaacctggtgcgcgtcttcttcggcgacgaggtgtacgacgtgaagcacatgatgcggcactgcggcggcgagctgtacggcgggctggagcgcgtggcggcggcgctgcaggtgaagcgcgcggcggggcggtgccaccaggccgcctccgacagcttgctcacctgggacgtcttccggcggatgcgggagctctacttcctcaagcatggcgtcgaggcctaccaaggcgtgctcttcggcctggagctcgacatggacatgcccagcaacaaaacaccctcgctgccgctggtggcagcgagatgatacgatctcctctcctccgctgtaaaatttgttgattcgtcgtctgcaagaaaggatttctttcggcagatgtactagctcgagtt

SEQ ID NO: 292 - DNA, 877 bp, Oryza sativa
ctgtcaatacaaccagctgcacgcccattcgtctcaaacacacattctttgattcttccttcaatttccccttttcaactctgtcatcaacttaattgttagaagcgacctaaagattttgcggccgatcgagcatggcgtccccttcggctctgatcgcaatgctcctcgtcatggtcgtcggctgcgccgccgtggcctcggcgatggagctgagtttcattgtcggagatgcgcagggttggaacaccggcgtcgactacaccgcttgggcgaagggcaaaaccttcgaggctaacgacacgcttgtattcagatacgccaggaagcagcacacggtgacagaggtgaccaagagcgactacgacgcctgcaccgtcagcggcaaaccgatcagtgatttcgaaggaggcgcgcttgtgacattcatagcgctcagccccggcgagcactacttcatctgcaaaatcggcaaccattgcgccagcggcatgaagctcgccgtcaccgtctccaactccagcgacaccccgaggccgcaaccttggattgggccttactccacgccagccagcgcgtccgcacacctgcacgccggtggcgccgtcgtcgcggcggccgttgggatcctcctcaatctcgccctcttctgagatcgcattgacgcgtcgagcggcatggacgttggcagggtggaggcaatgcatgattctttgtagcgtttctgatgaaatttgtttgattattttgtttacgttcgatcgtgtatacgtgcgtaataatgatttattggtcttgtgatttattttctccttatattcatttgtatatcctctgatataattttctgtacatctcagcattctgtatgccattc

SEQ ID NO: 293 - DNA, 1156 bp, Oryza sativa
tgtgatacctggactttgagagctagaaatggcaccgacttcgacgttcccggtcatcaacatggagttgctcgccggggaggagcgacctgcggcgatggagcagctggatgatgcttgcgagaactggggattcttcgagatcctgaaccacggcatctcgacggagctgatggacgaggtggagaagatgaccaaggaccactacaagcgtgtgcgcgagcagaggttcctcgagttcgcgagcaagacgctcaaggaaggctgcgacgacgtgaataaggcggagaagctggactgggagagcaccttcttcgtccgccacctcccggagtccaacatcgccgacatacccgacctcgacgacgactacaggcgcctcatgaagcgcttcgcggcggagctggagacgctggcggagcggctactggacctgctctgcgagaacctcggcctcgagaagggctacctcaccaaggccttccgtggccccgcgggcgcacccaccttcggcaccaaggtcagcagctacccgccgtgcccgcgccccgacctcgtcgagggcctccgcgcccacaccgacgccggcggcatcatcctgctcttccaggacgaccgcgtcggtggcctccagctgctcaaggacggcgagtgggtggacgtgccgcccatgcgccactccatcgtcgtcaacctcggcgaccagctggaggtgatcaccaacggcaggtacaagagcgtgatccaccgggtggtggcgcagaccgacggcaacaggatgtccatcgcgtcgttctacaaccctggcagcgacgccgtgatctcccctgcgccggcgctggtgaaggaggaggaggccgtcgtggcgtaccccaagttcgtgttcgaggactacatgaagctgtacgtgcgccacaagttcgaggccaaggagcccaggttcgaggcgttcaagtccatggaaaccgagacctccaaccgcatcgccatcgcttagcaaccccggcctcgctcgctctgttctgtgtactgtgtgtgtgcatgaactgtggtttcgtcgtcgttttgtgatactcctacataggattcgtcagagtggttcgtactgtactgaataaaagagcatgcagctagccaggtgtagccgtgtaggtat

SEQ ID NO: 294 - DNA, 1316 bp, Oryza sativa
cgtttccacttcaccattcaccaacgcaaacgcaaacgcaacgcagcggcggtagacgaagcagcagcaggtagcggttcttggtcggttcgccatggcagcggcggcggcgaggtacgacgtggagaagggagggaggaagagggagggggaggaggagaggtgcggttcgccggcggcggtggcgcagtacccgcagcgggagggggagagggagtggttgccgtggctcgtcccggccatcctcgtcgccaacgtcgtcgtcttcgccgttgccatgtacgtcaacaactgcccctcccacgcctctcgcggcggcgcgtgcgtcgccggattcctccgccgcttctccttccagcctctctccgagaacccgctcctcggcccctcctccgccacattgcagaagatgggagcactggtatgggacaaggttgttcatgagcatcagggatggaggctagtgacctgcatctggctgcacgccggtgttgttcatctgcttgccaacatgctaagcctcgtgctcatcggactcaggctcgagcagcagtttggatacatgagaattggcatcatctaccttgtttctggcattggaggcagcgttctttcatcgctgttcatcagaaacagcatctccgtcggtgcttctggcgctctctttggtcttcttggagccatgctgtcggagcttttcaccaactggaccatatacacgaacaaggctgcagctctagtgacgctcttgatcgtcatcgcgatcaacctcgccatcggcatcctccctcacgtcgacaacttcgcccacatcggagggttcttgactgggttcctcctcggattcatcttcctgatgcgcccacactacggatggatgcagcgatatgtcctgccttcctctgtcaagtacacctccaagaagtacctggcttatcaatggatcttgctggccgtggcctcggtcctagctgtcatcggattcgccgttgggctgtcgatgctcttcagaggggtgaatgctaatgaacgctgccattggtgccactacctgagctgcattcctacctcgagatggacctgcgggaactgaagatttagtagaaacgcaacaaactgaagacattaaggagatttattgaaagtgtttgatgcacagacatacaattttactgtatataacttatacagacataccctcccaggggtttagtcagttcacttgattgattcattctgttcgtttgtctgaattatttggaatagaaacatcttctccttgctcgcataggagtgattagcgatcttgagattcg

SEQ ID NO: 295 - DNA, 1279 bp, Sorghum bicolor
accaaagacgacgagttagaggggaaggaaggagacacagccacccgatcctagccatgatgatgatgggcgagggagtgagcgtgccgccgtggacccaccacgtccccgtgagcggcgtcgacgtcggcggcggcgacgagatgacgccgtacctgctcgcggcgctgcgccagtacctgccgtgcaacgacgccgccgctggcgccgaggcggacgacgaggacgcggccgccatggccgcgggcgtcgacggctacggctgcgacgagttccgcatgtacgagttcaaggtccgccgttgcgcccgcgcgcgcagccacgactggaccgagtgccccttcgcgcacccgggggagaaggcccgccgccgcgacccgcgcaagtaccactactccggcaccgcctgcccggacttccgcaagggcgggtgcaagcgcggcgacaactgcgacttcgcgcacggcgtcttcgagtgctggctccacccggcgcgctaccgcacccagccctgcaaggacggcaccgcctgccgccgccgggtctgcttcttcgcccacaccccggaccagctgcgggtgctgcccaccacgcagcatcagcagtccagcccccgcggcgccgcggcgtgctccccgctcgccgactcctacgacggctccccgctgcggcgccaggcggtcgagagcttccgcaccaagagcatcatgtcctcgtcgccgaccagcaccctcatgtcgccgcccaagtcgccgccgtcggagtccccgccattgtcgccggacggggccgccgcgttccgccgcgggtcctggccgggcgtggggtcccccgtcaacgacgtgctcgccacactccgccagctccgcctcagcaaggcgaactcgtccccgtcgggcgggtggggcggctacccggcatccgcggtcggctacgcatcgcccacggcgggtgggttctacagcctgccaaccacgccgacaaccctggccaccgcctccggctacatggccaacatggagccgcttgacgtcagcttctgcggcgacgaggagcctgtggagagggtggagtccgggcgggccctccgcaccaaggtgttcgagcggctcagcagggatggcgctgtttccggcgacgccaccgccggaatcagtggccctgacgtcgggtgggtctccgacctcatcaactgaggcggctgccggtcgttcttgcttcaatggcaatgtcattgggggcatggaggtgaaaggcggtggtaagccgtaacagagaa

SEQ ID NO: 296 - DNA, 1205 bp, Sorghum bicolor
atcacagagctcacgcaccaccagagccgagaggaaaggcgactatagcaggcatggcgacgcgggcggacgtggagaagggcggcgtggtgaggaaggagcccggcaaggtgccgtcgccgctgtacccgcagcacgagggggagagggagtgggtgccatggatcgtccccgtcttcttcgtcgccaacatcacagtcttcgtcatcaccatgtacgtcaacaactgccccacgcacaccaccacgccgcgcgacgccaagtgcgtcgcacgattcctcggccgcttctccttccagccgctgcgacagaacccgctcctcggaccatcctccgccacgctcaccaagatgggggcccttgtttgggagaaggtggtgcaccaccaccagggctggcgcctcctctccagcatgtggctccacgccggcgtcctccacctggtcgccaacatgctctgcctcctcttcgtcggcatgcgcctcgaacagcagttcggatacgtgaggatcggtgcgatctacatcctgtccggcctaggcggcgccgtgctgtcgtcgctcttcatccgtaaccacatctccgtgggtgcctcaggcgcgctcttcggcctgctgggcgccatgctctccgagctcatcaccaactggaccatctacaccaacaaggcggtggccgtggcgacgctcctgttcgtcgccgccgtcaacctggtgctcggcatcctgccccacgtcaacaacttcgcgcacatcggcggattcctcgcggggttcctcctcggcttggtcgtgctcatgcgcccgcacttcgggtggatggagcgatacagcatgcccgccggcgcaccctgcaccgccaggaagtacctcgcttaccagtggatcctcctcgccgtcgccctgctcctcctcgtcgtcggattcgcggtcggcatggcgatggtcttccgcggctccaacgccaacgacagctgccactggtgtcactacctcagctgcgtgcccaccgccagatggaactgcaccaactgatcatccagcagcagcacgagttgccaccttttttttttcctctctctccttcgtatatcctacccagcttgtcatgcatacacatactacacacagttgtaattcctttcggccggggtactgttactgtagatagcttctttgatgggggttgtgaactgtagagtcccg

SEQ ID NO: 297 - DNA, 1315 bp, Sorghum bicolor
cactgctgctgttctcagctctgccgctgcgcaagctgttgcattgcagtccgcgagccttgagctgcagctgctagctcgctcttcaccacagtccgcagacatggagttcgaagaccgctgccacaaggtccaggagcccaagttcgactgcctcctcttcgacctcgacgataccctgtacccgctgagctccgggatcgcaggccatgtcaagaacaacattgaagattacatggttgagaagctgggtattgatgagagcaagatcgagaacctgggcaatctgctgtacaagaactacggcaccacgatggctggcctcagggcgatcggctacagcttcgattacgatgagtaccacgccttcgtccatggaaggttgccgtacgacaacatcaagcccgaccctgttctcaagcacattctcaagaacctgcgcatccgcaaactcatattcaccaacggcgacatggtccacgccgtgagagccctcgagaggctaggcctggaggactgcttcgaggggatcatctgcttcgagaccctgaacccgccgtgcccgccgcagggagacgaggagccggagatcttcgacatcgccggccacttcgcccgctccggcaccgccgacgagcttcccaagacccccgtcctgtgcaagcccaacgtcgacgccatggaggaggcgctcaggatcgccaacgtcaacccccacaaggcgattttcttcgacgacagcgtacgcaacatccaggccgggaagcagatcggcctgcacacggtgctggtgggcaaatcgcagcgggtgaaaggcgcggaccacgcgctggagagcatccacaacatcagggaggcgctgccggagctgtgggaggaggccgagaaggccaaggaggacgtgctctacgccgaacgcgtcgcgatggagacctcggtcaccgcgtaaaacctcccgaatcctccggagccgaactttctcgacatccagaaacgcgacgatcacacatcactgcccgagccagggctggtgagctcacgctggaactgactgaatccagcaatggccgggccaaggatttccgacagcaggagggggtgcagcatgtaaaggggggaacagcagatgagatcatgtttgggatggtcccaatatatagttatgtatcagccagacctttgtttgtaaattaccagcattagaagtaataaggaaatggagtttacttgtacgtttcttgtgttctgtcatctgaagcaataaaactggttagcaagaccggaagagcaacgcatttgcttctctgaactgctg

SEQ ID NO: 298 - DNA, 494 bp, Sorghum bicolor
agccgatggcggttgtgagcggcagcggcggcgggaggctgaacccctgggcggagcccttcgtgccttccggggtgcggtaccgcggcctgatgcagacgcccgagcagcaggaggtggaggacttctcccccgagtggtggcgcctggtctccgcctccccggccttccgcgaccgctggctccgcgagtacggcgcgctcggcctgctcgacgccgaggaggacctggacgacgccgaggtcgacggcttcctccccgacgacttcttctccgctccggccccgcgccaagagagcgagcgggagggcggcgtggccggggctggtaagaaggtcggcggaggcctcgaggtggcggcgtgggggatcgacaagtggtggcgggcgcacggtgggccgccggaggccccgaggtacgcggagaaggcgccgcggagggtggcggccggcgccagggtgagcccccgccccatccagcagccgcgctgataa

SEQ ID NO: 299 - DNA, 1295 bp, Sorghum bicolor
gtgaacaccaggaggaagaagaagaagcaaaccagccaagaaaccgactccctaatcgggggtccctcaactcggtcccttgtccttgtccagttgtcccctcccctctcgccggtgctgctcttgcctactccgatggctgatgctgccgccgccgccgcccccacgaagacagcgaacatcccgacgacgatgcgggccgtgcagtacgacgcctatggcgggggcgccacgggtctcaagcatgtggaagttcctgtccctatggccaaaaagaatgagcttctattgaaactggaagcagcaagcatcaatccagtggactggaagatacagaaagggttgttgcagccttttctgcctcgtaaatttccttttatcccagtgactgatgtggcaggagttgtggctgatgttggtccaggaatcaatggattccaagccggagatcaagttgttgctatgctcaactcacttaatggaggtggacttgctgagtatgctgtggcatcagaaaatctgaccgtcaagaggcctcccgaggtatctgctgctgaaggcgctgggctgcccattgccgctggtactgcgctccaggtgcttaggaccatcggcgccaagttcgatggtactggccagcccttaaacgttctgatcaccgcagcatcaggtggtgtgggtctctatgccgtgcagctcgcaaaactggctggtctccacatcactgccacctgtggcgcacgtaacgtagagctggtgaagagcttgggcgcggatgaggtgcttgactacaggacgccagagggtgccatcctgcagagcccctcaggtaagaagtacgatggcgtcgtccactgcactgtcgggatcagctggtcaacgttcgagcctgtgctggccaccaacgggagggtgatcgacatcactccaaacttcactgtgttcctcaaatcggcgctgcacaaggtgaccttcgccaagaagcggctggtgccgctgctcctgtcgcccaacaaggcagacctagagttcctggtcgggctgctgaaggacggcaacctcaagacgctgattgactcgaggttcccgctgagcgaggtgagcaaggcgtgggagaagagcatcgagggccatgctactggaaagatcattgtcgagatggtaggctaatctatgcgtccattacctacatagacttccagggagaatatacttaagcatgatctaggcagttggacactacagggttaaggtcaacagatatggagtactagtgtctgagtttggtcgtcgta

SEQ ID NO: 300 - DNA, 827 bp, Sorghum bicolor
ccgccatggccgcgaactcccccttcgactgcgtgctcctagacctggacgacaccctgtacccgggcaacaccggcatcggccccgccctgaagcgcaacatcgacgagttcctgcaggccaagctcggcgtctcggcggagaaggccgccgccatgcgcgtcgagctcttccgcacgcacggcagctccctcgccggactcatcgcgctcggctatgacgtgcacccggacgagtaccacagctacgtgcacggcaggctaccgtacgacatgatccccgccgacccgcagctggcgcgcctgctgcagagcatcccgcagcgcaaagtgctcttcaccaactcggaccgggcgcacatgaagcgggcgttggagcggctgggcgtggacgaggccgtcttcgacgccgtcgtgtgcttcgagaccatgaacccgcacctcttcggcggcgaggccagagaggagcgcgtcgacggcggcgaccacccggtcgtggtcctcaaaccggcggtggacgccatcgtggcggggctgcgcgccgccggctccaacccacgccggacgctcttcctggacgacagcgagaggaacatcaccgctgggaaagcgctcggcctccgcaccgccctggttggcaagagggtgaggagcaaggacgcagactacgcgctggagaacatcggcgcgctccggcgggtcatcccggagatctggggcgtcgtcgccggcggcgagagtgaacgatcggaccacagcattgacaagatgccgatgaggtccgacctggactccatcatccagcccacgtccatccaggcctaataa

SEQ ID NO: 301 - DNA, 1296 bp, Sorghum bicolor
ataggatcctattgctttgcttgctcgctcgaggtgcacgtggcggtggaagcttcccggtggggggtgtgggtggcggaggcggtggtggtggtggttgattggttgatgtcgatggcgcaggtgtgctgcgactcggccgcagcggcgacggcggcggcggcacaggtggttggggcggaggcggaggccagggccagggcgcgcgccgagaggcggcgtcgggctggggaggccgccgggaggtggaggcacgcgggcgcggccgctggtggcacgcccgacgctgccacgaggaagcggagcctcgaggccggggagctgctcgtggcgcgcaagcacggcgccgcgtcggtggccggccgcaggagggagatggaggacgccgtgtccgtgcgcgaggcgttcgcgctcgcggagggctcccacggcgggaggcgcgacttctacggggtgttcgacggccacggctgctcgcacgtcgccgaggcgtgccgggaccggatgcacgagctgctcgccgaggagctcgctgtcgccgccgccgccgacgacgtctcctggaccgcggcgatggagcgcagcttcgcccggatggacagcgaggtgatgtcggccggcggggccagcggcgcctgcggctgcgacgcgcacaagtgcgaccacgtgggttccaccgccgtggtggccgtcgtggaggagcggcgcgtggtggtggccaactgcggcgacagccgcgccgtgctgtgccgcggcggggacggcgcgccgccggtgccgctgtcgtcggaccacaagcccgaccggcccgacgagctggcgcggatcgaggccgcgggcgggcgcgtcatcttctgggagggcgcgcgcgtgctgggcgtgctcgccatgtcccgcgccatcggggacggctacctcaagccgtacgtgtcgtcggtgccggaggtgacggtcaccgaccggtccgacggcgacgagtgcctcatcctggccagcgacgggctgtgggacgtggtcagcaacgaggccgcgtgcgaggtggcgcgcgcctgcctccgcaggggccgcgccaagtggtgcgccgaggccgccgcgctgctcaccaagctggccctcgccaggcgcagctccgacaacgtctcggtcgtcgtcgtcgacctccgccggaggaatcatcactagttggatctgtgcagtcgccagttttagtagtactagtagtacaaggtaggatgatggatggtgcacaaaaggatttcgcgggtgacgggtgtgtactaattgggaggtacctta

SEQ ID NO: 302 - DNA, 1183 bp, Sorghum bicolor
gattccttccgcctcatcgcgtccggcgaaccccatgtccactgcgaccgcggccctcgccgccgcgcgatcccccgctgtcgcgcttctcagcctgcgccgccgcgcccacgcggctgctcccattcgcttccccggtctccgcgtcggctccggttgccgtcacgtagctatggcttccgcggcgcatgcccgcgcccccaccgacccgcttcccaagggtgctgattcatttttccgggcagtgatctcgaacatggaaaaggtttatttgagcaggaatcctacagccaaaaccattctagagcttgtacgatcttatgatggtgatcacatttgttatgaccaccttgctttccggacatttggggtcaatggttatggtataaactcactttctgaatttttcactgattttggttatgtacctcgcgaagaactcagatttccagctaaaaagcttagagcactatggttttccccgcccaccaatggtggctactctggaactggtacatatggacctttgccaaggatattcatttcagaactgcttgtggatgagttgactactcaaagccaggaaattatacataagtacattaaaacttctggcaatggaaataatcatgctgctcttgcaagtacttctggggagctgacatgggaaaagcccatctattcagatttccagattttgtctagtgaaagtgaatatgctgcatggactcttgttaatggctatgcactaaatcatgccacaattgccacccatcgcctagaatcagatatcagaaatattaataagttcaacaaatttgtggaggacaatggcttcaagttaaattcagaaggagggattctgaaagtgagtcctgatggtctccttcagcaaagttcaacagtagctgattcatcattgtttacatttgctgatggaataactgaatctattcctcgatcttacattgaatttgctgaacgtctcctgctaccacagttcaaagatttgcaagatgaagaggtgaaagaataccacaggcgtgatggttttgaggtgggcaatgcggacaagatattcgaaagtacatcgagggatcagctgacaaggacatctgcataaacagtgaactctagatctattgtgcaaatgacccaatgtgcctcttggaagtgtgtttga

SEQ ID NO: 303 - DNA, 2165 bp, Sorghum bicolor
gacgaggctctgcttctcagcgtgacaagcctggcgaacaagctgccatggacctggtgggatccttgctgatgaacacgacgcgtctgcttgacccctccgggctccacttcttgggctggctcgtcaccgcgggatccattggcctcgccgcgctcatctacgctctcctcaggctgcagcgcgaggcggcgctgtactggaccaaggcagccagggagaagcgcgccgcgtggaggaggtcgcggtgcccgagctcctgccactcgtggtccgaggaccgcttccacggcggccagccgtcgacgtgctgcgtctgcctgtcgtccctcagcggctccgcgcagggcgccgacgacgtggttcaccgctgctctgtttgcggcgtggccgcgcactcgagctgttctccccacgctgagaaggactgcaagtgcgttgcgcaggctggcacttcgcccttgctgcatcactggtctgagaggtgggtggagctggacgataacccagagatatcctccttctgctactactgcgatgagccgtgcggtgtgcctttccttggtgtctctcctatatggcgctgcctgtggtgccagcggcagatccatgttgattgtcatgcgaagcttttgaaggaaaccacaaacacttgtgatcttggccttcttaggaggcttattgttcctccccaatcagtgaaagaagttggtcaaggttcaggaattagcggaatgctcaactcaatcaaggatgggtttgccaattcaacagctgggaatcgtaggaggccacgcaacaagaaacgcgggaataaccatcctggtggcaaggcaaattccattcccgcaaaaggctcagtccttgattcagtgcttgaaggatttgctagattgaagggcctggatggaaagtatgcactggcaaagcctttatctcaaaattctctaaagcaaacatatcgatctggtattcctaatgaacgagtgagaaagtatgaacttgttgatttgccacaagattcaagaccactgctggtattcatcaacggcaagagtggaggcagaaatggaccttctcttagaagaaggctgaacatgttgttgaatcctatacagatatttgagctaagtgcttctcagggacctgatgttggattacaactattccacaacgtgaaacacttcagaatccttgtttgtggtggggatggaactgtagcctgggttcttgatgccattgaaaagcagaactatgaatctcctccccctgtcgctattcttcctctcggaactggaaatgacctatcacgtgttatgcgctggggagggggtttatcttctgttgaacgagaaggaggcatatatgcacttttaaatgatgttgaccatgcagctgttacagtgcttgatcgctggaatgtagccatcaaagagaagaatggaacagaaggtcaatgcaccaagcaagtaaaatttatgactaattatttaggtatcggatgtgatgcaaaggttgcttatgacttccacacctctagggaggaaaaaccagataaattttgcagtcagtttgtcaacaagctgatatatgctagagagggtgcaaaggatatgatggataggtcatgttctgatttaccatggcatgttagccttgaagttgatggggaaaacattgaaattccggaggatgcagaaggtgtgattgtaatgaatatccctagctacatgggtggtgttgatctgtggcaaaacgacaatgaccacgatgatgatttcagtttgcaatcaatccatgacaaaatacttgaggtggtttgtatatcggggacatggcatttaggaaaactgcaggtcggactttcaagggcacaccggttagcccaaggaaaagttataagattgcacctccacagttcgttccctgtccaggttgatggtgaaccatggatccagccacctgggtgtcttgagatatctcatcgtggacagatgttcatgctgcggaggacatctgaagaacctactgggcatgctgccgcaatcatgagtgaggtcctcgtgaatgcagagtgcaatggtgtgattgatgcgtctcagaagagattgcttctccacgagatagcactccgtttatcctcttgacacttcatccagtcctga

SEQ ID NO: 304 - DNA, 1749 bp, Sorghum bicolor
ggctccgatcgaagctgcccgtgcccgacgaccatggcgtcagctgcgagaaccacgccggggccgggcaggtccgtcgtcgtcctcgtctccctcgccacgctcctcctcgtcaccttcgtctccaccgtggagagctacgacggccggcatgccgtggcgcactcggtcatggcgcggcggtcccgcctggggacccgacacgtgcagcaccaccaccgccgcaccaccacggtgccgcaccggtacgtccttgcggagaagagcagcccgaccggcggcggcagcagtcccaagaaccgcagcagctcccctgcgacggccaacaacgccagcgcgccggcgccggccgcctcgcagagtgacggcgggcgtcgccaccgcagccacaagcaccgggtgcgcaactggatcatcggcttcgtggtgggttccgtggcgggcgtcatctccggtctggtgctgtcggtgctgttccggctggcgctcaactgcgtccgcgggcggtaccggtcgcgctccggcgtgatgatcttcaccccgaagctgatccggcggccggagcacctggcgttcctggagaaggaggacgggctggcgtcgctggccgtgatcgggcgcggcgggtgcggggaggtgtacaaggcgcagctccccgtggagcgggagggcgacgcgccccggttcatcgccatcaagaagatcaagaagcacggcggcgacgcgccggccaccaacaacaacctcagcgacgaggagagccggcagctggacaagcggtcgcggcagatccagtcggagatccgcacggtgggccacatccgccaccgcaacctgctgccgctggcggcgcacgtgccgcgcccggactgccactacctggtgtacgagtacatgaagaacggcagcctgcaccacgcgctgaaagccggcaacagtgccgtcgaggtcgaggacggcggcggcggcgaggacggaggcaccggcacctgcaccggaacctccggcgggctttcgtggccggcgcgtctccgcgtggcggtgggcgtggcggcggggctggagtacctgcacgtctcccaccagccgcagatcatccaccgggacctgaagccggccaacatcctgctggacgacgacctggagccccggatcgcggacttcgggctggccaaggcgatgccggactcgcacacgcacgtgacggcgtcgaacgtggccggcacgctggggtacatcgcgccggagtactaccagacggtgaagttcacggccaagtgcgacgtgtacagcttcggggtcatcctggcggtgctggccacggggaaggagccgtccgaccagttcttcacggagacggaggaggtggtggggctcgtcaagtggctgcgccgagtcatggagagcggggagcacgcgcaggccatcgacccggccatcgccggcgccggacacgacgagcagatcctgctgctgctgcgcatcgcgctcttctgcaccaaggacgaccccaaggagcggcccaccgccaaggacgtccgctgcatgctctcgcagatcaagacctagccacccagccacttcaatcagatcaatcactacatacaaattactacccgtttgagattatctcctagatttaccagtcatcagcgaatcgtatctttagtcataacattttaggcaaacgaagaaagtagtttcaaatttcaataaattctctctgcgtctctggactgtggattagtg

SEQ ID NO: 305 - DNA, 2023 bp, Sorghum bicolor
gctgtgggtgatgttctggtaccttgatggcaaacacagaaggttttcgccttgtgagatgcccaaagtgtctgaacattctcccagaaccgcccaaagttacagtctacaagtgcggcggatgcggcaccacccttcgagctaaaatccgtgccagcaatggccaacatgtggctgcaaaacaagtccgccaggactccgacagttattcggttgcaaccgccgtgagcaatggggtgcctcctcaaaacaaagaccaaggctccattggtgctgtcacagagaatttttccttcaatgctgacgctccaagcaccgagcatgacagcaatggaacaaggagcagtgaaaatggtgatgatatgctggctgggcagaatgctgtggtggttgaggatactgagaacaaggacaatcgcaatttcgaagaccaggatagcagttcaaggatggaaggtcctgctgatcaaacacgcctgaatgcaaatggcatgtatttaaattccggtgaaacagaaaaccacaccgttgaacaacctatggagaattcagagacttaccgagtaagtggacatgatgatactgaatgccacttgaacccctctgaaaacaaaccgatttcttctgagataagcaaagcagccgtcagtatgcaagatcctgagcagaaggaagcaggcgaatccgaacatgcggcaaacaagaagagttatcttgtgagggtgctgtctcggtcttgtgatcttcggtcatcaataaactcgattgatttccactctgcacggacttcgcttcaatccaaaagcttcagggctagtgagccccttcagtcgaagatcatgaacacaatggatgaactgaagggtgacctttctgaattgttcaataaacctgctgcagactgcaagccaaaggcacacaaccctccacgcccttccaaacaagatggccacatgactcgtgcagccaccacaaccagcgcacctcttgcagcataccatcctgctgccaagtattctggctatgtgtctcgcctaagcaggtctggccaggttcctcttcctcctcgtggactgccgtcgctgagatatcgccggcacagggtttattcattccatcatcacagcatgcaaacggaaatgagaccttgccgtcatgagtgctgccatagctgccagccaccctgctacagatcctgcaaccaagaatcttcagcgatgcacaggccaccgatcatggagatcaggcgtcgtcctcctcccagaaatcactgcctgccagtgctacgtggcgctccgttcgtcatctgctccaactgcgtcagtctggtccagctgcccaccgacttcgccgtccctagcagagggacacgccgggtgcagtgcggctcctgctccgaagtcctctcctactcctacagggaccccgccaggaagaggctgcagtcaccatttgggggcgatgagtacagcactgatgagtacgagattcaccaccaggctgccgctgccggcggcggcttcgagcaagcagatccggtgtcctactccgaagagtacgggctctcgttcggcgtcagccactcgactagcaccgaggacgggcagccgctgtacgtgtcgaggaactcgtccttcaacaccgtcgacgaaaggatgatgggcaaagacggcaagcttcaccggcttatggggtactcgtcggcgagcgagctgctgcggcggcattcgcccgacctgttcgagagcttcgacaggcgcacgcccaccatcgaaagaacgcacgtcgtcgacaggaagggtaaaggcgtctgcgtggcagaaaacgatgccggcgagcgagacggtggtgcggtggtgaagagatcgaaggcgaggagtggtggcttgccgctccatgggatcctgaagaaggggatccatggcctggaatcactcaagctcaggtcgtagctcatgatcttcgttaggcggtggcgaggctcaggcgatcgagtttaggagagagtagcatacacgacagg

SEQ ID NO: 306 - DNA, 1001 bp, Solanum lycopersicum
ttccttccttccaacttgtgtctccgttaattatagccctttttttttccaccatggagctataacattaaatcacaataatacatccattttattttatttttctaaaaaaattgggtcgccggaaaatcaagattccggtaacccatagtaattattttgtttatacatagaaattttttcttttctgtcgcctggagattaaaaaaaggtgatgataaatggcaaagggtcggaaactggccacgagtcgcagtgaaatgttattaggaaactacccaagctatagaaatggaactgcaacagtcaacggttcctccgaactaggagaagatgatgtctgggcaacggttgatgacatggatgatcacgattcaaggggcgagtggagtccacgcgccgccgctgagggtaacaacggatacgtgaaccgtaaggtccaacaatccgaccaccaccaccacagccaccgcgggcgccaggttgggggcttgtcattggctttcgatgattcaggtaaaacggcatctcctcgaatcttgcaccagtttcgcggacaagacgcgccatccccacgtgtggcacacatggccacgtcagcacctgtgaatgtccctgattggtctaaaatataccgagttaactcggttgaatcgttgcatgactcggacgatggtgttgatgatcatgactcggagatggttccgccgcatgaatacattgctcggagccggaactcgaacgctcactcggtgtttgaaggtgtgggccgtacgttaaagggtcgggacttgagccgggtccgagatgctgtgtggagccagaccgggttcgatggctgagttcatcaatcgaactatctatcgttttgttagattaaaagattttataactattttagctgtttggagaattaaaaaagcaattgatgataattatttttttgctagataaatttttggtcttgggcaattattaaggttgaatgaatgcaaagtcag

SEQ ID NO: 307 - DNA, 807 bp, Solanum lycopersicum
tgaatttgttttctctctgctatggattcttcctcaccttttgactctattattttcgatttggatgatactctgtattcgtctgcgactggaattggacaatcgttgaagaagaacattgacgattttctggtggagaaatgcggttttccggtttcgaaagcatcggctttgcgtgttgagcttttcaaaacttacggcagttctcttgccggattacgagctataggttatgatgttgatgccgatgattatcacagctatgtgcacggaagattaccgtatgatttgattaaaccggatccccaattacgaagcattttgcgtagtattaatcaaaggaaaattattttcacgaattcggatcgaattcatgcgatgaaggctttggatcgtctgggaattacggattgttttgaacagatcatttgtttcgagacgatgaattttaacctctctaaggcaacaaggccggaagagattccggtgatattgaagccttcaatggaggcaatgaatatcgccattgaagctgctcaggtcgatccttatcgcacgctcttccttgatgataatgttaagaacattgctgctggaaaagctgtggggcttcaaacagttttggttggaagatcaaccaagacaaaagaagctgactatgcattagagatagtgactgatttggttcaagtagtaccagcaatatggttcaaggaagaagaaaaagatcaaaaagtaacacgtacaagaagtgaaatggactttcttgcaactacatctgtgggtgcttaatctatgtcaagatga

SEQ ID NO: 308 - DNA, 1169 bp, Solanum lycopersicum
tcacgatgtcgtactccaggaggtcaaggtattctcgctcaccttcatacgatcgatatagcaagtctgtctcaaggtccagatgtgtttcaaggagtcggtcaaggagctgtgattcaagtgatgttgagaacccagggaacaatttgtatgtgactggtctctcaacccgcgttaaggagcgagatattgagaagcatttttctgctgaggggaaggttgaagatgttcgtcttgttttagacccatggacccacgaatctcgtgggtttggtttcgtgacgatgtccagcgttgaggaggctgatcgctgcatcaagtctctgaatcgctcaatacttgaaggcagagttatcaccgtggagaaggccaggaggagaagaggtagaacacctactccaggaaaatatttggggcttagaactgttcgcgttcgtcgtgaatcacgaacttatcctcattattcaaggaatcactctccttgttactcatctgaaagctacaggagcaggagcaggtcttactctccatattaccgacaagagcatagatcatactcttattacagaggacgccagagatctcactcatcgtattacagtcggcaccactgctactcagaatcaccttattctccttactatagtcgtggaagatcttactctcgatctttatccccatataatgggcgtgatcggtcctactctccagatgactgttattacagaaggagccgttaccatgactattctcccgacaatcatcggcgtgatcgttcctattctccagatgaccgttactatagaagaagccgctaccgtgactactctcctgaaagccatgatctttcagactctccagatgttcgtgacaacagaatgagccgctatcgcgactactctccgaacaacagttactattatcgaaggaaccgatatcgttccatttctcggagcatttctcctcggtatcggagaagctactcgcgcagtgtatcacctaggtggtcaaagaggagctattcaagaagcgtttccaggagcagctgctctcgtagcagttactctcctaatcagaagaaaagctctaagaagagtcgcagtgttagtgcatcttccagatttgtttcaaggtctgttacacctaggtcttcaccttcatcatgatga

SEQ ID NO: 309 - DNA, 2075 bp, Solanum lycopersicum
aaaggatcccaccacagtttccctcgttcacctctctcctccctctctgtccggtttaccggaaaaacaagaatctcaaatgacttcgaatatccacttttttcttttatacgttgtgagccttttcctttttgttcaagcaagattgaatctttatccaccagatcatgctgcactcttgcttgtacaaaaggacttaggcatcatttctgttaacaacccgtgtacgctcgcaggaatatcgtgcgagcgtagaccgggtaacacaacacaagttgtgagagttacccgtattgtattcagatccaacggattaaagggaactttgtcttctgctattggcaaactcactgagctcaaagagctttctctttccgacaatcaactatctgaacaaatccccgttcagattattgattgtcggaagttagagattcttcaacttcaaaggaacagattttctgggaagattccatccgaattgtcagctttaaaccgtttaaggatagttgacttttcatcgaatgagttttcggggaatcttgatttcttgaagtactttcctaatctggaaaaactgtctctggctgataatatgttcactggaaaaataccattttcattgaaatctttccgaaatcttcgttttctcaacatttcagggaatagtttccttgaaggtccagtacctgtcatgagccaaattgagcatttatcagcagatttgaatcgaaaaaatggcgttcctaaacgttacattctagctgagaattcaacaaggatatctgcaatgggacctgcttcggttccagctccagctccagcacctgtcaatcgtgttgtaccggcgatgcataaacgtaagaacaagaaaaggaagttacgatcttggtttcttggtttcctagctggaacttttgctgggggtatatctgctgtgctctgttccttgctattcaagatggtaatgttcttcgtaagaagagggaataacgattcaagtttaacgatatacagtccactgatcaagaaagccgaggacttggctttcttagagaaggaagatggagtggcatcgcttgaaatgattggaaaaggtggctgtggagaagtttatagagcagagctaccggggagtaatgggaagattatagctataaagaagattatccaatccccaatggatgctgcagagatcacggaggaagatactaaggcgttgaacaagaaaatgcgtcaagttaaatcagaaattcaaattgtaggtcaaatcagacaccggaatctgcttccattactcgcgcatatgccaaggccagactgtcattacttggtctacgaatacatgaaaaatgggagtttacaggatatcctgcagcaagtcacagaaggcacaagggaattagattggttgggacgacacagaattgcagcgggggtagctgctggtctcgagtatctccatataaaccatactcaacgcataattcacagagatttaaagccagcaaatatcctacttgatgatgacatggaagctcgagttgctgattttggccttgcaaaggcagttccagatgctcatacacatatcaccacttcaaatgttgcaggaactgttggatttattgcaccagaatattatcagacactgaagtttacagataagtgtgatatatacagctttggtgtggtgctagctgtgttggttatcggtaagggtccatcggatgattttttccaacatacttctgagatgagtttagttaagtggctgaggaatgtaatgacttctgacgatcctaaaatagcaattgatcctaagcttataggaaatggatacgacgaacaaatgcttttggttctcaagatagcttgcttttgtactctcgacaatccaaaggagaggcctaacagtaaggatgttaggtgcatgttaactcagatcaagcattagataaccaatacactggttatgtaactaagaatctgttctgtattttcagtttcgcaagttgatattttgttgtaattgtgttatacatgtcaaatcaatattcattccacggtacctt

SEQ ID NO: 310 - DNA, 563 bp, Solanum lycopersicum
catacaatataatggggcttagggctattcccttttcaccttctcaaaattattatttgagtggttcagaatatttgcccaaatgcagtgttcttggtagcagcagaactggctcatcaaaactagtactaacaatttcagcaaaggctaaaaaagatgacgcacaagaagaagaagaagaaccaaaaaacaagaggaaacaatcgttgttttcaagtgtaactgaagctcttgatttttctcaagttagatctgcaaaggatgctgagcttcttgatgaagcaagagaaaaaactcaatctggagagagaatgtctaaagaacagtatggagctcttagaaggaagattggtggaacatacaaagatttcttcaagtcctatgttgaagtggatggacaatatgtggaggagggatgggtagacaaaacatgcaaggtttgcaagaaagatacaagtggagaagcaagacaagttgacaaaatgggacgatatgcgcacgtagcttgtctacaaaaatccaaccctggaaatttcttcaccaagctcttctcaagatgataa

SEQ ID NO: 311 - DNA, 1862 bp, Solanum lycopersicum
agaagagacgcagcaacattcttcttccaattcacaaattacaaggtagttttgttgatctgtaaaagaggaaaagttttttttttttttaatcttcctctttatcagtttgtttgggtagcaattaatgggatctctaccggagccaattatggatgaaacttacagcaagccccctggaattagggtgatggagaggacaaagaaggctaacctctctttcaagacatatcaagggattgtgttaattgtaacatttttagcttatacaagttaccatgctactagaaaaaccacaagcattgtgaaaagtgctttggatccccagtctcctgatgttggcttaaagtttccgtggcaaaggcgtaatacgacttatgaccaaaatcaaagttcaaaactttcttggatgcttaaagatggttgggtaccgtttaacggacctgatggtacggcgatgcttggtgaacttgatgtttcattcctttttgtatatgccatgggaatgtatttctccgggcacgttggtgataggatggatctgagaatatttttgacaattggaatggtggggactggtgtgttcactgccctttttggagttggatattgggcaaatgtacacatcttttattactatctaattgtacaaatgatggctggattgttccaatccacaggatggccttcagtggttgcagtagtggggaattggtttggaaaaaagaagagaggacttataatgggtatttggaatgctcacacctcggtcggtaatatcgcgggttctgtggttgcttcattattgttgaagtatggatggggttggtcaatggttgttcccggtacccttattgctgttgttggcgtggtagtattccttctcttgccggttaatcctgaatctgtgggagctaataaagatgaagatgaagtgttctctcctagaaaagaaggcgaggaagtaaccgagcctttcttgagatcagacggagaagaggaatcagccgtgggttttattgaagcatggaagattccaggggtggcgccgtttgcgttttgccttttctttgcaaagttggtagcatacacatttttgtattggctgcctttctacattagccacacagctatagaaggaaggtatttatccaatgaggaggctggaaacttgtcgacattgtttgatgttggaggggtagtaggtggaatcctagcaggttacatatctgaccgcttagatgctagagctataactgctgccagcttcatgtactgtgctatcccggttctctacttctatcgcagctatggacacgtctccatgaccataaacatcatcctcatgttgatcaccggagtattcgtgaatggtccttatgcattgatcacaactgctgtttcggctgacctgggaacacatagctctttgaaaggcaattcacgagcgcttgcaactgtcactgctattattgatggaactggctcaattggagcggccattggaccacttctaaccggttacatttcaactaacagctggagtggtgtatttacaatgctaatgggatcagcttttatagctggtttgtttctgaccaggcttgttgtagctgaagtgggtgccaagattcaagaattagggtcccaaggatcatcacctacatcaaggtcccctgactttctagtgtgaaaataataattgtggtatattcttttattgctttttgtgaatccatttcgaagcctcgattcgaatgttagcctaggatcatagagatatatagagttggagatgcatttcttgtataaagtcaagaaatgaaagggtttctagtatccttgtgtacagtgtgggagtg

SEQ ID NO: 312 - DNA, 617 bp, Solanum lycopersicum
aaactgaaagcaagtaaacacagaaaattctcaatagctcactgaaaatgtcactgatcccaagaatcttcggcgaccgacgaagcaccagcgtgttcgatccattttcaattgacgtatttgatccattcaaggaattaggcttcacagtttcaaattcaggggagacctctgcatttgccaacactcgaatcgactggaaggaaactccagaagctcatgtgttcaaggctgatcttccagggcttaagaaggaggaagtcaaagtggagatcgaagaggatcgtgttcttcagatcagcggagagaggaacgtggagaaagaagacaagaacgatacttggcaccgtgtggaacgcagcagcgggaaattcatgagaagatttagacttccggagaatgcaaagatggatcaaattaaggcgtctatggagaatggagtgcttactgttactgttccgaaggaggaggtgaagaagcctgatgtcaagtccattgagatctctggttaaaatatgtgaatttattgtatccttgtatgggcaaataaaaaataatcgtatctgtagtgtttgaagtcgttctgtttctgtattaaagtcttcgaatcggctctg

SEQ ID NO: 313 - DNA, 1163 bp, Solanum lycopersicum
attcttctgagcatttgcatccctctttctgtgtgaaggaagaggcaaagaatggcagcatacaggtggaagagtttcaacgatgatggcgatcgtcctgagaaacctcgtcgctatggcgttacagaaatgaagggtcccaactattcccttttctcgagaggccttcttgaggatgttttagagtctatgggtcattttgttgatgggctaaaactatgtgatggatcccatactgtgatgccaaagaattacatcaaagaagtgactgatatggcacataaacacaatgtttatgttagctctggtgattcggcagatcaaatgcttttccgaggtccttcttctcttaaagaatatattgaggaatgtaagcaattggggtttgattcaattgagcttgatgttgcatcacttggtttacctgaggagaccctcttgagatatgtgaggctgattaagagcagtgggctcagggctaagcctcagttctctgttaagtttaataagtctgatatagccttcgccggtgacagagcttttggggcttacgtgattccagcacctcaaacctctgagatggttgaagatgtggatcttttggtcagaagggcagagagatgcttagaagctggggcagacatgataatgatcaatgctgatgatttatgtaggcaggctggtttactaagatcagatattgttgcgaagattgtgggtcgtcttggacttgagaaaactatgtttgaggcatcaaatcctaaaatctctgagtggtttgtcaaacgttatggtccaaaggttaatcttatcgtggaccactcacaagtaatggatctggaatgcctcagaggacgtaacctgggtcagaatcactcatctgtacttggcaggtcatattttttgctctgatcttgtgatgtccatagagaaaactgtgctcattgtagcgaacaacgtgtgtctgtaaaatgctttgctggtcatgttcagatcatgtttgaacttttaaatgaaaaaaaaggagagtacacttcagatatgtactcatgtactgtaatgattgcagtcttttcagggacttctttttttttttttgcttgaagttcagctgtttgtaaagatgttcttttatgttctagtgcctaaatggctgaaagttc

SEQ ID NO: 314 - DNA, 1013 bp, Solanum lycopersicum
tcaactgtcaactactgccacagagatgatacatgaacattacatttccaatccacacacataaatatatcccaaatcaagaaatctcctcctcaatcttcctttttttttattttggtgcaagatttgcatgattgaagccgaattaataacatgtttgatacaggggaattttctccaagttcttcaacagctgctgtgtctgcagagtgttttagcagtagcagttgcttcagcagtctatcatcctcaaagaagaagaagattcatagtagtaacaacgcgaggaggttcagcgatgaacagattaaatcattagaaaccatgtttgaaacagagaccaaacttgaaccaagaaagaagcttcaactagccagagaactcggattgcaacctcgacaagtagcaatttggtttcaaaacaagagagctcgatggaaatcgaagcaactcgaaagggattacagtatacttaaatccaattatgacaatcttgcttctcaatacgaagctttaaagaaagaaaaacaatccttgcttattcagttacaaaagctgaaagaaatcgagtcagacaacagatgctctgtaattaagaaaaatgaaatggaagggatgccaagcttgtcttttgacttatcatctcaacatggaacaaatggtgttatgtcagatgatgacattgacagcagtataagagccgattatctcgggttagatgatgatgcagagtatcatctactgaaaattgttgaaacaggggatagttctttaacttcccctgaaaattggggctgtttagacgacgatggtatcttaaaccatcagcctaatagttctagttatgatcagtggtgggatttctggtcttgaatcaaaatcgttgataaatatttaaaaatgatcagataccaaattgctagcggttcttgtacatttgatcgagcatgctggcaccctcctctgttatcactttcatcttagcaacttacagtgcctttgtctactggaca

SEQ ID NO: 315 - DNA, 1041 bp, Solanum lycopersicum
tttccatctgtgcagtggtcatgacgagacgaaaatgccgccacgccccttatacagatgattctcgccgccgttttgcaccaccggaagcccaaccccaaccccatctccaactccaactccgtattcacccgtcagacttaattgatgatcgggaagttgctcagcaacgcgagattgaaaaattgctccaggaaaaccgcagtctagcgggtgcacacgtctctcttaaccaggagctctccgccatccagcacgagctccgtcttctctcttccacagccgcaaccgtcaagaccgaaagggatgctgaagtccgtgaggtttacgacgaggcacggaagaaggagtctgatgtttgtatactcgatgagcttagagtagatttggctcgggttaggagtgatattcagaacctagttgacgaccgtaaagagctcactgccaaattgcagaacatggaggaagatctcgtcaaagttggttccgagttacagcagtttcccgtaatcaaggccgaaatggagtccatgcgtaaggaagttcaacgaggaagggctgctatcgactatgaaaaaaagatgcacaccagcaaccttgaatatagtcaagcaatggagaaacataagattactctggcttctgaaattgagaaactacatgctgagcttgcaaatgcagagaagagggcaagggcagcagcagctgcagcggctccaagtaatttaaatcaccagatttctgcagcaactccgaattttacatattctgccaattatggaaatcctgaaacaggatatggagagaatctgtaccctgcgccttatgctgtacatcaggttcagggtagtgctgatgcaaatacccaatatgttggtggacatcactagttggttgtttgaaagtgtgctggatgacaagcatcgtacttagggatgttttacttcatgagaaaagtggtggtttttggaaacatttgtctcagaattcagataataactgtttctacatgtctctttgacctgggtttagtcgtttgaa

SEQ ID NO: 316 - DNA, 2078 bp, Solanum lycopersicum
agcctgcaaagcacatcaaccatagtatcatggattcacagtcgtcaccacatggctctattatcttctccaccgtcggcagaaccaattatggcttcgacatcttctccatcaaatctccattttcttttctcaattctccggtagaacatcgcctcacagacggtacctccatcaattacaacggacagtttgtcgatgaagatcaaacacttgtattcgtctcggagagatcaggtgctcctcgcatttacttgagacacccctcctctcaggtacagatggaacaacttcctactcccattgatagcctatttctcgaccgtccatttcttcgaaataaacaactctactatatttcagctcatcagcaacccaaaaaagttttcaccagctcgtccgctctttactctaccaatatagaagataatagtaacatcatccgcttgactccgtacggctgcgttgattatagtccggcgatttcgcagtctggacacctgattgcggttgcatcttacggagaccgtcgttggcctactggtgaattccatgatctgactactgatattgttgttttccctgaatctgacccagaaaagcggatagttgtgtgccaacacggtggctggccaacttggtctggtgattcgactatctattttcaccgacaagctgatgatggttggtggagcatttttagagtagatttgcttgaagattcactcaatctgcgtactgatccgattcgagttactcctcctggtgtgcattgctttactccagcggcctcacacagctccaaatcaatgattgctattgctaccagaagacaggggacgaagtatcgccacattgagattttcgatgtggagtctcacaagttctattcggtgaccgagttgcttaaccctaccactcaccattacagtccattcttctctcctaagtcgtcgtttctcagttatcaccggttccgaggtgaatcatcatcgggagatgcaacaattccttccttggccccgataatttctccagaaaaaggactgagaatgctgaggcttaatggatcatttccttccttctctccctcaggtgactttattgcgtttaatcatgatttcaatgctaattcaggcctcaaaatcatcaaatcagacggttccaagaagtggacattgttcagaggccgtacagctttctgcaactcctggtctccagccgaacccaatgtgatttttacgtcaatcggacctgtattcgactctgtaaaagcaactgtccaaatagcacgagtttcattcaattcattaaatctaactaacgatgattgcagagaaattccagtagaaatagaagttctcacaaaagaggagacgggaaataatgccttcccttcctgctcgccagacggaaagcacattgtattccgttcaggccgttcagggcacaaaaatctgtatattatggattctgttaagggagagctggagggtggaggaattcgtcagctaacagaggggccatggattgatacaatgccaagctggtcacctgatggaaagctgattgcattttcttccaacaggcacaatccggataatgtcacttgcttcagcatttatgtgattcatccaaacggcacaggtcttcgtaggatccacgtggcagggccagagggatctgatgaagtagataaagagaggctaaaccacgtatgctttagtaaggactgtgaatggcttctgttcacgggcaacttgggtggagtaacagcagaaccagtgtcactgccaaatcaataccaaccctacggtgacttatatttggtgaagttggatgggagtgggttgagacgactgacatgtaatgcatatgagaatggaactccggcatggcacccatcaggtacgcctatgactgctttggacatagaacggaacgttatagtaggagataagttgaggggtgaatttgatgatgtactatggatgaattgttgaggtagaacaaaagtgtccagtcaagagaaagatcaatctgaacttcaaacaggtgctattgttgttctctcatag

SEQ ID NO: 317 - DNA, 2449 bp, Solanum lycopersicum
aaagtcgactctaacacatttctcagcaaaaatggggaaaaagcagcaaaaaaaggtccaaaatcaagaagaattgttgaaaacattgggagatttcacaagcaaagagaattgggacagctttttcactatcagaggttcagatgatgcttttgaatggtatgcagagtggtctcagctcaaagaaccacttctctctaatctcacaattccatcatcaaacgacgccgtttctgccaaagaactgcaaattcttgttccgggttgtggcaattcgaagctctctgagtatctttatgatgaggggttttgtaatattactaatgttgatttctctaaagttgttatttcggatatgttgagaagaaatattcgggctagacctgttatgaaatggcgtgtcatggacatgacgaatatgcagtttgcgaaggagagctttggtgccattctcgacaagggaggattggatgctttaatggagcctgagcttggatcaaagttagggactcagtatttgtctgaggttaagagattgctaaaagtcggggggagatttatttgcctcactttggcagaatctcatgtattaggtttactcttcccaaagtttcggtatgggtggaagatggggattcatcccattgctctgaaaccatctgacaggtccagcctacagacttttatggtggtagccgagaaagaaaattctcctgcattgtgccaaatattgtcaactgttaatcagtcgtccttaggtggtccaaataaccaggttcatggactctttcaagcacttgaagatgaaaataaaatacgtgcagattattccagtggttctgatatcacatatgcactagaagacttgaaaatcggagttgagggaaatctggcagagcttcatccaagtcgtagagttcagcttagtttaggtgaacctggggtttcccttttctgttacagagctgtgcttcttgatgcccaaaggaactttggaccttttgcatatcaatgtgctgtttttcttgtgccaaagactcgagctcatgagtggctgttctcttcagaagaaggacaatgggcagttgtagaaagctctaaggccgctcgtttaataatgattttgctggattctagccattcagacgccagtatggatgacattcagaaagatctctctcctctgataatgcaattggcgccaggagattttgacgatgaagctcagataccttttatggccgcaagtgatggaatcaaacagcgaaagattgttcaagagatcacatctcccttgactggtccaataattgtagatgatgtgatctatgagaaagttgatgaaaatattagccgtctctttgcatctgaggatgtgatatttcgtcgccttactttccaaagaacggagagtttagttcaatctgaggctgtgctatcaaaagaaggatcaccgaagtctctagctgatattaatcagaagataggccagtcatcttcaaaatccaagaaaaaaggaaatcagaaaaaatctgggtctaatgtctcatcgtctgatggattgagcaatgatttgaaagttgaccacagttatttggccagttcatatcatactggaatcatctctggttttacattgatatcttctcatttggatggtttggcatctacgggaggcatggtgagatcagtagtaattggtcttggagcaggattgcttcccatgtttctacgcaagcacctgagttttgcagagattgaggttttggagttggatcctgtggttgtagatcttgctagagactattttgattttagagatgatgaacggttaaaggtacatgtgactgatggtttgaagtacgtcaaggatgcagctcatgcagttaccaatggttatgaaaatgatgtttctgaggcaaaggtcccttcttccaatggtaattccaccctgtctaatgcaccacttaaaagcacagaaaaaattgacatgctcattgttgatgtggattcttcagactcgagttctggtttaagttgccctgctgcagactttattgaagagtcttttcttgtggcagcaaaagattctctttctgatcaaggtctatttgtcataaatttggtatcgaggtcacaagccatcaaggattccatttactccaaattgaagtcggtatttcctcacctcttccaccttcagctggacgaagatgtcaatgaggttattttcgctctcaagacagagacatgtatcacggaagataaatttcacgaggcttctcaacgacttacaagattattaaacctagagaactcctcatggggccaaaatataacagaagccactagcaagatcaaaaggttgagatgatttacacattgatgaatgctatcgaatactgcagtctaggggcgaagctagaagcacaagtatgagtctagattt

SEQ ID NO: 318 - DNA, 1128 bp, Solanum lycopersicum
cccatatcacaagtgttcaatttcattttctggactgaagaatttgagatttttttttctaattcttactgaaaacccatcatgggttcttcgttttctgtgttgattcctcagttttcatctactgttactcagcaaactcacccaagtcttggtgatttgccggaaagttgtgtagcttcagttcttgtatacatggacccgcctcagatctgtaaattatctatgcttaatagggcttttagaggcgcttcttctgctgattttgtgtgggagtcaaagttgcctatgaattacacctctattattcaaagggtctttgctggtcgaaattttccggctaatttgtgtaaaagagatatttatgctaagctttgtcgacctaattcttttgatggtggctcaaagaaagtttggttagataagaaaactggaagagtttgtatgtctatatcttcaagtggcttggtgataacgggcatcgatgataggagatattggagtcggattgaaactgatgaatcaagattcaagtctgttgcatatctccagcagatctggtggttcgaagttgatggagaggttgatttcccattccccgttgggtcctatagcatattcttcagactacaagtaggacgagcctcttggagatttggacgccgagtctgcaactccgagcatgttcatggttgggataggaaaccggtgcggtttcagctgtcgacatcagatggtcaacaagctacaactcaatgctacttgaacgaacctggaatatggaagtaccaccatgtaggtgacttcgttgctacgggttcagtagaacccatgaaagttaaatattcgttgactcagatagattgtacacatactaaaggtggactatgtgtagattctgtactgatatgtccagtagagtttacagagaggttgaagcagagtttttgatttgctgattacctgttgctgaggtaggctcgtttggtaggaggggtaaaggatatgactaatcccgagatttattttgttatgagtttattccatatttggttagggtaaaatcgcaggagataacgattatcgtggaataactcgtttctaaccaaacgagccctaggagttgta

SEQ ID NO: 319 - DNA, 1066 bp, Solanum lycopersicum
atcggagttgaaaggcttgtagttgttaaattcatccataaggctaaatgggagacatagtgattgaacattcagggtcgccacattatgaggccttgaacttgcaaaatgttacaacatctgagaatgatgctgatctggttcggagttactgtgggggcttctttcctgagggtagtacacatgaagaaaaatccacttgcaccgaagccctcgacagaggattctttgaatatggatgttcccactatcgccgtagatgtcgcattagagccccatgctgcgatgagatgtttgactgcaggcattgtcataatgaatctaagaacaatatcaacattgaccagaaacttcgacatgagattcctcgtcacaaggtggaaaggattatatgctcactttgtaatacagagcaagaggttcggcaagtttgcatcaattgcggtgtgtgcatggggagatatttctgtgaaacgtgtaagctatttgatgatgatatatccaaaagacagtatcactgcagtggttgtgggatatgcaggattggtgggatggagaacttcttccactgtcccaaatgcagatgttgtcattctgttctattgaggaacagccacccctgtgtagagggggcaatgcatcatgactgtcctgtttgttttgagtatctctttgagtcgataaatgatgtaacagtcatgccttgtggacacactattcataagaactgtttgaaggagatgcaggaacactaccaatatgcttgtcctctctgctgtaagtcggtatgtgatatgtcaaaggtgtgggagaaatttgacatggaaattgctgcaacaccaatgcccgaaccttatcaagacaagaaggtttggatcctttgtaatgattgtggaatcacctcagaagtgcaatatcactttgtggcccagaaatgtccatgttgcaaatcttacaacacccgccaaacaagaggtggataaaaggaccaaatatcaatagccaatctggctttcaagtgaaaatgatcccacaccctatgtggctagggtggtacctctgagtg

SEQ ID NO: 320 - DNA, 378 bp, Solanum lycopersicum
ttcttcttcttcctcaacaatggcgcctatgagtggaaagccctttgctttgaccggatcaagcagcaagaatgacggcgttttagctaggatttctcaatccaccattgttacgaaggggaaacaagcagcttgtgatgcgacttatgtggggaaaaagcttgcgaagagtactggaaaagctgcttggcttgttgctacaacgtttttggttctgggtttgccgttgattattgttatggatcgtgaacagcagctgaatgatcttgatcttcaacaagcaagtcttcttggtgcttcccctgctactacacagaattgattttgttagtgggtttgagaaatttgtagaatgggttgggaaagctgcagtttatt

SEQ ID NO: 321 - DNA, 761 bp, Solanum lycopersicum
aaagtcgacgggaacttcatggcatttgtagcctaacttgaataagtttcttggattggcttgacctaaatagaaggaagctcgagctacattgcaaaagcttttatcagcttgtgatgaagaaaattgaggatccaacatcccgtcaacagttctattcaaagcgcaaggataccatccttaagaagtccaatgagttggctgttttatgtgatgtggatgttggtcttctaatgttttctccagccggcgaagtgactagctattctagcaaagaacgtcttgaggatgtcatgctccttgctatgaacaaggctggtgaactgaacaagctatctcctgaaaatccaaatgaacaggctttgatggactctctcacacaatcaaaacatgaagccgaaatggtggagaagatagcgattgttgaggctcatgaggagaagcttaatggggtcaaagaaagactaagtgaagcacaacagaaaataaggtattacgaaccacaagtggagagtatcaactctgtccaagaagctgatgcatatgagaagttcattttgagtgctctggaactgattcaactatcaaaggcaaaactcttgggtgaccaggaatttctccagagaaatgaaaatgttgcggtgtcttctgtcaacgcagaggctatggctgctgaaggaaccagtgggggatggatgtattgaggaaacaggccggatcacggcggggaagtagctgaggatgtccaatagtctagattt

SEQ ID NO: 322 - DNA, 1169 bp, Solanum lycopersicum
tactgccgtctaccgatttcaccgctatatattcatttcctatacaatctgttttcgcaggttttgttccaatttcaaggtgttgttgcttccccaattcacagagaattgaaattggtgaatttgatatggctgggaagattatgcatgctgttcagtacgactcttatggcggtggagccgctgccttgaagcatgtggaagttcctgtcccaactccgaagaaggatgaggtcttgctaaaactcgaggctgcaagcataaatcctgttgactggaaaattcagaagggcgtgcttcgtccccttcttcctaccaagtttccttttattcctactaccgacgtgggaggagaggttgtagaggtaggatctaatgtaaaaagcttcaaggctggtgacaaggttgtggctatgctcaataccctgaatggaggtggattggctgaatatgcggtggctaatgagagtttgactgttccaagacccgctgaagtatcagctgcagaaggtgcaggtcttgttattgcaggtcttacagctcttcaggcccttgtcaatcctgctgaggttaagctcgatggaactggaccccggaagaacattctagttacggctgcttcgggtggtgtcggtcactatgctgttcaactggcaaaacttggaaacacccatgttactgccacctgtggagcgcgcaatatagattttgtgaagagcttaggagctgatgaggttcttgattacaagaccccagagggagcagctcttaagagtccgtcagggcaaaagtatgatgcagtgattcactgcacgacaggcatcccttggtctacctttgagcctaatttaagttcgagtggaaaggtggtcgatataactccaggagttagtgccatgtggacctttgcagtaaagaaattaaccttctcaaagaaacagttggtgccactgcttctgattccgaagaaggaaaacctggaattgattgttgggcttgtgaaggaaggaaaacttaaaaccgtggtcgactccagatttcctctgagcaaggcagaagatgcttggagcaagagtattgatggacatgctaccggaaagattgttgtggagccatagagtactggtctaaaaaggcttgtgtgcagtttgtcatctggctaggaaacc

SEQ ID NO: 323 - DNA, 678 bp, Solanum lycopersicum
ggagtccattgtaaggtcaatctccaatattcccccaaaatggatgggagcaattattacttgatgaataggagccacattccagcatttggtagctgggactgtaacaatgattttccaattcctttcactcagtgctttgaatctgctaaaaaagttgggttgctcagatacagctactctgatgaccgtgatttgtatgtcgccggagatctataccagaatgatatcctcactccggccatgatcgtcgttcctcgtcgtaagagaaaatcaagtattagtgatggagttggaaaagcaagaaaggagaggtgggtggtgtgcaattgtgaatatgaatatgatgaagagaaaaaggacataactattgttccacctccacctccacctataagagcatccaaagcagtagatgaagatctctacaagatttcccctcaattgctccactataagcctacaaggaaaggtgttaggagattcttttcgagctgcttgctgccaacttgtgcttcttgatcctcaaataacacaagattgtcaacattatataggactagtagtatcgtattaatagttgctatgtgtctaatattaatttagtgtttggagtattttcttggggttttagcactaaattggcttataaactcagagattatgccagcccaagaa

SEQ ID NO: 324 - DNA, 2466 bp, Triticum aestivum
gctctcgtagctagggtttgagtctgctgctcgcgcagccacgccatggctaccacgccggcgctccacgacgcgctgctcgactttacttcgcgggagaactgggacaagttctttgccctccgcggcgatggcgacagcttcgagtggtacgcggagtggccgcaaatcaaggccccgctcctgtcgatgctccttggggaagaggggacggagatccttgtcccggggtgcgggagctcgtcgctctcggagcagctgtacgacctggggttccgccgcatcaccaacgtcgacttctcccgtgtcatcgtggccgacatgctccgccggcacgcccgtgtgcgccctcagatgcgttggcgcgtcatggacatgaccaatatgcagtttccagatggttcgtttgatttcatacttgataagggaggattggatgctcttatggagccggaggttggcacaaaactggggatgaaatatctagacgaggccgagagggttttgaagtcaggcgggaaatttgcatgctttactctagcagaatcccatgttttagacctacttttgtctgagttcaggtttggatgggatatgactattcaagctatagctagtgaaccctctagcaagtctgccttccagaccttcatggtggtcatggtaaaagggaagatgggtgttgtacgcacaataaaatcactagtggaccagtctgctgaatactgtaacatgcaacaggcaaatgcagtaattcatgctctgcaaaacgagaacaaaatccgggagtcacacaattctggtgttgatatacttttctcgttgcgagatcttcagctgggcactattggagatctaaaggttattgtcccaggacgaaggaggcagttaattctcggtgaacaaggaagctcactgtattgctacaaagctgttttaatggatgccaagaatcaaaacgagacatttgtataccactgtggagtttttattgtgcctaaggcacgagctcaggaatggttatttgcttcagaggaagggcagtggcttgttgttgaaagtgcaaaggctgctcgtctaatcatggtattcctcgatagcagacatgcaagtgctgacattgatgttgttaagaaggatttatctcctcttgttatggatctagaacctgaatatcctgaagagacagaccctatgccattcatgatggctagtgatggcgtgaaacaaagagatattctgcaggaggtaacatcagaaataacaggtcctatggttgtggaagatgttctttatgaaaatgttgatggagatcaaagctgcatgtctgaaaaaatgttccgacgacttatttttaaaagaagttctggcttagtgcaatctgaagcattgttaatcagagaatcaccaagtgacgagacggacagtaagaccgagaactcatctgcatcatcaaaaaagaagagccagaaaaagggactcactggatccaaggacagtctcagggttgaccatagctatcttggtagctcttatcacagtagtatcatatgtgggctttctttagttgcatctgctctgagtgctgcggcatcatctggagaaagggtcagtaccactattgtaggccttggggccgggagtttaccaatgtttcttcgtggatgcctccctcatcttaatattgaggttgttgagttggaccccatgatggaggaggtagcggcgaaatattttggcttttcaatggatgagcaattgaaggtgcatttgggggacggaatcaaattcattgaagaaaatgcccattctgaaccaaatggcaaagacagtgatgcagttagaattcttattgttgatgttgattcatctgatctaagttctgggttgtcttgccccccagcaaactttgtcgaagatgctttccttatgtcagcaaaaaggttcctttcagctgggggccttctcatcatcaatctagtcgcgcgatcatctgcagtcaaggaaatggtcatttcacgattgaaagcggtctttgaaaacctatactcactgcaacttgaagaagacgtgaacgaagttctgtttgcgtccccaagcaaaagatacctggaaatcgatcaccttgatgaggctgcaactaaactgaaggctatgctgaaattcccggtggatgtggaatcagatatgaagaatttgcagaggctgcagtagtataggcatctgtgcttgtgaggcaccatccattactcccggcactcagatatgaagaatctgcagaggatgcagtagccggtaggtgtaggcttctgtattgcagataatgcagtatatgtggaatctagcttttccaagcatgatgaatttaattttctcttcttcattatataccccaaaggtgtcctcccttaatttgggatgaaaaaagtgctcggatcttccgtgatgtttcagccatagtgacca

SEQ ID NO: 325 - DNA, 1067 bp, Triticum aestivum
aaagtcgacgccgctcttctccaagtcgccggcgtccctgctgctgctctccaagctgctcaccctctactgttgagctcccggcgggcggctgtttccttctcggtcgagtgagtcatccatccatgggcgccgtggggtcgtccgcgaggcggggcgggggcaccgcgctgggggacctgccggagaactgcgtcgccgaggtgatgctcaggctgaacccgacggagatctgcgggatggcgcggctcagccgcaccttccgcggcgccgcgtccggggacgccgtctgggaggccaagctgccgcgcaactacgcgcgcctcctcgccgccgccggcggagacgaggaggccgccgcgttggaggcggaggccatcccgaagaaggagctgtacgcgcggctctgccgccgcaactccctcgacggcggaaccaaggagttctggctcgacaaggctggtggaggcacctgcatgacaatctattcgagggcgctttcgatcaccggcattgatgacaggagatactggaacttcattccaaatgatgaatcaaggttccgttcggttgcttatctctcgcaaatctggtggtttgaagtcagaggggaggttgagttctgcttcccagaaggtacatacagcctgttcttccgtattcatcttggcaggcctttcaagcggctcggtcgccgggtttacagtgccgagcacatccatgggtgggacgtaaagccggtgcgcttccagctatcgacttcggacgggcagcaggcccagtccaagtgttacctaactgatccaggcgtctggatctatcatcatgtcggcgatttcgtcgtgaaggactcgaacgagccactgaatatccaatttgcaatggttcagatagactgcacacacacaaaaggaggcctgtgtatggattcagtggttataaaacccaaatgccttgcgcggaaaaagggacctgggagttatgagtagatttagtgagcacattaagctcgatatctatagaaactatatggttttgcttacttcctccgtcgtgtgtctagattt

SEQ ID NO: 326 - DNA, 362 bp, Oryza sativa
ttcatcaccaactcgatcagaccgcagagacgagggaagatgagctcgtcggcgaagacgtcgtggccggaggtggttgggctgagcatagaggaggccaagaaggtgattctcaaggacaagcccgacgccgacatcgtcgtgctgccattcggcacggcggtgccagaggattttcgcttcaaccgtgtccgaatcttcgtcgacaccgtcgccgagacgcctcgtgtgggctagctagcagaatatatatagctttaaattaaaattaataatggttagtagcgatgctgctgtgccccgaccgtatcctttctctaaaattgatatcatatatatgtgtgtaaatcatcaatcctggg

SEQ ID NO: 327 - DNA, 431 bp, Oryza sativa
caaccatggtggtctcctgccagctcaagcctgcgccggctccggccgccgccagcagaggcggcggcgcgcctcacctccagcagctgcgccgggcgtgcgtcgcggcggcggcggcgtgcgcggtgctcgggacggcgggcggccccggcgaaggcgccgtgatggcgcgtgcgccggaggcgacggcggcggcggcggcggggccggcgcggtggagcgaccgccggcagtgcccgccgtggcgcgccaactcgctggagaacatcgtgccggagaacctgccgcggccgtcggctcgccggaggttcaacagcatcacggcggcggcggcggcggagagcgcgccgccccccgcgtcggcgtcgcccgacgccgtgctcccgttcttggcgccgcgctccggcatgggctgcttctccctctaataa

SEQ ID NO: 328 - DNA, 917 bp, Sorghum bicolor
atcaccgggacctagcatcgccgcggcggcggcgggagaggggaaggaaggcgatgaggaaacgggagcgggagaacccgtgcgggatctgcggtcactaccacaagtacgaagagggggaggtctgcggggtgtgcggccaccgcttgaagccatcggatggggagggcgccccgtcgagccatgagtccgccttccccacagaggtgctgaaggagttcctcttcctcgggagctacgacaacgcctcacgctccgaggtcctcaggacgctcagtatctcgcacatccttaacactgtgcctgattgccacaatctttacaagaattcattcacgtatcacagtcttcaacgggacaggcctttggattttgacgaggcaaaccagtatctagagaaatgtgaaagagataaatcgcgtgttcttgttcattgcatgactggaaaaaacaggtctgctgctattgtcgcagccttcttgatgaagtctagaggatggagacttgcacagtcttttcaatgggtgaaagaccgaagaccgcaggttcaactgacagatgcttctcagaatgagcttttggagtatgagctgaagctttttggacccagtgctcaacccttggttcccactgaatcatttgcttctcttggatttggttatgaaaaaccagcaggtgacatccaagcacctatgttcaaccaaatgaccatgccatccatatttgagcgagtcaacccaaatgatcaccccaccaatttcacttttggagctgagaggatagcggaagttaaccctcacgataacaatagtgatggtggggtaaacccaactaaaacagagaacctgatggacggctcttaagatggtttcatgatgtcactgttcaatctccatgttgcagtgtactccttgtag

SEQ ID NO: 329 - DNA, 1005 bp, Sorghum bicolor
atccgctagggtttatctgctcgaggaatggcgtcgctgcaggtctccggcgcgggggttggcgccgcggccttcgctgcgaaggggaaggcctccatcggtgcgctccggcttccatctactgtgaccgtcggcgaggtctgcccggcccggcgggcgttccgcggcctcgtcgtcagggccgccaccgtcgtcgctcccaagtatacaacacttaagcctttggccgatagagtgcttgtaaagattaactcttccgaggagaagacaactggtggaattttgctccctacaactgctcagtccaaacctcagggtggtgaggtagttgctgttggagaaggaaggataattggggataagaaagttgatgtcagcattcaggttggagctcaagttgtatattcaaagtatgctggaaccgaggttgagttgaatgactacaaccatctggttctcaaagaggatgacattataggtatcttagaaactgatgacgtgaaagacatgaagcctcttaatgaccgtgtactaatcaaggttgctgaagctgaagtcaaaactccaggcggtctattgcttactgaaactagcaaggagaagccatctatcggaacggtcgtagcggttggcccgggccccctggacgaggaaggcaagaggagcccgctgtctgtgtccgcggggagcactgtcctgtactccaagtacgccggcagcgagttcaagggcgctgatggcacgaactacatcgtgctgagggtgtcggatctgatggccgtcctctcctgagctgggctggaggatagaggcgcaggagcaggatgccatgccattgccagtgccagccagccagtggtaccacaaccacaactcccagttgctgcatcggcgcatcgccattttttgtgggaatgggggttccctggcggcctaccagtactgtaggtttcctcgcggctttccgtttttttttttttcttcttcttggtcgtcttgtctgac

SEQ ID NO: 330 - DNA, 1231 bp, Sorghum bicolor
cacgcacacagagagaattcagccgccgccgacgacgacggacatggcgcgctgggccattgccatccacggcggcgcgggcgtggacccgaacctgccgcagcacagccaggaggaggcgaagcgcgtgctggcgcggtgcctgcaggtgggcgtggacctgctgcgcgcgggcgcgcaggcgctggacgtcgtggaggccgtggtccgcgagctcgagaccgaccctttcttcaactcgggccgcggctccgcgctcacccgcgccggcaccgtcgagatggaggccagcatcatggacggccgcggccgccgctgcggcgccgtctccggcgtctccaccgtcaagaaccccgtctccctcgcgcgccgcgtcatggacaagtcgccgcactcgtacctcgccttccacggcgccgaggagttcgcccgtgagcagggcctggagaccgtggacaatagctacttcatcaccgaggacaacgtcggcatgctcaagctcgccaaggaggccggcaccatcctgtttgactaccgtatcccactgacgggagcggacacgtgcagcgcgctggcggcggccgcggtggacagcggcaaccaccaccacaaggctggcatggtgatgaacgggctgcccatcagcgtgtacgcgccggagacggtgggttgcgcggtggtggacgcgtcgggcgcctgcgcggcggccacgtccacgggcgggctcatgaacaagatgaccggccgcatcggcgactcgccgctgatcgggtcgggcacctacgcgtgcggcgcgtgcgccgtgtcgtgcacgggcgagggcgaggccatcatccgctgcacgctcgcgcgcgacgtcgccgccgtcatggagtacaagggcctgcccctgcagcaggccgtcgactactgcgtcaaggagcgcctcgacgaaggcttcgcggggctcatcgccgtgtccagcaccggcgaggtggcttatgggtttaactgtaccggcatgttccggggatgtgccaccgaggatggattcatggaggtcggcatctgggagtgagtgagccagcgagtcctcggaggtggagacgtgtgctgcatgtggcaatcctgcgattgccatgtgcataatctctgtttctggtacttggtagtattgctattgggttgtcagtagtagtggtcacaagtgttgtccactgatcactagtggtagcgattggagattggacct

SEQ ID NO: 331 - DNA, 550 bp, Sorghum bicolor
agaagctcttgggactcgaacgagcatggcggtctcctccatcagctgctcccttcggcctccagctcccgtcagagaagcttccgctcgtctgacgccgccgcagccgtcgccaccaaagacgacggccacgccgtgggcggacgggctgcggcgggcatgcgtggcggcgtcggcgacggcggcgtgcgtcgtgatcggaacggcgggaggtggcgacgtggtggcggcgtcgatgccacgcgacacccccgttctggctgtggacgcgcggccggcggcggcggcgccgcggtggagcgaccgcagggagtgcccgccgtggcgcgctaactcgctggagaacatcgtgccggagaacctgccccgcccgtcggcgcgccggaggttcaacacagtcaagcgagcgccgcggaaggcccccgcgctcgggcgtcaagcggtggcgccgccgttcctggcgctgcgctccggcgtggacgactgcttcaccctctaggcaaggcaagttaggcaggtagtactagctgaccattctccagctgaatag

SEQ ID NO: 332 - DNA, 1672 bp, Sorghum bicolor
ttcgtttcgccaactataaagccgggggtcctctggtgtgtgacctttttataccgatgtgcagtgcagcgtcaacttcgtcaggtttcttggctccaacaaccttcgttcctgggtcactctaaactgtaaagatggggtgtggtccatcaatccccgagaagtacagcatacgagggaagagtggcaagcgccggagcatcatacaggaggttgctgtgttcgtgcccaccatccgcataccgttggcttctgacatagctcatccgctcaggggaatagtttccaaggatctcgtcgatcgcctctccacactccgtgctcatgtcgtcgcgctggctgaagaaatctattctgcggacgtatcagctgttcaagaactgcaacatgcgttagaggagtacttgccagttgttcttggtttaacaatgaaagagagccgtcttgaatcgtcagtacaattcacctggaagaccttagacgatgaccaggagtgttgtttggcgagtgcatggtacgaggtgctctcagtggtccacatgatggccatgcttgcattgtttgaggccaatctattactcattccaaagaacagtcaagttggtggtgaaaggaaggtatcagaagatgcaaagaaggatgttgtcgattcattgctcagggcatcgggatgcttagactatttggtgcatcgcatacttgttcaaatacctgcacaagtcaagaagagttttccttgttacttgcaggagggtatgcttgaggccatctcaattcaggcattggctcagtgtgtggaaatacagcttggcctggcttctgaatgtgaaaaggcaacattgtcagtaaagaggaggctagcctgtgagcaagtcagttatttttctcaggctcactattgtctgtcgggatgcgatacaagtgactcatatggaaagaagcttctgctgttcctgaagtggaaatgcatggaggctaaggctgtagcatattactaccatggtctcgtactcgacaagggcggtgaaccggccaaccatatcagtgcagtctgctgcctctctgcagctgacgacctactttcagacagcaaaagggcttgcttgagtttctgcttggcaaatcctgtcacaagggtacctcctccttggggtgtcatgaaaaacatgcacaaaaaaatcccagatgttgcttacaagaagtttcaagtgtatgggcatctgtttgagcaaaataagaatagcacacttcaatcagttcctgatctaccagagtttgcgctgtcactgagaccggaaggatacgaattgccaaccactgattcaatctgggagaatgttaatggccaacctcagattcagagcctcaaggagcatctggacgatggcgaagatgaagtagatacaaaatgatagttctcacttccaaatgcttcctttcattgtaccaccaaaagtagcagaagttatactgtagacttcaaaatgcttaatccaaaatgttttggattcagcatatgccacaactgcatctgtataattgcaagcattaccatgtgatatagtaaagtcttgatgtgtaatagaatcataaataataggaaataatagttggtttcttactgtaattgcctgagttttattttcccaactggaagaacagagcacacaga

SEQ ID NO: 333 - DNA, 2056 bp, Sorghum bicolor
caaccccacagcagctaggcgccacggcagctgtcgtgcccagccgccttctgcgcctcccctacctcagccaaaccctatcctcccgcccggaaaacagtattggacgatgttgattagagcggatggtggtcatgccacaagaaggtcgaagaagaataaaataacttgcaatgacgatagagacacaacagagccattgatttcaggtgatattcatcaggactcagaacaaggtatctggagtgagctcagtgaagaagttgcattgaatttgcctggaagtgttgtctcagttgctgtgctgtgtggaagttctgtgttatttgcatgctcgggaatagctataggatgccaggggtgtgtcacaaggattctgacttcagcaagtttggttagagcattaaatgataaaacaaaacaccctgctaacttgaaggttgaagtgcgctatggaggcaatgttgtcacaggatttttaggaaaatatgatttagattatggcattgctattgtcaatgtcacagcctgcctcgatgttcaagctatacgtctcacccatgtggtggagatggaatttcgtccatctacaaaggtagtagctttagggcgtgacctctctggcaaattaatgactactggtgggatactgacccgcgattcaagagaatctgaagatagtgaagagcttatgctatccacttgtaaaatctgtgagggttgggaaggcggaccacttttcaatgtagaagggaatcttgttggcatgaaccttttttttgttaaagaaagaactgtgttcctgccaacaagtataatctttgaacggttggagcatttccgagtattctttaggaggggtgaatttcttgaacggttacggaacttgaaggcatgcagtactggtgagacactggtacctgagaacagtggtgctgatctaacaagatgctcaaaggagaaaagaactgatgatctcacaagcttggatattaagactgatctcacaagaagctcaaagaagaaaagaacttgcagtggtggaggaaagacaacgaagtcattgatttctggaaatagtgatgttcttagtgatgatccatttgaggatctagacatctcaggttatccaaagccaccaatagaaatgtctgatggcatggttttagttaatacttttgaagatacttttggcgataaatatggtggaggtgtttggagtgaacttagcgaaacagtttgttcaaacatatctcgaaacgttgttgcacttgcttcatgctatgggaaaagaaggatttttgcatgcactggtttttttgttgaatggaatggatgtacaactattctgacgtcagctagcttactgtcagattttgttgatgacgagaagattcttgaagacttgaggattaaagtgttgcttccaaccaaacatatcagagaagggacattactgcattataatatacattacaatgttgctctagtcagtgtcaaggatttctgttctccacatccgatggatattgaacatcagaggcatagtcgtcctcgtcaatcagtatctgtagggcgctgcatagaatcaggcacactaatggctgcaagagggatacatttgaacaggtttgggagactggattgcaagttgctacagtactccacatgtaaaatcaccaaggctgggattggagggcctgtcgttgatcttgatgggaaatttattggcatgaacttctatgacatgcaaagaactagacctccatacctttcatgggatgtgattcttgatgtcttggcacattttaagacaaagcggtctgttcctgaagtaggccatgctagttattatcaatttgctgtcctgtttaactggactattgatggagataagagtgtgcgtccaaacagttggcctgtgcccaaggcattttggtgccctgctgagtatgttgacatggtgggtcaatcgtgtgttcaaaagcgaggcaaacgcagccgccccagaattagagttattaatggaagggagtaccgatatgcgtagagctag

SEQ ID NO: 334 - DNA, 1331 bp, Sorghum bicolor
tacctagcttgaggacgacacgacacgatggccttgcaggtcaccggcggagtgggctgctgctgccctcgtcctcaaccgggctgtggcggccggcggttggcgcaggcggcggcggcgctctgtcgcccgccccgcgctgtagcgtcgtccggcacgaccacgacggtggtggaggaggacgagggcaaggtgaggctgggcggctcaagcgtcgccgtcaccaagctcggcatcggcgcgtggtcctggggcgacaccacctactggaacgactccgagtgggacgataggagactgagggaggcacaggacgcgttcgatgcgagcatcgataacgggatgaccttcttcgataccgcagaagtatacggtacagcgctcatgggagcagtcaattctgaaagtttactgggaggattcatcaaggaaaggcaacagaaggaccagatcgaggtggccgtcgcaacaaagttcgctgcccttccttggagatttggaaggggtagtgttctttccgcgctgaagaaatcactagaccgtcttggcctatcgtcggttgagctctaccaactccactggccagggatttgggggaacgaaggataccttgatggtctcgcagatgcttatgagcaaggcctagtaaaggctgttggagtctcaaactacaatgagaagcgccttcgggatgcgcatgctcgtctcaagaagaggggtgttccacttgctgcaaatcaggtgaattacagcctcatatacagaaccccggagctgaatggtgtgaaggcagcttgtgatgagctcggtatcaccttgattgcttattcaccgatagcccaaggtgttctgacaggtaagtacactccagaaaagccccctactggtcctcgagcaaatacatacacccctgagttcctcaccaagctccaaccacttatgaacaggattaaagagattggagcaagctatggcaagagtccaacccaggtgtctctgaactggctgacctgccaggggaatgtggtgccaatccccggagccaagaatgccagccaggccaaggagttcgctggtgcactcggttggagcctgacaggagacgaggtcgaagagctacgaactctggcacgcgagatcaagggcatcaagatgcctatcgaggagtcgtagatactccgtatttcaccaaccccatgcatggtatagcactgattagagattataaggttttaaagcgagaagaagaaaacacacggatctaaaaaggaaccaagatgtgtaagtactaagtagaaaatgcagctttcaacgaatctcatgcctatcag

SEQ ID NO: 335 - DNA, 1081 bp, Sorghum bicolor
gaagcaatcaagcaatgacaagaatataactactagagagactgatggcggacccggtagaatggagtcgggagaacatcacattcttgcacgaaaacgaggtgaacgcggatgcagagaattggcttgctgtcactgttgtcctcaaggtgccaccaacagcaaaccaagattcggttaatcgcgaattgatacggtgtgcaattctcgataagtgcaggataatagtttttaaaagtgacattatgcaatatgatcacggttacttagtgcgcaccagcgggagggaagaaacccaattgatcctgaatactgattttttggacgttgggcccaacaagcttattgtctatccatggtctccctacaatggttccacctgtcaatattttgatcacataccacccaacatcggaatggtgacaccagctaagcgcccacgagagtctgatgttctggaaaatctaaaggttaggggtcacgggctgccaccacatttatgcacgagcaatgtcataagaaaagtcttctctagcatatgtaggtttcacaagatggaaatataccagggagatctgagttttgccatctggacatttgcaagccgacaatgtatacctgatacatggactgtagctgtcatcaaagatacaatgttgtacatgtggccactttggctctttgtagaaggctgtgcaccgccgcctgccccaaggtcagaggttttgaagaacacacgggtgaagttcaacctgtacccagggacatccttaggtggtggaggtggaggtgcaagtggaagtggaggtggtggtactgcaggtggacatgatggacactctcgtgaagctatgctattaggttacgttgttgaatcaccgtcttcatctgattcatcatcagattcagattccagccaaccggacagcccatgccagtccgatctatttgccgaaccaactttgagagtatcaactagcgacactgtttcccaagtacctgagacgccactaggttcaggagagacagaactcgttcccgcctacaactactaaatgtgcttgttatgcatttgaacttg

SEQ ID NO: 336 - DNA, 1660 bp, Sorghum bicolor
aagaagcctcgcgaagacatggcggggaagaagcgcaagtccgggtccgagaagccggcgaagcaccgcctcccgctgggagccgatgccgacgcggttgccgaggcctcgaagcgccgccgctcgggcgccgccaagcagcaccaggcggacgaggaggcgtccatcccgccctccctcagcgccaagatcctccgcgaggcgcgcaagcagcagcaggaggagatgcgcgccgacgactccagcgacgagcagcggccctctgctgccgaggcggccgcggggccgtccacgtcgtcctcgttccccgtccccgccgcggatggcgaggaggaggaggacgacgacgtcgacgagttcgacgggtttgacgcgcagaccgagtacgacggcggcgaggtggagatcaacgaggaggatgagagggcccttgctgccttcatgtcaaaggacaaagctgccgagcgcacccttggtgatatcatcctccagaagatcatggagaaggacgccgaggttgcaactgaaggacgacctcgtgtaaaattggacaacagcattattgagctttataaagaggttgggaagttcttaagccggtacacgagtgggaaaattccgaaagccttcaagcgcataccatcgctggagtgctgggcagatgttgtgcagctaacggagccagagaattggtctcctaatgccgtgtatcaagcaactcgcctcttctcttcgaacatgaacacaaagaacgctgagcggttctatgaagccattttgctacctcgtgttcgtaatgacataaggaagaacaagaggctgcattttgcactctaccagtcgctgaaaaaggccctttataagcctgcggcatttaacaagggaattttgctgccactctgtcgggaaaggaattgcaccctccgtgaagcagtgattattgggagtattatccagaaagtctccattccatttctccatgcaagtgtagctctagtaaaactagcagagatggagtactgtggcactacaagttacttcatcaagctatttctagacaagaaatatgctttgccgtaccgcgcgcttgatgcagtgcttgctcacttcatgcgttttcttaatgatgagaggaccatgcctgttatatggcatcaatcactgcttgcattcgtggaaagatacaagaatgagttagagaaaaaggataaggagaaccttgcacgtttgttggatcaccagaaacactatttggttactccagaaattcgaagggaacttcgagggagctgcaacaggggtgaaaaagatatgaatttgcagactttgtcacctatctccgtcattaccaagcctatcgaggaagacaagtgggacgtaccacaagtgccaatggaggaagattagccatattctccagtgtcaatttttacacttaaatgatttttggggcaaacttctaaagatattgctgtgattttttggtcataaacttgtagtgccaatattataaaatgggtacccagtagatagggccccaatgttctgggaaggtattttgcaatcagaatgcgattcacacagtagtttgttttgattggaacttggaacctgaagatcagttggcgcatttcaaggggtcattcagcatggatatgtg

SEQ ID NO: 337 - DNA, 687 bp, Sorghum bicolor
atcgagcatccgccttccggcgtgatgttcccgtgccgccccctggctccgcggcccccgccgcgtgccctttccctcttgcggcttcctccgtcgtcgctgcggccgccgccgtcgtctctgcgcgtggtgcggtgcatggcgaaggagcggcgggtgcggatggtggcgaagcagatccagcgggagctcgccgacatgctcacccgcgaccccgtcctgcagcgcgccgtgctccccgaggccgcgctcggcgccgaccgctacctctcgtcgctcactaccatcgccgacgtcgagctctccaacgacctccaggtgtgcaaggtgtacgtgtccgtgtttggggacgagagggggaagaaggtggccatcgaggggctcaaggccaagaccaagtacgtcaggagccagataggcaagcggatgaagctgcgcctcacgccggagataaggttcatcgaggatgagtctatggagcgtggaagcaggatccttgctatacttgacaaactaaaggaggaaagggagcaacaagaaggaaaagatggagaggaagatgtagaaggttcatatatatcagaagaagaagatggtgactgggatgcagatgacccagatgaggaggatatcatttatgtaaaatagcctatcgtcttctgggaacttggtcatcattcatcctag

SEQ ID NO: 338 - DNA, 489 bp, Sorghum bicolor
ggaggtgacagagtttggagcctgccggtccactggaacagtgacggaccctctgaccaggactgctacagtttacttcgggtattttctcggaagttggaacagaagaatgcctcatgtctcatgaggccgggatcgtagaattttgcctgcctgcctgcctgccttgctgcgaccaagagctccacgtctccgtcgccggggcaaagccgtgccgcacgggacgaggaaattcacggcacatcacgtataggcaggaggaccgagagttgtgcaagtcaggatctccccgtctcttgcttcaagtgttgcgttgcctacatgcattcttgacctagctggatagtaggtgagtgtagtaactagtcaaatcttgtgcaagggcatgggcaaaacgttacatgatttgccaataccatgtcggatgtgatctaacggtttctgatagtcagacagataccgtgcagcactgaaactctggccttgttt

SEQ ID NO: 339 - DNA, 971 bp, Sorghum bicolor
caacctcgaagctagtccaaactagtgggaggttgtgtgcagggatcgagcaagacgacaattaacctactgttgctgctgctgctgctgctgctactgctaggtaacaaccaaggcaagcgaccaggcagcaatccatctctcggcatccatggcgcggggcaaagtgcagctgcggcgcatcgagaacccggtgcaccggcaggtgaccttctgcaagcgccgcgcggggctgctcaagaaggcacgggagctctccgtcctctgcgacgcccacatcggcatcatcatcttctccgcgcacggcaagctctacgacctcgccaccaccgggaccatggaagagctgatcgacaggtacaagactgccagcggagaagctgccgacggctccggcgacaacagaatggacccaaaacaagaaaccatggtgctgcaacaggaaatcaatctgctccagaaaggactcaggtacatctacgggaacagggcaaatgaacacatgaatgttgacgaactgaatgcccttgagaggtacttggagatatggatgtacaacatccgctctgcaaagatgcagataatgattcaagagatacaagcactaaaaagcaaggaaggcatgttgaaagctgctaacgaaattctccgggaaaagatagtagaacagagtagtttgcttgatgtaggcatggtggtagcggatcaacagaatgggcattttagtacagtcccactgatagaagagatcactaacccactgactatactgagtggatattctaactgtaggggctcagagatgggctattccttctaactgtaataacaccctggagggctcattctgttgattatgattactagtgtgtaatacaattaataatgtttgtgtaatggtttgttctgctactttggtgtaccttgtcgtataaaccatagcccttcaggagtgccctggtattgtattg

SEQ ID NO: 340 - DNA, 1504 bp, Sorghum bicolor
cactcgctccaaccgtcgccgatctccaggcgcagcggcgatgagctccggaaaggcgcagcagcggccacacgccgtgctcatcccgcagccggcgcagggccacgtcacgccgatgctgcacctcgccaaggcgctgcacgccagggggttccgcgtcacctacgtcaactccgagtacaaccaccgccgcctgctccggtcccgcggccaggactcgctcgccggcaccgacggcttccgcttcgaggccgtccccgacggcctgccgcagtccgacaacgacgacgtcacgcaggacatcgccgcgctctgcctgtccaccaccgagcacagcgccgcgccgttcagggacctgctggcgaggctgaacgccacgcccggcagcccgccggtcagctgcgtcatagccgacggcgtgatgagcttcgcgcagcgggtcgccgaggagatggggatcctggccttggttttctggaccaccagtgcgtgcggcttcatggggtacctccacttcgccgagctcatccgacgagcctacgtgccactcaaagacgaaagtgacctgtcgaacgggtacctggacaccgcgatcgactggatccccggcatgcccggcatccgtctgaaggacatccccagcttcatcaggacgacggacccggacgacgtgatgctcaacttcgacggcggcgaggcgcagaacgcgcgcaaggcccgcggggtcatcctcaacacgtacgacgcgctggagcaggacgtggtggacgcgctgcgccgcgagttcccgcgcgtgtacaccgtcggcccgctcgccacgttcgcgaacgccgcggcaggaggcgggctggacgcgatcggcgggaacctctggaaggaggacacgagctgcctccggtggctggacacgcagcgaccgggatcggtggtgtacgtcaacttcggcagcatcacggtgatgaccgccgctcagctcgccgagttcgcctggggcctggcgagctgcggctcgccgttcctgtgggtcatcaggccggacctcgtgtccggcgagaacgccatgctgccggaggggttcgtcacggacaccaaagaaaggggaatcctggcgagctggtgtccgcaagagctggtgctctcgcacccgtccgtcggcctgtttctgacgcactgcgggtggaactcgacgctggagagcatatgtgccggcgtgccgatgctctgctggccgttcttcgctgagcaaccgacgaactgccggtacgtgtgtgacaaatgggggattgggatggagatcgacagtgatgtgaggaggcaggaggtggcgcggctcgtgcgcgaggcgatggacggggagaggggcaaggcgatgagattgaagtcgatggtgtggaaggagaaagctcgacaagcagtggacgaaggtggatcctcgaggaaaaacatggaccggatggtcgagttcctgctcgctgggaatgatgttcctagctgaatttattga

SEQ ID NO: 341 - DNA, 1984 bp, Sorghum bicolor
tttgatatcagcttcgcgatgcagcagcgccttctcgcgctggtggcagcggcagccctgctgctggcgctgcggccggcgctggccaccgacccctacgccttcttcgactgggacgtctcctacgtcactgaggcgccgctcggcgtcaagcagcaggtgataggcatcaacggcaagttcccgggccccgtcgtgaacgtcagcaccaactggaacgtcgtcgtcaacgtgctcaacgacctcgacgagcccctcctcatcacctggaacgggatccagcaccggaagaactgctggcaggacggggtgctgggcaccaactgccccatcccgtcaggctggaactggacgtacgagttccaggtcaaggaccagatcggcagcttcttctacttcccctccaccggcctgcagcgcgccgccggcggcttcggcggcatcgtcgtcaacaaccgcgacgtcatcgccgtgcccttcggccgccctgacggcgacatcaccatcttcatcggcgactggtacaacaagaaccacacggatctgaggaagatgctggacaaggggaatgacctcgggatgcccgacggcgtgctgataaacggcaagggtccgtaccggtacaaccacagccttgtgccggccggcatcgagtacgagaccttcaatgtgcatccgggcaggacgtaccgcatccgggtacacaacgtgggcacgtcgacgagcctcaacttccggatccaggggcacaacatggtgctggtggagacggagggctcctacacctcgcagcagaactacacgaacctggacgtccacgtcggccagtcctactccttcctcgtcaccacggaccagaacgccagctccgactactacgtcgtggccagcgcccggcaggtgaacgagtccctctggcgccgcgtcaccggcgtcgcggtgctccgctactccaactccagggcccccgcctccggccccctcccggacccgccgcaggaccagaacgaccgcaccttctccatgaaccaggcgaggtccgtccggtggaacctgagcgccggcgccgcgcgccccaacccgcagggctcgttccgctactcgtccatcaacgtcacgcaggcgtacctgctgcggagcacggcgcccgtgtccatcgacggcaggcgccgcgccacgctgaacgggctctcctacgcgccgccggagacgcccctgcggctggcggacgcgtacggggtcaagggcgtgtacacgctcgacttccccgagcggccactcaacaagggcgccccgaggatcgcgcgctccgtcatcaacggcacctaccgtgggttcatggagctcatcttccagaacaacgacaccaggatgcagagctaccacatggatggatacgccttcttcgtcgtcgggatggactacggcgagtggacggaggacagcaggggaacgtacaacaagggagacggcgtggcgcggagcacgatacaggtgtacccgggcgcgtgggcggcggtgctggtgtccctggacaacgtcggcgtctggaacgtgcggtccgagaacctggactcgtggtacctggggcaagaggtctacgtcagggtcgtcaaccctgaggacaccggcaacaagaccgagatgggcatccccgacaacgccctctactgcggccagctccacaagtaccagaaggagcagacgccgcaccacaagatgggggtgtctgctgtggcgccgagctcgttgtccctggcgcgccggctggtcgcgtcggcgctgctcgtggccggatccttcgtgttggcgccgtagagtggcaccgttacttgtgcgccgaggcaacaccgttgacataggcttgtttaggattattagaggtgtaggccgcgtcattgtcatttttccctgtcgatatgagaaatgttcttgttcatgtgccagtagtgctgggctctgcctgcctgactgcctcgagttt

SEQ ID NO: 342 - DNA, 349 bp, Sorghum bicolor
gaagcaagatagcaataagcaccgtatcagttgcactttcaattcgcgaccgacaaccgacgacgatgagctccacggcgacggcggcggattgcggcggcgccaagacgacgtggccggaggtggtcgggaagagcgtggaggaagcaaagaaggtgatcctcaaggacaagcctgacgccgacatcgtcgtgctgcccgtcggcacgattgtgaccgcagattttgtgcccagccgcgtgcgtatcttcgtcgacaccgtcgcccagacaccccacatcggctgattaattaagaggctgggtgatgcctagctagctttgattccttccttgctccagaactgaat

SEQ ID NO: 343 - DNA, 1295 bp, Sorghum bicolor
ctcctctacagcaacttccaccgcgtactccctccctcgtcccgtctccaagtttcgcggggggcgaaggttgctagccagagcagtcgcggtctgcgctgcggcaccggcacggcgacgaggtggggatggagtaccgcgacaagctggtgctcgcgcccatggtccgcgtgggcaccttgccatttaggctactggctgctgaatatggtgctgatattacttatggagaagagattattgatcacaaattgttgaagtgtgagcgtgttacaaatgaatctcttgggactactgattttgtggagaaagggactgacagtgtagttttccgtacatgcccagaagaaaggggtagggttgtattccaaatgggcacatcaaatgctgtgagggcacttaaagctgctcagcttgtgtgtcaggatgttactgctatagatatcaacatgggctgtccaaagtctttttcgcttagtggagggatgggtgctgcattactctccaagcctgagcttatacatgatattttgacaacattgcggaggaacttggacacaacagtgacatgtaaaatccgtcttctgaacacacctaaagacactgtggagttggcgcgccggattgagaaaactggtgttccagctcttgctgtccatggaagaaagattaaagatagaccaagagatcctgccaagtgggatgagatagccgatgttgtgtcagcgctgtcaattcctgttatagctaatggagatgtctttgagtatgaggattttaagagaattaaagatgctacaggtgctgcttctattatggttgctagaggtgccatgtggaatgcctctatcttttgtgccaaaggaaaaacaccttgggaggatgtcaagagagagtatgtacgaaagagcatattgtgggacaacgatgtgaagagcacgaaacataccttgaaagaaatgataatgcactattcttgccttgaacttcctgaggggaaaggtgttattaagtgtgatacatcagaagatttagcgagactatatggggaggaggactactataattttgttgtttcaaataggaaatgaatacagtttggtgctgtgagctttcatgtgtatcagcttctgcttggattcctatctcactttttattactgggattaggaggaatctgccctgtcaccaaggaaaacgattcgccatttttgcgctgtctggacgtaggaccactagtccagtaagggttttcaaattgggggaaaaaaaagacactggagctgctgatcttt

SEQ ID NO: 344 - DNA, 2348 bp, Sorghum bicolor
gagccacttagcgagggagcagcctccacctccacctccacggcgacgagagaatggggagaggagggatcggaggcgcggtgggcatggccatggagaacgccgattccgcccgcgcattcgtcaaggacgtcaagcgaatcattatcaaggtgggcacagctgttgtcactgggcagaatggccgattggcaatgggcaggctcggttctctctgtgaacaggtgaagcaactgaattttcaagggtatgaggtgattctggtaacctcaggagctgttggtgttgggaggcagaggctccaataccgtaagcttatccatagcagctttgcagatctgcaaaatcctcagatgaactttgatggaaaggcctgtgctgctgtgggtcaaagtggcctgatggctatctatgacacattatttagccaacttgatgtaacatcatctcaacttcttgtaacggatcgtgatttcaaggatccaagttttggggaccagctccgcgagactgtttttgcactattaaatcttaaagtaataccgttatttaatgagaatgatgccatcagtacccggagacaatcagatgaggattcatctggtgtattctgggataatgacagtctagcagctctgttggcagccgaacttaatgctgatcttcttatcatgcttagtgatgtggagggactctatagtggtccaccaagcgatcctcagtcaaagattatccacacatatgtcaatgaaaagcatgggaagctaattagttttggagagaagtctaatgttggaagaggtggcatgcaagctaaagtggctgctgctgctaatgctgcatcaaaaggtgtacctgttgtcattgcaagtggatttgcaacggatagcatcattaaagttctcaaaggagaaaagattggtacacttttccacaatgaagcaaatttgtgggaatgttccaaggaagctacagcccgagagatggcagttgcggcaagagactgttcgagacgtctacagaagttgtcatcagatgaacgcaaaaagattttgctagatattgctgatgctctggaagcaaatgagggtgcaattaggtctgaaaatgaagccgatgttgaggcagcacaaggtgctggttatgaaaagtcgttggttgctaggatgaccctaaagccaggaaagataacaaaccttgcaagatccattcgtgccattgctgacatggaggaccctatttcccatacattgaaaagaacagaggttgctaaagatctggtttttgagaaagcatattgcccattgggtgttctgctcattatttttgagtctcgtcctgatgcattggtccagattgcatctctggcaatccgaagtggtaatggtcttcttttgaaaggaggaaaagaagctatgcgatcaaacgcaatattacacaaggtcataactggggttattccagatattgttggtaaaaagctcataggccatgtgactagcaaagatgaaattgctgatttgctagcgcttgatgatgtgattgatcttgtcattcctagaggcagcaagaatctagtctcccaaatcaaagcaacaactaagattccagttttaggtcatgctgatggtatctgccatgtttatattgacaaatcagccgacatggatatggcaaaacggatagtattggacgccaaggttgattatccagcagcatgtaatgcaatggaaacactacttgttcataaagatcttaacaagagtgagggccttgatgatctattagtggaacttgaaaaggaaggagtagttatttatggtgggcctgttgcacatgacaaattgaaagtaccaaaggtagattcatttcgccatgagtatagctcaatggcatgcactctcgaatttgttgatgatgtgcagtcagctatcgatcacataaatcgttatggaagtgcacacacagactgcatcatcacaactgatgaaagtgctgcggaggcttttctgcagcaagtcgatagtgctgctgtgtttcataatgcaagcacaaggttttgtgatgggacacgctttgggctaggtgcagaggttggcataagtacagggcgcatacatgcccgcggacctgttggagttgatggacttctaactactcgctgcattttacgcggtagtggacaagtggtgaatggtgacaagggagtggtttacacccacaaggatcttcctttgcaatgaggcaaagaacctctgttgtagaacaattgctctcgtaacgaatggctgaactcccctttaagtacccttttccttttttccatgcaacaaagacaggtgtcgtaa

SEQ ID NO: 345 - DNA, 1251 bp, Sorghum bicolor
aaaggcagagtggagcacaccttccgttttaggaaggtgagaagtgggggaaccggggagttgggagagagagagagagaggcagggatcagcggcggccggcggaggagatggaggagcgggagaagctcgtgtgcctggccaagctcgccgagcaggcggagcgatacgacgatatggtggaattcatgaagaatcttgctaggatggatgtggacatgagtgctgaagaaaggcatttgttctcagttggtttcaagaacactatcggggcaaagagagcatcgtggagaatcatttgttcacatgagcaaaaggtcacaactgatcgtcagactggtgtgatgatagatgcctataagaagatagtagaagatgaactaaggaaggtttgcaatgaagtattgtcagtcatcgctattcactgccttcccttggccaatacgagtgaaaatgtcgtattcttttataagatgaaaggtgactactaccgatacttggctgaatttagcagtggaactgaaaagaaagctgcctctgaccagtcacttatggcctatcagcatgccatggttgtcgcctccagtgagctctcacctgcccaccagatccggcttggtcttgctctcaatttgtcggtcttcttttatgagataatgaactctcatgagagagcttgccaagtggcaaaacaagcattcaatgaggctcttactgagataaattctggtgaaggggtttacaaggatagcacacttatgatgcagcttctgaaggacaacttagcattgtggacatcagaactaaccggaggtgaagcatccaaggataatgatgtcgacatggagggttgattgatatgagctcaaggaacacagaacacacgcaaagtatccaatctgcgctgctagcgaacccgggtcctcaagtttttctgcatcggaattcggaagatccccacttatttttctgaagttttctgttcctctgtttcggccatcgtttggccctagagtcagtgtccctactaagtgtttctcagaggtctggactggtgaccatccaacaagctttggtcatattttgtgagcttgtgctggtgaccacccagctctgatgttatgttgcttctttttttttcggtgcttcagaggcatctttgtacaccgatgacaaaatgtatctcttatcaatacattaaaagactgtcgctgtcgttattaatctagctatcctgttccaggtgatgct

SEQ ID NO: 346 - DNA, 1034 bp, Sorghum bicolor
gtcgatcgggtctcatctgcggaagccgggtcagaaaaaatcgttgcgactggaggaggcggcgcgagggcatgggggcgtgggtctcggtcctgctcgggatggacgacggagccgcggcggcggctgccgccaggcctgctgctgtgggcctgggcgacctgccggagctctgcgccgcccaggtgctgctccggctcgacccgccggagatctgcagtctcgcggggctcaaccacgcgttccgcggcgccgcgggggcggacttcgtctgggaggccaagctgcctgagaactacagctacctgatggagttcgtcggggggagcggcgacgaggggaggcggcggcggcggcgggccggcaagaaagagatctatgccaggctcgccaggcctgtgcctttcggtgacggccagaaggaattctggttggacaagagcaaaggcatgatctgtatggcactgtcgtccaaagcactggtgataactgggattgatgacagaagatactggcaacacatgccaacttcagaatcaagattccagtctgtagcctaccttcagcaaatctggtggtttgaggtggttggtgaagtcgatttctgcttccctgttggaacatatagcttgtactttagggttcatcttgggaagttctacaaacgatttggccgccgacattgcacctcagagcatgtccatggttgggacaagaagcctgtccgcttccagctatcaacctccgacggtcagcaggcactgtctcagtgctacctggaggagcccgggagctgggtcttgtaccacgctggcgattttgtggcctcaaagcctgaccagccgatgaagctgaagttctccatggcgcagatcgactgcacacacacaaaaggcgggctgtgcatcgactcggtgctcatctatccgaaagggaaggggtttcagcaggagagggtggtcaggtctcagaaatgagactgtagattgttgtggaggtactactcacagtaggatgttagaccaaatgcagct

SEQ ID NO: 347 - DNA, 767 bp, Sorghum bicolor
atcgaagcatagcagccaaggcggattccgcgctccggggccgccatgaagctgaagctcctctcccccttccttctcctcgccttcctcgccgccgcggcgtacgcggcgccggcgtcgcgcgaggcggcggcggccgccgtcacgaccacgctgcagtcggcgtcgtcggacccggagaaccagtgcgtgtacacggtgtacgtgcggacgggttccatctggaagggcggcacggactcgacgatcggcgtgacgctgctgggcgcggacggcacggggatccggatccgggacctggtggcgtggggcgggctcatggggtccggccacgactactacgagcgcggcaacctggacatcttcagcggccgcgggccctgcatgagccagcgcccctgcgccatgaacctcacctccgacggctccggcgcgcaccacggctggtactgcaactacctcgaggtgacggtgaccgggccacacctgggctgcgcgcagacgctcttcaccgtcgagcagtggctcgccaccgacgcgtcgccgtaccgcctgtacgccgtcgtcgacgagtgcgagagcgagacgacgacgaagcggcggcagcggcaggagacggagacacagacacgctcgccggccggcgaggccgaggctgatgaggccaccgtgtccgtgacggcgctctgatcctgcctgtgtgacccatgccccccctaattatgtgatcgatggatccccatcgggattacgttcgtcttgtggag

SEQ ID NO: 348 - DNA, 1738 bp, Sorghum bicolor
aaaggatcccccaaatctagcagctcgcccccgtcacctcctgcccgtcggaatggctgccggtaaagcgcgcaagagagcacggcaagcagctccggcgagcgacggcggcgaccgcatcggcgccctcccggacgaaaccctacaccatgtcctctccttcctccccgcgcaggaggcggtgcggacctgcgttctcgcccggcggtggctccacctctggaagtccgcgactggccttcgcatcgtcggcgccaacggggaggcgccggtgcctttcgaggaggtccgggagtttgtcgacagcctcttgctcctccgtggaagctcacctctggagacatttgagctcagggtcgccggagacgatattgacgttcgccacgtgaggctctgggttaggtacgccgtgcagtgcaaagcccaggtcctgcggctcagcttccttgggaatacccatgtaggtcctgtggctcggttgcggccggatgacccacccctcgcctccaggcacctgaccaagctagagcttcgcggcctagtgttcaacgatgatttccttgacttctcgagatgtcctgagttgcaagatctacatattcaagactgcagcttggagtatgccgagaggatctcgtcccagtccttaaggcatctatatatcagaggcgcattcaacccgagttcccgagcaggaattcttgccccaaatcttgcttcattggtgctagaagtcacttttggcatgacccctgtaattcagaaaatgcccttgttggttaagggaactgttggattccgtgggctttgtgaagacttatgtagcagtcctgctcctaactatgtcagctatgtggactgtgataagagctgccgaggttgcatacgtgatggcagtgcctgtgtgattttgtgtgctgtgtcccaagcagaggatttggtgttgatagcttcccctgatacgttcattttcagaagggatttgaaaggttgtcctacatttaatcgactaaagtctttgtgtctcgatgaaaactggtgtgtgcctgatgagtatccactatcatgtattcttgaactttcaccagttttggagaagcttgctattattctatatttcaagattcacctacttgaagctaatgtgcaaattaaaggaaggttcaatccaaaggagctaccaccaaccatatcatcacaccttaaggaagttgaaatcctttgtggaggggttgatgggaacgttcttaaagttttgaggttcctgagcaaacttaacatcagttttagtttcccccccatagaagcttaaagctgaagacggatttttctgccacttaattacattaggaaactaagcttaaagctgaagacggatcttctgccacttaattacattaggaaactaagagccacagacagctgatatcactaagaatgatgccttcttcctgtgggattgtttttatttcctccacttgttgtaccaagttaagatgatctacttgaacctgataagtttcatccgggaagcacttttcggccaattgagtaagcatcatgctgtcttttgtctctagggttgtttcccagttctacctgtgtactgccaactttgctggacctggtttaccgtgatatgctgtttcttgcaacctttcctgtgcagcttactcaaggtgcctagctgttcatttcttgttatgtgcatgtctattgccttgttcttggtaccaaa

SEQ ID NO: 349 - DNA, 1110 bp, Sorghum bicolor
cagcgactcccctcacacccacgacgccgcaacccatcgcctgtaccctagcaccacccacagctggcctcccctcccgccgccgtggagaaattcctccgcctcccggagctgctccgctgccccgatgccgctagacgcgctgccgcaggctctggtgccacatccaccgcatccccatcgcgggacaggacaagagaggtcggcttccagcggcatcctccatgccggccagcgagctcgcctcctgattcaacacggcaaggtgcggatccagtagcatggagccctgccccggcgcgcttgcgcggctttggcatgtgcggctccggcagcgcgcggcactgccccggtcacctgctccagccctgcctcacctgaccgagccttcgaggaagtctagctaacctgttaatctgttactctataaacgctgagcggacctccacggagacggcggcagcatccagagcctcgtctttgttggccctttgtctgccgagtgctggtgagctagcgggaggaggaggaaaaagcagttgcaggccacaacactggtttaggacgatgccttgctgtctactaagcaggatatccaggatgccatcctcattcatggccccagcaataagcaactgcgagtgcgaggagttatcagtccccaatatattcttgttggcattgacaaatcaggcggccgaattggtctgctatcgtcgaagtttatgcttcaggttatcagcgtgcttcacatcgttcatctaaaattctgcaaaacagaagaagaggaaaaagagccacaatagtaacagtaccacaaatattttgccctaaaggtcataaatgcatacattatgttattaagggctcaagatcatctgaagttgagggcttgtggaaaagtcctcctcaagaattctcttatctccagtatcctcaagagggatggtgatgataaaattaaaattgtagacctatatcccacacatgacaagaatgaaattagaaccattgagaaatgggttttatcgtacctggaccatgacatgacacttaaggtgaggtggctgtgaggagattgttgttggtggcacgctaggagcaccttga

SEQ ID NO: 350 - DNA, 1436 bp, Solanum lycopersicum
aaaacatggagaagaagggtcatgcagtgtgtgtaccatttcctgcacaaggtcatgtaataccattcatgaaattagccaaattattgcactccagaggtttctatgttacatttgtcaacactgaatataaccatagacgtctaatccgatcccaaggtcctgactttgtgaaaggcttccaggatttccaatttgaaactatcccggaagggttgccaccatcagatcgcgatgcaactcaagatcctgcttccttatgtgactccataagaaaaaactgctcgactccttttcgggaattattatcgaagcttatttcatcacccaaagttccaccaatttcttgtgtaatatcagatggtgtgatgagctttgctaataaggctgcgcatgaatttggcatccttgatgtccaattttggacagcctcagcttgtggttatatgggataccttcaattggatgaactaacaaaaagaggcattatcccgtttaaagattacagttttatggaggatggtacactggatagagttgttgatggaattccaggaatgagaaacattaggttcaaagacttgccaagctttatcatgactactgatccacatgatattttgttaaactacttaagggatgaagcacaaaattgcttgaaatcttctgcgatgatcatcaacacgttcactgaattggaacgccaagtccttgaagcgattgaagctagacacccaaatatttatgttacaggtccactttccttgatggaaaaaaccatcccagaaaatgaattgagctcatttaggccaagtttatggaaagaagaattccattgtcttgagtggctgaataaacaggaaccaagttctgtagtatttgtgaattatggatgtgtcacattgatgtcagacaatcacctaaaagaatttgcgtggggacttgcaaatagcaaacacccattcttgtggattgttaggcctgacatagtgatgggtaattcagccgtattgcctgatgagtttcttggagagattaaagacagaggattattagcaacctggtgcccacaagatcaaattctttcacacccgtctattggcgtatttctaacacattgtggatggaactctacgatggaaagcctaagttcaggagttcctctaatttgctggccattctttgctgagcagcaaacaaattgtagatatgcttgtgtagagtggggaataggtgttgaggtcaataaagatgtcaagcgtcaagaaatcgaagcaattattaaggatatgttagaaggtgaaaaaggtaaggagttgaaagacaaggcgttggagtggaagaagaaagcagcagaagcaactaacattggagggccttcatggaaacactttgatacattcttggaaagacttctccttaatagggaatagtag

SEQ ID NO: 351 - DNA, 1169 bp, Triticum aestivum
cgatcagatcaagtcatgttcacttgttaaccaaaagccaacacatctaggtcaccgcttgcaagaatagatccatataagcagaaaagcaaaggaagaagcgcccattcctttttgggaaggttctcacagcagattagaggaatcaccaatccaggggaagtaggaggaggaggaggaggagatggaggagagggggaaggtggtgtgcatggcgaagctggccgagcaggcggggagatacgatgatatggtggattttatgaagaagcttgctaggatggatgtggatatgagcgttgaagagaggcatttattttcagttggttttaagaatacaattggtgcaaggagggcatcatggagaatcctttcttcacttgagcaaaaggtggcagcgggtgagcaggctggccggatgataagtgtctacagaacgaaagttgaggatgaactaaggatggtttgcaatgaaatattgtcaatcatcgctattcattgccttcccttggctaatgcgggtgaaaacgttgtgttctttcataaaatgaaaggtgactactaccgttacctggctgaatttagcactggggttgaaaagaagtctgctgctgaccaatcactcatggcctatcagcatgccatggttgttgcctccaccgagctttcgcctgctcatccaatcaggcttggccttgcgctcaatttctcagtgttcttttatgacataatgaactgtcatcagagagcttgccaagttgcaaaacaagcatttgatgaggctactactgagattaattccgctggtatggatggcaacaacgatagcacactaatgatgcagcttctgaacgacaacctagcattgtggaagtcagaactaactgaaggtgaaacctcgaaggatagcgacatcgatatggaggagggataactggaatgtgctgaaggctcccctgcatgcatgtgtgcaaaatgaccagaacataatgcagggataactggaatgtgcttcaaggctccctccctagcacttatgtgtgtgaaataaccagaacatagtgctaccattgaaatcgccccaaagtgccttgcctactgtgcagcttgttagtagttctggggtcctcgcttggtgttttcctaggctttccacagtatggattggt

SEQ ID NO: 352 - DNA, 735 bp, Arabidopsis thaliana
gagaattctgcttcggacattaagctcatgagtcatgacttcttcaatccatgagctttctgataacattggaagtcatgagaagcaagaacagagagattctcatttccaaccaccaatcccttctgcaagaaattatgaatcaattgttacaagtttagtctactcagacccggggactacaaattccatggcacctggacaatatccatatccagatccttactacagaagcatatttgcaccgcctccacaaccgtataccggggtacatctacagttgatgggagtgcagcaacaaggcgttcctttaccatctgatgcagtcgaggaacctgtttttgttaacgcaaagcaataccacggtatactaaggcgcagacaatcaagagcaagacttgagtctcagaataaagtcatcaagtcacgtaagccgtatttgcatgaatctcggcatttgcatgcgataagacgaccaagaggatgtggcgggcggtttctaaatgccaagaaggaggatgagcatcacgaagacagtagtcatgaagaaaaatccaaccttagcgctggtaaatccgccatggctgcttctagtggtacatcttgagaaggtcctacaagtagctttgttgtattttggctctgtttggtctcagatcatctatgtcttttagtgtatgatatatacaaatctttgtataaaggtatagataggttcttgggaagcaattaggt

SEQ ID NO: 353 - DNA, 1137 bp, Arabidopsis thaliana
aacaaccatgttctgaggaaggagacatgcatcatcatcatcattcatcatcatcatcatcatcgtaatctcaagcttattacttaacttctttttctctccatctcttcttaccaaatccaaagcaccaaagtttattgaagtaaagatttgaagacaatgcaagtgtttcaaaggaaagaagattcatctttgggaaactcaatgcctacaacaaattcaaatattcaaggatctgaatctttcagcttgactaaggatatgataatgtctacaacacaattacccgcgatgaaacattcgggtttgcagctgcaaaatcaagattcaacctcatcacaatctactgaagaagaatcaggcggcggtgaagttgcaagctttggagaatataagcgttatggatgcagcattgttaataacaatctctcaggttacatcgaaaacttgggaaagcctattgaaaattatactaagtcaattactacctcgtcgatggtgtctcaagactctgtgtttcctgctcctacttctggtcaaatatcttggtctcttcaatgtgctgaaacgtcacatttcaatggtttcttggctcctgaatatgcatcaacaccaacggcgctgccacatttagagatgatgggtttggtttcttcaagagtgccattgcctcatcacattcaagagaatgaaccaatatttgtcaatgcgaaacagtatcatgcgattctccgtcgcaggaagcaccgtgctaaactcgaagctcagaacaaactcatcaaatgccgtaaaccgtaccttcatgagtctcgccatcttcatgctttaaagagagctagaggctccggtggacgtttcctcaatacaaagaagcttcaagaatcatcaaactcactgtgttcttctcaaatggcaaatggacaaaatttctctatgagccctcacggtggtggaagcggaatcgggtctagttcgatctcaccgagctccaattcaaactgtatcaacatgttccaaaacccgcagttcagattctcaggttatccgtcaacacaccatgcctcagctctcatgtcagggacttgaggcacatgagaagaccttgctccgagagaactcaggctaaactccggagac

SEQ ID NO: 354 - DNA, 1390 bp, Arabidopsis thaliana
aactctggcatgtctcaattccacaaattattgtttaatcattctgcttcttctgcttattaattctctgcagataactgcagaagaaagaagaaagaagaagaagaagagattagagcttgagccataatatataatcccttgatcattagtctaaagaaccacataaaaagatgggattctggtcgttgttggaggtggcttctatgccggttattcaagttcttttcatgagtcttgtgggagctttcatggcctctgatcgttgcaagctcttccctgttgaagcccgtaattccatgaacaaggtggtgtttgtactatttgcaccggctctcatgtttgccaatctagctcagacggttacacttgaagacatcatctcatggtggtttatgccggtgaacatgggacttacatttctaatcggaggacttcttgggtggttggttgttaagattttgaaaccacctccttatcttgaaggtcttattgttgcaacttgttctgcaggaaatatggggaacctaccaatcatacttgtcccagcaatctgcgatgaggacaaaagtccttttggtaaccgaagtgtatgtagaaccgtcgggctctcttacgcgtctttctccatggcgctagggggtttctacatatggacatacacattccggctgattaaagggtccgcaatgaaagttcaagccatagaagaatctgagaaaatagcaattaaatcatccaatagtgacttagaagctgatcataagacccatctcctcggtgcaccggaagacaaggaaaacaaagtggtaaaggaaaagacagggttttggagaaaaggagtagacttcctccatgagatattggaggagcttcttgcaccacctacacttggtgcaattatcggtttcattttcggtgcagtaagatggctcagaaatcttatcataggtgatgatgctcctttacgaatagtacaaagcactgcaaaacttcttggagatgggaccattccctgtatgactattatactagggggaaacctcatacaaggtttacgttcttcggcagtcaaaccgatggttgtacttggaatagtctgtgttcggtacatagctatgccaattatcggtataggcattgtactaacagctgcaaatctcggatttcttccagctgatcctttgtttcagtatgttttgatgcttcagttcaccctcccgcctgccatgaatatcggtaccatgacacagctgtacaatgttgctcaagacgaatgctcagtgctcatgctttggacctacttggtcgcgatactggccctcactgtatggtccaccatcttccttcacttgttagtctaaagaacctgcaactctgtatgagcaca

SEQ ID NO: 355 - DNA, 583 bp, Arabidopsis thaliana
ttcttcttcttgaaatggcgacgagcaagtgctactatccacggccaagccaccgtttcttcaccactgaccaacacgtcaccgcctcttccgatttcgagctagacgaatgggatcttttcaataccggttcagattcctcttcaagtttcagctttagtgaccttacaatcacatccggtcgaaccggaactaaccggcaaattcacggtggttctgactccggtaaagctgcgtcttctctaccggttaacgtaccggactggtctaagattcttggagacgagagtcgacgacagaggaagatttcgaatgaggaagaagttgacggagatgaaattttatgcggcgaaggtacacggcgagttccaccgcatgaattgcttgcgaaccggaggatggcttcgttttcggttcatgaaggtgctgggaggactttgaaaggaagagatctgagtagggtgcgaaatactatttttaaaattagagggatcgaagattaattatcttttgggtacttcttttaaatctttgtttaaattgggggttacatatagaaatatgaggagcttaaatcgaaatt

SEQ ID NO: 356 - DNA, 2160 bp, Arabidopsis thaliana
tcttgctctgtctccgataccaaaaggtttttgtattctattgaagattataaactaaagggaggagctttgagaatttgattgttgatatccaaggatttgcaagctagttttttttttacgacgttatacttttcgattatgagtgcatcatgggctgatgtagctgactcagagaacacgggttctgggtcttctaatcagaattctcatccttcacgacctgcttatgttcctccacatctaaggaacaggccagcagcttctgagcctgttgctccattgccagctaatgatcgtgtaggttatggtggtccaccttctggctctcgatgggctcctggtggtagtggtgttggtgttggaggtggtggtggttatagggctgatgcaggtcgtcctggctctggctctggctatggtggacgaggaggtggtggttggaacaacagaagcggagggtgggaccgtagggaacgtgaagtaaacccctttgaaaatgatgattccgaaccagaaccagcttttactgagcaggataatacggttattaattttgatgcctatgaagatattccgattgagaccagtggggataatgtgcctcctcctgttaacacattcgcagagatagatctcggggaggcattgaatctaaatatccgtagatgcaaatatgttaagccaacacctgtacagcgtcatgcgattccgatattgcttgaagggagggatttgatggcctgtgctcagacagggtcggggaagacagctgctttttgctttccaatcattagtggaataatgaaagatcagcatgtacagagaccccgtggttcacgaacagtctaccctcttgcagttattctctcaccaacaagagagttggcaagtcagatacatgatgaggctaaaaagttctcttaccaaactggtgtgaaggtggttgttgcatatggaggaacacctattaaccagcagctccgggaacttgagaggggagtcgatattcttgtggcaacgcctggtcgattaaatgatttgctcgagagagctagagtctcaatgcagatgattagatttttagctcttgatgaggccgatagaatgcttgacatgggttttgaaccacaaattagaaagattgtcgaacaaatggacatgcctccacgtggagttagacagacactgttgtttagtgctacatttccaagagaaattcagagactcgcagctgacttcctagcaaattatatatttttggctgtgggtagagtgggttcaagtaccgatttaattgtccaaagggttgagtttgtccttgactctgacaaaagaagtcatctcatggacctgcttcacgctcagagagagaatggcatccaaggcaagcaagccctgaccttagtttttgtggagacaaagagaggagctgactctttggaaaattggttgtgcatcaatgggtttccagcaacctccattcacggtgacagaacacagcaggaaagagaagtggcattgaaagccttcaagagtgggagaacaccgattttggttgcaactgatgtagcagcacgtggccttgacattccccacgtggctcatgtggtcaacttcgatctgccaaatgatattgatgactatgtccaccgtattggacgaacaggacgtgctggcaaatcaggactagcaactgccttcttcaacgatggcaacacctcactggccagaccgctcgctgagctgatgcaagaagctaaccaagaagtccctgagtggctcactcggtatgcgtcacggtcctcttttggtggtggtaagaaccggcggtctggtggtcgatttggtggccgtgactttagaagggaagggtctttcggtagcggtagaggaggctatggcggtggaggaggagggtatggcggcggaggaggctatggtggtggaggaggctatggcggcggaggaggctatggtggtggatatggtggtgcttcaagtggtggatatggtggagaacctccaagtgcttgggactaagcttccaatgttctttttgttttggttacaacttttgacaaaaaaaatatttcttctacattcacaaagagagtatgtattgccccttacacctatgagatttcactcaggagataa

SEQ ID NO: 357 - DNA, 1425 bp, Arabidopsis thaliana
tgttgaagaagactcataatcggagattgtttgtttttggtttgctctgtaaattggagaagttttgttagagatcaaatggctgggatttgttgcggtgtagttggagagactgaaccggcggcaccggttgattcaacttctcgagcttctcttagacggaggttagatctacttccgtcgatcaaaattgttgctgactccgccgttgctcctccgcttgaaaactgccgtaaacggcagaagcgtgagacagtagtgctctcgacgttaccgggaaatctagatctggattcgaatgtgaggagtgataataagaaggctagatcagcggttacgaattcaaattctgttacggaagcagagagtttcttttccgatgtacctaagatcggtacgacgtcggtttgtggtagaagacgagacatggaagacgctgtctcgattcatccttcgtttcttcaacggaactctgagagtcatcatttctacggtgtctttgacggccatggctgctctcatgttgcggagaagtgcagagaacggttgcatgatatagtgaagaaggaagttgaagttatggcttccgacgagtggacagagacgatggttaagagttttcaaaaaatggataaagaagttagccaacgagagtgtaacttagttgttaatggtgctactcggagtatgaaaaattcttgtagatgtgaattgcagtctcctcagtgtgacgccgtcggatccaccgctgttgtatcggttgtcacgccggagaagatcattgtttctaattgcggtgattcacgggctgtgctttgtcgtaacggtgtagccattcctctctccgtagatcacaagccggatcgacccgatgaattgattcggatccaacaagctggtgggcgagttatatattgggatggagctagggttcttggagttcttgccatgtctagagcaattggtgataattacttgaaaccgtatgtgattccggatccggaggtaacagtgacggatcgaactgatgaggatgagtgtttgatcttggcgagtgatggactatgggatgttgtaccaaacgagacggcgtgtggcgtggctcgcatgtgccttcgaggtgctggtgcgggtgacgactcagatgcggcgcacaatgcgtgctccgatgcggcgttgctcttaacaaagttggctctagcaagacagagctccgataacgtgagcgtcgttgtggttgacttgaggaagaggaggaataatcaagcgtcgtcttaataattagtgttataattagtagtagtattagaataattgttacatagcctaattgtaattgtattctttttatttttctattttagtttttctcattttaaggtgttttttcttttctattttagttagctcttaattcaggctggg

SEQ ID NO: 358 - DNA, 1728 bp, Arabidopsis thaliana
gcatacttgcacgcaatctcttcttcttcttcttcgttcttctcgtagcttgaaataagattcatcagaagagtaaataaacatcaaaatccaacaaaccaaactagaaaaatgtcagtagttttactctcttctacttctgcaacaatcaccaaatcccaatccaaaaagattccctttttatctcccaccacaaaattcccattaaaggtctcaatttctccatcaagatcgaaacttttccacaaccctttacgcgtggcggcgccgccgtctgtacccacttcggattcgacggaggagaagcggatcgaagaagaatacggcggagataaggaagaagaagggtctgagtttaagtggagagatcattggtatccagtttctttggttgaggatttggatccgaatgtgccaaccccgttccagctcttgggtcgagaccttgtactctggtttgatcggaatgatcagaaatgggcagcctttgatgatctctgccctcaccggctcgctcctttatctgaaggaaggttggatgagaatggacacttgcaatgttcgtatcatggatggtcatttggtgggtgtggatcttgcactaggattcctcaggctgctacttcaggtcctgaagctcgtgctgttaaatccccgagagcttgtgctattaagttcccgacaatggtgtctcaaggtcttctctttgtgtggcctgatgaaaatggttgggatagagccaattcaattgaaccccctaggttgccggatgatttcgataaaccggaattttcgacggtgacaattcaaagggatcttttctatggatatgatactctcatggaaaatgtatctgatccttcccatatagattttgctcatcacaaggttacaggaagaagagacagagccaaaccattgccgttcaaggtggagtcaagtgggccttggggtttccaaggtgcgaatgatgacagtccaaggataaccgcaaaatttgttgctccgtgctattctatgaacaaaattgagttagatgcgaaactaccaatcgtcggtaatcaaaaatgggtcatttggatttgctcattcaatataccaatggctccaggaaagacccgttccatcgtttgcagcgcccgtaacttctttcagttctctgtaccaggaccagcttggtggcaggttgtaccaagatggtatgaacactggacttcgaacttagtctatgacggagacatgatcgtacttcaaggacaagagaaagtattcctcgctaaatcaatggagtcaccagactacgacgtgaacaaacagtacacaaagctcacattcactccaacccaggcagaccgttttgttctagcattcagaaactggctcagacggcatggtaagagtcagcctgaatggttcggctccaccccgtctaaccaacctctcccttccactgtcttaaccaagcgtcagatgctagatagatttgatcagcatacacaagtatgctcttcctgcaaaggagcttacaacagtttccaaatcctcaagaagtttctcgttggcgcgacggttttctgggccgccacggctggtgttccttctgatgttcagattcgactggttcttgctggtttatcactgatatcagctgcttctgcatatgctttacatgaacaagagaagaactttgtgtttagagattatgtacattctgaaatcgagtagtag

SEQ ID NO: 359 - DNA, 2297 bp, Arabidopsis thaliana
gctcatttcccagaaacctttgtttcatttgcttcgtgtgcgatcgcgagaacaagggaaaattagggtttatatcctcaagctttttcgaacaccattgatcgttgatctaagatttttcttctagtcgagtttcttaaggggctttgatcaaactcaaaattgaagaccaatactttgaaggattctggtaaagctaagcaactatgagttcaaattcatgggctgatgtttctgaatcagagagggcaccatctggtggtggttggggttattctcgtccgtctcgaaccaactatgttcctccacatcttaggagccgtacaccatcttcggagtttgttgctccttcacctggtaataatgatcgtgggggatatggtggtgcaaatagtggttatggtggtcgaggccaaggttatggtggtcgaggttcgggctatggtggtagaggaggtcctgtgggcggttggaatgccagaagtggaggttgggaccgtcgggatactgaaactaacccgtttggtaatgatggaaatgcagacccggctgttaacgagcaggaaaacactgtcattaactttgaggcctatgaagatattcccatcgagacaagtggggataatgtgccacctcctgttaatacatttgcagagatagacctcggagaagctctcaatctaaatatccagaggtgcaaatacgtgaagccgacccctgtgcagcgtaatgcaattcccatattggctgcaggaagggatttgatggcttgtgctcagacaggctctgggaagacagctgccttttgttttccgattattagtgggattatgaaggatcagcatatagagagaccacatggagttcggggagtctatcctcttgctgtcattctctcaccaacaagggaattggcttgccagatacatgatgaagccagaaagttctcctatcaaactggagtgaaagttgtggttgcttacggaggaacaccagtcaaccaacagattagggagcttgaaagaggagttgatattcttgttgcaactcctgggagattaaatgatttgcttgagagaggtagagtctcattacagatggtaagattcttggcacttgatgaggcggacagaatgctggacatgggttttgaaccacaaatcaggaagatcgttcagcagatggacatgcctcctcctggtgtccggcagacaatgttgttcagtgctacatttcctagggagatacagagacttgcatctgattttctttcaaattacatatttctggctgttggaagagtgggttcaagtacggatttaattgtccaaagagtagagtttgttcatgattctgacaaaagaagccatctaatggaccttcttcatgcccagagggagaatggtaaccaaggaaagcaagctttgactctagtttttgtggagacaaagaagggagctgactctttggagaattggttgtgcatcaatggtttcccagcaacgaccattcatggtgataggtcacaacaggaaagagaagtggcactgagatcattcaagactgggcggacacctattttggttgcaaccgatgtggcagcacgtggtcttgacattccgcacgtggctcatgtagtgaactttgatctaccaaacgacattgatgactatgtccaccgtatcggacgaacaggacgtgcaggaaattcaggactagcaactgctttcttcaatgacaacaacacaacaatggccaagccactggctgagctaatgcaagaagctaaccaggaggtccctgactggctgactcgatacgcatctcgtgcttcatttggaggtggtaagaaccggcggtctggtggacggtttggtggtcgtgacttcaggagagaatcttttagtcgaggcggtggtggtgctgactactatggtggaggtggtggatatggaggcgttcctggtggtggctatggagcaatgcctggtgggtacggacccgtaccaggtggtggatatggaaatgttccgggtggtggttatgcaccttatggtagaggtggtggtgcttactatggtcctggaggatatggaaccgttcctaaccaagggtatggtcctggagtggctagtgcgtgggactaagctttaacttcaattcttcaagaaccgattatgttctctttctctctcacttatctctattgtttattattagggagcagccacagatgtgtatgtttgctctttaaatggttatgtagtagacacgaatcgtctctttgttcaatgtga

SEQ ID NO: 360 - DNA, 1694 bp, Arabidopsis thaliana
tggctctctttattatccttcctgtatattttgttccttcataatatattactatccttctcgtttattaatacaaacttgaattcttcttcttcttaactttgtctgtcaattcacatatatatagtaccaccatcacataagtatctcacaacacatcatggtgaacgaagaaatggagtcatcacttaaagtcatcgacgtggcacgagtcacaccatcaaactccgactcgtcggagtcactcactctcccactcaccttcttcgacctcctctggtacaaacttcacgccgtcgaacgagtcatcttctacaaactcaccgacgcaactcgtcctttctttgactcagtcatcgtcccaaacctcaaaacatctctctcctcatccctctctcactacctcccactcgccggaaaactcgtgtgggaaccacttgatcccaaaccgaaaatcgtctacaccccaaacgacgccgtttcattcaccgtcgccgagtcaaacgcagacttctcacgtttaaccggcaaagaaccgttccccaccaccgagttatacccgttagtccccgagttacatgtctccgacgactcagcttccgccgtgtcgtttcaagtcacgttatttccaaaccaagggttttgcatcagcgttaatgcacatcatgccgttttagatggaaaaacgacaaccaactttctcaaatcttgggcacgcacatgtaaaaaccaagattcttttctagcgcaggatctaatcccagtttacgatcgtacggtcataaaagatccaatggatttagatacaaagatcttaaacgcttggcacagagtagccaaagtgttcaccggtggtaaagaaccagaaaaccccaagagtttaaagcttttatggtcgccggagattggtcctgacgttttccgatacactctcaatctcactagagaagatatccaaaagcttcgagagagactcaagaaagagtcttcttcttcctctgtttcctcatcacccaaagagcttcgtttatcaacgtttgtgattgtttactcttatgctttaacgtgtttaatcaaagctcgaggcggtgatccgagtagaccagtcgggtacggattcgctgtggattgtcgaagccttatggttccaccggttccatcgacttattttggtaattgtgtatctgcttgttttaaaatgtcgttaacggcagagacttttatgagtgaagaagggtttttagctgctgcgagaatggttagtgattctgttgaggcattggatgagaatgttgcattgaagattccagagattttggaagggtttacgactctttcaccaggaacacaggttttgtctgttgccgggtcgacccggttcggagtttacgggttggattttgggtggggtagaccggagaaagtggtggttgtgtcaattgaccaaggtgaagcgatttcttttgcggagagtagagatgggagtggtggtgtagagcttggcttctccctcaagaaacatgaaatggatgttcttgttgatttgcttcacaagggactagaaaattaaatcatttttttctttcttcagaagagtaaaataatataagaaataaaatttattgtggaaaattgtagctttctattgtcaaataaatctagtttagagttccagcttcaccaggaaactcaat

SEQ ID NO: 361 - DNA, 680 bp, Arabidopsis thaliana
ttcgatttcgaatcattgatggaaatgatttgaaaaaagagtaaagtttatttttttattccttgtaattttcagaaatgggggattccgacagggattccggtggagggcaaaacgggaacaaccagaacggacagtcctccttgtctccaagagagcaagacaggttcttgccgatcgctaacgtcagtcggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaacaaagattggtgaagtggatctctctctag

SEQ ID NO: 362 - DNA, 960 bp, Hordeum vulgare
cacagcttgaactgaaagcaagagtagaagcccatgagatgagacgcaagcaaaatatgcatgaaaatggcacaatcatgattcagtttggtcagcaagtgcctaattacgagtcatcggctagcgattctcctcgagaagtgtccggaatgagcgaaggaagctttaatgagcagaatgatcaatctggtaatcgtgatggttacacgaagagtgatgaaggcaagatgatgtcggctttatctctgggcaattcagaaacagcgtacacaccgccaaaacctgaccgcactcatcccttcgccatatcatacccatatgctgatccttactatggtggtgcggtggcagcttatggcacgcatgctattatgcacccccagatggtgggtatggtaccatcctctcgagtgccactaccaattgaaccagctgctgccgaagagccgatctatgtaaatgcgaagcaataccatgccattctccgaaggagacagctccgcgcaaaattagaggctgaaaataagcttgtcaaaagtcgcaagccgtacctccatgagtccaggcatcagcacgcgatgaagcgggctcgggggacaggcgggcggttcctcaacgcgaaggagaagtccgaggcggcttccggtggcggcaatgcatcggcgaggtctgggcatgccagcgttcctgcggacggcggcatgttctcgaagcacgaccacaccttaccgtccggtgacttccattaccgcgcgagagggggcgcctagggcggcgccgttgccccctggcaaatcatccttggcttatgtgtgtggcgaccgtcaactcggtcgaatgataatactgtagtaaactgaaagatttggggattgaaactgttacttggggtgtttggtagacagtctgttccgtttggggacgatgcgggccagtctctctgttggtggtagattcgtg

SEQ ID NO: 363 - DNA, 448 bp, Hordeum vulgare
ggctggatacgtgtgtcataacattcaccaccccttcccatcctgctctgctctgctcagctctgctctgctctgctgcttcccctccatccaccgagtgaaaaaagctctccgtccgccgaaggatcgaccatggcgggcacggccaactgcatcgacatcatcctcgccatcatcctcccgcccctcggcgtcttcctcaagttcggatgcgggcacgagttctggatctgcctcctgctcaccttcctcggctacatcccgggcatcatctacgccatctacgccatcaccaagtagaatccagccgtcccgagtatgctccgcggcacagtattttcaggatgacgatctcgtctgtctagtcgtccctccttgcttgtgtgggttcttttaattcttttccgtgtatgctgatgaagtgatgatgcaaattcctctgtggttt

SEQ ID NO: 364 - DNA, 716 bp, Hordeum vulgare
ctgtctgtcaccgtccattcccatcccatcccatcccactccaccagtccacaccgcagcagcactccagtgagctcgaaaccgagagggcaagaagaggaggaaccgatacagcactacaggcaaccatggaggtggtgaccggcagcaacggcgggaggctgaacccgtgggcggagcccttcgtgccggggagctggtgccgccccgcccccgtggaggctgcggcgtcggcggaggtcgaggacttctcccccgagtggtggcgcctcgtcgcctcctcgccgtccttccgcgacagctggctccgcgactacggcgacatgggtcttctggacgccgacgagtgcccggacgacggcgacgccttcttccctcctccggcgctgccgcgcaacgagggagaggggaggaaggaagaagccgccgtcaagaagagtgggggcgaggtggcgccctgggggatcgagaagtggtggcgggcgcacgtcgcctcgccgccggaggtcccgaagtacgcggagaaggcgcctgctaaggtcctcggcggcggcggcaggttcagcccccgcaccatccagcagcctcgctaagggaccggcgaatctcgtcgctccgtgtccatccaccgagatcttggcataaatgaggaaaatatactagaaaaaaatagtaatcctagttgttctgcgagctctcctgctccggataatctt

SEQ ID NO: 365 - DNA, 654 bp, Hordeum vulgare
caaactcacaagcaagctcagtcagcacgccatggtgacgatgaagcgatgcatggttcctaccatcctgctgatgcttgcgctgcaggcagccctgctcgtcgccggcgacgaggtgggcgccattctcctgccgagccaagcccaaggcgaagcagccatggcggcgggcaagaagaggccatggaagtgctgcgacgagcccttctgcaccaggtcgttccctcccatctgcacctgcatggaccaggttttcaagtgccccaaaacctgcaagtcctgcgggccgtccgcggctgacccgtcccgccggatctgccaagaccagtacatcggcgaccctggacccatctgccggccatgggagtgctgcgacaagcctacctgcaccaagtccaacccgccgacgtgccgctgcggcgacgaggtcgacaagtgtgctccgacgtgcaagacctgcctgccgtccaggtcccgcccttcccgccgcgtctgcatcgacagctactttggggccttcccgccaccgtgcacgccccgagaggccgtcgccgccggcggcaactagctaccgcgcgcgcgtacgcgctggtcacccgatcgatcagcgtgccgttgatcgaatcgccacgtcgtctgtactgcgacctcgct

SEQ ID NO: 366 - DNA, 1595 bp, Hordeum vulgare
ggtctataggcgagatgagctggttgccggcgacgagggcgctctcctgcgtcgtccttctcctcctccttgtcgtcgccgtcgcgcctccggcgtccgcggcggcgatcaccaggggcgacttccccacggggttcgtcttcggcaccggctcctccgcttaccagattgaaggtgcagttgcagaggacggaagaaaacccagcatctgggacacattcacacactcaggctactcgcccggcggagccactgctgatgtgactgcagatcaatatcataagtacaaggaagatgtaaagcttttgagtgagatgggcgttgatgcataccgattttccattgcctggcctcggctcattcctgatggccgaggagctgtcaatgcaaagggactggagtactacaacaaccttatcaatgaactcctacgtcatggaattcagcctcacgtaacagtatatcatttcgacttacctcaggctcttcaagatgaatacaacgggatgcttagtcgtaaattcatagatgactacacggtgtatgcagatgtgtgcttcaagaattttggtgacagggtgaaatattggagcactctgaatgagccaaacattgagccaattggcggatacgaccaaggattctttccaccacagcgatgctcattccccttcggcatcagttgcaacaatggcaactctaccacagagccctatatagtaactcaccatcttctgcttgcacatgcttcggcagtgtccctgtataaagagaagtaccaggacaagcaaggtggaaaaattggactcacattgctcggttcgtggaacaagcccgcgacacaaacacctgaggatatagcagcagcttcaaggatgaatgacttccacattgggtggtatatgcatcctttggtgcatggagattatcccccagtgatgaggaagaatgttgggtccaggctaccatctttcactgctgaagagctgaagagagtgcttgggtcttttgattttgtcggatttaaccactacgccgcctcatatgtgaaggctgatcttagcaagctggatcagaagctgagagattacatgggtgatgcagcagtgagatttgaaagcgtgccattttttgacttaaagaaccagtcgtcaccgtgggttctgagggaaatgctggagcatctccaggtcaaatacaagaaccctgtggtcatgatccacgagaacggagctgccagcgtggctgatccctctggtgataaggccctcgacgacgagttcaggtcgcggtacctgcaggattacatcgaggcgaccctccaatccagcaggaacgggtcgaacgtgcagggctacttcgtgtggtcattcgtggacatgttcgaattcctctttggctaccgcatgggcttcggcctctatggcgtcgacttcaactccgaggagaggacgaggtaccggaggcactccgccaagtggtatgccggcttcctccgtggcggcgagctcaggccggtggctgtccccggccaggcgtattcccagtgatcttggcacgcattttcaggcttctgtagcccacgaataggatag

SEQ ID NO: 367 - DNA, 551 bp, Hordeum vulgare
gccggatgtcggacgcgccggcgagccccccgggcggcgggaacgggggaggagggggaggggtgggcagcgacgacggcggcggcggcggatacggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggccagcgacaagtgccagagggagaagcgcaagaccatcaacggcgacgacctgctctgggcgatggccacgctcgggtttgaggagtacatcgagcccctcaaggtttatctgcagaagtacagagagacggagggtgatagtaagctagctgggaagtctggcgacgtctctgttaaaaaggatgcacttggtcctcatggaggagcaagtgcgcaagggatgggccaacaagtagcatacaatccaggaatggtttatatgcaacctcagtaccataatggggacatctcaaactgatga

SEQ ID NO: 368 - DNA, 1397 bp, Hordeum vulgare
cctgctcattatcggtccaccgatcgctcagcagaagagagaggagaggagaggagagaagagagaggaggagcacgacgaggatgagggggtggagagaggatgtggtggcgctgtcgctggaggcgcgcggccccggcgacgaccggccggagaagccgcgccgctacggggtcacggagatgaggagcccctgctactccttccgccccgcccaccacgcgctccaggaaatattggattccctcggtccttttgttgatggcctgaagttctccggtggatctcatagtttgatgggaaaggaactgatcagagagatcactgatttagcgcacaagcatgacatgtatgtgagcactggtgattgggcagagcatcttctgcgccaaggaccctcttctttcaagcaatatgtagaggaatgcaaagagttaggttttgacaccattgagctcaacgctggatctctcaagcttcctgaagaggctatcctgagactagtccgcctcataaagaacactggcttgcgagccaagcccctgttttcggtcaagttcgacagttctgagatgcctgcagctggtgatagggcatttggggcttacatagctccagtgaagcggagctcagaaagagtcgaagacgttgacctgctgatacggagggccgagagatgcctggaggcaggtgcagatatgatcatgatcgacgcagacgacgtctgccagcgcacggattccctcagggcggacatcatcgcgaagatcgttggccggctcgggctcgagaagaccatgttcgagacatccaatgccaacacctccgagtggttcgtcaaacgatacggcccacgggtgaacctcttcgccgaccactccgaggtgatgaacctggagcgcctccgcggcttggacgtgcgccggagggtccgccccttgctcccttcgccgttcttcctgatgtgatgacggccttgctgagtaatgatatgggactggggcctaagcgaagtgttgatggagctgagttttctgtactgggaggagttgtgtgaactgtactgagggacctaagcgctgtgttgaagtagtagcgagtcccggagccgaggcggcagtgtgttggtacttggtagcaggtaataaggctgaggctgtgtgtgtatgatctcggggtgatttgcactgggagtaagtcctactacttgtttcgaatgtgtgtgaatgtgatgatgcatctagagcaagattgcaaggattgctgggatgaacaaaagagatgacgtgtacaccgattcctgaagacgacgggaacaatacgggccttcgctgcattgcttaacagcaactctagctgatccctgtaataaccagttgctccctgtataaccgcta

SEQ ID NO: 369 - DNA, 874 bp, Hordeum vulgare
cccaaatagatcgatccaagcaagccatgatgagaccctgctgcctctccctggccctcctggtcgccctgagcgccgtcgggtgcgcggcggcgcaggcggccgactacgacttcttctacctcgtgctgcagtggccggggtcgtactgcgacacgaagaagagctgctgctacccgcggacggggaagccggcggcggacttcgggatccacgggctctggcccaaccgcgacgacggctcctacccgcagaactgcaaccccgccaacgccttcgatccctccaaggtgagcgacctgctgagcagcctgcgcgcggagtggccgacgctggcgtgcccggcgagcgacgggctccagttctgggcgcacgagtgggagaagcacggcacctgcgcgcagaacctcttcaacgagcacggctacttccagacggcgctgcacctccgcgaccagctccgcgtcctcgacgcgctcgcctccgccggcgtcgcccccgacggcggctactacacgctgagcgccgtcaagggcgccatccagcaggggacggggttcgagccgttcgtggagtgcaaccgcgacgagtccggcaacagccagctctaccagctctacttctgcgtcgacgcccgcgcctccggcttcgtcgagtgccccgtccagcccggcggcaggccttgcggcgaccggatcgagttcccggccttctgatgcgccgatttctgttttcctcctgatttctgttttcctcctgattcattccctgcgttattatttaatatagcaaagtttgaggggtcgtgatgttaatgaagacagtgtatgtcatgacatggtgtaaacatgtggagggagcaggttgctattta

SEQ ID NO: 370 - DNA, 798 bp, Gossypium hirsutum
aaaggatcccctttcttctccagcgtccgattttcccttgaaaatccaatctctttcactcccgcccttttccatttttctttttaatcaatttcaatttttttcccactttctggattctttacatggcgacgtcggcaccggttccggcgagtccaggcggcggtggaagtcacgagagcggcggcgagcaaagcccgagatccaacgtgcgagaacaagagaggtttctccctatcgctaacattagccgtatcatgaagaaagctctccctgctaacgctaagatcgctaaagatgctaaggagaccgtacaagagtgcgtttcggagttcatcagcttcatcactagcgaagccagcgacaagtgccagaaggagaagaggaagacaattaacggggacgatcttctctgggctatggcaactttagggtttgaagattacatcgatccgcttaagatttaccttaccaaatatagagagatggagggtgatacaaagggttcggttaaaggtggagatacatttgctaagaaagatgtccaaccaggtccaaatgcccagcttgctcatcagggttcattctcgcaaggtgtttattatgggaattctcaatctcaatcacaagcccatatgatggcttctgatgcccggcactgagaacgagaccaaatccttcttgagccaatttcatcatccaaatctcattgaattatcatgtttcaatggtggcaaaaacaggtgtgaaaaactgacattttggatggttcagatcatccttcacatgctcgagttt

SEQ ID NO: 371 - DNA, 2426 bp, Gossypium hirsutum
ctaagcaaaacgtcgaaggacaaaaatggggaagaagaaaaaccaaaagcagcaaccatcagcctcaaaagacgatcttctcaatacactcggagacttcaccagcaaagaaaactgggatagcttctttaccatccgtggcagtgatgactcgttcgagtggtacgctgagtggcctcagcttcgtgactcacttctccctcgtattcaacaacacccatcaccctcttccctttctccttcttcttcgttgcgaatattggtgcctggttgtggcaactcccgattatcggagcatttatacgacgccggatttggtgatataaccaatatagatttttccaaagttgtcatctccggcatgcttcgacgtaatgtaagggaccgacccaacatgcgttggcgggttatggacatgacccaaatgcagttcccagatgacactttcaatgttgttctcgacaaaggtggattggatgctttgatggagccagaacttggccctcagctagggactaaatatttgtcagaggtcaaaagagttttgaagtccaggggaaagttcatttgtcttaccttggcagaatcccatgttctaggtttgctttttccaaagttcagatttggctggaatgtttgcctttatgctatacctcagaaaccatctactaagccggatctccaaacttttatggtggttgctgagaaggaaagttccaatgaacttctccagatcatttcatctttcgatcattcttcccttgcttgcaatccaaatcagacttctggtcttcttgaagcccttgaaagtgagaatcaaatacgtggagaatacttgaatggctctgatgtactgtattctcttgaagatctgcaacttggagctaagggggatctgaaaaaacttagccctggtcgtagagttcagcttactctgggtgaccaaggggtctcacacttttgttacaaagctgtattgcttgatgctaaacaacagtctggggcattctcttttcgctgtggtgtctttattgttcctaagactcggtctcatgaatggctcttctcttcagaagaaggacaatggcaggtggttgaaagctcaaaggctgctcgtctaataatggttttattagaggccagccatgctaatgctggtatggaagatattcagaaggatttgtctcctctggtgaaaccattggcacctgctgataatgataaaggaaatcaaattccgtttatgacagcaagtgatggaatcaagcagcgaagcgttgtttaccagggatcatcttctttaactggtcccgttgttattgaagatgttgtttatgaaaatactgatgatgtcagtcactctttacccttccgccgccttgtcttcgaaagaactgagggcctggtacagtctgaagctttgctaactagggatggattgtttgacaaaagtgtttatggaacagagaagaagaaagccagttcatcttccaaatccaaacgaagaggagccctcaaaagaaataatgaatcaagcggcaaaatgaaggtgtatcatggttatttggccagttcttatcatacagcaatcatttctgggttttctctgatttcatcctatttggaaagtgtggcatcatcagggaatagggttaaagcagttgtgataggtcttggtgcgggcttacttcctatgtttcttcatggatgtatgcaatctatgcaaattgagggagtggagctagatcctgttatgcttaaccttgcaagagactattttggttttactgaagataaacgaatgaaggtacatattgctgatggcatccagtttgtccgggactacagaaacttattttcagctggcaatgaagtgctcctttcttccaacggaagttgcaaactttcagatgctgaaagcagaagtaccgctattgacataattattgttgatgtggactcttctgactcaagctctggactgagatgtcctgctgctgattttgtggaagattcttttcttcaaaacgtaaaagatactctttccgagcaaggtctctttgttattaatttggtctcaaggtctcctgccatcaaggatgcagttgtctcaaggatgaaagaggtttttagccacttattttgcattcagctggagggagaggtcaacctagtacttttcggtctttgttcggagtctcacattgaggaggattgcatacctgatgctgcccttaaacttgataaattgctcaagtccgaacatcccgagataagccagagcatcacagatgcagcaaagaagctcaaacgtttaaagtgaagaccgtttgataataaagtttcccctttaatgtattctcaagtaactcagagagcaagcttttgcagattttgaagcaaatggcattgaaactgggtgactg

SEQ ID NO: 372 - DNA, 893 bp, Zea mays
gccacatgttgagtgagcagacggcggctagcactagcagcagcggcggcggcgtcgagcgtcaggacaggtggctgcagccggtggcggagaacgaggaggaggaggaggagttcagggacatccacgcgctgagcccgccgccgagccagccgtcgtcgtaccgccgggcgcgcggcggcgagccgtgggggtccgccgcgggcgggagcaggcacacgtccgtccgctccgtggggagcgacaccgcgcccagcgagcccttcccgactatgaccagggagttctcggccatggtcgccgcagcagccagcgccgcagcagacagccgtgacgccggcagcgacgtcgtgggcagggccgaggaggaggaggaggaggagctggaggagaccaacccgctggccatcgtgccggacagcaaccccatcccgtcgccgcgccggggcccgccgcccgccgccccgggcgccgacgcggcggcgctggtggccgccgacgggcacggaagccgcgaaggcgggggggtgtccgtggggcaggtcaggaaggaggaggtggagtccaagatcgccgcgtggcaggtcgccgaggtggccaaggtcaacaaccgcttcaagcgcgaggaggtcgtcatcaacggctgggagggcgaccaggtcgagaaggccagcgcgtggctcaagaagtacgagaggaagcttgaggagaagcgtgccaaggcgatggagaaggcgcagaacgaggtggccaaggcgcggcggaaggcggaggagaagcgcgcgtccgcggaggccaagcggggcaccaaggtggcgcgagtgctggagctcgccaacttcatgagggccgtggggagggcgccctccaccaagcgctccttcttctgatga

SEQ ID NO: 373 - DNA, 1220 bp, Zea mays
ggcatatatttggcagcaggagcggcctctcacttgcttcgacgtatttctctatctatcgatacggttcaagggaccgaagaaggtagagagagaaacttgaaggggagaggaaggagatacaggttcatgttcatttaggtgtcagttcatctgatttctcagaagcaaaatgttgtttggagctcagtgacaccattttgtaatgcatgtgccttttacgggaaatggaggatcattatgtccatcccaagtctaagtctaaccatggctccttgtcaggaaatggttatgagatgaaaaatccaggccatgaagtttgtgatagggattcatcatcagagtctgatcgatctcacccagaagcatcagcagtgagtgaaagcagtctagatgaacacacatcaactcaatcagacaatgatgaagatcatgggaaggataatcaggacacattgaagccagtattgtccttggggaaggaagggtctgcctttttggccccaaaaatagattacaacccatcttttgcttatattccttatactgctgatgcttactatggtggcgttggggtcttgacaggatatgctccacatgccattgtccatccccagcaaaatgatacaacaaatagtccggttatgttgcctgcggaacctgcagaagaagaaccaatatatgtcaatgcaaaacaataccatgcaatccttaggaggaggcagacacgtgctaaactggaggcgcagaacaagatggtgaaaggtcggaagccataccttcatgagtctcgacaccgtcatgccatgaagcgggcccgtggctcaggagggcggttcctcaacacaaagcagcagctccaggagcagaaccagcagtaccaggcaccgagtggttcaatgtgctcaaagaccattggcagcaccataatctcccaaagtggccccacctgctgcacaccctcttctgacactgcaggtgcttcagcagccagccaggaccgcggctgcttgccctcggttggcttccgccccacagccaacttcagtgagcaaggtggaggtggctcgaggctggtcgtgaacggcatgcagcagcgtgtttccaccataaggtgaagagaagtgggcacgacaccattcccaggcgcgcactgcctgtggcaactcatccttggcttttgaaactatggatatgcaatggacatgtagcttcgagtt

SEQ ID NO: 374 - DNA, 1040 bp, Zea mays
aacagcgcaagtggagtgatgcagccgagggggccagaccagaggaagggacggcggggaggtggcaaggcgcagagagcaggttcgcttggcggacgcaccgagggaggcgtgtgggagccatgcttcttccgtcttcgtcttcgtcttccgcttccgcttccaaaggtaactcctttgggaaaaccgttaacgatcatctgaggtcaactttgagttttgataacaagcaacctccatttgcaagtcaaaactttgactacggtcaaacaatagcttgcatttcatacccgtacaatcattctggctcaggagatgtttgggcagcctatgagtcacgcaccagcgctgccactgtgttccgttcccaaattgctggtgggggtacatccacaagaattcccttgcctttggaattagcagagaatgaacccatatatgtgaaccccaaacaatatcacgggatacttcgcagaagacagttacgtgccaagttagaggctcagaacaagctagtcagagcccgaaagccttaccttcatgagtctaggcatcttcatgcaatgaagagggcacgaggttccggtggacgattcctcaacactaagcagctccagcagtctcacacagccctcaccaggtccaccaccacaagtggcacaagctcctcaggctcaactcatctgcggcttggtggtggcgcagccgcagctggagatcgatctgtgctggcacccaaaacaatggtctcacaagacagtagcaagaaggccgtttcttcagccctcgccttcactgcgactccaatgctgcgcagagatgacggcttcttgcagcacccaagccatcttttcagtttttctggtcattttgggcaggcaagcgcgcaagctggcgtccataatggaagtcagcatagggttccagttatgagatgaccggtttgcgaaccatagctggtgatccaggcgtctagggtcaacttcgctgtggtgtcttagtctctcaggcaattcatccttggcttaatttctggcttt

SEQ ID NO: 375 - DNA, 1483 bp, Oryza sativa
tttggatccgacctgactgcattctgtagtgagaactatcctgctaaatgcataatacttgcaggtgttttctgttgtattggcaacgtgatagtttttgtggtgcaaaacattcaagatgggcgccatggacgtacaacttgagtctactgctgttcaacatggacaagctaagataaatgtggaggaacatgctctagtttctctgttgtctgatgagaagtacgcaactgaaaagaccgaagatgtggaccctgatgattatgagaaacttgaggaagggataatgcagtatgggtgtgcacattatcgaagaaggtgccgcattcgagctccatgttgcaacgagatttttgattgtcggcattgccacaatgaaacaaagaattcaattaaaattgatgctgtgaagaggcatgaactcccacgccatgaagtgcagcaggttatatgctcgttgtgtggcacggaacaagaggtacggcaagtatgtatcagttgtggtgtatgcatggggaagtacttctgtgaagtgtgcaagctctttgatgatgatgtttcaaaacagcaatatcattgcaatggttgtggaatatgcagaattggtggcaaggagaatttctttcactgctcaaaatgcggatgctgttattctatagtattgaagaacagtcatgcatgtgttgaaggagcgatgcatcatgactgtccaatctgctttgagtacctttttgaatcaaccaatgatgtttccgtcttgccctgtggtcataccattcatgtcaagtgcttgcgagaaatggaggagcactgccaatttgcttgcccgctttgctctaaatctgtctgcgacatgtcgaaggcatgggagagattggacgaggaactagcaacgatatctgacacctgtgacaataaaatggtgcgcatattgtgcaacgattgtggggcaacatcagaggtgcagttccatttgattgcgcacaagtgccagaagtgcaagtcctacaacacccgccagatctgaagtggcgaagttttgatgtgattcattttgtatgggaagagagccctgggggatgctcattttgcaacacaaatcccgctaacgcctctgggaatctgatgagctctcggtcgttttcttgctcattggatgcctcagccgaggcaaatcactcgcatctgaaattcatctatgaagtggatgctgttccctcctgtgttcaatttattacctcaccatgtcgcagactcagagtcctgttcagcttaagtttctactagcactagccgagataataagtgcacgtctactcaagcttctgggcataaatggtggctagcttgtgtgttatggtgtgtacttgttgagtctcgggcaaacactgtaacggttagtggcatagtattacttcttgctcgtgtgcgtgtgtagtaggatggcggattgcaggacgtgggtgttatttacctcgagttt

SEQ ID NO: 376 - DNA, 1724 bp, Oryza sativa
gcgacatgaatccctacgacctccgctacgccgacccttcctcctaccgcgacaggcgcagcgaccttgccggggctcccgtgctcgccgcgtcggcccccgcggccgccaacccctacgccgccgcgtacgcgcccgcgccggctgctcccgtggcccccgctggtggcgacttctcgcgcttcggcgggagaggccgtggtggaggcgcgggcggcggtgggtggggtagaggtggtggtggtggtggtggcgctggcggataccgaggcggcggtgggagaggaggtggaagggacgcgctggactcgctctccttgccgaagcctgacttccggagccttatacccttcgagaagaacttctatgtggagtgccccgccgtgcaggccatgtcagacatggatgtgtcgcagtatcgtcgccagcgtgatatcactgttgaaggccacgacgtgcccaagccggttcgctacttccaggaggccaacttcccagattactgtatgcaagcaatagccaagagtggattcgtagagcccacgcctattcagtcacaaggttggccaatggctttgaagggcagggacatgatcggtatcgcacaaactggctctgggaaaacactatcttaccttctccctgggttggttcatgttggtgcacagcctcgactagaacaaggtgatggcccaattgttctgatccttgctcctacaagagaactggctgttcaaatacaacaagaatctggcaaatttggatcatactcaagaactagaagcacttgtatctatggtggagcacctaagggaccacaaatacgtgaccttaggagaggggttgagattgtcattgcaacacctggtcggttgatcgatatgctggaaggtggtcacactaacctgcgaagagtaacatacctcgtcctggatgaggctgaccgcatgcttgacatgggttttgagccccagattcgtaaaatagtggcacagatccggccagacaggcaaaccttgtattggagtgccacttggccaagagaagtagaatccttggctagacaatttctgcagaacccatacaaggtaatcataggatcacctgatctgaaagctaatcattccatacagcaaattattgaggtcatatctgaacacgaaaagtatcccagactcagtaaacttttatctgatctaatggatggaagcagaatcttgatatttttccaaactaaaaaggactgtgacaaggtcactcgtcaacttagaatggatggatggccagcattatctattcatggtgacaaagctcaagcagaaagggactatgttctggcagagttcaagagtgggaaaagtcctataatggctgccacagatgtagcggcacgtggtcttgatgtcaaggatattaagtgtgtgataaattttgattttccaacaactcttgaagattatattcacagaataggtcgaactggccgcgctggtgctagtggaactgcattcacctttttcacactctccaatgcaaaattctccaggaatcttgttaagatcttgagggaagctggccaggttgtgaatccagcgctagaatctatggctaaatctgccagttctatgggaggaggcaatttccggtcaagggggcgtggtgggtttggtaacagatctggctcaaatagcattcccataagaggaagaaggccatactgataa

SEQ ID NO: 377 - DNA, 2192 bp, Oryza sativa
tctgcatggacgcctccgccggctcgtcggcgccgcactcgcacgggaacccggggaagcagggtggcggcggcggcggcggcggcggacgggggaaggccccggcggcggagatcaggggtgaggcggcgagggatgacgtctttttcgctgacgataccttcccgttgctcccggacttcccgtgcctttcttccccgtcaagctcaaccttctcgtcgtcgtcgtcgtcgaactcgtccagcgctttcaccaccgcggcgggagggggttgcggcggtgagccgtccgagccggcctcggcggcggacgggtttggtgagctcgccgacatagaccagctcctcgacctcgcgtcgctgtccgtcccgtgggaggccgagcagccgctgttcccggacgacgttggcatgatgatagaggacgccatgtccgggcaaccgcatcaggcggacgactgtaccggcgacggcgatacgaaggcggtgatggaggcggccgggggaggagacgacgccggcgacgcatgcatggaggggagtgatgcgcccgacgatctgccggcgttcttcatggagtggctcacgagcaaccgtgagtacatctccgccgacgacctccgcagcatccgcctccgccgatccaccatcgaggcggcggccgcgcggctcggcggcgggcgccagggcaccatgcagctgctcaagctcatcctcacctgggtgcagaaccaccacctccagaagaagcgcccccgcacggcgattgacgacggcgccgcgtcgtcggaccctcagctccccagccccggcgcaaaccccggctacgagttcccctccggtggccaggagatgggctccgccgccgccacatcctggatgccctaccaggccttcacgccgccagccgcgtacggcggcgacgccatgtacccaggcgccgccggcccgttccctttccagcagagctgcagcaagagcagcgtggtcgtgagcagccagccgttctccccgccgaccgcggcggcggcgggcgacatgcatgcgtcgggcggagggaacatggcctggccgcagcaattcgcgccgttccccgtctcctccacgagctcctacaccatgccgtcggtcgtgccaccgccgttcaccgccggattccccgggcagtactccggcggccacgccatgtgctctccacgcctcgccggagtcgagccgtcctcgacaaaggaggcccggaagaagcggatggcgaggcagcgccgcctctcctgcctgcagcagcaacgtagccagcagctcaacctgagccagatccacatctccggccatccacaggagccctcccctcgcgccgcgcactcggcgccggtcaccccgtcgtcggccggctgccggagctggggcatctggccgccggcggcccagatcatccagaatcccctatcaaacaagcccaatcctcctcccgccacgtcgaagcagccgaaaccctcgccggagaaaccgaagccgaagccgcaggcggcggcgacggccggagcggagagccttcagcgctcgacggcttcagagaagcggcaggcgaagacggacaagaacctgcggttcctgctgcagaaggtgctgaagcagagcgacgtcgggagcctcggccgcatcgtgctccccaaagaagcagaggttcacctgccggagctgaagacgagggatggtgtctccatccccatggaagacatcgggacgtctcaggtgtggaacatgcggtaccggttttggcccaacaacaaaagcaggatgtatcttctcgaaaacacaggtgattttgttcgttcaaacgagctgcaggagggtgatttcattgtgatctactccgatatcaagtcaggcaaatatctgatacgtggtgtgaaggtgaggcgcgcggcgcaggagcaaggcaactcgtcgggggcggtaggtaagcataagcatggctcgccggagaaacccggcgtctcgtccaatacaaaggccgccggcgccgaggacggcaccggcggcgatgacagtgccgaagccgcagcggcggcggcggcaggcaaggctgacggcggcggctgcaagggcaagtccccgcacggcgtgcggcgttctcgccaggaggccgccgccgccgcctccatgagccagatggcggttagcatctgatga

SEQ ID NO: 378 - DNA, 951 bp, Oryza sativa
cgcttatctggcctatcatctgatcatctactgtcggctcgatcagtagctgggaccataattaatttaagttaagttcaatcaagaagtcgagaggcgatgtcctggtggaagaaatccagcggcaaaagcagcagcagcagcagccagtactacgctggctctgacagctcgtcgttcgccggaggaggaggagacgaccggtacggacgagccggcagcggcaacggccgctcgccgtggacgacgtccgaggagtacccgaggtacaccagcgacgacgacaaccgcagcggcagcggcagcgacgacgacgacgaccacggcgaccggaacaggcgcaggggaaagaagagcaacaagaagaagagcagcagcagcagcagcagctacaagtacgacgacgacggcggcgagagagaccggagctacagcaactacggcggctacggcaacaacgagggctacagcagcagcgcccccagcggctacaacccctacaacaacggcggcggctacggcggcccttcctacggcaacggcggcggctacggcggctctacctacggcaacggcggcggctacggcggctcttcctatggtaacggcggcgccatcgtagccggaggcggcggcggcagcgcccctgcctcctatggctatggctctaattccggctggggtgcgccggcgccgccgcggcaggagggtggctcagggtcggcgccgacgtacctcaacgtcatctacatgacgcagccagggtcgtcgtcgtcgcagaacgagaactccggcgagaggagagacaacggcggcggcggaggaggacgaaacgggctcttcggtccgacgttccaagccgtcggcggctatatggaccgtaggttcggattcgactgagcctgatagattcctaaattgcttcaattcaattcgtcgatgtctcctctc

SEQ ID NO: 379 - DNA, 2986 bp, Oryza sativa
gcgcaatggagcagctgcggacgatcgggcgggagctggcgatggggtcgcagggagggtgggggcagtcgaaggagttcctcgaccttgtcaagtccatcggcgaggcgcggtccaaggcggaggaggaccggatcatctcgcgggagctggatcacctcaagcgccgcctcgccgaccccgacgtgccccgccggaagatgaaggagctcctcctccgcctcgtctacgccgagatgctcggccacgacgcctccttcggccacatccacgccgtcaagatgacccacgacgagtccctcccgctcaagcgcacgggctacctcgccgtctccctcttcctcgacgagcgccacgacctcgtcatcctcgtcgtcaacaccatacagaaggacctcaggtccgacaactacctcgtcgtctgcgccgcgctcaccgccgcctgccgcctcatcggggaggaggccatcccggccgtgctgccccaggtcgtcgagctgctcgcgcatcccaaggaggccgtgcggaagaaggccgtcatggcgctccaccgattctaccagcgatccccctcatccgtctctcaccttgtctccaacttccgcaagaggctctgtgataatgatcctggggtcatgggtgcaactttatgccccctctatgacctgattttggaagatccaaattcgtacaaggatttggttgttagttttgttaacatcctcaaacaagttgcagagaggaggcttccaacttcctatgattaccaccaaatgcctgcaccatttattcagattaaactattgaaaatacttgcggtgctgggtagcggtgataagcaggcaagtggaaatatgtacatggtcttgggtgacatattcaggaagggtgacactgcaagcaacattggcaatgcaatattgtatgagtgcatatgctgtatttcatccatattcccgaacgctaagatgcttgatgctgcagctgaaacaacatcaaagtttctgaagagtgatagccataatcttaagtacatgggcattgatgctcttggccggttaattaaaataaatccagatatcgcagaagagcaccagctggctgttattgattgcttagaggatcctgatgacactttgaaacgcaagaccttcgagcttctttacaagatgacaaaatcaacaaatgttgaagtgattgttgatcgaatgattgagtatatgattaacatcactgatcaccattacaagacagaaattgcatctcgttgtgttgagctagcagaacaatttgcacctagcaatcagtggttcatccagaccatgaacaaagtctttgagcatgctggagatcttgtcaacatccgagttgcacataatttaatgcgacttattgctgaaggctttggagaggaggatgaaggtgctgatagccaactaagatcgtcagctgtagattcctatctacggattgttggggagccaaagcttccttcttcgtttctgcagataatatgctgggttttgggagaatatggaacagcagatgggaaatattcagcttcatatattattgggaagctgtatgatgtggcagaggcccacccaactgatgacactgtcagggcttatgcaatctccgcaattttgaagatctttgcgtttgaaatcgctcttggaaggaagatcgatatgctacccgagtgccaatcgttgatagatgaattgtcagcttcgcattcaacagacttgcagcagcgtgcatatgagctacaggctttgctaggtttggacaaacaggctgttgagaatgtaatgccagccgatgcaagctgcgaagatattgagatcgacagaaacctctcgtttctaaatggttatgtgcagcaagccattgaaaatggtgctgcaccctacattcctgagagtgaacgctcaggagtggtaagtgttggcaactacaaggcccaggatcaacaagagacatctgcccatgctcttagattcgaggcctatgagctacctccagcagcttcacaggccagtatttccccaactactgacctggttccagttccagaaccaagctactataaggaagatcaccaaatgtcaagatcccagccatcaggcgattctctttctggtgaatttggtctcaaacttcgtcttgatggagttcagaagaaatgggggagaccagcctattcctcctcatctacgccttcaagttcaacatctagtcaacaagcaaccaatggaggcgttagttctgaggtgggagggtcaacaagttcacaggctcgggaatccacatatggttccaagagacagcaggccactgaagtttcagcggaaaagcaacggttggctgcttcactctttggtaaagctgataggaagacccaggctgggcgaaagacagcaaaggagagttcctcaactgagaaagtagctactgctaatgcaacaccgcagccagccaaagagcaagtaatcccttctgccccaccacctgatcttctggatctgggagagccagtttcatcaagtcctccattagctgatcctttcacacagttagaaggtcttctcggaccagcatcagcctctcctgtggtttctgaaaccccagcttcgagcacttcgaaaacaccagatcttatgtcaatcttttcggatgatgtacaaactggagtgaccagtggatccacagaaccatcactcggggtaaatgtggtcgctgcaaagaagggccctagccttcaagatgccttgcagaaggacgcagcggcccggcaagttggtgtgacgccgacagggaacaaccctattctattcaaggacttgttaggctagaatatacagcatatgttcagcgtgctcaaattgggtaagtggagtttgcctccaagatggtcttgattgctctagattaaagggcgaattccagcacactggcggccgttactagtggatccgagctc

SEQ ID NO: 380 - DNA, 1914 bp, Oryza sativa
ctgcttcccgtccaatctcgcgacgccccccgggcagattcgaggacgaccggaggcggcgaacggcgacccccccgccggataccggcagactaggttttctttgttagcataagcttgtgaaaatttagcttgtttcttacttatggataactcacacgaacagccattaccccctggtgtcggggcatggccgccgccaccttccattcatcctgcaaaatttcaacctaatccacagccttatgcaacaccttatggcgctacacccaacaatggcagcaatcacaatgcagcgagctactctgctgctgcacaacccaccatgcctttccctaacatggatgctgggggtgcacaatcaaatcagacagctcatgaagtttccaaccataatgatagtgcagcagacattgaatctgctgtccaagaggctgttcttcgtgaacaggacattgagactcagcaagtcatacaaaatcaaagacaagcaaaagcaacaattgagcctacgcagtatggagaagacctcctttcaaaccgccgcaaccctaatgcattgaaggagcacttactaaaaatgacagccgagcatcgtgcagagatggcaaacaaaagggggaagccgcttcatgcagataatggcaatgttgaaattggcaatggctatggtgtaccaggagggggtgcttattatgctgcaaacatgtcaagtggtcaaatgaataaacccaaggatatagctgataaagcaaaaggtgccgatgatctccctgaatttttgaggcagagattaagagcaaggggtattcttaaagatgaggcgacaaataatagattcacgattaaacaaaatgtcgattctccagtagggcagataaaagctgcccaagagttgcctcctggttgggttgaagcaaaagatccaacaagtggtgcttcttatttctataatcagagcactggaacgacccaatgggatcgccctggtgctcctttgaacaccatgcaacatcaagctcctccatcctcgtccttgccagagaattgggaggaggcacttgatcaatcaacaggccagaaatactattacaatacaaatacacaagcaacacagtgggagccgcctactgctgtgaacccaggtgttgcgcctcatgctcccaccaatgctgctgttgagatggctgctcaaaatacagatatttggaactctcaaatgcagagatgtttaggctgtggtggatggggtgtaggtcttgtccagccatggggttattgcaatcactgcacaagggttcaaaatcttccttttcaacagtatccatcctacccaaacaatactacacactcaagcagtaacaaaaatccagggaatgtagcagccaaggacagatcaagcgcaaaacctccatttggcaaagcaaacagaaaagatcaccgcaaaagaaatcgccctgaggatgatgagcttgacccgatggacccaagctcttactcagatgctccacggggtggctgggttgttggcttgaagggtgtgcagccacgggcagcagatactactgcagctggacctttattccaacaaagaccatatccgtcacctggtgctgtgctgagaaaaaatgcagaggttgcatctcatggcaagaaacgtggtatggctccgatcaccaaaagaggggatggcagtgacggtctcggggaggcggattagatcaatcgtcgtaaattttccttgcaacccagtggactagcggtcattttggctttggcaatgactgaaacatcggtgcactgtcgtccaaaaagaagcaaactgtcagcagtaaatcactccagtgcaggagaacccagagctgagtgcattgtgagactgagcttaataagattcacatcctaaatgtgccc

SEQ ID NO: 381 - DNA, 671 bp, Oryza sativa
tagccatggcgccgggtgctgggtcgtcgtcgtcggcgaggaggggcaggcgcgtcgccgccgccgagccgccccgccgcgcgctcaggatgcgcgcgtcgtcgccgatgtactacacgtccgacgacgaggacttgccggagattgtcctgacgcccccggctccggcgccgccgcgcaccggtacccgctcgctgcggatgcacgcgtcgccgcccgactatgggcgccgccgtaccaaccgaccccgccgcgtggcacggacgaggtcgccgccggtggtgcaggaggcggagagggagccgccggcgccgcagcagccggcggcggtggtggtggagcgcgtgttttacatggtgggtagcccgccggacgtcatcacggccacgggggaagggccgggggggcgcacggtggcgggcttccgttgcaggaggctcacgtccacgcgcaccctcgtcgacggcgaggacgccgccgcccgcgccgccgccatcagcggcgcccgcgccctggtcatgtgcagctgccacggcgcgcccttcacccacgccgagttcctgctccacgccggcggcaccgacctgggccgcaacgtcaccggctacccgtggcttggcgacgagatggagctgactcctcccggcgccggcggcccccatctgtagtag

SEQ ID NO: 382 - DNA, 1328 bp, Oryza sativa
cgccgatggacgacgccggaagggcctccgctccagcggtggtgacggtgacggcctccgccgccgcccccacgcctcctcttcctcctcctccgcctcccccccctccctcgcagctccccgccaccgccgccgccacggacgagccttcccacgaccccgccgctctctatggagagggtatgtggcagcagatgaccatgagcggcagtggcgctatgcaacctggaccatatcctgagcggtccggagaaccggactgcacttactacctcaggactggattgtgcaggttcggtatgagctgcaggttcaatcatcctcaggataggaatctggctattgcctctgccagaatgaaaggagaataccctgagaggatggggcaaccagaatgtcagtattatctgaagactggaacatgcaagtttgggcctacatgcaaattccatcatcccagagaaaaagctggaattgcagggagggtgcagctaaacacattaggatatccactccgaccgagtgaaaaggagtgtgcatattacttaaaaacaggacagtgtaaatatgggaatacatgtaaatttcaccatccagaacttttcaatgctatggcttcttcacgtggttcacctatttatccttctgtacattcctctgcaaccgcgggtccaccttatactggaacaatggctagctgggcttttccaagaggttcttttattccaagccctagatggcagaatccctcaaattatgcaccgatgattgtaccgcaaggtcttgttcaagtaccaagctggaactcatatactggccaaatgatgcctgtttcatcttctgagagtcgactgcagtccccaggggctcaacaaacctatggaacttctcagcaagttgatgccagtgcaggcaatcagggaatgttgtcaccctacagatctagttcatatcctgtacctcaatacgcattgcagagagagaatgtatttcctgagagacctgatcaaccagaatgtcaatactacatgaagactggagactgtaaatttggtgcggtgtgcaagttccatcatccccgggtgcgatcaatgcctactccagattgtgtcttgagtccagtgggtcttccactacgtccgggagaagaactgtgcaagttctattctcgctatggcatctgcaagttcggcgcgaattgcaaatttgaccatccaacgatggctcctccaatgggagtgtatgcctacggctctgcttcaactaatgtacctatggttcggcgtctcctgcaatccccatccgcatccgcgtacacttcctaataa

SEQ ID NO: 383 - DNA, 1055 bp, Oryza sativa
cgccgatggatccgtggattagcacccagccttcgctgagcctggacctccgcgtcgggctgccggcgacggcggccgtcgccatggttaagcccaaggtgctcgtcgaggaggacttctttcaccagcagcctctcaagaaagacccagaggttgcggcgctggaggcggagctgaagcggatgggcgcggagaaccggcagctgagcgagatgctggcggcggtggcggccaagtacgaggcgctgcagagccagttcagcgacatggtcaccgccagcgccaacaacggcggcggcggcggcaacaacccgtcgtccacctccgagggcggctccgtctcgccgtcgaggaagcgcaagagcgagagcctcgacgactccccgccgccgccgccgccgccgcacccacacgcggcgccgcaccacatgcacgtcatgcccggcgccgccgccgccggctacgccgaccagaccgagtgcacctccggcgagccctgcaagcgcatccgcgaggagtgcaagcccaagatctccaagctctacgtccacgccgacccatccgacctcagcctggtggtgaaagatgggtaccaatggaggaagtatggtcagaaggtcaccaaggacaacccctgcccaagagcctacttcagatgctcatttgctcccgcctgccctgtcaagaagaaggttcagagaagcgcggaggacaacacgatcctcgtggcgacgtacgagggggagcacaaccacggccagccgccgccgccgctgcagtcggcggcgcagaacagcgacggctccggcaagagcgccgggaagccaccccatgcgccggcggcggcgccgccggcgccggtggtgccgcaccgtcagcacgaaccggtcgtcgtcaacggcgagcagcaggccgcggcggcgtcggagatgatcaggcggaacctggccgagcagatggcgatgacgctgacgcgtgacccaagcttcaaggcggcgctcgtcaccgccctctccggccgcatcctcgagctctcgccgaccaaggattgataa

SEQ ID NO: 384 - DNA, 2825 bp, Oryza sativa
gaacgatggaggtgtgctgctgctcgacgtcatcggccgtgcccgggaggaggttcgcggcggccggggcggcggcggcggcggtggcggcgaggtggggcgccgtgggggtcgggagggcggtggtgctggcgcacccgctgcgcccggcgccgcgcggcgggcacgcgcacgcgcagcaggcgggcgcgcggcgggcgcggcgcgcggtcgtcagggcggtgttcgagcggttcacggagcgggcggtgaaggcggtggtgctgtcgcagcgggaggccaaggggctcggggagggcgccgtggcgccgcgccacctgctgctggggctcatcgccgaggaccggtcggcgggcgggttcctctcgtcggggatcaacatcgagcgcgcgcgcgaggagtgccgcggcatcggcgccagggacttgacccccggcgcgccgtcgccgtccggctccgggctggaaatggacatacccttctccggcagctgcaagcgggtgttcgaggtcgccgtggagttctcccggaacatgggctgcagcttcatctccccggagcacctcgccctcgcgctcttcaccctcgacgatcccaccaccaacagcctcctcaggagcttgggagcggatccgagtcaactagcatcagtagcgcttacccgactccaagcggagcttgcgaaagattgcagagaacctgcaggagcatcatctttcaaagtacccaagaaatctcctgctggagctggaagatctgccttctcgaaatctttaaattcaaagaaagaaaagggtgcgcttgatcaattttgtttagatctgaccacacaagctagtggcgggtttattgatcctatcattggccgtgaggaggagattgaaagagtagttcagataatatgccgacggacaaagaacaatcctattcttttgggtgaggcaggtgttggcaaaactgcaatcgctgaagggttggctcttcgaattgcaaatggagatgtccccatttaccttgtggcaaagcgtataatgtcattggacgttggtctacttattgctggtgcaaaagaaagaggtgaactggagtccagggttactagtttaattcgtgaagtccgggaagcaggggatgttattcttttcattgatgaggttcacaatcttattggatctggcactgttggaaagggtaagggtgctggccttgacattggcaacttgctgaagcccccacttgctagaggtgaattgcagtgcattgcagctacaactctagatgaacacagaatgcattttgagaaggataaggctttggctcgccgcttccagccagtattagtagaggagcctagtcaggatgatgctgtgaagatattacttggtcttcgtgaaaaatatgaaacatatcacaaatgcaaatttaccttagaagccatcaatgcagcagtttatctgtcagcaagatatattcctgacaggcagctccctgacaaggccatcgatctgattgatgaagctggcagtagagctcgaatggaatcatttaataggaagaaagaagggcagtcttcaatcctcttaaagtcgccagatgaatactggcaagagataagagctgctcaaaacatgcatgaagtggtgtcatcaaaccagatgaagtattcccctcgtcaagagaatggcagtgctgccattaaagcaccaagcgaggacatgaatgagttgacatctgaactccaagttgaggaaccaattgtagttggaacagaggaaattgcaagagttgcctcattgtggtcagggataccagtccagcagttaactgctgatgatagaaagcttctcgtaggactagatggtgaactcagaaagcgtgtgattggtcaagatgatgctgttatggcaatatctagagcggtgaagagatcacgtgttggcctcaatgatcctgacagacctattgccactctacttttctgtggtccgacaggagttggtaaaactgagcttactaaagctctagcagctagttattttggatcggaatctgctatgcttagattagacatgagcgagtatatggagaggcacactgtgagcaagctcataggctctcctccagggtacatcggatatggtgaaactggtactctgacagaagctgtcaggagaaagccatttactgtagtattacttgatgagatagagaaagctcaccctgatattttcaacattcttctccaaatttttgaagatgggcatctgtcggactcacagggccgcagagtgtccttcaagaacacattgattgtcatgacatcaaatattggttctacatcaatttcaaagggaagacgaagcatgggtttcatgacagaagatactgaatcaagctcatatgttgcaatgaaatctctagtaatggaagagttgaaggcatttttccgtccagaattgctcaacagaatcgatgagatggttgtattccgtcccttagagaaaactcagatgctagcaattcttgatatcatcctacaagaagtgaagggtaggctgttagcccttggaataggcctcgaggtgtccgatgcaatgaaggacctgatttgcgaagaaggctatgacaagagctacggtgcgcggccactgaggagagccgtcacccacctgattgaggatgtgatcagcgaagcaattctatttggcgaatacaagcctggggacacgatactgatggatattgatgccggggggaaactttgcatgagccacctgaatgagaaggttgtccagttgtctgatccgacacggacattctgataa

SEQ ID NO: 385 - DNA, 1040 bp, Oryza sativa
aggcataaagtgagagaccgtgattggatcgatcaccggagcgacgatcaatggcgacgctcaccgtgcccgccgccgtgccgcccgtcgccgaggactgcgagcagctgcgcaaggcgttcaaagggtggggcacgaacgagaagctcatcatctccatcctcgcccaccgcgacgcggcgcagcgccgggcgatccgccgcgcctacgccgaggcgtacggcgaggagctgctccgcgccctcaacgacgagatccacggcaaattcgagagggcggtgatccagtggacgctggacccggcggagcgggacgcggtgctggcgaacgaggaggcgaggaagtggcacccggggggccgcgcgctcgtcgagatcgcgtgcacgcgcactccatcgcagctcttcgctgcgaagcaggcgtaccacgagcgcttcaagaggtcgctcgaggaggacgtcgcggcgcacatcaccggcgactaccgtaagcttttggtgccacttgtgactgtatatcgctatgatgggccagaggtgaacacatcgttggcacattctgaagccaaaatactccatgagaagatccatgacaaggcttacagtgacgatgaaatcatcaggattctcaccacaaggagcaaagcacagttactagcaacattcaatagttacaatgatcagttcggccatccaatcactaaggatcttaaagctgatcctaaggacgagttccttggtacactaagggcgatcataagatgcttcacttgccctgacagatactttgagaaagtcattcgattggctctaggaggaatgggcacagacgagaactctcttacaaggatcataacaactcgtgccgaggtagacctgaagctgataaaggaggcctaccagaagagaaacagtgtcccattggagcgagctgttgctaaagatacaaccagagactacgaggatatactccttgccctccttggagcagagtgaggtgtatatctgctccatctcgtctgtctgatcctccttgtttag

SEQ ID NO: 386 - DNA, 1949 bp, Oryza sativa
agtcctaacccgaatccatttccaataatccatttcgccacgatttgttcttggttgtctgagagagagagagagagagatccgtatacattgctgctacttgaggtcaagcccgttcgttcgcgcgcgcgcgcctgtctgtctctgtttgattgattcttctacgtcgtcgacgtacgcctgttcatgatgtcgctcaacctggctcaccagaccggagcggcggccgccgtggcaccggcggcgccacgtacggccgtggtcgcggcggctgcgggtacagtgtctgctccggcggtcgcgccggcggcggcgccgagcctgcagctgcagacgcagactgtggacccggcggcgccggcgcaggggccggacctccccatggccttccaggcgctggtcgagagcctgccggaggagcagcacccggacgtgggcggcgaggagcggcgcaaggtgggcgtgccggtgtacgtgatgatgccgctggacacggtgcgcaaggacggcaacgggctgaaccggcggaaggcggtggaggcgtccctgaaggcgctgaagagcgccggcgccgaggggatcatggtggacgtgtggtggggcatcgccgagtgcgagggccccggccgctacaacttcaccgggtacatggagctcatggagatggccaagaagaacgggctcaaggtgcaggccgtcatgtcgttccaccagtgtggcggcaacgtcggcgactcagtcactataccacttccgaaatgggtgttggaggagatggacaaggaccaggacctggcctacacggatcggagcggccgccgcaactacgaatacctctcgctcggcgccgacgccatgccggtgctcaagggccgcacgccggtgcagtgctacggcgacttcatgcgcgccttccgcgaccacttcgccgccttcatgggcaacaccatagtcgagattcaagtcggcatgggtccggccggtgagctccgctacccgtcgtacccggagagcaatggcacctggagattccccggcatcggcgagttccagtgctatgacaggtacatgctgagcagtctcaaggcggcggcggaggcggtgggcaagccggagtggggcaacgccgggccgggagactccggcgggtacaacgactggccggaggactcgcccttcttccgccgtgaaggtgggtggaacactccctacggtgagtttttcatgagctggtactcgcagatgctcctggaacacggcgagcgcatcctgtcggcggcgtcgggcgtgtacaccggcacacccggcgtgaagatctccgtgaaggtggccggcatccactggcactacggcacgcggtcccacgccgcggagctgacggcagggtactacaacacgaggcaccacgacgggtaccagccgatcgcgcgcatgctggcccgccacggcgcggtgctcaacttcacgtgcgtggagatgcgcaaccacgagcagccgcaggacgcgcagtgccggcccgaggagctggtgcagcaggtggcggccgcggcgcgggagtccggcgtggggctcgccggcgagaacgcgctgccgaggtacgacgagacggcgcacgaccagatcgtgacgacggcggcggagaaggcggaggaggagcgcatggtagcgttcacctacctgcgcatggggcccgacctgttccagccggacaactggcgccgcttcgccgcgttcgtgaagcgcatgacggagtccggcgtgcgggacgtgtgccgcgagcaggtggagcgggaggcgcagggcgtcgcgcacgccaccgggtcgctcgtgcacgaggccgccgtcgcgctcagcaactgatcgatcagccgacctcgcgcgtagaagggtaaaaacgctttacatattttatactcccaagattatttgttgtaatcagcgtcgcgtac

SEQ ID NO: 387 - DNA, 1973 bp, Oryza sativa
acgccatgcgtgctcctgctgcacacttgtcccccgcctcctccgccgtgccgtcacgcaaccacggactcctcctccacctccgtttcctactctcttcttcagtttctcacctctccgcacgagaaaattcgaatcccccttccggctgctggttttcgtgccagaaacaggcgattttaccagtgccagttagctctcgccttcctcctcctccatcgtgctactactctgttcttctggaagaacactggtctcctcgcctacctcagtcaccactcaccacaccaggtgcgagctataaaaaccggcacgccaaaaatcttcaaaaccacacagaaacctcagatctccgaggcttcccaagcgagtcgacgaaaatgcccgtgatggctccgaccgcatctcttctcctctccccgaggccgctgccggcgagccgccgggtcccctcgctcccggcgctctcggcttccggtcgcctgcgcctccgccgcgcccgcgccgacacacggctccgcgtggcggcgccgccgtccgtccccggggaggcggaccaggcgcccggggagaccgagccgagcacgtcgtcggccgacgagaagttcgtgtggagggaccactggtaccccgtgtccctcgtcgaggacctcgaccccagcgtgcccaccccgttccagctcctcaaccgcgacctcgtcatctggaaggacccaaaatccggcgagtgggtcgccctcgacgaccgttgcccccatcgcctcgcgcccctctcggaggggcggatcgatgagacggggtgcttgcagtgctcataccacggctggtcattcgatggctccggcgcgtgcacccggatcccgcaggcggcgcccgaggggccggaggccaaggctgtgaggtcgccgaaggcgtgcgcgatcaagttccccaccctcgtctcgcaagggctgctcttcgtgtggcccgacgagaatgggtgggagaaggccacggctaccaagcctccgatgttaccgaaggagtttgaggatcctgcgttctccacggtgaccatccagagggatctgtactatggctatgatacattgatggagaacgtctctgatccgtcgcatatagaatttgctcaccacaaggtcactggtcgaagagatcgagccaggcctttgccattcaagatggaatcaagtggtgcatggggatattcagggtcaaattctggaaaccctcgcatcagtgcaacttttgtggccccttgctatgcactgaacaaaattgagatagacacaaagttacccatttttggagatcagaaatgggtcatatggatttgctctttcaacattccaatggccccagggaagactcgttctatagtttgtagtgctcggaactttttccagtttagcatgccaggaaaagcatggtggcagcttgtccctcgatggtatgagcattggacttcaaatttggtctatgatggtgatatgatagttctgcaagggcaagagaagattttcttgtctgcatcgaaggagtcttctgcagatattaatcagcagtacacaaagatcacgtttacacccacgcaggctgaccgttttgttttggcattccgggcatggctaaggaaatttggtaacagccaacctgactggtttggaaatcctagccaagaagtgttgccttccactgtcctttcaaagcgtgagatgctagatagatatgagcagcacacactgaaatgctcatcttgcaaaggggcatacaacgccttccagactctgcaaaaggtcttcatgggagcgacagtggcgttctgtgcaactgctgggattcctgcggatgttcagttcagattattgcttgccgctgctgctttggttagtgccgctgtagcgtacgcattttatacgctccagaagaattttgtatttgtagattacgtgcatgctgagattgattaataa

SEQ ID NO: 388 - DNA, 1201 bp, Oryza sativa
ccgtgactgagaacaagagaggccggcacagagagacgctctcggctagggcacggatcgtcgcgacgaaggaagatgtcgtactccagaggatcaagatatgagtccgactcatattctacatcgcccagacggagcagccgttcaaggtataggagtcgttctagaagtgtggactcaagtgatgttgaaaaccctgggaacaacctgtatgttactggcttatctgctcgtgtgacagatcgagatctggagaaacacttttctgctgagggagaggttattgatgctagcatagtacttgatccatggacaagggaatcccggggatttggatttgttaccatggctactgttaaggaggctgatctttgcatcaaatatctagaccgctcagtgttggaaggtcgtgtgataactgtagagaaggccaagagaagacgtggtcgaacaccaacgcccggaaggtatctaggcacaaaatcatcatgtgtgacaccagcacggaggtattccccaagctactcgcctgttgaaagagaccgctacagttcacgctactcacctgagcgagaacggtcttattctccttatggtagaaggcgatcatattctccatacaacaggcgaagatcatactccccctatgagaggcgtagatcctactctccacatgaaaggagacagtcctactctccgtatggcagatccccttctccttatggtagacggcgatcatactctccctatgacacacgtggttcacggcgtcggtcatactcatcttaccgtggttcccgctaccgttcaagatctccataccgttacagaagagagaggtcatgttcctatgaccattctgtttcaccatactatagaaggtgctattctccaagtgctagaggacggagctattctcgcagtgtatcacctcagaggagctactcccatagctgttccccggattctcagaggtcagggagctattctccaaggaaaagatacagtgaaaggaaaccgtcgcgcagcaggtcgtcgggtaagaggcattctagggagagctactctcacagccgcagttcctactcaaggtctgtctccagggagcgctcagaatgaattgaagcttgatgttctagagatcaataaagctctctatgcctaagtgtatgtctgtatctcgtgaagcttactttgcacc

SEQ ID NO: 389 - DNA, 1115 bp, Oryza sativa
gttacaatcagcacacgctctctgctagtctgatcgctctcgccatcgcacctctgtctcgtcgaacaatggcctccaccgccgccgcttcctcccctttcgactgcgtcctctttgacctcgacgacacgctgtacccgggaagcgcgggcatcgggctggcgacgaagcgcaacatcgacgagttcctcatggcacggtgcggcgtcacggcggagcgggccgccgcgctccgcgtcgagctcttccgctcctacggcagctcgctcgccggcctcatcgctctcggctatgacgtgcacccggatgagtaccacagctacgtgcacgggaggctgccctacgaccggatcgccgccgacccgcagctcgccggccttctgcggagcatcccgcagcgcaaaattctgttcaccaactctgatcgcgcgcacatgaggaaggcgctgcagcggctgagcgtcgacgagggctgcttcgacgccgtcgtgtgcttcgagaccatgaaccctcacctcttcggtgaggcgccgtgcgcctccggcgatgaccgccccggcgtgatcctcaaaccgtcccccgatgccatcgtcgcggctctgcgcatcgccggcaccaatccacaccggacgctcttcctcgacgacagcgagaggaacatcgccgcaggaaaagctcttagcctccgcaccgtcctggttggcaagagggtgaggagcaaggaggccgactacgctcttgagagcatcggcagcctccggcgagccatcccggagatttggggcggcgtcgccgtcgccgtcgccggcgaacagctcgaccacggcgccgcggagaagacgaagggaatgaggtccgatctggactccatcatccagccaacgtcagtcctggcgtaatcggttcctaatccattcgcacataaacaaatcgccactaataaaagcaagtactgtccattaattatcatgtaaattattctgattcctgatgctgagtgcgtgtgcagtgtatttgtatatgggcctggctgacaaggaaatatgcatgtgtatatcagttctgatgatcagcttttgtttgctgtaaaatgtaaatggcactatgagcaagga

SEQ ID NO: 390 - DNA, 619 bp, Oryza sativa
agggagtgagtgagcaatcgagatcgagatggaggtggcgagaggcggcgggaagctgaacccgtgggcggagcccttcgtgccggcgggctggtcggccacctactggcgctgcggcggcgtcgctgccgtggagccggctgtggccgaggtggaggacttctccccggagtggtggcgcctcgtcggctcctccccggccttccgcgaccgctggctccgggactactccgcgctgggcctcctcgacgacaacgacaacggcgacggctacgacctcgaggggttcctcctccccgacgacctcttctcctccacccctcatctggtgggagaaccggcggatgagaaggagggcaagggtttcggcggcgccggggggaagaaggtgaagggcgggtccgccgaggtggtggcgtggggcatcgacaagtggtggcgcgcgcactcctcgccgccggaggtgcccaggtacgccgacaaggcgcccaggagggtcgccgccgccgccgctagggtcaacccccgccccatccagcagccgcgctgagcgtccgtctccgccgccgcccgcgtaatcatccatccatccacccatcttgacaaacaagcagaatag

SEQ ID NO: 391 - DNA, 908 bp, Oryza sativa
agccagtgcaaatctgatcgatcaagataatcgagcaaaatccatcagagttctaacattcgcgcgtgaatttcgaggttaatttttgaagcttaggatcaatggcttcccaccaggaccaggctagctaccgcgccggcgagaccaaggcccacaccgaggagaaggcggggcaggtgatgggggcgagcaaggacaaggcgagcgaggcgaaggacagggcgtcggaggcggctgggcacgccgccggcaaggggcaggataccaaggaggcgacgaaggagaaggcgcaggcggcgaaggagagggcgtcggagacggcgcaggcggcgaaggacaagacctccagcacgtcgcaggcggcgagggacaaagccgccgagagcaaggaccagaccggcggcttcctcggcgagaagaccgagcaggccaagcagaaggccgccgagaccgctggcgccgccaagcagaagaccgccgagacggcgcagtacaccaaggactctgccatcgccggcaaggacaagaccggcagcgtcctccaacaggcgagtgagcaggtgaagagcacggtggtcggcgccaaggacgcggtgatgagcacgctggggatgaccgaagacgaggccggcaccgacgacggcgccaacaaggacacctctgccaccgccgccgccacggagacgacggcgagggatcactagacgccgtgaatgatttccttttgggtctatttatgtatgttttcacttcaaattcggtgcaagtttgaatttgtttttgtgtcgttttgagtctgtatcgatgctgtatgaagtggtggtcgtcgcaggggaggatttctgacgggtgtgggtgatgtgtactgatgatgttcagttgttttcgtcagagtttctcgtctgtgt

SEQ ID NO: 392 - DNA, 1700 bp, Oryza sativa
aaactcgagagatccgcccatgagtaggcccccacgcccaccgcctgctcgccatcgcgcctccactccaccacaccatgccgatccccaccacctctgacactactccgcccctccccctctctcattcccatggaggacctcgccctgcccgccgctcctcctgcccccacgcttagcttcacgctcttagccgccgccgccgccgtcgccgaggccatggaagaggctctgggcgccgcgctgccgcccctcaccgcccccgtccccgcccccggagacgactccgcctgcgggagcccgtgctccgtcgccagcgactgcagcagcgtcgccagcgccgacttcgagggcttcgccgagctaggcacttcgctcctcgcggggcccgccgtcttgttcgacgacctcaccgccgcctccgtcgccgtcgcggaggctgccgagccgagggctgtgggggccactgcgaggagcgtgttcgccatggactgcgttccgctctgggggctggagtccatttgcggccgccgcccggagatggaggacgactatgccgtggtcccgcgatttttcgaccttcctctgtggatggttgccggcgacgcggcagtcgacggcctcgaccgggcctccttccgccttccagcccatttcttcgccgtctacgatggccacggtggcgttcaggttgccaattactgcaggaagaggatccacgccgtactgacagaggagctgcgtagagcggaggacgacgcgtgtggctctgacttatctggccttgagtccaagaagctgtgggagaaggcgttcgtggattgcttcagtcgtgttgacgctgaggtgggaggaaatgctgcgtctggagcaccgcctgttgctccagacaccgtggggtcaactgctgtcgtcgcagtcgtttgctcgtcacatgtcatcgtagccaactgcggtgactcgcgtgctgttctctgccggggcaagcagcccctgcccctgtcactagatcataaaccaaatagggaagacgagtacgcgaggattgaggcgctgggtggcaaggttatccaatggaatggttatcgagttctcggtgttcttgccatgtcgcgatcaatcggggacaaatacctgaagccatatataatcccggtccctgaggtcacagttgtcgctcgtgcaaaagacgatgattgccttattcttgcaagtgatggcctttgggatgtaatgtcgaacgaagaggtctgtgatgctgctcgcaagaggatattactatggcacaagaagaatgcggccaccgcatcaacgtcatcggcccaaataagcggtgattcttcagatccggctgctcaagcagctgccgactacttgtccaagcttgccctacagaaggggagcaaggacaacatcactgtcgttgtaattgacctcaaggcacataggaagttcaagagcaaagcatgacattgcctccatgaacaataacaatagtttataggaagctagaaatgtgggaaatccaagacaatttatttagctgctgcaccggtacaatttgtttagctgctgttcagtactggtgctgctgcagctgcagctgcttctttgccctcgccatttatttctgccgagggatgtactactagtatactgtatttttctacacggtacagactcccaaatctgagctcttt

SEQ ID NO: 393 - DNA, 2165 bp, Oryza sativa
cgaggatgtccgtgccggcgattgccgtgtacaccagcccgccgggggcggtctacacgtcgtcgtcgtcgtcggagcttgaggcgagctcccggggctcggcgccgtgcgccaccgcggctcccccgtcgccggcgagctcccaccgccaccaggccatcgctggtgggctatcctgcctcttctcctcacctaccgccgcccctcgcgccgccgcggctcaggacgagctgggcgcgctctggcacgatagatccggcgaggcgacggccgtcggcggcgggggcgggggcgggggctactcctacccgcagccgtcgtcgccgttcaagtggcgggacatgctccaccacagccccgtgccgctgttccacagcccggcctcctcgccggcgtcacggagcccctcggcgtcctggctcgccggccgcgagcgcgagcggctcttctccagcttcgtgcgcaacgcgctcggctcctgcgtcgattacgcgccggtcgccgcgctgccgctcggcgtctcggctgctgtcggtgtcggtgccggcgagctcgcgttcgagctcgacgagcacctctccgaggcggagccgtcgtgcgagccgtacgctcgcgacctcctcgccggcgcccaggctcgccaccgcatcttccacgacgagctcgtcgtcaaggccttcttcgaggctgagagggcgcaccgaggccagacgcgggcgagtggtgatccgtacttgcagcattgtgtggagaccgccgtgcttctagccaagataggcgcaaacgcgaccgtcgtctctgccggactcctgcatgacaccattgatgatagcttcatggattatgatcagattttccggatgtttggtgccggcgtggctgatctagttgaaggggtctccaagttaagccacttgagcaaacttgctcgggacaacaatactgcaagcagaaccgttgaagcagaccgcctgcatacaatgtttcttgcaatggctgatgcaagagcagttctgataaagctagcagatcgtctacacaacatgaagacaatagaagctttgcctttggtcaaacaacaaagattcgctaaggagactatggagatatttgtgccgttggctaatcggttaggaatcgctagctggaaagaccagctggaaaatatttgctttaagcatttgaacccagaggagcacaaggagctttcctccaaacttgtcatatcttttgacgaagcacttcttacatctactctggataaacttgataaaggtctaagagatgaaggtatttcgtatcacagtctttctgggaggcacaagagcctgtacagcatatactccaagatgataaagaagaacttaacgatggatgatgttcatgacattcatggtctacgtcttgtggttgatacagagcaggattgttaccaagctcttgacattgtccataagctctggccccgagttgctggacgatttaaggactatatcctgcatccaaaattgaatgggtatcggtcattgcacactgtcatcatgtgtgagggcatacacccatttgaagttcagatccgaacaaaagaaatgcatctacaagcagagtatggatttgctgcacactggagatacaaggaaggtggttgcaagcactcttttgtactccaaatggtggaatgggcaagatgggtgctcacatggcaatgcgaagcaatgagcaaagagcggtcctcaggtttaggccgctctgatgccattaggccaccatgtccatttccctcgcattcggaggactgcccttattcttacactcgccagtgcaaccacgatggacccatctttgtgattatgcttgaacatgataagatgtctgtccaagagcttcctgcgaactcaactgtagtcgatctgatggagagagtgggggccaatagtccaagatgcagcccttacagcttcccactgaaagaggaattgcgcccgagggttaaccacaagcccataagtgaccctaaccggaaactgtgcatgggagatgtggtggagctgacgcctgcgctcccacacaagtcgctaactgagtatcgggaagagatccagcgcatgtatgaacgaggcgggtttgccctcgccaccacccgggacggtccggcaagctgataa

SEQ ID NO: 394 - DNA, 1085 bp, Oryza sativa
gtttgatgtcgatggcggaggtgtgctgtgattctgcggtggtggtcggggcggaggcggaggcgagggcgagggcgcgcgccgggaggcggcggcgggcgggagttgagggggcagggaggtggaacgccacggcgacggctgcgggtgtggcggcggaggaggccgcgacgaggaagcggagggcgagtggtggtgaggccgggttggtggtggtggcgaagcggcacggggcggcgtcggtcgccgggaggaggagggagatggaggacgccgtgtcgctgcgcgaggcgttcgccgcgccggcgaacggggaggttgcggcggcgaggtgtgacttctacggggtgttcgacgggcacggctgctcgcacgtggcggacgcgtgcagggagcggatgcacgagctcgtcgcggaggagatgggcgccgggtcaccggcggcggcggcgcgcgagccggcgtcttggacggagacgatggagcggagcttcgcgaggatggacgccgaggtgatcgccggctgccgagccgagagcggcagctgccggtgcgaggggcagaagtgcgaccacgtggggtccaccgcggtggtggccgtcgtggaggagagccgcgtcgtcgtcgccaactgcggcgactcccgcgccgtgctctgccgcggcggcgcgcccgtgcagctatcctccgaccacaagcccgaccgccccgacgagctggagcggatcgaggcggccggcggccgcgtcatcttctgggagggcgcccgtgtcctcggcgtcctcgccatgtcgcgctccatcggcgacgcctacctgaagccctacgtcaccgccgtgccggaggtgacggtgaccggcaggtcggacttcgacgagtgcctcatcctcgccagcgacggcctctgggacgtcgtcagcaacgaggccgcgtgcgaggtggcgcagtcgtgcctccgccgcggcaggcagcggtggtgcgccgaggcggcggcggtgctgaccaagctggccctcgctcgccgcagctccgacaacatctctgtcgtcgtcgtcgatctccggcgaggcaacgccttgtagtaa

SEQ ID NO: 395 - DNA, 614 bp, Oryza sativa
caccaccactccaccgatcggcgagagcgcggggagatcgttcgacggcggcaagatgcagatcttcgtgaagacgctgacggggaagacgatcacgctggaggtggagagcagcgacaccatcgacaacgtcaaggccaagatccaggacaaggaaggtatcccgccggaccagcagcgcctcatcttcgccgggaagcagctggatgacggccgcaccctggccgactacaacatccagaaggagtcgacgctgcacctggtgctccgcctccgcggcggcagcaggggcggctacaccatccaggagcccaccctccgggctcttgcgctcaagtacagagagaagaagaaggtctgccgcaagtgctatgcacgccttcccatcaggtctcaccactgccgcaagaagaagtgtggccacagcaaggagctgaggttgaagaagaagttcatcaactcgctttcgatagcgtgaggcactggaaagtgttcaccagctgaatcaatctcttggatctccgtgtgcgcagctaccatgttatgtccagtttagaagtactccgtagttgttaatctcttggaacttcgtatgcccagctaccatgttatgt

SEQ ID NO: 396 - DNA, 3335 bp, Oryza sativa
aaagtcgacaaattccgctcctaaaccctccctctcctctcactccggccgcgattctcccgccgccccggcgatggtcccgatctaagcatgtccgacgccgacggcttcggttgcgagcaccgccgaccctccaagcgccgccgcgacgggcccgatcatgccctcctcccggtgtcccgagaggtgctgatgggccaccccgatgaccccgccgccgccgccgccgccgtgggggcggaatcctcctcggcctcgtcatacctcggggttgtggcggccgccgcgtccgcctccgcctccgcggcggggggtttctcctgcggggcccacttcttcgtgcgggccaccgactcgaggaccgtgtcgatgcacgcggcgtggggggacaccgtgggcgccgtgctcgcgcacctcgccgaccgggggtacggccgcgacctccgcctcgtctacgccgggaggcagctcgcgccggagaccgccctcgccgacctccgcctcccgccggactccacgctgcacctcctctcccgcctccgctccaccccctacccggacgcgtggcagctcgcttcctacatcgcctccaccgccgccgccgccaagtccgaccccgcccacaccagctccgccgccaacatcaacgagctcgtcaaggagttcatcctctgcgcgcaccgagccaacatgcggcagcgccatgatcgcgactcccccctcttcgatgcccaacccacgggggaccacgcggcgcagtacctcgagattttccgccaggcgggcgcccccttcgcgctggttcgcctctacgccgctaatccctcctccgcctcccaccatcacgcggagaacgccatcaaatgcttcctcaccatggatccttcggccttgccacccgacgtgctgccggtcatggcgccggtgctgcttgaattttgcgggttgctctctttttctgtgggcaagagggatgaactctatatatcatcccgttctatgcttgcaacagtgctcagcttgccttctgggcttcccccttgcatcaagtcaccttccaagctgatcgagcaggtccttccgtttgctgaagaaatagtgggagtggttatggacgaacttgcatcactggatatgactgtgtcatccaaaaaccttgaagacctctcaaatttctttaaagtgctgcgccagcaggcactccgttgggttcccaatggggggccattgcccaagaatctgtataacagtgagcgtgggcataatgacacgtgggtgtggaagttgcacgaaatgtcaatgaacttattgaacagggtggatgagtgcttgaagaggttggaaatggatctgtccttgtcatcggagaacagaggggtcaatataagtcaatctcgatgggttgcccggtcacatatgctggtcatgctgacacaactagattttatatcgatgatttatgaggatttggcacataacctacggcttgtgttgctggcacacagagatcctctcaatgccctcgtgcgctgttccaagaggaatgagcatctccactggcttgtgaagcataaagacctcctttgctttgaatcaagaaggaatttagtcttgatgatgctacctgagggaaaggatgaatacggggagcttcatgagatgttgattgatcggcaacacttattggacgagtcctttgaatacattatacaggccagacccagtgagcttcgcagtgggctatttatggagtttaagaatgaggaagcgacaggccctggagttctgagggaatggttctgcatggtgtgtcaagctcttttcagcccgcagcaagttctcttctcgccttgtcctagtgatcgacagaggttcttcttgaacggaacatctgctgtggatccactgcacctgaaatacttcatattttcaggacgaataattggattagcattgatgcatagagttcaagtagggatcacattggaccgcacattattcttgcatcttgctgggagaagtattaaattggaagatatttctgctgcagaccctgtcatgtatgcaagctgtaaaagaattttagagatggatgctgctgttgttgatggtcttgaactaacattttcccgagatgttcatgaattagggtctcgaaggactattgagctttgctcaggagggaaggatctccatgtaaatatcaggaacagagagctttatattgaccttcttattaagagtaccttcgtggattccatatcagttcagttaacccatttcgtgcgcggatttagtgacattctagttgatccggaactccagaaagtattttttgagtttttggatctagaagacttcgacggaatgctagggggaagcaacaaaactataaatctggaagattggaaattacatactcaatataacggctacaaagaaaaagatcgccagattatctggttctggaaggctgttgagagcttgtcaattgagcaacagaggcagctgctgttcttttggacttcagttaaatatttaccctcagatggttttggtgggctggcctcaaaactgtacatatataaggtatctgagtcagctgaccgtctcccatcgtcacatacctgcttttaccggctctgcctgcctgcttatccatccttgaaagtgacgagaaaccagctgcagaagatcacacaagagcatgtgagctgtagctttggcacatggtagatgccgcccttatggtaatccaatatggtaaattctgtacatacccaagttagtgtcgatttacctgcctcaattgaagctagaaattaaaagcaataggctatcttttgtttgttttgtacatatttaaagtgttctgggccatttaatctagttaggcataatcagaagagagcaggttcctttcattctccctcttttgaaccaggcttccatttttcatatactttctggagaagtgtggtgggagcatttgcatcgtgctatgctcacaagctctggaagccagttaaggcttaaaccatgtcataaaggtaattgcaacgtgtagtagccatgtggcttggtgttcctggtggagctgaaattctgcatagagtcgagtagagttaaagtgatcatctgtttgtgaatctggacaaaatcggtcactgaaactttgaaggtatgcgactctgctaatgtgaagttaaaactcggatatgctttgctgtttagtaccagcaggcagcagaaattttctgggaatcagccagaaaccggtgtctcagcagctgacaagtgatatggaccatactctgcctgaacatgatatcttt

SEQ ID NO: 397 - DNA, 1555 bp, Oryza sativa
cagcaagaacgaagctaaggacagggaacagtgactgcttgttgaactaagctacaacaatcatgggcctcctggagctctttattacagcatgtgtgccggttctgaacatgcttctggttactggtgttggatcattcctggcaactgattttgttggcatactgaacaaagatgcacggaaatatctaaacaatatagtattttatgtatttaatccatctcttgttgcgacctatttagcacaaacaatcacattggaaggcttggctaaattgtggttcatgcctgtgaatattcttcttgcttgtacctttgggttaatccttggatggatcgtggtacatgtcaccagagcaccggctaggctaagaggcctcattttgggttgctgttctgctggcaattggggcaatatttttctcatcatcattcctgctctttgcaaagagaaaggaagcccgtttggagcacctgatgtttgtcacacttatggattagcgtattcttcactctcaatggctcttggtgctgtctttctgtggactgtcgcgtataacattatgcgagccacttcaaaagtggctgatgaaggtaatgctcgaacaaatgatacaaaagtatccaattcagggagcagtacaggaacagcgtcagaagagaatttatcaatcccaaacgataacaatcaatgcacactccctttgatatccaattcaagtgtaccttcaagcaaaactaaggtcacattgtcagagagagcgaagcgatttgtatcatcaatgttcggagcaattgacttcaagaagatctttgctccttcaaccattgctgtgattattgggtttataattggaggaacgcctctaattagaaatgctattatcggagaaaacgctcctcttcgtgtcattcatgagtcagctgatctaataggtggaggagcaattccatctgtcacactgataatgggagggaacctcctcaatggattacgaggagaagcaagcgtccagccttcagtgatagctagcgtaatcgtcgtcagatacattcttctcccttcgctaggcaccttgctcgtcaaatcggcggttcacctgggcctcatccaccctgatcccctctaccagttcatcctattgcttcagtacgccgtgccgccggcgatgaacattgggaccatcacgcagctgttcggcgtgggggagagcgagtgctccgtcatcttcgtgtgggtgtacgccctcgcctccgtcgcggtgacggtgtggtcggcgttcttcatgtggacgctgtcgtgatagatcgatcgatcgatcggacgccgcgtgccggcgtgaggaggtttcagggggttcagagacgacgacggcgagacgtacggtgcgttcctccggcgagacaggatgaagcgaccgggcaagatgacgccggcgagagggcggcgcggctgctgctgcatcgcatttgcgtcgctggagaagatgcaacgcgacatctagctaaggcaattcatggcgttcgtgttcgttgtctcattccgagcaaataa

SEQ ID NO: 398 - DNA, 1295 bp, Oryza sativa
agatctccggttggaagttagggtgttcatcttgacacaaaatcatgccgaaatcaaactgtaccgaagcgaaaataagatatggattagctctccttccaattgatttatcgttctgtcaatattgatccgaatacgaaaattttaagtgctgttattttgaaggtttcggaaccggaattcggaattgcagtagcagtggatgcctttataaatcaagttcttgtccttggcttcaaatactcgatgtgtttcttggctaatcctaatccctagctgcttgtgtgttgcgtgtgcaatttctgacccttttgtggtggtgtatatcaacagagaaatctctagctttttcagcggcgaagcgaatccatggccgagcacctcgcttccatctttggcacggagaaggaccgcgtgaactgccccttctacttcaagatcggcgcgtgccgccatggcgaccgatgctcccgcctgcacaacaagccgtcggtctcgccgacgctgctgctctccaacatgtacctgcgtccggacatgatcacccctggaattgatgctcagggcaaccccatcgaccctgagaagatccaggccgacttcgaggatttctacgaggacatctttgaggaactcagcaagtacggcgagatcgagagcctccacgtgtgtgacaacttcgccgaccacatgatcggcaatgtgtatgttcaattcagggaggaggatcaggccgccagagcgctgcaggcgctgacggggcggtactactccggccgtcctatcattgtcgagttctcgccggtgtccgatttccgggaggccacctgccggcaatatgaagagaacagctgcaaccgtggtgggtactgcaacttcatgcacgtcaaggagatcggcagagacctgaggaagaggttgtttgggcacctgcataggtcccggagaagccatagccatggccggagccgcagcccgagcccgtaccattaccggagggactatgatcggaggagctcatcgcggtccagggaccacgacgattactaccgtggaggtagccacgattactaccgtggaggtagccggaggagcagcgagaggcaccgcagcagctacgacagcgatggcagcaggcggcggcacaggtccaggactaggagtcctgtcagggatggtagcgaggagaggagagctcaaattgagcagtggaaccgtgaaagggaggctgcacaagtgtgatctctggattagttgctgtttgcaatggcccatgtttctcatcttgtactggt

SEQ ID NO: 399 - DNA, 1016 bp, Oryza sativa
aaggcatgccgatcccggaaaaggacggggtggaggacaatcaagaggatgatacattttcaaggttgcaattgcttgcacaacaacgacatgccatggagaagttctggaggatgagccaggaacagatcgaagaatccgcaggcaacgaagagcttatactgccgatttcccgtgtcaagaatatcatccatgcaaaggagggtggtatgatgttatctgctgataccccagcttttgtaacaaaactttgtgaacttttcgtccaggagctcatccttcgtgcttgggtgtgcgccaactcacacaatcgtgaaatcatacttggcacagatattgctgaggcaatcaccaccacagaatcctatcactttcttgctaatgtagtccatggccaccaggcgctaggaagcaacataccagagataggggtttctgcttggaagcgccataagctagatgaaatgacctcactctgccatcctccccaagcagtgcaggtcacagatttagctaaccatccacccaatattcctgtttgtcctcctataggtcaatcgggtactcagcacacaacatctacacatgttttgatgatgcaaggagaatctattcacaaggcaagtaaagaaaaatccccactgaaggaagtgatggtgccgaccaacaaggtgggcatgaccaacagctcttatggagttcctaatggtggtggtgctactagtagtaaagttgttattgatagcccgaaaggcgaaacagcacaagttttctcttcccagcatgcatgtccttccctagaagataactatgttattcccattcctgctggacatggtgatagttttcgtactcttgatgaggccaatataccccagctacatcaggagcagaaaaactttatttcacaagatgctattgttggtgaaaacattccgctgaatgagtctttggaaaagagcaagcataaggatgaggacttactttttcctgacaaagatcttcctgagtgatga

SEQ ID NO: 400 - DNA, 1581 bp, Oryza sativa
cattggaggaggagatctctccctctcatcatcatcatcatcctcctcctccctatccccttctcccccctctctctctctctccaccccgcgcggcggccgcttccgatccctctccgaccgaccaagcgccgtctccaagaatggggagctcggagaagaacggaactgcttatggcgagtacacctatgctgaactggagagggagcagtactggccgtctgagaagctgaggatatcgatcaccggagctggtggtttcattggatcccacattgctcgccgtctgaagagcgaggggcattacatcatcgcctccgactggaagaagaatgagcacatgactgaggacatgttctgccatgagttccaccttgttgaccttagggtcatggacaactgcctcaaggtcaccaacggcgtcgaccatgtgttcaaccttgccgctgatatgggtggtatggggttcattcagtccaaccactctgtgatcatgtacaacaacaccatgatcagtttcaacatgctcgaggctgcacgtatcaatggtgtgaagaggttcttctatgcctcaagtgcatgcatttaccctgaattcaagcagcttgaaactaacgttagcctgaaggaatctgatgcctggcctgctgagcctcaagatgcctatggtttggagaagcttgcaactgaggagctctgcaagcactacaccaaggactttggcattgagtgccgtgttggccgcttccacaacatatatggcccctttggaacatggaaaggtggccgtgagaaggcaccagctgcattctgcaggaaggctcagacttccactgacaggtttgagatgtggggtgatggcctccagacccggtccttcacattcatagatgagtgtgttgagggtgttctgaggttgacaaagtcggacttccgtgagccagtgaacattggaagcgatgaaatggtaagcatgaacgagatggctgaaatcattctcagcttcgaggatagggagctgcccatccaccacatccctggacccgagggtgtccgtggccgtaactccgacaacaccctcatcaaggagaagcttggctgggcacccacaatgaagctcaaggacgggctgaggttcacctacttctggatcaaggagcagatagagaaggagaagacccagggcgtcgacatcgcgggttacggctcatccaaggtggtgtccacccaggccccggttcagctgggctccctccgtgctgccgatggcaaggagtaatttcaaagctgctacaccatgaagatcaatcagctcctctcagcttgatcgtggccataccttacttcgctacagatagctcacagaaatgaattcttcttggaaatcttgcaacctttcagaacaacaacagccgttcttcctgtcgttataactcatatgcagtacaccggtttcttgtgtttaaaaagctatactcgagatttcttcctcttttttttttcgcgtcgtgttggaaattcttcgtatggattacattttgtcatatgaacaatgaaacaatgggaatgctctgcattac

SEQ ID NO: 401 - DNA, 1341 bp, Oryza sativa
tcgtagcggcgaaggatatagccatatattatagatggcgattggtgttggtggctgctgcgccgtgctgctcgcggcggcgctgctcttctcctctccggccaccacatatgcttatgattccctggatccaaacggcaacatcacgataaaatgggatgtgatgcaatggactcctgatggctatgctgccgttgtcacactgtccaactaccagcaattccggcacatccagccaccggggtggcagctggggtggacatggcagcagaaggaggtgatctggtccatgtacggcgcgcaggccatcgagcagggcgactgctccatgtccaaggagggcagcaatgtcccccacagctgcaagaagcatcccaccgtcgtcgacctcctcccgggcgccccaatcgacctgcagatcgccaactgctgcaaggctggatcactgagcgcattcagccaggacccggcaaattctgccgcgtcgtttcagatcattgtaggccattctgggaacagcaatgagactgttagggtgccgaagaacttcagtcttatggcgcctggtccggggtatacctgtagccgtgctatgattgtgaagcctagtaggtttttaagtccggatgggaggagggcgactcaagttctgatgacatggaatgtgatctgcacatactcccaatttcttgcacaaaaggttccatcctgctgtgtttctctctcgtcgttcgacaatgacaaaactgttgactgcccaacatgctcttgtggctgccgaaatgaaaaatctactacaggaaaatgtgtaaagaagaatgcacctgatttgcaatccatcattcacggccctggcagatggacctggcagcctcttctccagtgcacttcacacatgtgcccagtgaaaattaactggcacttgatgctcaaagacaaggaacactacagagtgaaaatcactgtcactaacttgaactaccgcatgaatttcaccgaatggaacctggttgttcagtatcatcccatcctcgatatcacccagatatctggcttcaattacaagtcaatccaagtcggcaaaataaatgatactacgatgctatggggagtaaagccctactatgatttgctcatgcaagctggtccgcttggaaatgtgcaaggagaactgattgtgagaaaggatttcagggcttcttccactactaacaataacaagggaagggccttcccagtccgtgtgtacttcaacggtgataactgtgtgatgccgcctccggatgcatatccagttagtattacggcttagaggcgatcgtcaagatgattgtatcgcat

SEQ ID NO: 402 - DNA, 598 bp, Oryza sativa
gtcgcgagccttactgaaacttctgatccctccgaaaccgagaaaagaggggaatctgtgaagagattttagcagcagtgcaatggaggtatttggaaaatccgtgattgctgagcccagcaatgtgatttacttgtccagtattcttaacacagaagggccaatccctagtcacaagtgtgacaagaattgccagaacgagcacgtctttggcaacatgtaccgttgcaaactgaccgggaccacgcacatctgcgacaaaaactgtaaccagaggatcctctacgacaaccacagctcactctgccgggtcagcgggcagctgttcccgctctcgccgctggagcagcaggcggtgagggggatccggaggaagcatgaggtcgacagcaacgaagggtgctcctttaagcgcaggcgaggtgcacaactgcatccatcccctttcgagaggtcctacaccgctgtgtctccaatcccaagccaagttggagacggcatggacctgagctagagataacgagaatccgtcttttcttgcccacagctggctaatgccgttgtttcgacccctttctccctttgacaggatggaact

SEQ ID NO: 403 - DNA, 1403 bp, Oryza sativa
cccaaatggcccacgtcatggccgcctccgagctcgtcaccgccaccatcaagcgccccttccagaacgacgacgacaacagcagcaacggcaacggcaacgccgacgggaagcccaaggcgcggcgccgggaggccgacccggcggcggcgctggccgcggcgcgccacgagttcggcgagcacggcggggtgaacatgtccatcgaggcgtcggcgacgttcacggtgatggagccggacaccatgcgccgcctcttctccggggagctcggcccggagcgcggcgacctgtacatctacagccgccacttcaacccgacggtgctggcgctggggcggcagatggcggcgctggagggcaccgaggccgcgtactgcacggcgtccgggatgtccgccatctcctccgtgctgatgcagctcgtcggcgcgggggggcacgtggtggcgtcgcggtgcctgtacggcggcacgcacgcgctgctgtcccggttcctgccgcgcgcgtccggggtgcgcgcaacgttcgtggacgctgacgacgaggcggcggtgcgcgccgcggtgcgcccgggggagacgcgggtggtgtacgtggagacgatgtcgaacccgacgctggccgtggccgacatcccgatgctggcccgcgtcgcgcacgacgccggcgccaagctggtggtggacaacacgttcacgcccatggtcgtctcgccggcccgcctcggcgccgacgtcgtcgtccacagcgtctccaagttcatcagcggcggcgccgacatcatcgcaggggcgatctgtgggccggcgagcctggtgaacgcgatgatggacctgcaggagggggccctgatgctgctgggcccgacgatgaacgccaaggtggccttcgagctctcggagcgcctcccgcacctcccgctccggatgcaggagcactcgcggcgcgccgccgagtacgcgtcccggatgcgccgcctcggcctccgcgtcgcctacccgggcctccccgaccacccgcaccacgcccgcctcctcgccatcgccaacccgggctacggcgccggcggcatgctctgcgtcgacatgggcaccgaggaccgcgccaaccgcctcatgcaccacctccagaacaccacccgcttcggcctcatggccgtcagcctcggctactacgagaccctcatgtcgtgctccggcagcagcaccagcagcgagatgccgcccgaggaccgcgctcgcgccggcatctcccccggcctcgtccgcatgtccgtcgggtacaacggcacgctcgagcagcggtgggcgcagttcgagcgcgcgctctcgctcatgcagcagcagcagcagcagcatcccgaccgcgacgccgccgccaagtactgcaaggtgtgataa

SEQ ID NO: 404 - DNA, 958 bp, Oryza sativa
tgcaagctcctgtctctcctacaaggtttcaaaaccaaaatatgcctgaagcacacggaaagctggggtgattaacgtctgtttcttttgactacaatcatcctgattctgcttctgtctgcaaaaacaaccaagccatgacgtctgtagttcatgatgtttcaggcaaccatggagctgatgagcggcaaaaacagcaaaggcaaggtgaacctgaggaccagcaagaagcctcagttactagtacagatagccatacaatggtagcaacaccttcaacagattatgcgacaccctatgcccatcacgatatggcccatgcaatgggccaaattgcttacgcaaatattgatccatattacggaagcctttatgcagcttatggtggacagcctatgatgcatccaccattggtcgggatgcatccagctggactaccactgcctaccgatgcaattgaagagcctgtctatgttaatgcaaaacagtacaatgccatattaaggcgtcgacaatctcgagccaaagctgagtctgaaaagaagcttgtcaagggccgtaagccatatctccatgagtcacggcatcaacatgccctgaaaagggctaggggagctggaggccgatttcttaattcaaaatcggatgacaaggaagagcattctgattccagttccagagataaacaggatggagttgcaccccgtgatagtggccaaccgtctacctctccgtcttcaaagggtgcatcatcagctaaacaaaataagaagtcaaaaaccagtaactaaacgggatttaagcacctggtgtgaaacatggaaacagttttgtacagtacatgctagtgatcgacaaagaatggtgtcattgggtgttgtaggataatgctccatagagaatatatagacagggcaacagattttgcagcctttggttcggtctgctcagtttcttt

SEQ ID NO: 405 - DNA, 2905 bp, Sorghum bicolor
cgttgtagtagattgtgaggagtagcaaagcgcagcagccatgaatccggacaacttcacccacaagacgaacgaggcgctggtggcggcgcacgagatggcgtcggaggccggccacgcgcagctcacgccgctgcatctggccgcggcgctggcggcggacaagggcggcatcctgcggcaggccatcacgggggcgtcggggggcgacggagcggccggggagtcgttcgagcgcgtgctgagcaacgcgctcaagaagctgccgtcgcagtccccgccgccggactccgtcccggcgtccacggcgctgatcaaggtcatccgccgcgcgcagtccgcgcagaagaagcgcggggactcgcacctcgccgtcgaccagctgctgctcggcctggtcgaggactcgcagatctccgactgcctcaaggaggccggcgtgtccgcggcgcgggtgcgcgccgagctcgagaagctccgcggcggcgaggggcgccgcgtggagtccgcgtccggcgacaccaacttccaggcgctcaagacgtacggccgcgacctcgtcgagcaggccgggaagctggaccccgtcatcggccgcgacgaggagatccgccgcgtggtgcgcatcctctcgcgccgcaccaagaacaaccccgtcctcatcggtgagcccggcgtcggcaagacggccgtcgtggaggggctcgcgcagcgcatcgttcgcggcgacgtgcccagcaacctcctcgacgtgcgcctcatcgcgctcgacatgggcgcgctcgtcgcgggcgccaagtaccgcggcgagttcgaggagcggctcaagtccgtgctcaaggaggtggaggaggccgaggggaaggtcattctcttcatcgacgagatacacctcgtcctgggcgcgggcaggacggagggttccatggacgcggccaacctgttcaagccgatgcttgcgaggggacagctccggtgcatcggcgccaccacgctggaggagtaccgcaagtacgtggagaaggacgcggcgttcgagcggcggttccagcaggtgttcgtcgcagagccgagcgtgcccgacaccatcagcattctcagggggctcaaggagaagtacgagggccaccatggtgtgaggatccaggaccgcgccctcgtcgtcgccgcgcagctctccgcgaggtacatcatgggtcggcacctgcctgataaagccattgacttggtggacgaggcctgcgccaatgtgagggtgcagctcgacagccagccggaggagattgataacctggagaggaagagaattcagcttgaagtcgagctccacgcgctcgagaaggagaaggacaaggccagcaaagcccgcctggttgaggtcaagaaggaattggacgatctgagagacaagctgcagcccctgaccatgaagtacaggaaggagaaggagaggatcgatgagatcaggaagctgaagcagcgccgcgaggagctgcagttcagcctgcaggaggccgagcgccggatggacctggctcgtgtggccgacctcaagtacggcgcccttcaggagatcgacgccgcgatctccaagctggagagcgaaactggggagaacctgatgctcactgaaaccgtcggccctgaacaaattgcagaggtggtgagccggtggacgggtattccggtgacccggcttggccagaacgacaaggagaggctggtcggcctggctgacaggcttcaccagagggtggtcggccagacggaggccgtgaacgccgtcgcggaggcggtgctgaggtcaagggccggtcttggcaggccacagcaacccaccggctccttcctcttcctgggtccgaccggtgtaggcaagaccgagctggccaaggctcttgccgagcagctgttcgacgacgagaacctgcttgtccgcatcgacatgtccgagtacatggagcagcactcggttgctcgcctcatcggagcaccacctggctacgtcggccatgaggagggtggacagctgactgaacaggtgaggaggaggccgtacagcgtgatcctcttcgacgaggtggagaaggcccatgtcgccgtgttcaacaccctgcttcaggtcctcgacgacggcaggctgacggacgggcaaggcaggacggtggacttcaggaacaccgtgatcatcatgacatccaacctcggcgccgagcacctcctcgccgggatggtgggcaagaactccatgaaggtcgctcgcgatctggtcatgcaggaggtgaggaggcacttccgccctgagctgctgaaccggctcgacgagatcgtgatcttcgaccctctgtcccacgagcagctgaggaaggtggctcgccttcagatgaaggacgtggccgtccgccttgccgagaggggcatcgctctggccgtcaccgacgccgcactggacatcatcttgtctctctcttacgatccggtgtacggcgcgcggccgatcaggaggtggatcgagaagagggtggtgacgcagctgtcgaagatgctgatccaggaggagatcgacgagaactgcacggtgtacatcgacgccgcgccggccaaggacgagctggcctacagggtggaccggagcggcgggctggtgaacgcggagacggggttgaagtcggacatcctgatccaggtccccaacgacgccgtcaggagcgacgccgcgcaggccgtcaagaagatgaggatcatggaggaggaggacgaggacggcatggacgaggagtgagcgagagcagcgtgcaggtcgccggccggaggacgcggacatgcgacccggccctggttcggtggcgtcatcgtccagtgtcttctgaaatctgaataagcgtgtagataagtcgtgaacgtg

SEQ ID NO: 406 - DNA, 420 bp, Sorghum bicolor
accgcaaccggaaaatccccaatcccctcggcttcgcggcgaacatgtcggggcgcggcaagggcggcaagggcctgggcaagggcggcgcgaagcgtcaccggaaggtgctccgcgacaacatccaggggatcacgaagccggcgatccggaggctggcgaggaggggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggcttcggcggctaggccggccacgtctcgctgtcgctgtggatctagtgttgctccagttcgcaagttgtcagttgtg

SEQ ID NO: 407 - DNA, 591 bp, Sorghum bicolor
tcgcatccacagcctctcgagctcgaagcgccgcagcagcaccagcccagcagccatggacgtgagcggagccggatccggcgggaaggcgaagaagggcgcgggcgggcggaagaccggcggcgggccgaggaagaagtcggtgacgcggtccgtcaaggccgggctgcagttccccgtcggccgcatcgggcggtacctgaagaaggggcggtacgcgcagcgcgtgggcacgggcgccccggtctacctcgccgccgtcctcgagtacctcgccgccgaggtgctggagctggccgggaacgcggccagggacaacaagaagacccgcatcatcccgcgccacgtgctcctggccatccgcaacgacgaggagctcggcaagctgctggccggcgtcaccatcgcccacggcggcgtcctccccaacatccacagtgtgctcctgcccaagaaggtcgccgagaaggccgcggccgcggccaaggagcccaagtcgcccaagaaggccgccaagtcccccaagaaggcatagaggggcctccatggagatgttcagtagatctgtagtaggtctgtagatggcacggt

SEQ ID NO: 408 - DNA, 2405 bp, Sorghum bicolor
gtcatcccagtccacgcccacgccaacgcacccgcatccctctctcgcctccgccgcaacgatgtcgggctgggacgagggcgccgtgttctatagcgaccaggcgcagttcccccgcggcggccccggcggcgacccagccgccgacctcacccgccactccgccctccgcaagttcaaggagttcctcagaggcttcaccggccccaccggcgacttcccctaccgtgagagcctagtacacaaccgcgaccatgtcaccgtcgccatcgaggacctcgacgccttcgatgccgagctctctgacaggatccgcaagtcgccggccgattatcttccgctgtttgagacggctgcggccgaggttctcgcaagcctccgttcgaaggtcgccggcgagaccggggagatggaggagcccgtcacgggagatgtccagatcttcctctcctccaaggagaactgcctgtccatgagatctgttggggctgattacatgtcgaagctggttaagattgcgggaatcacaattgctgcatcgagagtaaaagccaaggccactcatgtaactcttatctgcaagaattgccggagtgtgaggacagtgccttgcaggccaggcctcggcggggctattgttccacgttcttgtgaccatgttcctcagcctggagaagagccctgccccctggacccttggattgccgtcccggataagagcaagtatgtggatctccagaccctcaaactgcaggagaatcctgaggatgttccaactggtgagcttccaaggaatgtgcttctttctgtagataggcacctagttcagactattgttccagggactagattaactgttgttggcatctacagcgtctaccaagcatccgcaacccagaagggcgctgttggtgttaaacagccttacattagagttgtgggtttggagcaatctcgagacaataactcaaatggcccctcaaacttcactctcgatgaggaaatggaattcaaagaatttgcacagagaccagatgcatatgccaagctttgctcaatgattggtccttcaatttatggtcattctgatgtcaagaaagctattgcatgcttgttatttgggggatctaagaagaggctacctgatggtgtacgtttgagaggggatattcatgtcttgcttctgggtgatccatccacagcaaaatcacagttcctcaaatttgtagagaagactgcacctattgcagtctatacatctggcaaaggatcatctgcagctggtcttacagcatctgtaactcgggatggtagctcgcgtgagttttatttggaaggaggagccatggtactggctgatggtggagtagtctgtatcgatgaatttgacaagatgagacctgaagacagagttgcaattcatgaggccatggagcagcagacaatatctattgccaaagctggcattacaacagttctcaattcaaggacttcagttcttgcagctgccaatccaattgcaggacgctatgatgatcttaagactgcacaagataatattgatctgcagacgaccattctttctagatttgatctaatctttatcgtcaaagatatcagaatgtatgatcaagataagcgaatagcaagccacattatcaaggtgcatgccagtggtgctgcagcttcttccacaggcacagaggcaagtgatggagagaattggctgaaaaggtacattgagtactgccgtgccacatgcagaccacggctttcagaaaaagcagctgagatgctgcagaacaaatatattgagattagacagaaaatgaggcagcaagctcatgagacagggagggcagcagcgatacccatcactgtgaggcagcttgaagccatcatacgtttgagtgaatctcttgcaaagatgagattgacaagtgtggctacaccagaacatgtcgaagaggcattcagactgtttaatgtctccaccgttgatgctgcaagatccggaatcaacgagcatttgaacctgtcaccggagattgctaatgaaatcaagcaagcggaagcacaaataaagagaagaatgggcattggaagccacatatctgagcgacggctgattgatgaactaaataggatgggaatgaatgaatccattgtcagaagagcccttctgatcatgcatcaaagagatgaggtggagtacaagcgagagcgccacgtgattgtccgaaaggcttgaggtgcagagtccagtcagattcatgggtggcagacaacataaattgaaggcgtccttcctcttcagacgtgtgtataccttcactgaaactgcacctctgtccagaggacgaggcacgccttagttgatctctgacatgactgttgtaacctgc

SEQ ID NO: 409 - DNA, 1638 bp, Sorghum bicolor
tcttcctcccattagcagcagcagcgtcgaccagcagagcacaagccggcagcgattgagcgagggaggaacacgatgagcggcggcggtcaggatctgcagctgccgccggggttccggttccacccgacggacgaggagctggtgatgcactacctctgccgccgctgcgccggcctgcccatcgccgtccccatcatcgccgagatcgacctctacaagttcgacccatggcagctccccaggatggcgctgtacggcgagaaggagtggtacttcttctccccgcgggaccgcaagtacccgaacgggtcgaggccgaaccgcgccgccgggtccggctactggaaggccaccggcgccgacaagcccgtgggcacgcccaagccgctcgccatcaagaaggcgctcgtcttctacgccggcaaggcgcccaagggcgagaagaccaactggatcatgcacgagtaccgcctcgccgacgtcgaccgctccgcccgcaagaagaacagcctcaggttggatgactgggtcctgtgccgcatctacaacaagaagggcgggctggagaagccggcggcggtcgccggcggcgaccacaagccgatgttcgccgcggccgcggtgagctccccgccggagcagaagccgttcgtggcggcgccgggcgggcttcccccattcccggacctggcggcgtactacgaccggccgtcggactcgatgccgcggctgcacgcggactccagctgctcggagcaggtgctgtcgccggagcagctggcgtgcgaccgggaggtgcagagccagcccaagatcagcgagtgggagcgcaccttcgcctccgaccccgtcaaccccgccggctccatgctcgaccccgtcgtcggtggccacgccggcgacccgctgctgcaggacatcctcatgtactggggcaagccgttctagacgaagacgacgacgcgatcgaaggtcatcaatcaaaggggggaatttatttaaaaaaaaaagaaggcgctgcggttggttggttgatctgtcttgggcagcgcaatgcaatgcgacgcaaccgctcggtgtgggcttgactcaggcgagccgccattgttgacctcgttgaggaggagataggttatgaaactatagctggattggataaggcggcaatgagaccgtgtggccccgccggaagggagggagacggacggatggcacagtgcattgggtggtcgatcgtgcgcggcatgtgtgtgtgtgtgttcttgtacatatacatacagtacatgattggttcagtgcagggtttctgttccttcattggttagtagtaattctattttataaggtcctgtagttgcaatctccaatgggggtaggtagtgcaggctatatagatactccatttgtcatcgtcaagcttcgagtagcacagagtatattgtagctgttggctctttgaaaaaactgaaacgggaattatgttatttcgatcattttgctggtcgcgtctgaagaagtgctgttcgtctgtattcaactatcatgttcgcttggctgcctgaaaggcttgcagcggtgctgtatgctggagttgtgcttatggacgaagaaacgtttgtgaaccacacgttgaag

SEQ ID NO: 410 - DNA, 1959 bp, Sorghum bicolor
aaacccgggcacgaaagcacacgagtccacaacaaaactcgagtgttccagccccccacatcagcgcccctctctccctgtttcttcacgtgccatggagaccctcctggtcggcaaccccgccaacggcgtggcgaagccgatgtgcaacggcgtcggcgctctgcccgtggccaactcccacgccgtcatcggcgcggcgccgccggcgacgacggcggccccggcgggcgccactctcggccggcacctggcgcggcggctcgtgcagatcggcgcctccgacgtgttcgccgtccccggcgacttcaacctcaccctgctcgactacctcatcgccgagccggggctgagcctcgtcggctgctgcaacgagctcaacgccgggtacgccgccgacgggtacgcccgctcccgtggcgtcggcgcctgcgccgtcacgttcaccgtcggcgggctcagcgtgctcaacgccatcgccggcgcgtacagcgagaacctccccgtgatctgcatcgtgggcggtcccaactccaacgactacggcaccaaccgcatcctgcaccacaccatcggcctcccggacttctcccaggagctccgctgcttccagaccatcacctgctaccaggccgtcatcaacaacctggacgacgcgcacgagcagatcgacaccgccatcgcgacggcgctgagggagagcaagcccgtgtacatcagcgtcggctgcaacctggccggcctctcccacccgaccttcagccgggatccggtgcccctgttcatctcccccaggctgagcaacaaggcgaacctcgagtacgccgtggaggcggcggcggacttcctcaacaaggcggtgaagccggtgatggtgggcgggcccaagatccgggtggccaaggccagggaggcgttcgccggcgtcgcggacgccagcgggtaccctttcgccgtgatgccgtccgccaagggccttgtgccggagcaccacccgcggttcatcggcacctactggggcgccgtgagcaccacgttctgcgccgagatcgtggagtccgccgacgcgtacctcttcgccggccccatcttcaacgactacagctccgtcggctactccctgctgctcaagcgggagaaggccatcatcgtgcagcccgaccgcgtggtggtcggcaacggcccggcgttcgggtgcatcctcatgtccgagttcctccgcgggctcgccaagcgcctcaggcgcaacaccacggcgtacgacaactaccgccggatcttcgtccccgaccgcgagccgctcaacggcaagcccgacgagccgctcagggtcaacatcctcttcaagcacatcaagggcatgctgtccggcgagaccgccgtcgtcgccgagaccggcgactcgtggttcaactgccagaagctcaggctccccgagggctgcgggtacgagttccagatgcagtacggctcgatcgggtggtcggtcggcgcgacgctcgggtacgcccaggcggccaaggacaagcgtgtcatcgcgtgcatcggcgatggaagcttccaggtgacggcgcaagacgtgtcgacgatgctccggtgcgggcagaagagcatcatcttcctcatcaacaacggcgggtacaccatcgaggtggagatccacgacggcccgtacaacgtgatcaagaactgggactacacggggctcatcaacgccatccacaacggcgacggcaactgctggaccatgaaggttcggacggaggcggagctcaaggaggcgatcgccacggcgacgggcgccaagaaagactgcctctgcttcatcgaggtgatcgtgcacaaggacgacaccagcaaggagctcctcgagtggggctccagggtctccgccgccaacagcaggccgcccaacccccagtgagctatctagctggctcatgctcatcccccgggttt

SEQ ID NO: 411 - DNA, 1758 bp, Sorghum bicolor
aaaggatccacatcttcgatcgtcttccatggagaggctcattgccggcctacttggcttcctattgattgcgtcagtaggaagccatgcagctcgtgctccggatcaatactggaagtctgctcttcccgacactcccatgccgacctccctctcccaactcctcaacaccccagccggaggcacgaccgtcaacgtcggctggggcggtgtccacgtcgatgctgggcacggtaagcccgggggtacgacggttgacgtaggcaagggcggcgtcggcgtcaatgttaaccctggcagcagcggcaggaagcccggcggcaccacggtcggcgttggtgggaaagggggagtcggcgttaaggtcaaccctggctatgggaagcccggcggcacgacggttggtgtcgggaagggcggagttggtgttaacgtcaaccctggctacgggaagcccggtggcaccactgttggcgtcgggaagggcggcgtcggcgtgaacgtcaaccctggcaagcccggcggcactacggtcggcgtcggcaagggcggcgttggcgtcgacgtcaatcctggctatggcaagcccggtggcaccacggtcggcgtcggcaagggcggagtgggcgtcaacgttaatcctgccaagccgggcggtaccggcacaaccgttggcgttggcaaaggcggcgtgggcgtcggcgtcaatcccgggtacggcaagcccggcggcaccacggtcggcgttggcaagggcggggtcggcgtccacgtgaacaacccgcgcaagaagcccgtcaacgtcaacgccgggcctttccagtacctgtacgccgcatcagagacgcagctgcacgacgaccccagcgtagcgctcttcttccaggagaaggacctccagcagcccggtaagaaggtgaccgtccagttcgccaacaccgcgaccgccggcgccaagttcctcccgcgaagcgatgccgaggccatcccgttctcctccgagaaggtccccgagatcctgagccgcttctcggtcgacccggactccgtcgaggcggcggagatggcgcagacgctgcgcgactgcgaggcgcccgcggccaagggcgagaagaaggcgtgcgccacgtcgctggagtccatggtggacttcgccaccaccagcctcgggaccagccacgtgagggccgtctcgaccgtcgtggccaaggaaggctcgccgaagcaggagtacaccgtgaccggcgtcaagcccgcggccggcaccggccacgacggccgcctcgtggcctgccacgcggagccgtacgcgtacgccgtgttcgcgtgccacctgacgcagcagacgcgggcgtactcggtgtcgatgctcggcagggacggcacggccgtggacgctgtcgcggtgtgccacgccgacacgtccggctggaaccccaagcacatcgccttccaggtgctcaaagtgaagcccggcacggtgccggtctgccacttcctgccgcaggaccacgtcgtctggacccgcagcggctgaggctgctggatggctgccgtttgctctcgtcgcgccgcctgatggagtgatggtttcgttttcattgtattctagtagcctctgggcatactgtttatgtttccagtatagtgcttgatgtttgtatggatggtgtggccagccagtatcgaccacctgcttagattctgttgtatagttctaaataaacaggcatgtctttacggttactgctcgagaaa

SEQ ID NO: 412 - DNA, 881 bp, Sorghum bicolor
gcaagaatcagcatagcatggatccgagcgcggtcagtttcgactccggcggcgcgcggcggggcggcggcggcggcggcgcgcagatgctgctcttcggcggcggaggcagcgccaacagcaacggcttcttccgaggtgttccgatggcggtcctgggcatggacgacgcgacgcgcgtgggcaagcggcctttcttcaccacgcacgaggagctcctggaggaggagtactacgacgagcaggcgcccgagaagaagcgccgtctgacggcggagcaggttcagctgctggagcggagcttcgaggaagagaacaagctggagccggagcgcaagaccgagctggctcgccgcctcgggatggcgcctcgccaggtggccgtctggttccagaaccgccgcgcgcgctggaagactaagcagctcgagaccgactatgaccgcctcaaggctgcctacgacgcgctcgccgccgaccaccagggcctcctggccgacaacgatagcctccgggcacaggtgatctccctaacggataagctgcaacgcaaggagacatccccgtcggcgaccactgctgcccaagaggtcgaccagccagacgaacacaccgctgcgtcaggcactgagaaactgctggtgcagcagctcaaggacgacctccacagcagcggcgacttcactggccatggtgccctctcttcagaggaagaggatggtggtgtggtcagcgacgagggctgcagctttgatctcccggatgccatgttcgctgccggggtcacccaccatggcgccgaggaggcgcagctggccaactggacatcctggttctggaactgatttccatcagtggagggatggctgcatcaagtgtga

SEQ ID NO: 413 - DNA, 736 bp, Sorghum bicolor
cgcgtaacgaaacccaacgccgccggtcgccggccggccgtccatccgccgcaccggccatggccatggcgctggccctgggtggtggccaagacgcggagcggaaggtgaaggtagcggaggtggcgctgcgcgcgctgctgtgcgggctgggcgcgctggcggcggcgctggtggcgacggacacccagacgcggaccttcttctcgctgcagaagaaggccagctacacggacatgaaggccatggtgttcctggtggacgccgccgccgtcgccgccggctacagcctgctgcagctggctgcgcgctgctgcggcggcggcgccatgtccagcggccgcggcgacggcggcggacgcggccgggccctgtcctggtgcgtgttctcgtgcgaccaggcgctggcgtacgtgctcctggccgccgtcgccgccgcgctgcaggcctccgtcgtcgccaagcgtggccagcccgagttgcagtggatggggatctgcgcactctacggcgccttctgtaggcaggccggcgccggcctcgctaccgccgtcgtggctgggctcgccgccgtcctgctcgccttcctctccgcgttcaacctcttcaggctctacggcagcggcggcaccaagagctagtagctttgtgatgagcagaggccgttcttccatctgaccaccatctcttgcaaacaccgtagcgtagggctttgcttgatttggttgctactggt

SEQ ID NO: 414 - DNA, 1760 bp, Sorghum bicolor
caatccgatcccatagaaactctctcagtttcagttcgatcgatcgctcccgtctcgatcgtttgcacaaaaacatggccttcaacctggctcagtgcgccaccgctgcggcgtccgtcgcgccccgcacccctcgccctgctaggtccgcggtcgcggcgtccgtgtctgtctccacaaggaaggcggcggacggcaggctgcggctgcagcggcaggcgagctgcgagccgtcggtggcgccgtcgcgttcggtgttctgccgggccgcggtgtcggggaagagcgcggccgaccgggccgcctccaccaggaggaggtccggcgtgccggtgttcgtcatgatgccgctggacaccgtgaagaagtgcggcagcgcgctgaaccgccgcaaggcggtgcaggcgagcctgtccgcgctcaagagcgcgggcgtggagggcatcatggtggacgtgtggtggggcatcgccgagagcgacggccccgggaggtacaacttcgcggggtacatggagctcatggagatggcgcgcaaggccgggctcaaggtgcaggccgtcatgtccttccaccagtgcggcggcaacgtcggcgactccgtcaacatcccgctgccgcggtgggccgtggaggagatggagaaggaccaggacctctgctacaccgaccagtggggccgacgcaactacgagtacgtctccctcggctgcgacgccatgcccgtcctcaagggccgcacccccgtcgagtgctacaccgacttcatgcgcgcgttccgggaccacttcgccgactacctcggcaacaccatcgtggaaatccaggtcggcatgggccccgccggcgagctgcgctacccgtcgtacccggagagcaacggcacctggaagttccccggcatcggcgccttccaatgcaacgacaggcacatgcgtagcagcctgaaggcggcggcggaggcggccggcaagccggagtggggccacggtggccccacggacgctggcggctacaacaactggcccgaggacaccctcttcttccgcgccgacaacggcgggtggagcacccagtacggcgacttcttcctgtcgtggtactcgcagatgctgctggagcacggcgaccgcatcctgtcgggcgccacgtccgtgttcggcgcgtcgtcgcccgtggaggtgtccgtgaaggtggccggcatccactggcactacggcacccggtcgcacgcgccggagctgaccgcggggtactacaacacgcggcaccacgacgggtaccgccccatcgcggacctcctggcccgccacggcgccgtgctcaacttcacctgcgtggagatgcgggaccacgagcagccgcaggaggcgcagtgcatgccggagcacctggtccggcaggtgggcgccgcggcgcgcgcagcgggcgtgggcctcgcgggcgagaacgcgctgcccaggtacgacggcacggcgcacgaccaggtggtagccaccgccgcgcagcgcgccgccgaggaccggatggtggcgttcacgtacctgcgcatggggcccgacctcttccacccggacaactggcagcggttcgccgccttcgtgcgccgcatgaacggcgccgggtcgtgccgggaggccgcggagcgggaggcgcacggcgtcgcgcaggcaaccgggtcgctggtgcacgaggccgccgtcgcgctgcggagctgacccccaccggaagccgcctgcgatggatttgattgtgtatag

SEQ ID NO: 415 - DNA, 1055 bp, Sorghum bicolor
gtcatcgtccagaccatttacctgagtgctctgctctcgctggagcccgtggtgcacgctcatggaggccgctattcccaatcccagtgccctgaaaacaaggattgccgtggtcaccggcgggaacaaagggattgggctagaggtttgccggcagctggccggcgacggcgccaccgtggtcttaacagccagggacgagacgaggggcgcagccgctgcagagaagctcagagaagcagggctctccaatgttattttccatcagctggagattactgatgctccgagcatcgctcggttggctgagttcctcaagactcgttttgggaagctagacatactgataaataatgccgcaattggtgctgttgagtacgtccaagatcctgccgacagtccagcaagcgaggaaaagttcagtggcatggatcagggccaaaggcttgaatgcatgtttaaaggtgtccgggagacctacgacgctgcaagagaaggcgtgaagaccaactactatggcgtaaagcatgtgattgaagccttactgcctctgctgcaggcttcctccgatgggaggatcgtcaatgtctcctctgaatttgggctgctaaggctaatcaacaacgaggagctaaggcaggagctgaacgatgtggagaagctgaccgaggagaggctggacgaggtgctggccacgttcctaagagacttcgaggccggcgaggtggaggcgcgtgggtggccgatggctttctcggcgtacaaggtggccaaggtggccatgaacgcgtactcgaggatcctggcaagaaggcaccccgaactgcgcatcaactgcgcgcaccccggctacgtgagcaccgacatgaccatccacaccggacccctgacgcccgaggaaggcgcggccaacttggtgaaggtggcgctgctgccggaaggcggcccgaccggcgcatacttcgcgtggggagtggaggcgtcctttgtgtgaaaaagcaccatgcatcgttaatgttctgttcgttgttctccaactgcctgttatcaacgtt

SEQ ID NO: 416 - DNA, 1521 bp, Sorghum bicolor
caaattgctcccgcattcccttccccttcctcctgcatttccgtcccatcggcggccctctcccaccctcgtggcgacggccaggcgaccgcagccgccgccgaggtcatcgccagcgaccaccgctccaccgggtacaacagatttatgcttggaacttctgcagaaaagcacacaacagtaatggggcacgaccatatttctcgtataaagatgcatatggcagaaggttcttttggtgacaggaaccggtgccagcaacccgggtgcaatgaggttgtcgatggaagggtagtgtactgcaaaactcacagtggggagttttcatgccaacagttcagtcacctccacagcggaatggagagctcaggtttatcggtgccccatgttaatgacaaccagttcaagggatctatttccattgcagtgccatgcactgagcaagagttacatgtcaagcatgaagggaatgatcgaggtaaactaaaggatagttctgggtacactttggatcagactgcacaatttgtcttctctggggcaggcttgctttgcaagaacgaaaactgcagcaagcaagcacatgagaactcgatctactgtaagttgcatagcggtgttagcaagggctgcatggtacggggttgtacgagaggtgcgcatggaggcacacctttgtgcattgggcatggaggtgggaaacggtgtgtgatccctcaatgcccgaatgcagcatgtggtcaaggccgtagtgaccgctgtgtaaggcatggcggtggtaagagatgtaaatttgaagggtgtgcaaagggcgcacaagggaacaccgattattgcataagacatggtgggggaaggcggtgcaaatttgaaggatgtacaaagagtgcacaaggacgcacagatttctgtattaagcatggtgggggcagtcggtgcaagttccaaggatgtggtacaagtgcaaaatggggaacggatttctgctctgtccacaggaagagtttgttgggcggtgacagtgccatccctgaagctttgcctgccccgtcagaaaaacgacgtcgtgccaagaagcctaaaaaggcagcgaagctgtctgagacctcccaagagaatgtcacaacagcagctattgctggtaacagcacgcaacacatgggcgttcttctcatagctacccctgttactaaccatgacatgttaaccaagggtgtgacagtggcggcgccagctgcaatagcgcccacgcagatagtggcgccacttgccatcaaatcaccaacaccatctggatcggtggctgcaggagcagagagggaggcgggagcaagcagggagatgctgggtctgtagaaagatggtggcagtgcataatttgggaggcttggagacacctggccagatagctctctaattattgctttttagactgagaaacctcgaaactttaggaaggttgcaatttgacaggcttgcaccgtcaactgactagttatgtcctgtgcctttctcatttgt

SEQ ID NO: 417 - DNA, 1355 bp, Sorghum bicolor
cgagcttctttacacagcaggccggagaaacacaggcagccaaagccgccaccgcttttaccgaccgaccgatcggtgttgccgccgcctgtcgggtttaagcaaccaaccagaccaagccatgggattgccggtgatgaggagggagagggacgcggaggcggagctgaacctgccgccggggttccggttccaccccacagacgacgagctggtggagcactacctgtgccggaaagcggcggggcagcgcctcccggtgcccatcatcgcggaggtggacctatacaagttcgacccctgggacctgccggagcgcgcgctgttcggggtcagggagtggtacttcttcacgcccagggaccgcaagtacccaaacgggtcccgccccaaccgcgccgccggcaacgggtactggaaggccaccggcgccgacaagcccgtcgcgccgcggggccgcacgctcgggatcaagaaggcgctcgtcttctacgccgggaaggcgccgcgtggggtcaagacggactggatcatgcacgagtacaggctcgcggacgccggccgcgcagccgcctccaagaagggatcgctcaggctggatgactgggtgctgtgccgcctgtacaataagaagaacgagtgggagaagatgcagctggggaaggagtccgccgccggcgtcggcaccgccaaggaggaggcgatggacatgaccacctcgcactcgcactcccactcgcagtcgcactcgcactcgtggggcgagacgcgcacgccggagtcggagatcgtggacaacgacccgttcccggagctggactcgttcccggcgttccaggacccggcggcggcgatgatgatggtgcccaagaaggagcaggtggacgacggcagcgccgccgccaacgccgccaagagcagcgacctgttcgtggaccttagctacgacgacatccagggcatgtacagcggcctcgacatgctgcccccgccaggggaggacttcttctcctcgctcttcgcgtcgcccagggtcaaggggaaccagcccgccggagccgccgggttggggccattctgaggctgaggcgagcgaggatggagccatggatcaggagaagacagcgttgcaaggttgcgaactctgtaaatacagcataggagtcgaacctgaacccgactctgaacctggtcggggttacagggttatgggtgtcggtgttagcgtacatggagccggccggcccagtgttggcgaggctcattctttagtttcactttcaacgcagaagactgtagatatatgtgtagctgttcactttcatcacttcctcttcaacagaaccgacgaaatt

SEQ ID NO: 418 - DNA, 1133 bp, Sorghum bicolor
agttcgactcagtcatccaacccccgatcgatcggatcagatccacaagcaattaagcaagccacgccgacatgccttcagtcgaggtgggcggcgccgccgggtggaggcccaagcacctccacaagcagtaccagcagaagcaccaccactacacccagcagcagcagcatcagccaccgtcccatccccatccccacccgccgccgcaacagcaaccgctggagatccgggaggtatgggcagacaacgtcgaccgcgagttcaagctaatccgcgcggccatcgagcacttcccctacgtgtccatggacacggagttccccggcgtgatccaccacccacccgcttccgtccaccactccacgctcaccccatcacagcgctacgccctcctcaaatccaacgtcgacgcgctgcacctcatccaggtcggcctggtcttcgcggcgtccccgtcctccccgccggcactcgcgttccagatcaacctccgcgagttcgacccgcgggtacaccgccacgcgccggactccgtccgcctgctcgcgtccagcggcgtcgacctcgccgcgcaccgcgccaggggggtttcggcccgcgccttcgccgcgctgctcatgtcgtcgggcctcgtctgcaaccctgacgtggcgtgggtcaccttctgctccgcctacgacttcgcctacctcgtcaaggtgctcatgggccggaagctgccccgggcgctcccggagttcctgcggtacgtcagggtctacttcggcgccgccgtgtacgacgtcaagcacatggctagggtcgccgttgactcctacggcgaggtcgcgctgctgggtgggctcgagcgcgtcgccggtgccctccgggtgcgccgcgccgccggacggggacaccaggccgcgtccgacagcgtgctcacgtgggacacgttccgggagatggctaggctctacttccccaaggaatgcagcctggacgtgtgcgccggcgtgatctacggccttgagctccgccacggcgacgccactaccaagcccaagccggctaaagtgcgcgctgcgctgcgctgctgagataataatgttgttatcatcatgtacagtacagaacctcccaaactggattag

SEQ ID NO: 419 - DNA, 868 bp, Sorghum bicolor
cggtcctcctcactgctcgccgcgcgttgcaatgggtatcgacctagtcgccggcggccggaacaagaagaccaagcgcaccgcgcccaagtccgacgatgtctacctcaagctcctcgtcaagctgtaccgcttccttgttcggaggaccaagagcaacttcaacgctgtgatcctgaagcggctcttcatgagcaagaccaaccgcccgcctctctcgctccgccgcctcgtcaacttcatggagggcaaggagaatcagattgctgtgatagtgggcaccgtgactgacgacaagagggtctatgaggtaccagcaatgaaggtggctgcgctcaggttcactgagacggccagggcccggattgtgaatgctggtggcgagtgcctcacctttgaccagcttgcgctgcgtgccccgctgggccagaacacggttctgctgaggggacctaagaatgctagggaagctgtgaagcactttggccctgcgcctggtgtgccccacagccacacgaagccatacgtgcgctccaagggcaggaagtttgagaaggcaagaggaaggaggaacagcagaggcttcaaggtctaggttgtcgccatatctatgtattctgacctggttgaccatcttgtttgagtcatagagttggtatatgatattacaccccagttccaggacgtttgagagctctttgttgtttgtacaccagttcaggatctgcaaaaatttgctcgattggtttgcgccctacttgaagttccaagtgacaaaagcacaatagggtgcatctcattggatccattaatgtctgtttggagaacgtcccatgttatccttttgtgttcgagtcgcattcagtta

SEQ ID NO: 420 - DNA, 1032 bp, Sorghum bicolor
aacgctttgtctgcgacgggcgcccgccctcctgccgccagaagcttccaggagcatcagcgatggtgtggttccaatgcgaggactgtggcgagaacctcaagaagcccaagctcgccagccacttccgctgctgctccgcgtacaagctgtcatgcatcgattgcggcgagttcttcagccaggagaccgtgcaggggcacacccagtgcatctccgaggccgagaagtatggtcctaagggacagaacaagccatccaatggtgtacagggtaaggcagataagccaaagccaaatgcagatgttgatatcaatgttgggctgtcgacacggcctccttggttctgtagcctatgcaagaccactaccacaagcaagcaaactctcttactgcatgctgatgggaagaagcatagggcaaaggcgaaagccttccatgcttctcagaaacaaacaaatggtgcagaacaaactccagatgtgaaggaagccggagctgtacccacaaaagaatctgttcaagtaaatggtggtatgagtggtgatcgtgaaagaaatgatgataaagatgctgcgaaaagaaaacgaatggatgacatgaccatagaggagccagataacacaaaaaaacagcatttaacgcagtctagagatgagaagtcagaaaacaaagtgaagagtaaggcagatgaactaacaagtggtgccgactgcaaaagtgttcagaaacaaaagatcaaatggaagaagattattactaaagcactgaagacgaacgcagatggagttatgaagctaaagaagctacaaaagctagtctccaaggagcttcaggaatgtggtgtctctaaagacgagggtctccatgctaccttgatggataaaatagcttcaagctccagattttctgttgatggcaagcatgttagactggtggctaagaatgaagaagaatcttagaaagaggttgtcagtcatttcttggcattgttcctggcctaattctttggtgtcaactttcagatggctt

SEQ ID NO: 421 - DNA, 1173 bp, Sorghum bicolor
tcgagctcactcagacatcaactggtgagcggtggtgtcgtggtgaccatggcgcctgccctcctcgccgccgtcgtgctggccgcggcggcgtcgctcgcggcccacgtcgcgctcaactgccccgtgaagccgctgccgtcgcctccgccgccacccactccgccgcccaacaacctcctccagaggctggagaggcttggggaaggggcgctggacgcgccggaggacgtgtacgtggacgcggcggccggcggggcgctgtacacggccaccagggacgggtggctgcagcggatgcacccgaacaacgggtcctgggagcggtggcgcttcgtcggtggcacggggctgctcggcatcacgccgtccgccgacggcaccatgctcgtctgcgacgccgacaagggacttttgagagtcggggaggaaggagtgacccatcttgcttcggaggtcgacggctccaccatcaggttcgcagacgcggcgatcgaaggctccgacggcacggtctacttcagcgatgccagcaccaggttcggcttcgacaggtggtaccatgacttcatagagtccagcgccaccggccgcctcctccggtacgacccgcgcagcggcaagacgtccgtcgtgctcgacgggctcggcttcgccaacggcgtcgccctgccgagggacgaggccttcgtggtcgtctgcgagtccagcaggttcaggtgcatgaaagtgtggctgaaaggggagaaggccggcaaggcagagacgttcgtcgaccttccggggtgtccggataacattcgcctcgggtcagacggtcacttctggattgccctcatccagctgaggtcgccatggctggatttcatcacccgctggaccttcacgaagagagtggtggcttcgttcaccgggctcatcgagtggagcaagggaacggcgaagggagccatggtggctcaggtgacggaggacggcaacatcgtccgcattctcgacgactccgaagggaaggtgatcaacttcgtgacatcggtgacggagttcaacggggacatcttcctcggcagcctcgcgaccaacttcgtcgggaaattatctctggcgcaggtgatacagcaggagcagtgagcagcacatctccagcccttggagcacgaggaaagtttatag

SEQ ID NO: 422 - DNA, 1390 bp, Sorghum bicolor
cgaactccgcttcttcctcctccggctttcgcgtgaggttgtgtgctgctgaggaggaggaggaggaggaggaggaggcagcgccatggaggcggagaagaagacgccggcggtgtccgatgtgggcgcgtgggcgatgaacgtcgtcagctccgtcagtctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggcttctaccagatctccaaattgagcatgattccggtcgtctgcctgatggaatgggtgctgaacagcaagcactacaccactaaggtcatatcggcagtgattgtcgtggccgccggtgtcgggatttgcacggtcacggatgtcgaggtcaatgccaagggattcatctgcgcttgcgtggcagtgttctgcacgtcgcttcaacagattacaattggctcctttcagaagaagtacaacattggatcatttgagctgctgagcaaaactgcaccaattcaggcactttcgcttgttatactgggcccctttgtggactactatctaaatggacggtcattgttgaactaccctttttcaggaggggcaactttcttcatactgctttcctgctccctggctgtcttttgcaacatgagccaatacctctgcatcggtcggttctcagcgacctcattccaggtcctgggccacatgaagaccgtgtgcgtgctgatcctcggctggatcctgtttgactcggccctcaccgtgaagaacatcctcgggatgctgcttgccgtgatgggcatggtggtctacagctgggccgtggaagcggagaagaaggcggcagccccgatcccccggaacaagagcgacatgctcgatggcgaggacgtacccctcaaggccagggtgagtggcgtgcccacgggcgacctcgaggacggcgagatgaagagctagctgctgcggccgccgctgctgattcgttcattcttcttgttcttttgtaactgtgcgcgcccactcgctcgctcgctcggtctatccaaagttgcttgttcgtcagtcctcagctatcgacactacactgttaattttggccctttgttggggggagtccgttcgtaggtgacgaagagaccacccccggtttcgacgtagatgaaacacatactggcagattgttaggatttctcaggcgggaaggtggagccattcattgtcaatttc

SEQ ID NO: 423 - DNA, 996 bp, Sorghum bicolor
gaaacaatgctctccatgaccatgacagccatgccccaccgcctcgcccgcttcctcctcatcctgctcctcgccgccaccgccaccggagccggcgccgccaccccgcgccagctgttcctcgtgagccagcctcccgtcacgctcaccaaccaccacggccagctgctgacgggcaactactccgtcaacctgctctggtacggccgcttcacgccggcgcagcgcgccgtggtggccgacttcatcctgtcgctttccccttcggtgtcggggacggcgtccgtagcggcgtggtgggccacgacggcgcggtaccacccgggcgcggcgcggctgtcgctgggccggcaggtggtggacccgacgctgtcccttggccgccgcctctcggagtcctcgctggcgtccctggcgtcgcgcctgggcccgcaccgcggcaccgtggcggtggtggtgacggcggcggacgtgctggtggacgggttctgcctctcccgctgcggcctgcacgcatcgtcctcctcctccacccggaacgccaccagcagcagcgggcgcggtggccgcggtcggttcgcgtacgcgtgggtgggcaacccagcggagcagtgtcccggggagtgcgcgtggccgttccaccagccaccgtacggcccgcaggcggcgccgctggtgtccccgaacgcggacgtggggatggacggcgcggtgatcacgctggcgacgctgctggcgggcgccgtgaccaacccctacggcggcgggttcttccagggccccgcggaggcgccgctggaggccgtgtcggcgtgcgcgggcgtgttcggcaacggcgcgtacccggggtacccggggcaggtgcgcgtggacgccgccacgggagctagctacaacgccgtcggggtggcagggcgacggttcctgctgccggccatgtgggaccccgcgacggcgcagtgctccacgccgctcgtgtagacggtgaaggtgtag

SEQ ID NO: 424 - DNA, 2180 bp, Sorghum bicolor
aaaggatccagtcagcaccgcatctgtctcgcgctccggctctctgtgactctgtcccctcacggccgtagccctttccaagggatatcggagggagaggagggggaggcgggagcagtaggaaggggcgttcgtgtcgtgggtggagaagatggagaacctgaggaggctcctgaatccgctggtgctcaacctgcagaagatggagctggagctcacctgccccgtctgcctgaagttgctcacctcgccgacaacgctgccgtgctaccacacatcctgcagcaagtgtgcccttacaccgacttcaaaaggttacagctgcgccatttgcaaatctggctattgttctcaagatttaaggccagcttctcatctcgagtcgatagtgagcattcacaggagcctcagctctaccgtatgcaccatgattgaacagcaggatgctcaagttaacattcctgttgcaaagacagcatctcatggaacaccagagtcaggaaacagaagtggggtgatggagaaatctgaccagatgaaatcttacaaccctgttgcttcaaagctagtatatgatcagtcaactggacctgcatttgggaacatggagggtgttcaagcaaaagatcctgcagtagagaacaatgctggtgctgcagctgttgcaccaacggctatagtacaaaagggtcattctgggtcacaatcttctgacggccctggggatttggattgtgacagcaatgaccttgaaggagaactgataacaagcagatcacttcttcaaactgcattgaaaagagagacaaatgtaatggatgaccataccagagaattgaagaggcaaaaatcaaatgaccaggttcaaagacaaacaaccatggccagtgcttggaaatgtgagttctgtcattcttcccaagtcactgagtgtactggacctttgtcacattatctgaatggggagccaatagaagctgatcaagcttggaaatcaagtgttcatcatgtccatgagaaatgtgttgaatgggctcctcaagcattctttactggtgacattgcaaataacttggagcctgagttggcccgtgcttctaagatcaaatgcagtgtttgtggcttgaaaggtgcagcacttggctgccttgtgaagagctgccgcaatagttttcatgtcccatgtgcctacaacatcaaaggctgcaaatgggatcaagagaacttcgttatgctgtgttctacacattcttcaaaaaagttgccttgtgaaagatcaaagtcaaaaaagaaggccaagttacagcaaccatcttctgacactgatggtctgaattcaccctctccaatgcaaagggatgaactttggactgcctcaccttttctgactagtggatgggtgatatgtggatctgccctcattggccatgagaaggaaatcttggatcaatttgagtgtcacactggcatcactgtaactaacacttggagttcggatgtgactcatgtgattgctaatacggatgaacgtggggcatgtgctaggacactcaaggttctcatggcaattttagctgggaagtgggttctcaatgtgaattggctgaaagactgtattgaggctaggaaaccaatcccagaagagccctatgagataagctgtgatgttcatggctctgttaatgggcctcgctcaggaaggcttcgagcaatgcagcaggcaccaaacctgtttgctgggttgaccttctatttcagtggccatttcatgccgggatacaaggccaaccttgaagatttgattgccgcaggagggggttccattttggagaagactcagctctcttgtgcatccttgattctttacagcatggagccaccacaaggaaacagtcccaacacccttgagaccatcaataagagaatagctgaggctcaagaactggcagccacggttggctgcaaagccattcctcatacatggcttctggattctattgcatcctgcaaagttgagttgagcgtgtgaagtactgcctaggttcaaattcaaacataggaatgtgatatctgttctgctttttttttcttttcaaaaaggagattaggatgtgattgacatgttgtcttgatccaaaatatctttaaatgttgtagcatgaaagcgcaatggtaccttt

SEQ ID NO: 425 - DNA, 3605 bp, Sorghum bicolor
aaagtcgactagcaggcaacaagcgcgacctcacctcgccgccggcgatggagccgccgccgcctcctgctccggcgacccactccgcgcccgtccgcgtgctctcccgcactccgccgccgtcctccccgaccccctcttccgcgggccccgccccgtcgccagcctcccgcgacggggtcgtcgccgtcggcttcgtgggcggcgcggggagcgcccgcctcgccgaccggatcctcgatgcccacgtcttctcccccggcggctcggcggggaccctcgccgggagcgtcaggtaccaccgcgacgccggcaggaggatggtgttcctgcacctcgcgccgctccagacggcggttggaggctgcggcgacggagacctaccggagatgctcttcatgttctctgtctgccatgtaattatatttctgcaagatggcttcaggtttaacacacaaaccttaaagaagttccgactgctgcaatcttcaaagcatgctcttgctccatttgtcaagtcattggtagcagctgcgatgcctgccaaaactgttgcctctgacaccccaacaagagcaacccacagggcttcctccatctcccctccagcacgccgtggaggtcacgccggtcgtcagtcctcggccatctcacttatgtccgggaccagttcaaatccttctgtactgccaggccaatgcattcctgtattgctctttgtctttgaggatgatgtgcttgatgtttcaagtgctgcagcaagttctgatgatatgggtgattcatcttcatcaaatcagtgttctacctctgatggattatcaaaacaaagtttagcttcaaaaagttctggttcagtggttatgcttgcccgggcagcaaacaaatctgagggcaattcagcgaaaaagctacactcgtcattggagggacagatccgtgtcttgctcaagaagtgcagggtacttgcaggcatggagccagggcatattggcccgaggggtgtaagtaacatgagtcatcatttacccctgttctcgcttgatacctcgagggttgttgcactgttggaacggtacatcaataagaaacaggagccactggacatcattgcaggattatttgaagattctttgtgctccaaattgtcattggatattctttcactggaaaacaactaccacccaacaaaccatgatgactttcagttgatcaaggattttatatttcggcagtctgatgccctgagaggtagagggggatattcaagcaatgcaagtgccgggtctgtttctggtgttggcatggtggctgctgctgctgcagcagcagcagcatcagctgcatctgggaaaccagttaatgcacctgatctccctacttttgataaatggttgtccataagtacctctattctaactgcactgttgagtggaagaaatgtgctgagtggtcagtctgaaagcaagactcatacaagtcctattgagaagaatgaccaacttcctgctgcaggatctaatgctattgagatcgcattatcgtgcttggaaagtaataatggtctgaacatgaaattttcttcatcatggtgccaaagggtgcttccggctgctaaggagatttacctgaaaggtttgcctgccttttaccccacaagcatgcatgaagtgcagctacagaaggcattgcggtcctttggctcgatggttaaaggaccagcagtcagggtattcttaaagaagctagaagatgagtgccgggcaatatgggaatctggaaggcagcaatgtgacgctgttagcctaactggcagaccatgtaagcaccgcaggcatggcgatttctcttcatcagatgcaatgaaacaacattctagtggatatgtattcctccatgcatgtgcttgtggccggtcacgtcgccttagagatgatccttttgactttgagactgccaatgtgtcttttaattgtttccaaaattgtgatgatctactacctacccttgcgcttccaagaggcagtgatgctggttcgttttcagtatcttcttggcgcttggtgcgtctcggaggagccagatattacaagccaacaaaggggcttctccaaagtggatttagctccaaggagaggtatcttctaaggtggattatatctgttggtaaggggcaagtgagaaatggcattcgttctaatactgttacttcatccacaagatctggtatgaaccctcagactcccccaatagtcactggtgaagtaaaatctgctgtaacccaagtcacagcacaaattaaatctgcaaagctcgaaagttctggaaaacaacctgatatggaaccaatgagcaactcaggtattaattttggtaaaggtctgccaaattttactatgaaaaaaccctttgctgaagttgttgctggcaccacatcaaaagattccgagtttcctgctcttcagcagatgaggccaccgaaacctggtggtcgaaaagatgagcgccaaatgaatataggagaccatcctaatggccgaggtcatgcggctgtcagccaagggcctgtagctgaaactgaatctgcgaaagcaagcagaaacaagagtagtgaaaattctgatgggaagccctttttacagatagggagcaatatagtaccagtgattgttggaaatgagactagagaaactagtcagcaggtacaacagtttgttgtgtatgttggatttgagcatgagtgtccctatggtcatcgcttcttactgtcagagaaacatatgaaggagattgattcttcctgtttgttgtatcaaagacctcatgtaaacaaagaagcagaaggcaagcatgcacaaaagttgctccaaaatgcatctggtttaattgcatctgcagtggacataaacagtgcacagaaaaacagtaagccattgcaatcatcagggagaaacagccagcagcaatcactgcagctgagggttgatgcagagacttcacaaccttctccttggctttcagatccacagaatggcaaaaggggggagcactattttccaagcattacaattgatgatggcggagaagcattttcactgatgaacagaaacttgccaatatatatgcactgtccacattgcaagatctcagaaaggaaggaacatcaagatgtaaagtttgctggtgccgtgtcacaacttcaacggattttcattgtgacacctgatttccctgttctattggcaagctgcccacttgtacagtttgaggggtcatgcttgccatcgaatgtctctgatcatgatcgagaaggatcattcagtattgggtgccgagttatcctcccacctgagagctttcttacaatgaggcttccttttgtctatggtgttgagacaaaagagggaagtacatttcccctcaaaaactttgagcaacaaccagaactcacagcatggcttgttggaggcacagccttgcaaatcgtatcggtaggggacgtcaccgagaaagaaaccgttatgaagtgatagacatgtcatctaaagctttactggttttaacatgttctagtcacgtgtcagtgatgtgccatttctagaata

SEQ ID NO: 426 - DNA, 1792 bp, Sorghum bicolor
ttcctggcttgagctatctttgcaggaaatatcaattcatcagaaaagcaaaatgcgtagcagaaagcccttggggattcaactttttgagtgtgcccgggggagtcccatctccttcagatcatgtcaggctcttgtactagttctgacgttcttatcatacgccagctaccatgccactagaaaaaccacaagcattgttaagagtgttcttgatcctaagacaaacctaggtatgttgcattggcccagtcatctctaccttcaaaatttgaaaggtgcagagaacaataatgcgactctctccggcggttgggctccgttcaacgctgaagatggcactgtattgcttggggagattgacttggcttttcttggtgtatatgcaattgggatgttctttgctggccatttgggcgacagggtggatctgaggatcctgctgactataggaatgataggaactggattgttcaccgccgcctttggagccggctactggttcaatgtacacagcttctactactttctgggcatgcagatggtgtctggcctgtttcagtcatctggatggccttcagtggttgcagtagttggtaactggtttgggaagagcaagaggggactgataatggggatatggaatgctcacacatctgtaggaaacatatctggctctctgattgctgctgccatgctgaagtatggatggagctggtcctttgtggtgcccggtatcatgatcgcactggtcgggctcacggtgttcctcttcttgcctgttgggcctgatgtgattggaatccaggaggatctccatttgaaggactctgagaagagtgacatggacgctcccttgttggaacgacgctcatcagatgtaaaagaaaaggcagtgggatttattgaggcgtggagaattcctggtgtagcacctttcgccctctgccttttcttctgcaagcttgtggcctataccttcctgtattggcttcccttttatatcagccacacagctatcggtggacaatacttgtcagactcggaagccggggtactgtcaactctgttcgacttgggtggcgttgttggcggcatcctcgcgggccacatctccgaccacctggacgcccgggcgctgacggcagcgagtttcaccttctcggcgataccggcgctcttcttctaccgcatctacgggaacgtctcgctggcgtggaacatcgcgctcatgttcatcaccgggatgctggtgaacgggccctacgcgctgatcacgacggccgtgtcggcggacctcggcacgcacagctccctcaacggcaactcccgcgcgctggccaccgtgacggcgatcatcgacggcacggggtcgatcggcgccgccgtcggcccgctgctgacggggtacatctccgccaggagctggagcgccgtgttcacgatgctgatggcgtcggcgctcgtcgcggggctgctgctgtcgaggctggtggtggcggaggtggccgccaagatggagtcccggaggacgcccgcccacgccgctagcgacctgcccgtgtccaccatggacgaaccgtagaccacgagaccacctgtgattttaggcctcagggtgaggggagcaggtgcgcttctgtcccagaactgtgggatcttgctcctggtgtgccgtgcttcttgttcgtcatggtatatatgtatatggaaatggaatgcaatgtggttgcagcgcgccagcccgggcgtttctatctctgctctgttagggagctgcacatactgctag

SEQ ID NO: 427 - DNA, 1177 bp, Sorghum bicolor
tacccaaccgccggtcatggcgtctgcggacgccggcgagacgtccaccccggagcccgcggcgagggagaagcccatcgtcgtccggatcaagcgcaagccctcgcagacccgcccagacgccttctggctcgagattaatgagaggccggccaagaaggcgatgctcgatttctcccgcctctccatctccgaaccctcctcatcgccctcctctgccagtgccaaagcttcggaggaaccacgagttaagaagcttcttgtccaacacatcgagacagtacaccattctgaagctgttgaagatgttttacaatctcttttgcttgctgactcaaatgccaaagagataaagagcaagacaaaggagtggaatgacaaaatcaagcaagacaataaaccagagcagctacgatcagcagccagacagaggcatgaggatatgggaagaaatgctcggtttgcacaaatatggaagagtcgaaaaggagaaaaggatgatgctgatgactcattgagagaaatatgccacctttatgatgctgtccaagtagatcctgatgatgagaagcatcgagcagaaccacggcaagtcttgatttctgacaacttatcaggtcatttggaatgtagagttgcattgtttcatgttccttacaatattccctgcaggattacctctttcgaagagggtgctgttctatgcaactttcttcctcttctacgcgagtacttgccatcaactgcagaggaaattgaggcagatataatttcattggcacaatcagaagattctgaagtttatgatatctatactgtcaaggaggtggatgatacaaacatggaggccacttcagcagcttcatatccaaggttacaagtggatgatggagaagatgaatgctacgaagattgcccgtatgacacagatgattcaaatgctgaagacaatccgcttttcgattatcctgatgaattttccgaggacgaggatgatgatcgcaacgatgaggatccttttggagacgaagaagggtctgacaccgattacgagaaggaagaagtagaggtggaagaggatgagtaatattgaagggaagttgtgatgaaatgtggggactagcctgtgggctgaacgtaatgtttgacaatgagataggttcggagctgactgatg

SEQ ID NO: 428 - DNA, 1717 bp, Sorghum bicolor
ctctccctctctttctcttcacccccaaagtccccgccgcctgccagcctgtgcctgcccaaaagcaaaaatggcgccttcgccgcgccggcccgtgctggtgctgctcctgctgctcgcgcttctctgctcccacgtcgcgctctgctcctccgccgagccggggaagccaaagcccaagcccaaggtctccggcggccgcaaggcgctgctggcggacgacgacggcgaggaggtgcccgccgccaagccggccaagacggccgcggcagggaagaccaagaagaagctgctcgccggcgacgccgcttccaagaaccagaccaaggttgccaaggctaagaagccagagtcagccgctgccgccgcggcgaaagggaccaccaagaagcctgctggcaaagcggctgcgggtggggatgccgccattgccaaggtctccaaggcccccaaggtccctaaggcggaaaaggcggataaggccaaggtcccgaagccggacaaggctgcggcggcggctgctggtgccaaggccaagggcgccgattcaaccaagcctgccaaggtttccaagacgggcgccaaggcggtaaagccacccaagacgggcgccaaatctgaggttgccgccgtggctgggaaggcgaagaaaccggcagcggccaattcgaccgtggatgccggtgccaagccggccaaatccggcaagagggcggcgcaggtggttgccgacgcgaagccgaaggcgaatgccaccgtcgtgagcaaggaggagtcggcggcgacggaaacggcggaggtggaggttgaggaggacgtggtgttcgccaaggaggcggaggagggcacagacgacctcatctccgagttccgggacctgcccagtcggctgcaggagacgctgatgcccgacctggcgcgcctctcgcaccactccaaggcgtacctgtcagcggcgaacgccgggatcgccgacggcgtgcgcccgattctcggcggccggtgggcggcagtggccgcctccgcggcgtcggtggcggtgctcctgctgccgctcttcatgctcaccgcgctggtgcggcgcatgggcccgtacctgccgctcctccaccgtgcgctgctgctggcgcaggcgtacctcgctatctacttcgccacgctcgcgctcgccgcggccgccacggggctggagccgctgcgcttcttccacgcggcctccccggccgcctacgcctggacgcaggccgcgcagtccctcggcttcatgggctacctcgtgctacagatggtggacctcgtcgccgtcttctccggcgccgcctcccccgaggacgacggcaatggggacgccgccaaggcgctcggcctcgcgcagatggtggtgggcctcgccgtcggcctgcactactacgccgctgtcttccaccgcgccgcggcgggggaggcgccccgtgccaactggcgcgtctacgccgtgtacgcggcctgctttgccatcgtctgcgcctgcgcgcgcgctgagaggaggaagaaggcctacctcgcgggcaccgacggcgccgccgaggagtggaagaagagctgagctgctcatctcctctcgggaaacatggctagatcagaatttgggagggacttttctgaaaggaaatcccaatatggcggaagcccaatggcgtgagtgtaagaaggcccagaatttaggaagaaaaggagg

SEQ ID NO: 429 - DNA, 1586 bp, Sorghum bicolor
aagcacatgcgtgttgatttagcatagccatcgcgagagagatagggaaggaagacgatggccggcggtggtgaagcgccgttgctggaagggaagcccagggtgtacttcgacggctgccccgggtgtgccaatgaccggaggaaggcggagaacctgggaattccctacggccaattcttccatatctggatcatcatcctcgtctcctgtttgccaatatcattgttgtttcccttcatatatttcatgataagagacttgcatattgctgaaagggtagagggtattggattctatgccggttttgtaggtgcttcatatatgcttggtagagctctaacttccaccgcttggggaatgatagcagatcgtattgggaggaagcccgttatcattctttcaattatctccacgcttttgttcaacactttgttcggattgagtgtaaattattggatggcgatagcaacaagattccttcttggttctttaaatggtttacttggcccaataagagcttatgctgttgaagtatgccgaactgagcatcaagctattggactgacacttgttagcacatcatgggcaataggtcttattattgggccagctattggtggatacctcgcacagccagttgaaaaatatccaaagttatttccagccaattcaatatttgggaggttcccatattttttaccatgtttgtgtgtatcattcttctgtttggttatcctcataagctgtatttggctcccggagacattgcataagcataaacttcacaaaactgaagatcaaggaatcgaagattttgctgagcaacaaaatagttcaactacaaataagagcttgcttaagaattggccattgatgtcatcaattatcttattttgtgtcacctcttttgatgatatggcttacacagagatattttctctatgggccgaaagcgacaaaaagtatggaggactaggtttctcatctgaggatgtcggtcaagtgcttgcagttacaggtgctagcatccttttgtaccaaacatttgtttatccacgtattgtaaaagttcttggaccagtcaatgcttcccgtattgcagctattttgtctatggtgctccttttcacttatccaccaatgacacatctatcaaaaccatggttatcagttgtagtgaatattgcatcaatgttgaaaaacaatttagttgttaccgttgtaacatgctcttttattcttcagaataattcagtgcctcaagagcaaagagcaactgcaaatggcttagcaactacattaatgtcctttttcaaggcatttgccccagcaggagctggtattgtattttcatgggcacaaaaacgccaacatgctttcctctttccaggtgatcaaatggtgttcttccttctggacattgtgatctttgttgagctcatatggacattcaagccatttctagccattccggagcaaatccccagaagttagccttcatgcatcatctctactggtgttttattgtggatgggtcaatatcagataacaattgggatacctatttcttgtgcaatgtgatg

SEQ ID NO: 430 - DNA, 853 bp, Sorghum bicolor
gattcgatctgagaaacgttggctgctttaattcatgaacatgtgtgttggtttagcccaccactaaaccaatgaggagtgttttaagtgagaagacgtcatataggtcctggcgggggtcatcacatcttgttatctccaataatagaagtgtgttagggattttgtttcgacaaaaaacttcattttataagctaattttgaggactatcatcaactgcgacaacatcaaggagttcattgctctatgtgaagtactagagcttattccagaggatgagctagaattgtctaggcagaagcagcctgatactatggcaaacaggagagcacagaaggttgccaggttcaaacgtcaaaaggctgcagaaacgaagctccaagagatcagagagagaaaagaaaggcgtggacgctcattgagagcagctgctttatctgccccaattgaagctggagaggaagatgacctggaggatgatggagaggaagaaagagaggcttggttagctaccatctcattggctctctgcaaggcgtttgatcttctcgacatgctaaagaaggaagaagaaatgcttctagctgtaaaggaaaggaaggcaaaggtttggtatgaccacctagcagtggtactacctctcagagatgcaactctagaaaccagttcaggagtcaatatcctttttgtgttgaccagttcagcaaggacttatacatatttgcatggaaaactatttcaatggttactgattaagcaatatactggttgagagtggtagatatgaaatttaggatgtaaacttcaaaggaaacaatgttgattccggcgcatgaatgaaatggatattgg

SEQ ID NO: 431 - DNA, 425 bp, Sorghum bicolor
gtttctggaggtaccaagcatcaccagggcggcaatggcgcctcccatctcagcatcacaaagcacaatcaccattctgaagatttttccaaaacctcctgcacctgataccagcagcaataacttcactgttggggccaaattcgacaacaggagggcacttttatgtggcttggtcgctgctgctgctggcaccgtgctgagccctgacatcgccggtgctgcttcgaagaggcggcctccaccaccagggccggcagaggagaagaaagacccgaatgttagcggtgtgcaggctaaggtgcttgccagcaggaagaggaaggaggccatgaaggaagctgtggccaagctgagggagagaggtaagccagtcgataagtgaaggccagattgccagaaccagtagcctcattatggctcga

SEQ ID NO: 432 - DNA, 1374 bp, Sorghum bicolor
tagctagatcagccattgatcgattgacatcgtcatggaggtttgcaatcttggcaataatgccatggaggctcagcagcagcgcgagcagagccaagccgggggctgcaccgacgacgacccggcggcggtgctgacgtgcctcacattcctggagcagaagatcgcgcacctccgcgccatcatcggcgcggcgccgcgcccgccgcggcagatggtgtcggccgagctcagctgcatcgccgtgcagctcgtctccatctccaagagcctcgccgcgaccggtggcggcggggccgcggcggcggaccaggacgacggcgccgcccgatcgccggccccgaacgacggcgacagcgactcgtccgaccatgacctcctccacgccgaggacgactacggcgacggcgacggcgacagcgatggccgcatgccaccggccggctcctacgaggtgatcgagctcggcaaggaggagatcctggcgccgcacgtgcactcgtgcaaggtctgcggcaagggcttcaagcgcgacgccaacctgcgcatgcacatgcgcggccacggcgaggagtacaagacggcggcggcgctcgccaagcccgcctccgcgccgtcgtcctcgctggcccggtgcttctactcctgccccttcgtcgggtgcaagcgcaacagggagcaccggagcttccagccgctcaagacggccgtctgcgtcaagaaccactaccgccggagccactgcgacaagagctacacctgccgccggtgcaacgtcaagcgcttctccgtgctcgccgacctgcgcacgcacgagaagcactgcggccgcgaccgatgggtctgctcctgtggcacctccttctccaggaaggacaagctcttcggccacgtcgccgccttcgacggccacgcgcccgcgctgccaccggaggacgacgacgctgttaccaatgctgtcggcctcggaactggctctggtcgcctgacgacgatggacaccgaggcagtgagcagaatggcgagcatggagttcttcccggacgccgtgctcgatggtctcgtctgttctgacatcaagggcttcgcgctcatggatggtggacaaggacaatatctggaggacgacgacggacgagggtcgctctcaccattgccaatggggctcgattcctgtgattttgatggatttgatctctttggggcaccagcaattgatttctgaactcaggagaaaacaaaaaagaaaaatgaaaactgatttgtcctcactcaattggcattttggcctacaaaaactaaagaatgatttgtcctcactcaattggcaattttagggtacactaaataatgatttgtcctcactcaattggc

SEQ ID NO: 433 - DNA, 7202 bp, Glycine max
acaaatcctagagtttctcctttggttgtgagtatgctaatttgtttcctcaagcttttattatctccattttctgcttcaaaacaaattacaaagtggattgacatcttttctgatcatctcttatgggtttgaatgatgcatgtaaaatgttgtaggaaagagagggacctgtgagtgtcacaaacatgggagaggagaatgttaaacaaccgttgttggagaggaagtactacaaggactgcccaggttgtaaagtggatcaagccaaagagttgagtgagggaaagggtgtacctgttaaaaatctttttatcatgtggatggtggtgctgtgtgctggtaattaacatttcactcttttctgagtattttttcacttctggaaaaattggttgttccagctctcctttttttttttactctcgggacgtgttagaaagtttcacattgtctgtatctattcttaaagtgcaacttatatatttattagacaatcatagttataatattatttaattttaagatgaaatctaatatgatattgaatcattttttttcttgaatgtgtacattgacggcacgtgaggtttgaacctagaatctcatgcagactaccaaaacccacaggactagtctgacccttgtgggtttgatatcaggtctatcttcgtgtatagcctgttcacgcaggcacatgtggagggggtgttgcttatagaggttgccaaatcaaagaccttaaaagttcaaccatgttggcaagaaaattgagttggtgcctaacttcagaactgaaactgaattgcaacactagtctttttcaagttgttcacttcttaacttaggttcatcctttttcttttattggagaaaatcagaaaaagatcatccttagtggttaccgattgaacatgactatttactctttctcttgaatgatgctgatattgtgtactataactctaaaaatagtgccttctaatcacatatgagtagtgggggagaattaaagttaaatgctaaattttttttatgggattttcaattttaatattttgaaaggaaaatcagtgtttgattctgtgttttaccagttgtcatattttgtatttctcaatcagttgaaacaacttctttgtcctttctgatatcactctattttgtcctgtacatgtacagcactgcctatatcatctctctttccattcctctatttcatggtgagtttaactatctactggggtatttactgttaccttttcatttgatgtatactctgattttgtgacattattttttaagttgtctgagaacacatctatatattttagtgcttcaagtttaatttcagtttttatttatttatatttataaataaaaaatgcagatagtgaaactcccttcaatcctcacatcatctctgtttggcatttcaaaaaggaatttaagatcaatccactgtttacgcatcatttttatatataatgtaaataattggttctataatgttggtttactgtaaatctttgttccagtcataaaaggaattaaaaacggttgtggaagacattcctctcccagtcccagcagctggttctcacagtagttttgtatttctgggaatgtttatggccaagactaacttacagaaggaagagatgtatttgagctagtttgaatgggagaaaagaaatcgctatcaatggaaagtgtgtctggagttataaagttgacttggtggtaaaaggagaagggagggaggaaaaggtcatgggtacaattgtccacgccaacaaaaaactaacaattaaccactaacatttaccgataaaaaaaatggaaagtgtgtcttattgcaaatagcaatttattctttggtcaatgtgaatgaattttagtcctccagtgagaccacttatacaaattgcaattttggcatgcaaacaactgattaatggtggtctcaagaactgaataatgttcaatctaagtaatttaaaagcctctgagtcattaatcagtaaattttgttcaatgtaccaagtaccctccatttcttcctcaataatattataccaatttctgttccctctcaaccatataattttcctgtgagactgataattgcaatatgttagatgtcataaagtcaattcttaattgcttattgttttccgttctgcttagtcacttgttatcgaaatactcacgaattttattaatgtttaactttatgctgatgcacataatatacatcatcattcttcaataatgcatcattttcaggtaagggattttaatattgcgaaaacagaagctgatattagttcttatgctggttatgttggtaagattacttctatgattttaatttttttaaatcttcaacaatccttgcaagttatttattagtgatggctggatgataaaaaatgctgtaggctcgtcattcatgcttggcagatgtttgacatctgtattatggggaattgtagccgatcgctatggccgaaaacctgttatagttatggggattattgcagtgtaagtatatttgtcaatcaattgaatgctttctttaagttatgctctatctgcagcttccagtacgaaattatcaatggttgcttgctttcagtgtcattttcaacacattatttggccttagcacaaatttttggatggctgttatcatgagatttcttctgggaagtttaaatggtttgcttggaccagtgaaggtatcaaagttagcactttcatgtttcaggatacaaattttgaatgtgtgtgcacaattggatatataacttgttcaatcgctttcaaacttccatttaaacttctgtttgcctaactcctctatttaacaggcctatgcctctgaactttttcgagaagaacaccaagctataggactctcaactgtaagcatcaccaactctgttatactagtagattttagaactacatttccataataataatcaaaagtgagatttgattttaggtcagtgcagcttggggcataggtttgatcattggcccagcattggggggctatttggctcaggtactatctaatattatttgctatttggagtatacctagaagatgcaacttgcataaaagctttgaattttgtatatgttggtaaaatgaattgttttgaattgaaagacttctggctttttgacaagtttgacgcctgaaattctgtatttaattgaggaatagaaatttttcaaataatccatcttccatattgaaaggaaaagaaaatgtgtttttcatttttttcacattttgcgttgttaagtacttgagtttctgtgtgagtgtgcatgcgcagggattgtggcaaacatatatctgcacatatttatcacttgtttatctaatattttgggaaaattttcattgtagccagtagagaagtacccacatatatttacaaaggattctttttgggataagtaagtgaacttttggattcaattttcctctcgtctttgtctttctatcattttatccttgaatgatgtgttgattttcatttatgaaaacataaattattctgcaggtttccatacttcttgcccaaccttataatttctgcattcgcatttgtagtagctattggctgtatctggattccggtatgcttcttaggttcaaacgtatttgtttattgtttacacatgtttcttatgttctaacaattttatgatcacattttataatttagaaccatcttcactgtctatattgtctagtctgtctcccacatcagcataattgtttaacatacctgcaggaaacacttcacaaccacaattgtagcaatgaatccacagacgatgctgaagctttagaaaatggaaacagtggagctggcaatgaaaagattaatgataacctcctcctgaattggcccttaatgtcatctatcattgtttattgtgttttctcacttcatgatattgcgtatcaagaggtataattcatttgtactcattgaggctaaaaaccatctatgcatctacataaatatatgctgcttggatttcctgctttttatccatgcatttttaagcgaacaacattcattcatcctgctttctttaggttttctcattatgggccgtcagtcctcaaaggctggggggtttgaactttacaaccgataatgttggtgatgttctttcaatatcaggtgcatctctggaaccaacaatatatgcttattactgtagggcatacatgttttcttcctaactttccttccacaaaagattgctcataaattttatgcatttacatgaggccacttgataactacctgctggttttttttctccttttattggtcttgttgaatgaatttcccttattaccaaacttaagtcaaataatctttagacatgtctcggtcatcaccataatttaccttgctttgagaatgactttcttgacctgatcatattctgaatgtagctttgtaaattcaaataagtatgttttgatatcaaaagctataggcatctcaaatatcatatctttctgtgcctaaatcagaattagtcagttgatttatatggtaaaaaatactttgatctcaaaaagttactaattcaaatgtatattggtcggtcaaaatgaactccatattactagcctctattactagccaatttttctagttataggactccaggatgctataactttgtcagcaaggttcttttatctttctctttataaaagaggaagcatgagcaatagccaagtttgcatgataataagtttggactttggagtttggaacagtattgacataattccataccacttgaaacaagttacatttattcctttagttatatacttttatcaaaattttgacatggtacaactcctattgcagaatagatattttgcataatgaatgacttctcaagttttcaggtcttgcacttattatttaccaacttaccttatacccatttgtggaaaaagctagtggacctattgttattgcccgcttctcaggggtgagttttcaactaactgtggcaatgattgtatttcagcatttcagtttttgtcatttgaaatatgtcctgttactttggttccatgtgcagatgttaaccataccacttttgcaaagctaccccttcatagcattgttgtcaggcttggcactatacatagtgataagtatagcttcaattctgaagaatattctgtctgtaagtgcacctcttcatttatttaatcatttattagtgattttgagggtttatatgaaattggataaactaagcctcagtagatcaatttatttgattcagaaaagtttctgtgttgcaaatttgactgactgtactctttcttattggatttagatcaccattataactagtttgttccttctgcaaaaccgagcagtggtaaatttttgtataatttcattgtcttttgattctatacaatacttgagactagttattaatgataacatgttaatttggacgacaggaacaacaccaaaggggggcagctaatggcatttctatgacagccatgtctcttttcaaagctattggccctgctacaggtggtgcagtgtgagtgttcctatgctgccttcagcttttattcaacttgtcggttcaaaaaatgtcaaatatacttgttataacacttgcatattaatgtacaagttttttcacgtgatctataataacacagaagattaatctaattcacgtgttcccaatacttcatgctaattcctttattatatggttctttcatgcctaactgttagttgactagattaaaagatgaaggtagcctgctacctgtcaatttatataccgtgagccttgccgtcatactgaacaatttaatagaaattactctcactatattttaatgcattagcagttaacaaagttttcacctgtagttcttaaccagatacattctgccacaagtatgatacattaagaatgatctaaaattttcttatatgatcatggtcaatgcagattaacttggtcacaaaagcggatggatgcttcattcctcccaggtatgatgttcaactaatttatttgttctagtttctgtttcatatatggaacatagaaccctctgactatcgttaaagtcagttagccttcaacaacagcagctttaatctgtgtgcacattagatcaaacattgcatttatttcaattaatctaaacaaagaaaaaaatatgtatgtggtggtacaataaactattgtgtaacaatcaagggggtctagctcagtcgattaagcagagtatgtaagtattataaattttctggtagcgtgtttaattcctacagataaaaaaaaaagggactattgtgtagcaagacaataatttcaatataaattaagagcattgattcttatgctagctgtattacttgagcttacttactattgtacatttaactgcaggcacccatatggtgttctttgtactgaacatagttgaagcacttggaatactaatgatgttcaaaccattccttgttgaaaagaagaaaacacactcagatcagttacactgataccaatcaattttgttcaaggcatgtagcatcggagctgctgtctaatattggggacaatgatggtaactttgtcatcacggggaccaatgatgattgtaactaaattaatggcaccaattcaatatgtagcttgccataaaaaaaacgtagaaacgtcacagaaaaaagaacaaaccaagctaatccaagtgaaaaaaagagtaccgaatattgtttttttaaaattgaaggtgatatcactatattccccttccccttcctggattgaatcccaactttgaacagtaacattgaaatcgttaaattgttagaggtttgtcatctttgatttgggaaaaaggaattattgtttgtgaaggaagaaactgctaatgttgtgtaaggttacccgtccttgtattcaagataaagagaatctctgttaagcaagaaaaacaagaaagagaaaataattaatatatttctgtcaaatttattcaatacaaagggaataatttatggctaataattgcacatttgcattacatgataactactattattcattacatgataactacttctatccactacatt

SEQ ID NO: 434 - DNA, 1362 bp, Glycine max
catagttggtgtagctagcgagggagggatatagggggaagcgtttattcattcattaagatggcatcggagcttcaattgcccccaggcttcagattccatccaacggaccaggagctggtgttgcactatctctgccgtaaatgcgcatcgcagcctatcgccgttcccatcatcgccgaaatcgacctctacaaatacgacccctgggacctacccggattggcttcctacggagagaaagagtggtacttcttttcaccacgggaccggaaatacccgaacggttccaggccgaaccgggcggcgggaaccggttactggaaggcaaccggggcggataagcccattggccaccccaaaccggttgggataaaaaaagctttggtgttttacgcagggaaagctccgaaaggggacaagagcaattggatcatgcacgagtatcgtctcgccgatgtagatcgctccgttcgcaaaaagaacagcctaaggttagatgattgggtgctttgccgtatttacaacaagaagggcacgatcgagaagttccaaccaagcagcgatgttgttgttagccgaaaaatggaatcatcggagatcgaagacaggaagccggagattctgaaaagcggaggaggttgtcttctgccgccggttccgccgccgcaagcgaaggcggcggtgaagaaggattacatgtacttcgacccgtcggattcaatcccgaagctgcacacggactcgagctgttcggagcacgtggtatcgccggaattcgcgagcgaggtgcagagcgagccaaagtggaaggagtgggagaaaagcctcgagtttccgtttaattacgtggatgccactctgaacaacagcaacagcttcacgacgcaattccagggcaataatcagatgatgtcgccgctgcaggacatgttcatgtactggcccaacaagcccttctgaacaaaccgatccacgccgcccattcgcatttgcacggtagcacgagactcaaggtctatgagtgtgcctgtgcgaccacacacagacgattatttatcaagttagcttagctagggcaaagaaagataaaaacattgaagctggaaacgcatgtgtttgttgggtccaccgtctgcaccggttctttttggtgttttgctatgtgacgacgacgacgacgatgacgatccaacggtgcatgtttgttgacctgtccctagtagtagtagcatgtgtacagctattgtatgtagaatgtagataggtacactactacacgttgttgtcatgtgatcatagaagctctcttaccgggaaaaataaaaattgatagaaggatggaaggtgtatttggacctt

SEQ ID NO: 435 - DNA, 1649 bp, Glycine max
cattgatggcgctccctcactccatctctgccttagccaccacactcacactctcctccccaataaccaaaccccataaagttaacccctttcccttttcctcgaaccgaaattcacaatttttaacgaaacaaacgcgacccagaagcagaagaaacctctccctaacccctgcacgcgttgcggcgccaccctcaacggttgaagccgatcgattatacccagaggccgaaaataacgaaactgaggaagagtttagcgacgagagctcttcctctaaattcacttggagggatcactggtaccctgtctcgttaattgaagatctgaaccctctcttgcccacaccgtttcagcttctgggtcgtgaaatcgtgctctggtacgacaagtccatttcccaatgggttgcttttgatgacaaatgcccccatcgtcttgcccctttatctgaagggaggatagatgaagatgggaagttgcagtgttcttatcatgggtggtcttttgatgggtgtggatcttgtgttaagattcctcaggcttcatctgaaggccccgaagcacgtgctattggatctcctaaagcatgtgccactaggttccctaccttggtgtcccagggtttgctctttgtatggcctgatgagaatggttgggagaaagcaaaggcctccaagcctccaatgttgcctgatgactttgacaaaccggagtttgccacggtcaacattcagcgtgatctgttctatggttacgatactctcatggagaatgtctctgatccttctcacattgagtttgctcatcacaaggtcacgggaaggagagacagagccaaacctctgccattcaagatggattctcgtggttcatggggcttctctggagctaatgaagggaacccacagatcagtgccaagtttgttgcaccatgttatatgatgaacaagattgagattgataccaaactccctgtagttggtgaccagaaatgggtagtatggatatgttccttcaatgtccccatggcacctggtaagactcgctccattgtttgcagtgctcgaaacttcttccagttctcagtgccagggcctgcctggtggcaagtcgttcctagatggtatgagcattggacttcaaataaggtatatgatggagacatgattgtccttcaaggtcaagagaaaatcttcctttcagaaaccaaggaaggtggtgacattaacaaacagtacacaaacatcaccttcacaccaacacaggcagatcgctttgtcttggcattccgaaattggctgaggcgacatggcaatggccaaccagaatggtttggaaacagcagcgaccagccattgccatcaactgtgttatcaaaacgtcagatgttggatagatttgaacagcacactctcaagtgttcatcatgtaaagcagcatatgagggattccaaacatggcagaaagtcctaattggggcaacagttgtgttttgtgcaacatcagggatcccatcagatttccagttgcgtgtacttttggctggactcgcagttgtcagcgcagccatagcttttgccctaaaccaactccaaaagaattttgaattcgtggattacgtgcatgcggaaatcgattaagcatag

SEQ ID NO: 436 - DNA, 1173 bp, Glycine max
aaagtcgacttcatcaaacaaacaaagccttcaacaatcaaaagcaaagaagtgaagagagagagaaagagatcattctagagacagagagaaaaattagcttcagtagatattagtggtgggtttgggtttcaagagaggagacatgcctaacttgaacccaacacttcaagtacttgcttcttcatacccttaccagatcccaaaggttacatgaagccatttctctttttaaatcttcccaacaccgagttcaattcttcacaagttgattgtaatcactcaatggctcattcttcttatccctacggcgatccaatttttgcttatggaccacaagctattagtcatccccaaatgatacccccgatgctgggactagcatccaccagagtggctttgccacttgatcttgcagaagatggaccaatttatgtcaatgcaaaacaataccatggtatactgagaaggcgtcagtcacgagcaaaacttgaggctcagaacaaacttatcaaaaatcgtaagccatatcttcacgagtctcggcaccgccatgctttgaatagggttaggggatccggggggcgatttctcagcaccaaacagcttgcacagtctaatgcagaatttgtcactggtgcacattctggttctgaccctaccaacagatatcaaaaggaacatctatcagaggtggaaagtcattcctcaaaagatggagataattcatctttcatcacaacctgctccgaccggccatgtttatctggcaacaatgtcaattttcggcagcaggagtgcatgtttctggggaattctgcaaacatgggtggatcaccacagttcagtgggggactcacctttggcggagcaaagcagcgcacatcagttgtccggtgagagaagaaactgatcgaaaccgacttcaccggtcaggcaaatcatccttggcttagtcacttttgtctgtgtctttatgtgttcgtactaaatgctcattttgagagacttttttcagtctgcattagcactataagacctttccaattgctttggcatgtattttaaagttgctattgtactggattttgaactggattggaatagtcttttgcatggaacttgtatgtttgtgttagttactgttgaatttccttgcttcaagagctcttt

SEQ ID NO: 437 - DNA, 1338 bp, Glycine max
ttggtttgtgtaggatgctttgcttgaaaggatggggtgcacttactctgtgtataggaagaaaaaatcaagcttccctgaagtggtggtctttgttccatcaacaagaattccggttcaatctgatctccaaaggatggtcaagggtgtaattccaagggatcttgctgataaattaacttcactaaggaatcagatagtgttgattgcagaggatactggtgggtcagctatagctgaattgcggcgagctttgaaagaatatttgtctgttctgattggacttacaaagaaagagtatggtcctgaaggactaatagatttcaagtggaaaaatttagaagatgggagacaagatagcagtatatcaaatacctggtttgaggtgctatcttcagttcaccttatggctatgctgacactctctgacgctgactcactgatgattccaaaggatccctcagggtctggattcagggttgtatcttcagatagcaagagggaagcaattgatttgttactcaaggcatcaggatacctggagttctgtgtaagggatgttcttactcggatacctgctgaaacaaagaaaacttttccccacgacttacaggaaggtgtattggaggctattgctattcaaacactaggccagggaactgagattcaacttggtcttgcggtggaaagtcagaaggcaactttgtctgtgaagaggaggttggcatgtgaacagctgatttactttactcaggcttatcactgcttgtcaggatgcgacatcaaccaagggcatggaaggaagcaaattcgatttatcaaatggaagttccttgaagccaaggctgcagcctactactaccatggtctgatccttgacaagggtagtgaaccaagcatccacattggttctgtgtcttgttttcttgctgcagaagagcttctggctgaaagcaagaaggcctgcttaagcttttgtcttgcacctccagtgacaagggctcctccactctggggtgctatgaaatttttacaccagaaaattcctgaagttgcatcaaggaagtcccagatgtatggttacctctgggagcaagagaagggtcttcaatcattgccagaccttcctgagttccaattatcattacgtccagatgactatgaattgcctgaaattgatccggcatgggatagtgaaaactgggaatctcttgggcagccattgaaggagcaccttagagatagtgatgagcatgatgagaatccaactgattgagaaatttgaatggtcttctttcttttgtattttgtagttgaatacatgcttgagtgtcagca

SEQ ID NO: 438 - DNA, 1302 bp, Helianthus annuus
tcagttgtagtttcggtttcagcttctctccaatgaggttctttcttctccacgtttgtacacttttttcggtagcacttttaggaagtcatgctgtgactcctgaagtatactggaagtctgtgttaccaaacagtcctatgccaaaatcaatcaaagatcttctatatacagaatggagtgacgagaaaagcaccgcagtgggggtaggaaaaggcggtgtaagcgttcatacaggaaaaccaggaaaacgaacagatgttggtgttgggaaaggcggcgtcggcgttcacaccgggaaaccaggaaaacggacagatgttggtgttgggaaaggcggtgtcggtgttcacactggaaaaccaggaaaacggacagatgttggtgtcgggaaaggcggtgtcggtgttcacactggaaaaccaggaaagggaacccatgttggtgttggaaaaggtggtgtaaatgtgcacacgcgccacaaagggaagccagtttatgtaggtgtgcgtaaaggacctaatccttttgtttacaagtatgctgcttccgagaatcagctcaaggataatccaaatgtagcattgtttttcaaggagaatgatttgcatcaaggcaaagaaatgaacctacacttcactaaaaacgacgaaaaagctacgtttttacctcgacaaatcgctgattcgatacccttttcgtcgaacaagcttccacaaatctacgaagagttctcagttaaacctgactcgatggaagccgagatcatgaagcaaacgcttagcgaatgtgagagtacaggcatccaaggtgaggagaaatactgcgcgacttcattagaatccatggttgattttagtacaaccaagcttggtaaaaatgtgaaagcgatttcaacagaagtaagcgctaaagaaagtaccccgttacaaaagtacaaaattgaagtcgctaaaaagcttgtggcgaataaagctgtggtttgtcataagcaaaactacgcatacgcggtcttttattgccataaaaccgctagtactcaagcttatgcggtttctatggttggtgcggacggtacaaaggtgaatgcggttgcggtttgccatactgacactgcaaaatggaacccaaaacatttggcgtttcaagtgcttaaagttaaaccgggaactgttccgatttgccatttcttacctgaagatcatgttgtttgggttccatacaaataaacttagcaagaaaaacacagaatacggtttatggttggtgtctagcgaccctatttatggtgttgttgcttcc

SEQ ID NO: 439 - DNA, 1273 bp, Solanum lycopersicum
tgttcccacgtatattcttgagattgtacatatactatagttttgactcataaataattcaagaacacacagcacattctcaagaaagggaaaaaaaatgtctagtcttaaagttccagcatcagttccagatccttatgaagatgctgagcaactcaaaaaagcttttaaaggatggggcacaaatgaggaacttattattcagattctggctcataggaatgcagcacaacgcaagttaatccgagattcttatgctgctgcttatggagaggatcttctcaaggacttggattctgaactgacaagtgattttcagcgtgtggtgcttctctggactttgagtcctgctgagcgcgacgcctacttggttaatgaggctaccaaacgtctgactgctagcaattgggttatcatggaaattgcttgtaccaggtcttctgatgatctttttaaggcgaggcaggcctaccatgctcgatacaagaaatcacttgaagaagatgttgcttatcatacaagtggggatttccgtaagcttttggttcctcttataactgcattcagatatgaaggagatgaggtgaacatgacattagcaagaaaggaagcaaatatactgcatgagaagatctctgacaaggcttacaatgacgaggagatcatccgaatcatttctactaggagtaaagcacagctgagtgctacgttcaaccactacaatgatcaccatggccatgaaatcatcaaggatctggaagctgatgatgacgatgagtacctgaaactactcagagcagcaatagaatgcttgaaaaccccagagaaacactttgagaaagttcttcgattggctatcaagaagctgggtacagacgaatgggatcttactagagttgttgccactcgggctgaagttgacatggagcgtatcaaagaagagtaccataggaggaacagtgttacattggaccgtgcaattgctggagacacttcaggagactatgaaaaaatgcttctggctctgattgggcacggagatgcttgaattacatgtgctgaaaccttaagataataaaaaaaactctacttattttctgaagtttgaatttgcttttatgatgtatggtgtgtactctcagagtttggttctgtgtttatatgaactaaaaacactcgggagttgagttgtgttttgttttcgccttcacttttcatttcggacttctactggttttgcctgctaaataagcatagcttcaactttggcttg

SEQ ID NO: 440 - DNA, 1078 bp, Solanum lycopersicum
tcttgaatgatcactttgtttgaagaatagggcaaaaaacctaaatcaagaatcatcaatggcttccaccattagctacacttcactttgttctttacttaaactcaaccaaaccaaccaaaaaaccccattttccccttccctttcttctccttcttctccttcttctttggttaaaatcaagaaccagttgtgttttagcagcaatttttgtagccacttaaataaagcttcaatctttatggttaaagcttcagaaacagaagcaactcagtcagaaaaagaagaagaagacaaatatgaagaatatgaagttgagattattcagccttatggacttaaatttactaaaggtagagatggaggaacttacattgatgctattgctcctggtggttttgctgataagactggaaaatttactgttggagataaagtcattgccaccagtgcagtgtttggagaggaaatatggcctgctgctgaatatggaagaacaatgtatactatcagacagagaattggacctttgctcatgaagatgcaaaagagatatggtaaggtggaagaagtaggtgaattgacagaaaaggaaattatcagagctgagaggaatgctggtttcattagtgacagagttagagaaattcaagtaacgaatgctcggaggaagaaagaacaaaaggagcaaagagaaagagaacttcgcgaaggactaaaactttctaagaatggcaaatacgaagaagcactcgaaaagtttgaatctgtgttaggatcaagaccaactggagatgaacttgctgtagcaagttacaatgttgcatgttgttattccaagcttaatcagcttcaagcagggttatctgccttgaaggatgcaatggaagcaggatttgaagatttcaagagaatcaggacagaccccgatcttgctaatctaagaacgtctgaggatttcgagacactcatgaaaaagtttgatgaatcgtttatcaatgagaatgccatcaacgcgattaagtccctatttggcttcaacaagaaatagaagcagcagcacatccataaactgtag

SEQ ID NO: 441 - DNA, 680 bp, Solanum lycopersicum
gctaaagaagagaatagatccaactatgtcaaataggcaactttgttcattagatagtgagaaatcacatttgatgaatacttgtaatttgttgactcaatttttcaatggaaaagcaaatatcaatgatctaaatcttacaattagtaacaatggagaagccaaagcctcagcaacaaaggatttgttaaccaacatggaagaattatcaactaagacaacagaacaagaccagaaattaatagatcatgttcctaaaagtgcaataaataaagccagcggcagcaaagagataccacataaggagcaaaagctagcccaattatctatattctatgggggtaaagtggtggtttttgatgattttccagcagagaaagccagagcagtgatgttattagctagcaaaggaatctctaacaactcttgtgccatttttcaaacccccaccaccactcagactaatggatccaacaactttgatttacctattgcaaggagatcttcactttataggtttcttgagaagagaaaagacagggacacggctagagcgccataccaaatgcataatccattgcaatcatcttcaaggactcgtggagatcattttgatctcaatttctagttataactcaactcttcgattcgaagatattgttagtaactaggacaacttg

SEQ ID NO: 442 - DNA, 1497 bp, Solanum lycopersicum
cccattcagtacgtagcacacagaaaaccagaagaaaaaaaaaataaaggttcaagaaaatatacagctgctatatacaacacaaaatgagcttgttcagattttttgcttccaccatacttttactattcttgatttcttgcttcagcttcagctcaacagatgcctttgatccacttgatccaaatggaaacattactataaaatgggatgtgatcagctggacacctgatggatatgtggctgtggtgacaatgtacaattttcaacaatataggcatattcaagcaccgggctggagtttgggctggacgtgggcaaagaaggaagtcatatggaccatgatgggagctcaaacaacagaacagggagattgttcaaaatataaaggaaatattccacattgctgtaagaaagatccaacagttgttgacatgctgcctggaactccttacaaccaacagattgcaaattgttgcaagggaggagtgatcaactcatggggacaagatccggcaaccgctgttagctcgtttcaagttagtgttggtgctgctggaacaaccaataaaacagtgcgagtacctaagaacttcacattaaaggctccaggtcctggttatacttgtggacctgctaaaattgtgaaatcgactaagtttgtctccgcagatgggagaagagtgacacaggctatgatgacttggaatgtcacatgcacttactcacagttcctagctcaaaagactcctacatgttgtgtgtccctctcatccttctacaatgacacgattgtgccctgcccgacgtgcacttgtggctgtcagagtaatggcactcagcgcgggagttgtgtagatccagaaacgccacacctagcttcagttgtatcagaccatgggaagaacaattatgttcctttggtacaatgcacaaagcatatgtgcccaattaggatacattggcatgtgaaactcaattacaaggaatattggagagtgaagatcactataacaaacttcaattacaggatgaattatacacaatggaacttagttgtccaacatccaaactttgacaacctcactacattattcagctttaattacaagtcactgactccgtatggatcaatcaatgacactgctatgctatggggtgtgaagttctacaatgatctgctcatgcaagcaggtccttcaggaaatgtccagtcagagctactattccggaaggatgcatcaactttcacttttgagaagggttgggcttttcctcacagaatttatttcaatggagacaactgtgtgatgcctcctcctgatgcatatccattcttgccaaatgccggttcacgatgggaggcgtctctgattacattagtggtgacattgatgtcttcaatggcagttgtccttacatacatttaaaaaattatcatctgtgtatagttcaatgtatatctgttttagtttgttatctctgggttgacatccg

SEQ ID NO: 443 - DNA, 1031 bp, Solanum lycopersicum
agccatggtgaacaaaaagcagtagagataaacactactactaaaaaccctccaaaaaaaaaatgatgatgatcggccgatcacctcccaccgtccaaatccctccttgggacgtcaccgatgatccaacggttgatgtttattccccattctccgttagccctgattctgctttcgatgttttgacggcgttgcagcgttacctgccatcaaatggtaacgatgtgatttttgactctgatgggttggatattccggtggatgcattttcatgtgataatttcaggatgtatgagtttaaggtgaggaagtgtgcacgtggaaggtcacatgactggacggagtgtccgtacgctcatcccggtgagaaagctcgccggagggatccaagaaagtatcattactcaggtacttcttgtcctgattttcgtaaaggtcagtgtaaaaaaggtgatgcatgtgagtacgctcacggcgtatttgagtgttggctacaccctgctcgctatcgtacgcagccttgtaaagatgggacccactgccgccggcgcgtctgcttcttcgctcacaccccggaacaactccgtgttttgcctcagaacagtccgaggagcttcaacgagtcgtctgattcgtttgatggatctccgggtcgggtcgggtttgaatctttttcgtcttctccacctcttgaatctcctccgatgactccacgtgggctggcggagtcgatgcgtaatatgcagattgggatggtgagaggtatgcgtagtatgcaaatgggttctcctgcgtttggttcacctcgtagcccatcaatactccgacccggattcatgagtatgccaacaactccgacccgtagtggagcgtcggtgtttgatcactgtgaagaagagccggcaatggagagggtagaatccggccgagatctccgagcaagaatttatgctaaactaagcatggagaactctcttgattccggtgcaccggatgttggatgggtttccgaactgctaaaatgaatgtga

SEQ ID NO: 444 - DNA, 1407 bp, Solanum lycopersicum
cagtttctgaagttgtcttgcttgttataaaagtgtgaatggcagaagtctgttttggagttgtgactgaaactgattcatcatcaccgtgtgaatcaagttcacgggcggtgaggaggaggagaatggagcttcgaaaaataaaggtcatagctggagtaacgcaacccgaaacagagaatggaattaaacgtccaaaaatgaaacttatttctggttctgtttcaaggatttgtgataacgctgtggaaagttctagcaccgacgatgatgaagaacaactgagattagtagagacgaaagggtcaccgccaactattattttgactccatatttgggtcctttgaattctactctccttgttcaatcagtggcttacccaaagtttggcttcgcctctgtttgtggaaggagaagagatatggaagatgcagtcgcaattcatccttcattttgccaaatggaacaaggaaacagtggagaattacattactttgccgtttacgatggtcatggctgctctcatgtggcgaccaagtgtaaagagaggttacacgagctggtgaaggaggagctggagaacacagaaggagatcatgaagagtgggagcatttaatgaaccgaagcttcaatcgaatggagaaagaagtgattgaatggaacaagagcgtaaccggagccacatgccgttgcgaacttcatacgccggaatgtgacgccgttggttcaacggcggtagtcgccgttgttacgccggacaagattattgtcgcgaattgtggtgattccagagctattctttgccggaatggcaaagctattcccctttctaacgatcaaaaaccggatcgtccggatgaacttaaccgcatccaggaagctggtggcagagtaatctactgggacggccctcgtgtttcaggcgttttggctatgtcaagagccattggtgataattatttgaagccgtatgtgatctgcgagccagaagtgacgataactgatcgaacgtcggaggatgactgtttgattttagcaagtgacggattatgggacgtagtctcaaacgacactgcatgtggcgttgccggaatgtgcctgaaagggaatgcatcgccggcgtcaatgccgggaaatggaaccgacggcgaggtgaattccgaccagtgttgctctgatgcatcgatgcttttgactaaactagcccttgctaggcggagctacgacaacgtcagcgttgtcgtggttgatttgaagaactacaagtagacagcattaaaacccttttttttttttttgcagcatttttttcgcttttatgtaacattttagtgtgtttattttggatggtgtttaaggtggtattcagttttttagattagttctttagacggttgaaattgga

SEQ ID NO: 445 - DNA, 1232 bp, Solanum lycopersicum
ccaccactttttctctatgatacacacaaataaataaataaattaggcctagatatctacttctatatatatatatatgttgatacagatgtatgtataatcttgagaatctttagtgaaaagaacttcctttttagcttaagcatatgtatgtaatagacacaagctaaacttgtgagtttttcttgaaaggggtttttctttaactgctgtcatccccagaaaaagaaagatcataattacttggggcaagtctaataatgcctactattgctaaacatgatggtcggcagctggagactgggctgcgaattacctcactatcaactacccaaatgcaaccatggtggcacggttatggtgataatactatgcctttggctagtgagaatgccgttgcccaggagaaatctgaaggtggcaaccaggataaagaaacaaaggctctagccatggaatctggatcagatggaaataacgagcaatacaagcagcacctcaagcattttgcacccacaactgctgccatcatggctgagcagcagaaggaactcacaggtcattcagctatgttggcgtcatatccatatccagatatgcagtatgggggaatgatgacttatggcgcacctgtacatccccacttatttgaaattcatcatgcccgaatgcctttgcctctcgacatggaagaggaacctgtctacgtgaatgcaaaacagtaccatggaatattaaggcgaagacagataagagctaaagcagagcttgagaggaaagctattaaagcgagaaagccatatctgcatgaatctcggcatcagcatgctatgagaagggcaaggggaactggaggccgctttctgaatactaaaaagctcaatgacatggactgtacaccaacggagactcaaaaatatggggcaaccattgcaactcactctggcaactcttctggttccgggagttctgatcaagggggaaaggaaggatctacagttcaagacatgcacaaaggacacagccagagtttcacaactggcaatggccatggttcatctgtgtatttttccgcgagcagtggaagtgagcaagggaatggccattacggtcatggaagttggagcctgctggtcaatcaggcttctcagggggcagcttccagcaattaagaagctactctccaatcgtggaggggtcagcccagcatggttccgtctcttgcgtcgtaa

SEQ ID NO: 446 - DNA, 1112 bp, Solanum lycopersicum
tgacatggctgctactaaatggggtttctctaattgactgtacaatcacacaaagcttaaagttttcatcttggtacaactattacttcactaggaacataattcctttagattttcaagagaaaaggtgtgagttgctcttgtataaccatgaatactactatattttccaaaggaaatgaacgggttgtccagaatcaatctgttggaacattgtgctctgctccttggtggagtaatggttttatgtctcaatctgtggcttatgctgagccttttggacaattgaaatctgcatctgtggagcagcagcctaaggggaatgcaacagagttcactatttcctctggtgattgcaaatcttcggcaaatgggcaaaaacttccgaacattcaggctgcttcctctgttcgtgcagctaatatggactatcgaggtcactttgagctaggttttggtcagtccctgatttatgcaaaacatccttatggagagcaatgcattgggttattttcggcttatgctcctcaactttcgggccgcattatgctaccattgaatttggcttctgatgaaggtccgatattcgtaaatgccaagcagtatcatgggatactaaggcgtcgaaagaccagggctaaggaaatggagaaaaaagctcttaaaccacgcaagccgtacttgcacctctctcgccatctccatgctttgcgccgacctaggggctgtggtggtcgtttcttgaacacaaggaatatgaatggaactatgaaggctggaaaaaccaacaatatgttcaagacaggcgatgttcaaaacttttaccccaccggatcccagaattctgaagtgctgcagtctgatagcagcaatttgagctcaccaaaagaaacatctggcagtaggttcttcgattcatcaggggtcgctaacatgtactctagtgacaatcttgatccttttctgttccaaaacctgaggcctccggtccaggcaataccggacatgatgaatactggacacggtattttcgtgtctggtaagtgggtttgcacagcagatagctgttgcaacctcaaagtatgatagccttggcttgagaaagaggtcag

SEQ ID NO: 447 - DNA, 1609 bp, Solanum lycopersicum
cttcctcgtaaaagctttgtatatacgacgtacaaagtttataaataaaaaatggcgagcgaagaaaggagggagacgctactaaataagagagaagagaaacactactacgaaaattgccccggttgtaaaatggatcttcacaaagcgggtcaaacgggtttacccgttaaggagcttttcactatatgggttgtcgtgcttggtacagcacttccaatatcatctctctttccatttctttatttcatggtaagggactttcacattgcaaagagagaggaagatattggttcctatgcaggttatataggttctgcatttatgtttggaagaactttaacatctgccttttggggtgttgtggctgaccaatatggacgaaaaccagttataattttcggcacttctatagtgattattttcaatactttttttggtcttagtgccaacttttggatggctgttgtaacaagatttcttcttggtagtttaaatggtttgcttggaccaataaaggcatatgctgctgagatttttcgtgaagaatatcaagcactaggaatgtcaacgattagtagtgcatggggcattggattgattattggtccagctttaggtggttttcttgctcagcctgcagagaaatatccagacttgttctcaaagggttcattatttgggagatttccctatttcttgccttgcctatgcatatcagtgttcgccttggttgtggctgttggttcattttggattccggaaacattacataaccatgattcagaaaggccgcgtccagattcttacaaggctctggaggctgcatcagatacaaaagacggaaatgaatcagccccaaaagaaaatctttttaagaactggccgttgatgtcatctatcatatcatactgcgttttcgctcttcatgatatggcgtactcagagattttctcattatgggctgttagccccagaaaatttgggggcttaagttattcaactgctgatgttggtgaagtactatcaatatcagggtttggccttctagtctttcaacttacattgtattcatcggttgccaagtatattggccctgtcatgactgctcgagctggaggagttttgtcaattgttttactgacgacttacccttatatcgctatgctgtctgggactaccctctccgtggtgatgaatgtcgtatccatgatgaagaatatcttatccatttccatcataacggggttgttcatattacaaaacaaagcagtggaccagcgacagcgcggagctgctaatggtcttgccatgacaggaatgtcattttttaaagctcttggaccagctgggggaggagcactcttttcttgggcacaaaaaaggcttcatgcttctattcttcctggtaatcatgtggtgttctttgtgttgaatatgattgaggcaattggtgtgttgctgactttcaaaccattccttgttgaagcacaaaatactaattaatcaaacgaaaatttatgtatgattatttttttaatattctattttacgtgttataacgattagaaattaaaaaaagggtgtcctattgtaaccaattcaattc

SEQ ID NO: 448 - DNA, 888 bp, Solanum lycopersicum
gtgcttttgtaagtttgagaaagaggaaaaagaaaaatgggaaggggtagggttgagctaaagagaatagagaacaagatcaacaggcaagtgacctttgctaagagaagaaatgggcttttgaagaaagcttatgagctttcagttctttgtgatgctgaggttgctctaatcatcttctctaataggggaaaactctatgagttctgcagtagttctagcatgctaaagacgttggagaggtaccagaagtgcaactatggagcacctgaaccgaatatatcaacacgagaagcactggaaattagtagccagcaggagtacttgaagcttaaaggacgttacgaagcattgcagcgatcacagaggaatcttcttggtgaagatcttggtcctttgaacagcaaagaacttgaatcacttgagagacaacttgatatgtcgctcaaacagatcagatcaactcggactcagttaatgttggatcaacttacagattatcagagaaaggaacatgcattgaacgaagccaacagaaccttgaaacaaaggttgatggaaggaagccaactaaatctgcagtggcagccaaatgcacaagatgtgggctatggccggcaaacaactcaaactcagggcgatggcttctttcatcctttggattgtgaacctactttgcaaattgggtatcagaatgatccaattacagtaggaggagcagggcctagtgtgaataactacatggctggctggttgccttgaaggctcacgattctgatcataacattattataaatatgctcaatggttttcctatcatcataaacattgaatatctcctaatttctgtatgttgtttgagaaaatgtttcatcctggacctaacgg

SEQ ID NO: 449 - DNA, 973 bp, Solanum lycopersicum
ttcttgaagacaaagtaatggtggaattgcaatttcctgctggatttcgattccatccaactgatgaagagcttgtgatgcattatttatgtcgaaaatgcgacgcacagccaattgctgttccgattatagctgaaattgatctctacaagtacaatccatgggatctacctgatttggctttgtatggtgagaaagagtggtatttcttttcgccgagagatcggaagtatccgaacggttcacggccgaaccgagctgcggggagtggatactggaaggcgacgggtgcggataagccgattggtcgtccaaagtcgatgggaattaagaaagctttggtgttttacgcaggaaaagctccgaagggagaaaaaacaaattggattatgcacgaatatcgacttgctcatgttgatcgatctgctcgtaacaaaaacaacagcctaagactcgatgattgggttttatgtcgaatctacaataagaaaggtacaattgagaagaatcaactgaatatccgaaaaatgaacggtgaaatgtcgccggcggtgagtgaaggtgatgtaaagcctgagatcgtgccgatttcagtttcaacaaacccatcttcgacgtcttatcacgtttacaatgacttcacgtactttaattcaccagattctcttacgaaacttcacgccgattccagctgctcggagcacgtaccttcgccggagttcacatatgagaaggaagttcagagtgagccgaagccgaaaccgagtgagtgggaaaaaactgcccttgattttccatttaattacacagatgccactgcttctgagttgcagagttgttatgagatgtcaccgctacaagatatattcatgtatctgcaaaagccgttttgagtgggcctcgcattgttgttcgcacgtgcgaatgagactgaagtcgatgacttggcacgtgccgatgatttgtaggaatt

SEQ ID NO: 450 - DNA, 2390 bp, Solanum lycopersicum
gttggtccaatggcatcatcaattgtacaaaatggacatgttaatggagaagctatggatttatgtaagaaatcaattaatgttaatgatccattgaattgggaaatggctgctgaatcattaagagggagtcatttggatgaagtgaaaaagatggtggatgaatttagaaagccaattgtgaaacttgggggtgaaactttaacagttgcacaagttgcatccattgcaaatgttgataacaaaagtaatggggtcaaagtggaactttctgaaagtgcaagggctggtgtgaaagctagtagtgattgggtaatggatagtatggggaaaggtacagatagttacggtgtgactactggatttggagcaacatctcatagaagaactaaaaatggtggtgcacttcaaaaggaacttatcaggttcttgaatgctggagtttttggaaatggaacagaatcatctcatactttgccacattcagcaacaagggcagctatgcttgttaggatcaatactctgcttcaaggctactctggcattagatttgaaattttggaagcaattactaagttgatcaacagcaacattaccccgtgtttgccccttcgtgggacgatcactgcatcgggtgatcttgtcccgttgtcatacattgctggtttgctcactggcaggcctaactccaaggctgttggacctaatggtgagaaacttaatgctgaggaagcgttccgcgtggctggtgttactagtggatttttcgagttgcagcctaaggaaggacttgcacttgtgaatggtactgcagttggttctggtatggcatcaatggtactgtttgagtccaacattcttgctgtcatgtctgaagtcttgtcagcgattttcgctgaagtgatgaacggaaagcctgaattcactgactatttgacacacaagttgaagcatcaccctggccagattgaggctgctgctattatggaacacattttggatggaagctcttatgtcaaggcagctcagaagctccatgaaatggatcctcttcaaaaaccaaagcaagatcgttatgctcttcgaacatctccacagtggcttggacctcaaattgaagtcatccgtgcagcaactaagatgattgagagagagattaactcagtgaacgacaacccattgatcgatgtttcaagaaacaaggccttacacggtggaaacttccaaggtacccctattggtgtgtccatggataatacaagattggcccttgcatctattgggaaattgatgtttgcccaattttcggaacttgtcaacgactattacaacaatgggttgccatctaatctcacagcaggaaggaatccaagcttggattatggactcaagggagctgaaattgcaatggcttcttactgctcagaacttcaattccttgcaaatccagtgactaaccatgtccaaagtgctgagcaacacaaccaagatgtgaattcattgggcttaatctcagcaaggaaaaccgctgaggctgtagacatcttgaagctaatgtcatcaacctatctcgtggcgctttgccaagctatcgacttaaggcatttggaggaaaacttgaggagtgctgtcaagaacacagtgagccaagtagctaagagaactttgacaatgggtgctaatggtgaacttcatcctgcaagattctgcgagaaggaattgcttcgagttgtggacagggaatacgtgtttgcctatgctgatgatccctgcagctccacctaccctttgatgcagaagctgagacaagtccttgttgatcatgcaatgaagaatggtgaaagtgagaagaatgtgaacagctcaatcttccaaaagattgtagctttcgaggacgaattaaaggccgtgttgcctaaagaagttgagagtgcaagagctgttgttgaaagtggcaaccctgcaattcctaacaggatcacagaatgcagatcatatccattgtacaggttggtgagacaagaacttggatcagaacttttgacaggtgaaaaagttcgatcacccggtgaggagatcgacaaggtgttcacagcaatgtgcaatggacagatcattgatccattgttggagtgtctcaagagctggaatggtgctcctcttccaatctgctagatgcttgccagaaaaaaagaccagttgtgaatgcttgtctagtgctatttttcagattctttttttgctttatggtgaattactatcataatatgttgtgaacttacatcttttttggttaacttgagagagtgttaaactctcttaaatatgaatatgtctcttttcagtaaaaaacttaaatgaaaagtgacagtgtgcttatgtctattcaa

SEQ ID NO: 451 - DNA, 1390 bp, Solanum lycopersicum
ttaccgtcgacgttcctaattttttactaatcatcatggcacgcttggcaccagaaggagctcaatttgatgctcgacagttcgattctaagatgaatgatttacttgccgctgagggaaaagatttctttacttcatatgacgaggtgtatgacagtttcgatgctatgggtctgcaagaaaatcttctcaggggcatttatgcttatggttttgagaaaccatctgccattcagcagaggggtatcgtaccattttgcaagggacttgatgtaattcagcaagctcaatctggcacagggaagacagctactttttgttctggaattttgcagcaacttgattatggtttaattcaatgccaatcattggtgttggcacctactcgagaacttgcacagcagattgagaaggttatgcgagcacttggtgactatcttggggttaaggtccatgcttgtgtaggtggcactagtgtcagggaggatcaacgcattctcgcagctggtgttcatgttgttgttggcacccctggacgtgtgtttgacatgttgcgaagacagtccctccgtcctgattgcctcagaatgtttgtgctagacgaggctgatgaaatgctgtcacggggttttaaggatcagatatatgatattttccagatgctgcctaccaaagttcaagtcggagtgttttctgcgaccatgccaccagaagcccttgacatcacaagaaagttcatgaataagcctgtgagaatcttggttaaacgtgatgaattgacacttgagggtatcaaacagttctacgtcaatgtagataaggaggaatggaagcttgagacgctctgtgatctatacgagacacttgccatcactcagagtgttatctttgtgaacactaggcgcaaggtcgattggttgacggacaaaatgcgaagccgtgaccacacggtttcagctacacatggagatatggaccagaacactagagacataatcatgcgtgagtttcgctctggttcttcccgtgtccttatcacaactgatctgttggctcgtggtatcgatgtacaacaagtatcccttgttatcaactatgatctcccaactcagccggagaattatctccatcgtattggaagaagtggaaggtttggaaggaaaggagttgcgatcaactttgtgacaacagacgacgaaagaatgttgtttgatattcaaaaattctacaatgtggtcatcgaagaactcccttcaaacgtcgctgacctcctctgaaaacttcatctttataaggtgagtaccaagcttatagtatagaagaaatcattttaaactaccattattatctatcgtcaaaaacgcacccctggcattaatgttgctaagaa

SEQ ID NO: 452 - DNA, 401 bp, Solanum lycopersicum
caaagatggcacaatacggcaatcaagaccaaatgcgcaagactgatgaatatggaaaccatgtccaagaaacaggagtctatcaaggtaccggtactggcggtatgatggggggcacgggtactggcggtatgatggggggcactggtggagaatatggaactcaaggcatgggtactggtactcatcaccatgaggggcaacagcagcttcgtcgatccgacagctctagctcgtcggaggatgatggagaaggtgggaggagaaagaagggtttgaaggagaagataatggagaagatgcctggacaacatgaaggtgagtatggacaaacaacaggtgaagagaagaaaggaatgatggacaaaatcaaggacaagatccctgggatgcattgataa

SEQ ID NO: 453 - DNA, 1488 bp, Triticum aestivum
tccaacagaggctgggaaccttaaagcggaacagggttcatggagggtggaggcgcaagaaatgtttctgcagcggcagcacagacaaaggaaagtgcggatgatggctcctgcaagccactgcctccttgctgtgtcaaggcgcaggctgctgtggcggaatctgaggccaagtgccacgctaccgtggtgtctgggtggttcacaggaacccggtcacgctctggcaaaccaagcaaagcgcagtacttcaacaatccaatgtggcctggggaggctcattcgttgaaagtagagaagattttgtaccaggggaaatcgccataccaagaagttttagtatttgagtcttcaacctatgggaatgtccttgtgcttgatggaattgttcagctcactgacaaggatgaatgtgcataccaggaaatggttactcaccttgcactgtgctcaattccatctcctaaaaatgttttggttgtcggaggtggtgatggtggtgtactacgagaaatagccaagcatgattcagtggagagtatagacatatgtgagattgatcagctagttattgatgtttgtaaagattttttcccacgtctatatgttggatataaagaccctcgtgtcaaacttcatgttggtgatgctgtggagttcttgagaaactctccagaaggaaaatatgatgccattattgttgattcatcagatccaattgggccagctcaggaacttgtggagaagcccttttttcagacaattgctagggctttaaagcctggcggtgttctttctaatctagctgaaagtatgtggctgcacacacatctaatccaggatatgctttctatctgtcgagaggtattcaagggtggcgtgcactatgcctgggcaagtgttccaacatatcctagtggtgtcattggatttttgctatgtgcgaaggaaggcccaccggtggacttcttaactcctgtgaatccaatcgagaaaattgaaggagctactaaagatggacgagagatgagattttacaattcagagattcataaggctgcttttattctgccaacgtttgtaaagagggagctggaggcatataactcttccactgaaaaggagagaccggagaagccaaccgcaaaaccagtgaagatgaaggtaatgcgggacagcgctattaccgcttcctagaccgcgggcggacacctgtgtgctatccatcttccccgatgagacccgccgcatctgtatatccacgttccacgcctgtcctttgctaccaaattttattcaatagttacatgattgtgtggtgctctagcatagttgcgtgacacgactgagggtgtaatatcactaaatgtgtatggtgtgttgcagttggtgaataaaggagcaaacagaaggggatgtgtgatgtgtttcccttatctgtaacatgtatgatgtttcattgttgcgtgagttctcgtggtgcaagta

SEQ ID NO: 454 - DNA, 587 bp, Triticum aestivum
gcagtgaaagagaagaggctaatcaagctcaacagccttcttttccagagagtgtgctgtgtacgtagcagagcgaagagttagagccatggctggggtggtcggcgtctggttcgccaagttcggccgggaggcggcgccggcggtagaggcagaggccgaggtcgtcggacggcgacaccagggcgacggcctgctcgaggtggaggccgtgaagacggtgcagatccaggagaggaggaggaggaacagcgccgtcctcgccaactccgaggacacggtgtgcatgctcatggaccgcttcgccccggcctgatgcgccggtgaaccggcggtgtccgtacgtacgtgtaaattccagggcacgtacgtaggggcgcgggcacaagggaggagccataccttgatgtgcgggttcctcttgtacataagctctttttcatcgctaatcgagtgatagtagtagtagtgctcatgcctcccgttaaaaaaaagataaataaataaagcgcccagtcgaatcaactgtatcatatcatgtactcctatgtagtatgactgtatcctttgaatggattcgtttggtt

SEQ ID NO: 455 - DNA, 467 bp, Triticum aestivum
acatccttcagctagccaaatcccaggcatggacggaaagaagaagcccactgctgcgactgggagctccatcgtcgacgacctcttcggccccaaggacggcgccgcctcctcctccgccggctacttcagcaccgtcttcccaactccatctggggcgacggggaaagatgcgtcgctccgggcagcagcagccgctgggaataaatcatcgtcggcagggcatcagcagcaaggaaagcagcacgggggctcacctgagtcgccttacttcggctcctcttccgtccactatggcggccgggacttctacgccggcgccgaatctcagcgccaatatccggccgccgctgccgcaccggcacccaagcacaaggacgacggcgacacatcggcagccacccggggtgactggtggcaaggttccctctactactagcactagcaggaaagagagactggtgtga

SEQ ID NO: 456 - DNA, 1337 bp, Triticum aestivum
acagccatcggaatcaacagcagcagcagcggagcgatctcatcgaccaactctcttccaagtttcgattcaacggacatggggatgccggcggtgaggaggagggagagggacgcggaggcggagctcaacctgccgccgggcttccgcttccaccccaccgacgacgagctcgtggagcactacctgtgccgcaaggcggccggccagcgcctgcccgtgcccatcatcgccgaggtcgacctctaccgcttcgacccgtgggcgctccccgaccgcgccctcttcggcacccgcgagtggtacttcttcaccccgcgcgaccgcaagtaccccaacggctcccgccccaaccgcgccgccggcaacggatactggaaggccaccggcgccgacaagcccgtcgcgccccgcggtgggaggaccatggggatcaagaaggccctggtgttttacgccggcaaggcgcccaagggggttaagaccgactggatcatgcatgagtaccgcctcgccgacgccggccgcgccgccgccagcaagaagggctcgctcaggctggacgactgggtgctctgccggctctacaacaagaagaacgagtgggagaagatgcagctccagcagcaggggggagaggagatgatggtggagcccaaggaggagcacgccgcgtcggacatggtggtcacctcgcactcccactcgcagtcccagtcgcactcgcactcctggggcgaggcgcgcacgcccgagtcggagatcgtcgacaacgacccgtcgctgttccagcaggcggcggcgttccaggcccagagccccgccgccgcggcggcgcaccaggagatgatggccacgctgatggtgcccaagaaggaggcggcggacgaggccggcaggaacgacctgttcgtggacctcagctacgacgacatccagagcatgtacaacggcctcgacatgatgccgccaggggacgatctgctctactcgtccctcttcgcctccccaagggtccgggggagccagcccggcgccggcggcatgccggccccgttctaagcagagccaagacacagaccgtcagataccgagatcgacagaagtggaacggatgacttcttcgccgcgagcgagcgagatcgcggcgcagtgtaaatacagcataggaaacgggagggaggtcgcgtcgtcgtgtcgagagagccggcgtggcgcgggcgccggcgccggggcgtgccgttgtacatggagagcccggtgccggggcctggccggctgggttgattcttttgttcttactactttgtactctcaatgcggatgtagctctttct

SEQ ID NO: 457 - DNA, 769 bp, Brachypodium distachyon
aagaatgtcgtcggcggtagaagccatgtcctgctccaaggtcgatgtcgcggcggtgccggaggaggccaaggagcgcgtggtggtgatggagcacggcatcaacggaggaggcgccgacgccgccgcgaccaacgggaagcgcggcgaggcgcaatgtggccgcaaggacgacggcggcgaggaggaagacgacgaggacggggagaaggtccccgaggccatcgagctcggccccatcctcagcatcaaggaccagctcgagaaggacaaggatgacgacagcctgaggaggtggaaggagcagctgctgggcagcgtggatttgaactccgtgggagagacgctggaaccagacgtgaagatcatgagcctatccatcatatccccggggcggcccgacatcttcctgccgctgccggtggagcccaacggcaagggggtgtggttcaccctcaaggaaggctccctgtacaagctcaagttcaccttctccgtcagcaacaacatcgtctccggcctccgctacaccaaccgcgtctggaagaccggcatcaaagtggacagcaccaaggagatgctcggcacgttcagcccccagcaggagccgtacacgtacgtgacgcctcaggagaccacgccgtcggggatgttcgcccggggatcctactctgccaggaccaagtttctcgacgacgaccggaagtgctacctggagatcaactacacgttcgacatacgcaaggactggccgtcgtcgagctgataa

SEQ ID NO: 458 - DNA, 867 bp, Brassica napus
ttcggaaacaaacttctcaaggcttttgaaggggaggagggggaagacgagtttgatctgattttgattgatgtctggagctgtatctggttccagggacatgggtttcgtcgacaacaacaacaacaagaaagatggagacgacggtaacacttccaaaacggcgtcgtctcatcaacacgagggcaccgacgacgagggcgctggatccttggggaggcaaatgagcgaagcctctcttagcgcagctgaggaggaagaagacgatgactccaaattacaattgggtcctcagtacactatcaaggaacatctcgagaaggataaggatgatgagagtctgaggaagtggaaagaacagctccttggaagtgttgatgtcaccaacattggagagactcttgaccctgaagtgaagatcattagcctggtgatcttatcgccaggaagaccagatattgttctaatggttccggagaatgggaacccaaaggggatgtggtttactttgaaagaagggagcaggtactgtttgaaattcacgtttcaggttaaaaacaacattgtctctggtcttaggtacaccaatactgtttggaagaccggtgttaaagtggatagaggaaaggaaatgcttggaacctttagtcctcagtcggagccatacaaccacgtgatgcctgaagagaccactccttctggcatgtttgctcgaggatcttattctgctagaactaagtttcttgatgatgataacaagtgctacttggagatcaactacagcttcgacatccgtaaagaatggcctgctgtttgaaaactcaagaacaagtcacatgagatgatgtgttgtcagtagaagttgtg

SEQ ID NO: 459 - DNA, 635 bp, Zea mays
aggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttacggcggcggcggtgaccgcggctacgggggaggaggcgaccgtggctacggcggcggcgaccgtggttacggtggaggtggcgaccgcggctacggcggcgaccgtggctacgggggaggcggcggctatggcggtgggtacggtggaggcggcggtggaggcggccgcggctgcttcaagtgcggcgaggagggccacatggcaagggactgctcccagggcggcggctacggagggggaggcggcggcggccgcggcagcgagtgctacaactgcggccaggagggccacatctcccgcgactgccccaacaaaaggcgttagtaa

SEQ ID NO: 460 - DNA, 1269 bp, Oryza sativa
actagtccactccctcgcttcgcatctcgcctctggtgatgagagcggacagagccgagctgagggaattaaaacccccttatcctctctctgcccccgggctgccattgctggatccaaccatctgcccccgccacgcctcgtctcgcgctagccgtctcgcgtgcgtgcgcgcgcgtcgcgccgcgccctcgttttggagccttgcgccccgctactttccccttgtcccgaacccggaatccgcctcggcgagcgtccttgctttgcttctttggtatctgtgctcccgtttgctttgccttgccacgctccttcctcctcctcattgtctcctcccgtggttcggctcattctgttcttgggttgacgcgggctgcgtgcgtgcgtgcgtgcgtgcggaggcgatgtcgtcggcggtggatgccatctcctgttccaagggcatcgcggccccgccgacggaggaggcgacgaaggagcgggtggcggtggtgggcaagaacggcggcgtggagcacggcggcgacgccgcgacgatgaacgggaagcagtgcggcgaggcgccgcattgccgcaaggagagcaacgaggaggaggaggatgacgaggagaaggcccccaaggccatcgacctcggcccgcgtgtcagcatcaaggaccagctcgagaaagacaaggacgacgagagcctgaggcggtggaaggagcagctgctcggcagcgtggatttgaactccgtaggagagacgttggagcctgacgtgaagatcatgagcctggccatcctctcgcccggccggccggacatcttcctgccgctgccggtggagcccaacgccaagggcgtctggttcaccctcaaggagggctccctctacaagctcaagttcaccttctccgtcagcaacaacatcgtctccggcctccgctacaccaatgccgtctggaagaccggcatcaaagttgacagccacaaggagatgctcggcacgttcagcccccagccggagccgtacacgtacgtgacgccggaggagaccacgccgtccggcatgtttgcgaggggatcctactcggccaggacgaagttcctcgacgacgaccggaaatgttacctggagatcaactacaccttcgacatacgccgagagtggccggcgttgagctaatgatcagctgagccgtttttccggtggtggtcgccgagtagaagggtgaggcgccggccggccggcattcatgctgtgtgttactgtcgtcaccgtt

SEQ ID NO: 461 - DNA, 1547 bp, Oryza sativa
cagcaatggcgttcgcggcgaccaaaccgagcaagtctccccttctcatcctcctcgtctccggcgtcgcgttcctgctcctcgcctccgccgtcgagtgctacggcggcggccgccacgatgtgacgcggtcggccgtggcgcggcgctccggcgtagggagccggcggcagtacgtgcgccaccgcctgaccggcgccgccgtggacgttccgcacaggtacatgctcgccgagaagggcagcaactcgactcgcgctaaccacacctcgccggcggcgtcgaactcgacgccgtcagcgacgactacgacggaggcggcggggaagcaccaccgcagccacaagcaccgcgtgaggaactggatcatcgggttcgtggtcgggtccctcgccggcgtcgtctccgggctggcgatgtcggtgctgttccggatggcgctgaactgcgtgcgggggcggtaccggagcaagtccgacacggtgatcttcatcccgaagctgatcaagagcaaggagcacctggcgttcctggagaaggaccaggacgggctggcgtcgctcgccgtgatcgggcgcggcggctgcggcgaggtgtacaaggcgcagctcccgccggagcgggaaggcgacgcgccgcggttcatcgccatcaagaagatcaagaagcgctccggcgacggctccggcggccagaacaacctgagcgacgaggagagccggcagcttgacaagtggacgcggcagatccagtcggagatccgcaccgtcggccacatccgccaccgcaacctcctcccgctcgccgcccacgtcccgcgccccgactgccactacctcgtctacgagttcatgaagaacggcagcctccacaacgcgctcaaggccaccaccaccgacaccacgacgaacgactacaacgacaacaacagcggcgagcatccgccgccgcagccgccgccgtcgccggcgctgccgtggccggcgcggctgcggatcgcggtggggatcgcggcggggctggagtacctgcacgtgtcgcagcggccgcagatcatccaccgcgacctgaagccggcgaacatcctcctggacgacgacatggaggcgcggatcgccgacttcgggctggccaaggcgatgcccgacgcgcacacccacatgacgacctcgaacgtggccgggacgctggggtacatcgcgccggagtaccaccagacgctcaagttcacggccaagtgcgacgtgtacagcttcggcgtcatcctggcggtgctgggcaccgggaaggagccgacggacaggttcttcgcgcagcaggtggtggacgacgtcgggatcgtgcggtggctgcggcgggtgatgcaggaaggggaccccgccgcgcaggccggggtcatcgacgccgccatcgccggcgcgggccacgacgagcagatcctcctcgtcctccgcatcgccgtcttctgcaccgccgacgaccccaaggaccgccccaccgccaaggacgtccgctgcatgctctcccagatcaagaactagcaatag

SEQ ID NO: 462 - DNA, 1992 bp, Glycine max
aagtgagtgtaacaatggctgagaaaatgaaaactcactactttcctctcttttcattctttttcttcttcttcttaatctccatcaacgccaaacttgatctctacccttcagactacaaggcactcctcactctgcagaaggacctccgagtcaacggtcaactcgcggcggcaactgaggcgtgcgaaacggagggcgtgctctgcgagcggaggcggctctccggcaaggaaacctacgcgctccgaatcaccagactcgtcttcaaatcgaacaacctaaatggtgttttgtctccttccatcggacgcctcacggagctcaaggaactctctctctccgacaaccaactcgttgaccgagtccctccccaaatcgttgactgccgaaagctcgaaatcctcgacctcgccaacaacatcttctccggcgaggtcccctccgagctctcctccctcacgcgcctccgcgtgctggacctctccaccaacaggctctccggcaaccttaattttctcaaatactttcccaatttggaaactctttcagtagccgacaacctcttcaccggaagagtccctccctcggtccgctccttccggaacctacgacactttaatttctccggcaaccgcttcctcgacccctctctacaatcatcctcaccagacacaattctctctagacgttttctatcagaagacggtgatggtgatgttcctgcacctgctcctgcacctaataactcacagaagaagaaatccaatgcttctactcatgctgctgctgctgcacctggtcctgcacctaaccataccaataagcacaagcacagtaagagaaaactcttggggtggattctggggtttgtagcaggggcactggggggaaccttatcaggattcgtgttttctttgatgttcaagctcgctctcgcgttgatcaaaggaagaggaaggaaagcggggcctgatatctatagtccattgatcaagaaagcagaagatttggccttcttggaaaaagaagaaggaatcgcgtcgttggagatcatcgggcgcggtggctgtggagaggtctacaaggcagagttaccgggaagcaacgggaaaatgatcgctataaagaaaatcgttcagcctccgaaagacggtgctgagttagcagaagaggacagcaaggttctgaacaagaaaatgaggcaaattcgatcggagatcaacaccgtgggacaaattagacacagaaaccttctgcctctgctggcgcacgtgtctagaccggaatgtcactaccttgtgtacgagttcatgaaaaatggaagcttgcaagacactctgagcaaggtcgagaggggcgagagcgagttggattggttgtcaaggcacaagatctccctcggtgtggctgctgggcttgaataccttcacatgaatcacaacccacgaatcattcatagagatctcaagcctgctaatatccttcttgacgatgacatggaggcaagaattgctgattttggactcgccaaggctatgcccgattacaagactcacataacaacctccaatgtggctggcactgtgggctatattgctcctgagtatcatcagatactcaagttcactgataagtgtgatatttacagttatggagtgattcttggtgtattggtcattggtaagcttccttctgatgatttctttcagcacactgaagagatgagtttggtcaagtggatgaggaagactttaagctccgagaatcccaaggaggcaattaattcaaagctgctggggaatgggtatgaggagcagatgcttcttgttttgaagattgcatgcttttgcactatggatgatcccaaggagaggcctaacagtaaggatgttaggtgcatgctgtcacagatcaaacactgaatctgctgtatgtttaagtatgtgaaatattgtgtaccatatttgtgccaaagtgtgcttgtttaag

SEQ ID NO: 463 - DNA, 674 bp, Panicum virgatum
gggagatggcggcggagcgggctcaggggacggtgaagtggttcaacgggaccaaggggttcggcttcatcagccccgacgacggcggccaggacctcttcgtccaccactcctccgtcaaggccgacggcttccccaacctcaaggacggtgacgccgtcgagttcaccgtcggcgccgacaacgacggccgcgccaaggccatcgacgtctccgcgcccggcggcggcgcgctcgccggcggggagcgcccggacaacggctacggcggacgcggtggcggcggctacggcggcggaggcgaccgcggctacgggggaggcggcgaccgcggctacgggggaggcggcgaccgcggctacggcggaggcggcgaccgcggctacggtggaggaggtgaccgcggctacggcggaggcggcggcgaccgcggctacgggggaggaggtggcttcggaggaggcggcgaccgtggctacggcggcggcggcggaggcggccgcggctccgggtgctacaagtgcggcgaggagggccacatcgcacgggactgctcccacggcggcggcggctacggcggaggcggctacggcggaggccgcggctctgggtgctacaactgcggtgaggacggccacatctcccgcgagtgccccaacaagaggcgctagtaa

SEQ ID NO: 464 - DNA, 1071 bp, Triticum aestivum
gggaattgcttgctctctctctcgttctctgtgccgggcatggcgtcgagggacttcttgggcaggttcggcggggagaagggcgcgtcgtcggacaaggcggggggcggcgccggcgagccggacgaggtggtcgagcttagcctgggcctgtccctgggcggctgcttcggcgccaactccggccgggacgccaagaagccgcggctggtgcgctcctcctccctcgccgccatgtgctcgctcccgggcaccagcgacgacatcgccgccgcgacgcccccgccggcgccgctgatgcgcaccagctcgctccccaccgagaccgaggaggagcggtggcgccggcgcgagatgcagagcctcaagcgcctccaggccaagcgcaagcgcctcgagcgccgcacctccatgaactccggcaagtccggcggcagcagcagccgggacgacgcccaggagccgctctaccccagcgcgttccagctccgccgctccgtcgtcgaccaggggaacgcttcctcaagcatgccggagcaaggtagcggtgatggcgctgaggcgaagagcacatcgagcatggagatatcttctgataataataaccagaacaaatccctcccgccgccggcaccatctacggccgggaagctgccgaacggcatcgtcaaggagcaaccgccgttgcggaccctcaggtcgctgacgatgcgcacgacgagcaccggcgacctgcggaagagcatgatggaggacatgccgatggtctcctccaaggtggacggccccaacggcaagaagatcgacggcttcctctacaagtacaggaaaggggaggaggtgaggatagtgtgcgtctgccacggcaacttcctcacgccggcggagttcgtgaagcacgccggcggcggcgacgtcacgaatccgctcaggcacatcgtcgtcaacccctcgccgtcggtcttcttgtaatgccggaatgtacgtagggggagagatgctcttttcctctctttccttttttactctgaatttttagctatcattacagtgtattatgtttagcggcct

SEQ ID NO: 465 - DNA, 975 bp, Triticum aestivum
acccagcagcaactcgtcgacgcagagcggaggagcgaaggaggccggccggcgagatcgacgcaaatgcagatggactcctactacttccacgacgacgcccacttcttcgccggctgcggcgtccccggctcgccggacctgcccttcgccgacctcattgcgtcgctgtcggagccgctgcctgaggtggcgagccagagcgcgttccgggagtaccgcggcgtcgggctggagcttccggggacggcgcggggagggacggggaacgggatcaacatccaccggaggatgatgggcgtgctgggcaggatggtgccggtcaccgaggaggaagagagaccgcagcaacagcaccagcagcagcagcagcaggcggccggcgccgtcgagagcagccgcgggttccggcacatgatgcgcgagcgccagcgccgcgagaagctcagccagagctacgccgacctctacgccatggtctcctcccgctccaagcaggacaagaactcgatcgtgcagtccgcggccgtctacatccacgagctcaaggtcgccaaggagcagctccagaggaggaacgacgagctcaaggccaagatcctggggcacgacgcgcagcagcagtgcgtcaaggtgcagttcgaggtcgacgagccctcgtcctccgtcgactccatgatcggggccctcaggcgcctcaagagcatgaatgtcaagaccagggggatccactccaccttgtccggccagcggttgacgacggagatgaatgtcgaaaccacgattgcggcctgcgaggtagaaaatgcagtggaggaggctctccaggaagtagagaggaatcagctgcctgacagcgaggccccgtttcccggaagcaggagcgcctggcctcaaacatcacacgtgcaaaatgtgttctgagatggttctgagcacgagggccatgagacccatttgttcattgttctttag

SEQ ID NO: 466 - DNA, 668 bp, Brachypodium distachyon
agcgaatggagcccaaatccaccacccctccgccgccggcccccgtgctgggcgcgcccgtggggtaccctccggccgccgtctacccgccctccgccgccgctgccggctacccgcacgcgccggcgctctacgcccccccgcctcctcctccccccgccgccgcgtcgcagcaggccgccgcggcgcagcagcagcagctccagatgttctgggcggagcagtaccgcgagatcgaggccaccacggacttcaagaaccacaacctgcccctcgcccgcatcaagaagatcatgaaggccgacgaggacgtgcgcatgatcgccgccgaggcccccgtcgtcttcgcccgcgcatgcgagatgttcatcctcgagctcacccaccgcggctgggcgcacgccgaggagaacaagcgccgcacgctgcagaagtccgacatcgccgcggcaatcgcccgcaccgaggtcttcgacttccttgttgacatcgtgccgagggacgaggccaaggacgccgaggctgctgccgttgctgcaggcatgccccaccctgctgccggcatgcccaccgccgactccatggcctactactacgtcccgccgcagtaactgtagtatgttctattagccagttttaattatgttcagatcgtgctgttgttttag

SEQ ID NO: 467 - DNA, 570 bp, Brassica napus
aaaggatccctaacgaatcccaattccgagtttttaggagtaaaatggcggatacgccttcgagtccagccggagacggcggagaaagcggcagcggatcggttagggagcaggacaggtaccttccgatagctaatataagcaggatcatgaagaaggcgttgcctccaaacggcaagatcgggaaagatgctaaagacactgttcaggagtgcgtctctgagttcatcagcttcatcaccagcgaggcaagtgataagtgccagaaggagaagaggaaaactgtgaatggtgaggatttgttgtgggcaatggcaacgttggggtttgaggattaccttgaacccttgaaggtataccttgcgaggtacagggagttggagggggataataaggggtcagggaagagcggtgatggatctaatagagatgcagctgctggaggtgtttccaatgaagatatgccgagctggtgaaagaagtcgcaagtaagctctctagagataaagaacaacgccaaaatgatcagggaaacttagagatcagtgtggtgtttgacaactcgagttt

SEQ ID NO: 468 - DNA, 870 bp, Populus trichocarpa
caactctcgcgccaaatacaaaaccaccctctcctccccctctttctttctccaggttttctaagtgagatggcggataatccgacgagtccggcggcggggagccacgagagtggtggtgaacagagcccgcggtcaggggtgagagagcaggacagatacctgccaattgctaatataagtaggatcatgaagaaggcgttgccagctaatggaaaaattgcaaaggatgctaaggatactgttcaggaatgtgtttctgagtttattagcttcgttaccagcgaggcgagtgataagtgtcagaaggagaagagaaagacaatcaatggggatgatttgttgtgggcaatggcaacattaggattcgaggagtatattgatccacttaaggtgtacctggctaggtaccgggagctggagggtgatgcaaagggatctgctagaggtggagatggatcttctaaaagggaagcagttggaggtctgcctgctcaaaatgcacagtttgctcttcaaggatccatgaattatataagcccacaaggacagggacagcatatgatccttccttccatgcaaggcaatgagtaggattcggctttgcttttgtcaattcaatgaattctagtgctggcaaaactttttagtttcaacacttgtagagtcttttgcattagttgatctgattgaaaccaaagcgctatgcattttggcggctttggtttttggttattgttggaggtggtttaaatgtggttggtgccgtcatcagcagagcagcttactggtcagattaagttatgtaaatttgccctttatctaatatatactcttccgagtattgccaggatggtttcttggagcatc

SEQ ID NO: 469 - DNA, 631 bp, Glycine max
ttctcttactgactctctttgtcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatagtttagatgcttctacgcatcttatttatttcccttgaatgcttgtacgcatggaatgggtggaaactag

SEQ ID NO: 470 - DNA, 1427 bp, Zea mays
ccgccatggccgtgtcgccggaccagcagcagccacctgcaggggtagggtctcccttgccgtctcctcgcctccgcgtccgcgtccgcgacaccaccctcgtgccgccgtctccgtcaccaccggagacctcgctcccgctcaccttcttggacatcttctggctgcactccccgcccgtcgagcgcctcttcatctaccgcctcgcccccgacgctgacgtcgacgccatcatctccagactccgggactccttgcaccaggccgtccgcgccttctaccctctcgccggccgcctccgcctcacccccggcacgtccgaccgctacgagctgcactaccgcccgggtgacgccgtcaccttcaccgtcgccgagtgcgacgacgatgacgcggacgcgcacttcgacgccctcgccaccgacgagccccgcgaggttgccaagatcgccacgctcgtgccgccgctgccggagcgcggcgggctgttcgccgtccaggccacgctccttcccgcgcgccgcggcctctccatcggcgtcaccgtgcaccacgccgcctgcgacggctcgggctccacgcatttcctgcacacctgggcggtcgcctgcagagccggcgcagaagcgccgccgccgccgccgcctgtcatcgaccggtcactcatcgccgacccaaggcgcatgtacgacgtcttcatccaaggagcgccgagcactgaagagtacgagttcgtcaagatgtccgccgaccagctcttcgctacgttcgcgctgtccaaggacgaactgaagcgcatcaaggacgctgtggccgaggaggctgcgaggcgcggcgtcgcgccgccccggtgctcctctctagttgccaccttcggcttcgtctggtcgtgctaccagcaagccaaggaggccagcagcggcgccggagagttccctatgacctgcatggcctttcccgtcgaccaccgctcgcggatggagcctcccctgccggacaagtacctcggcaactgcgtcggcccagcgttcgcgctggcaccaacaggcgagctggcccaggccggcgcaggcgggttctttagcgcgtgcgccgccgtcgcctcctccatcgacgaagctgtacgcgacatcgagacatcaaacgtggaggtgtggtttgaccgcatcagggatttaatcccgatgggttttctgaccgtggccggttcgccgaggttccgcgtctacgatatggacttcggattcggccggccggcgaaggtggatgtcgtgtccgtggcgaggaccggcgcagtggcggtggcggagagttgggatggtaacggcgggatagaggttggggtctctctacagccggctgccatgaagaggtacaggaagtgcttcgcggatgctatcgcgtggctccaccagaggacatgataa

SEQ ID NO: 471 - DNA, 1517 bp, Zea mays
ccaaaatggacaacggcggcagcaacggctccgccaccgcctccgcctgctgcaacggcaaaattaaccgcgggccgcacgtggcgatgctggcgacgcccgggatggggcacctgatcccgctggcggagctggcgaagcggctggcgtcgcggcacggcgccacggccacgctcatcacgttcgcgtccacggcgtcgcccacgcagcgcgcgttcctggcctcgctcccgcccgcggtgtcctcgctgtccctcccgcccgtcgacctctccgacctgccccgcgccgccgccatcgagacgcgcatgtcggaggagtgcgcgcgctcggtgccggcgctgacggccgtcctcgccggcctcaggcggagcacggccggccgcctggcggccttcgtggccgacctcttcggcgccgactcgctggacgcggcccgcgccgcgggggtccgccgcaggtgcatcttcttcccatccaacctgcacgtgctcacgctcatcctccacctgccggacctggacgccgccgtgcccggcgcgttccgggacatgccggagccgctgcgcctgcccgggtgcgtgcccgtcccggggcccgacgtgctcatgccgctgcaggacaaggccgacccctgctaccgctggatggtgcaccacggcgccaagtaccgggacgcgcacgccatcctcgtcaactcgttcgacgccgtcgagccgggccccgccaaggtcctgcgccagccggagtcgggcggccccagccgccggtggcccgcggtgtacccgatcggcccgctcatccacgccgacggcgggcggaaggacggcgcgtcgtcgtcgccgtgcctggagtggctggaccggcagccgccccggtcggtggtgttcgtctcgttcgggtccggcggcgcgctgccggcggagcagatgcgggagctggcgctggggctggagctcagcggccagcggttcctgtgggtggtgcggagccccagcgacgggggcgccgtcaacgacaactactacgacgcggagagcaagcgcgaccccttcgcctacctccccgagggcttcgtggaccgcacctgcgccgccggcgtggggctggtggtcccgtcctgggcgccgcagacccaggtgctggcgcacgccgccacgggcgccttcctcacccactgcggctggaactccgtgctcgagagcctcgtctacggcgtgcccatggtggcgtggccgctctacgccgagcagaggcagaacgccgtgctgctctccgacggcgtcggcgctgcgctccgggtgcccgagtcgtccaagcggagggagattatcgcggacacggtgcgcgaggtgatgcgcggggaagggaagggcgccgcggtcagggccaaggtggccgagctgcagaaggccgccgccgaggggctccgcgacgggggagccgccgccgccgcgctggccgaggtggtacaggggtggacgacgacgacaggtggaggagagaaggactagtaa

SEQ ID NO: 472 - DNA, 908 bp, Zea mays
cggaaatgcagatggactcctacaactacaactacgccagtttcttccacgacgaggctccgtccttctacccgcacgttgcggtgccgccctccccggagctgcccatcggcctcattgcctcgccaggggagccggagccgcccttcgcgccgccgatgccggcctcgttccaggactacacgggcgccgtgggcgtgggcgtaggggtgagagcgccgttcgggggtgccagcgtgcacgggcaggcgatcgacgcgctgggcgggggcgacgggcagcgcgagcagagcatggcaatggcggaggacggggaagagccggcgccccggcggcggcagccggcgggaggccccgccgccgccgccgtcgagagcagccgcgggttccggcacatgatgcgggagcggcagcggcgcgagaagctgagccagagctacgccgacctgcacgcgctggtggcggcccggtccaggggcgacaagaactccatcgtgcaggccgccgccgtgtacatccacgagctcaggggcgcgcgggaccagctgcagcgccggaacgaggagctcaaggcccgcatcctgggccacgacgccgggcagcagtgcgtcaaggtgcagttcgaggtggacgagccggcgtccgccatcgactccatgatcggggcgctcaggcgcctcaagggcatggacgtcagggccaggggcatccgctccagcctgtccgggcgcaggctgtggacggagatgaatgtggagaccacgatggcggccgacgaggtggaaaggggcgtggaggaggctctgctgcaggaagtggagaggaagcagcagcagcagcttggagctgggagcgccgcccctggttttccaggcccgtcatcgcacgtgcaaaacgtgttttgataa

SEQ ID NO: 473 - DNA, 1615 bp, Sorghum bicolor
aaagtcgacccctctccacacccgaacgccccgtgccttctcccacccgccggagccctctccacacccgagcaccccccgccctctcccacctgccggtgcccccccctcccctctcttccactatggcggatctagaggatcttggaagagctcgaggatgtggtggaccctatggcccggcgtccttacggggactccctctctctctctccatccaggagacggccggtgctgggcgacgaggctggacgaacgacggcgggggcggcacgacgcgacaaggacgagtggtgcgacgtggccagaccagatgcacagaggtcgggcgacatcgatttgacggtgccatgcatggtatgcggtagtgaccctcatcctctctctctctctccaatctcagatccatggaggatccatccttcaccttctccccctcgcagatccagtgttatgtaggggatgatggccaaatccgacatcaagggcacggcagtactggccggcttcctgcgatctgctgctggcatgcccttgccgtatggattttttgggactttcaattttctgggtggtttcgttaattagtgaatgtccatgacagacattggactgggccacaggccactgcaatttctctttgcacgtagttgctgcggctctagatactcttgtaatttgtttgtgatttattaactgcttttgtgttatactatattaaaattttgtttttatctaatatagaaataattgtatttgctgtctaaaaaaattaaatttcaggcatatgaaattgagcaactcccattaatttccatgttctcaaatttctctgtatcgcatggtcaggttgctgcagctgacaccgagtgaaaacatgaggatcatcatgttctttaggaagtttttgcaggtataatcttgacatacggtaaacaacacacctcaatgtgtgtgtgtttggtaaggcatggttatcaagttctgaattggaataaagcaatcaattagagtatacagatttatttcttggtgggaacaaaattgcagaaatatatatatgtctcattgctgcctttagatatttgtttttaccacctaccatgcttgtattttttgtgtgtttgtttatcaaatgcacctctagtatatgcgatagcttcgtgtcatagcctatctgaacaatatattatctgaaacttatttgcttagtatgacttattctgtctatcaaggaaaccttctgctactaagtacaataatatatttgcaggctcgaataattgattgacatgctattgattgtcactaattaatttttatctccctcatgtataattgcagtgggcagatggatcagaggagaaaggcgtcataacctgatgccacttgctagctgagaatgtgtctcctttcttttttttcatctgtttcttttattttatcttgaagaacaggagggcaatgctatcttagtcttctattccttttgctacttcattcttttcgtttggttgtggtcagtttacttttgtatgtaattgtactgcttttatatgtaattgtagtgggttattatatattgcaatcacatgtgcttgactgtaggcctaaa

SEQ ID NO: 474 - protein, 240 aa, Hordeum vulgare
MKLVVLSALLLLSLVAVSSAEEFDFFYLVQQWPGSFCDTKKGCCFPDTGKPATDFGIHGLWPNYAECKTRGELDGALEMVTRRRKKCWPESCNSERLKLWEIRDLVTELDANWPTLACKGGKSFEFWTHEWEKHGTCSNLDQHGYFATALGFKARHNLTSILADAGIVPSDTETYFLSSIRDAIREGTGFTANLECNRGVDGETQLFQVYQCIDRDGENLIDCPLPMQGNCKDRVQLPAF

SEQ ID NO: 475 - protein, 365 aa, Hordeum vulgare
MDGKGYTTPPTAPAPQAEAGAPHFYPPTEHGTAPQPGSQVSYPPMPKAMDGQDAAAPQPGAPPHPSSPLTQQAMELEGKYAAPQPGTGATPSPPTQQAVDGKDAAPTPPAESARWGTRQMGPPAAPGAHPENQQAAQWTATRGDQELPPYVIMGAPEPAPAASARRTDKEARDSPMEHILDFFNTWSRKAEELSSNIWLNLKTAPSMSDAAMGKLSLGAKAITGGGFEKLYKQTFGSGPDEHVKKTFACYLSTATGPVAGTLYLTNTNVAFCSDRPLSFAAPSGQTAWSYYKVMIPLAKLAAVEPVTAKESPPERYIHIVTVDAHDFWFMGFVSYDKAVRHLGGAVSSSQHHGAAPAPAPAPTYE

SEQ ID NO: 476 - protein, 619 aa, Hordeum vulgare
MATNPGLFSEWPWKKLGSFKYVVLAPWVAHGIQQVATKGWREADLGYLVILPSMMLRVLHNQAWITVSRLQNARGKRQIVDRGIEFEQIDRERNWDDQIILSAILFFLGALHLPGGQNLPLWRTDGAVLVALLHAGPVELIYYWFHRALHHHFLYTRYHSHHHASIVTEPITSVIHPFAELVAYELLFSIPMIACALTGTASIMTFELYMLYIDFMNNMGHCNFELVPAWLFKWFPPLKYFMYTPSFHSLHHTQFRTNYSLFMPLYDYIYNTMDKSSDKLHEKSLDNKQEAIDVVHLTHLTSLQSIYHMRPGFAEFASKPYASKWYMRIMWPLSWLSMVLTWVYGSWFTVERNVMEKLRIQSWAIPRYNFHYGLNWEKETINNLIGKAICEADKKGAKVVSLGLLNQAQSLNGSGELYLQKYPKLGLKLVDGTSLAAAVVVNSIPQGTDQVVLSGNISKVACAVAAALCKKNIKVTITNKQDYHFLQPKMPEDAADNLILSKTGIAKVWIIGEGVDAAEQLRAPKGTRFIPYSQFPPRMVRKDCCTYSTTPAMSVPKTLQNVHSCENWLPRRVMSAWRIAGMVHALEGWDEHECGDKVLDMDKVWSAALLHGFRPVTED

SEQ ID NO: 477 - protein, 477 aa, Hordeum vulgare
MQRLASSRRLLQAALAPGRAHSSLTAAAVAAAPENGAGAPKMPPFAYTPPPYDGPRVAEIAQKRAQFLSPSLFHFYDRPLNIVDGKMQYLFDEDGRRYLDAFGGIATVCCGHCHPDVIEAIVNQAKKIQHSTVLYLNHAIADFAEALAAKMPGDLKVVFFTNSGTEANELALMIARLYTGCHDIISLRNGYHGNAAATMGATGQCNWKFNVVQTGVHHALNPDPYRGAFGSDGEKYARDIQETIDYGTTGRVAGFISEAIQGVGGIVELAPGYLPVAYDMVRKAGGLCIADEVQAGVARTGSHFWGFEGHGVIPDIVTMAKGIGNGIPIGAVVTTPEIAKVLTRRSYFNTFGGNPVSTAAGHAVLKVLEKEKLQENAFVVGSYLKDQLNALKEKHDIIGDVRGKGLLLGVELVTDRQKKTPAKAEIAQVMSHMKDMGVLVGKGGFFGNVFRVTPPLCFSKEDSDFLIEVMDIALSKL

SEQ ID NO: 478 - protein, 264 aa, Hordeum vulgare
MLAIFQKQVAHAPQELNSPRGSTAKPKNPDEILRDFHAAHPSDAFSTSFGGGAALACVAAQPRNLAAGGYQRMFCGLDDIYCVFMGTLDNLSSLMRQYGLTGRSTNEALLVIEAYRTLRDRGPYPADQVVKDLSGSFAFVVFDNRGRSGSGAAVFAAQSTDGGVPLHWGVAADGSVVICDDRGVAKAGCGRSYAPFPPGCMFHSEGGLKSFEHPMNRLKAFPRVDSEGVMCGANFKVDAFTKINSMPRVGSATNWAATWDDAAI

SEQ ID NO: 479 - protein, 575 aa, Hordeum vulgare
MEHQAHVAGEKKGIMEKIKEKLPGGHGDHKQAADTHGQQGHAGTGTHGAPATGGAYEQQGRTGVTGTGLNGADAGEKKGLMEKIKDKLPGGHGDQQTTAGTYGQQGHTGTAAHGTPAGGGTYDQEGHTGMSGMGAHDTHATGGAYGQHAHTGGTGTGTHGTGEKKGVMENIKDKLPGGHGDHQKTSDTYGHQEDTEMTGMGRHSTPATGGSYGQHVHTGQTDMGTHGTGEKKGVMENIKDKLPGGHDDHQKTAGTYGQQGHVGTGTHGTPATGGAYGQHEHTGATGTGTYGTGEKKGIMENIKEKLPGGHGDHHKTGDTYGHQEDTKMTGMGRHSAPATGGSYGQHAHTGETGTGTHGTGEKKGVMENIKEKLSGGHDDHQKTAGTYGQQGHVGTGTHGTPATGGAYGQHERTGATGTETYSTGEKKGVMENIKEKLPGGHGDHQQTGGIYGQQAHVGTGTHDTPATGGTYGQHGHTGVTGTGTHGTGEKKGVMENIKEKLPGGHSDHQHTTETYGQHRHTGVAGTETHGTTATGGTYGQQAQTGTTGAGTHGTDGTGEKKSLMDKIKDKLPGQH

SEQ ID NO: 480 - protein, 193 aa, Hordeum vulgare
MAARALTAAAGRRVAGRTGTTPLLASCRNGASMSHSSATAGARREEEPYKDVHGPAAAAAMTGAQVEAALNRKNVEVLQGEEEEEEHVATVLPDETVSIPAGDGEEDASWVPDQDTGVFGPAHVDATHGDGGAAHPAPPHLFGGTTATAYSTHGSVLDQAVFVREEDMEDVERPAAVDMANANADVNGSIKNF

SEQ ID NO: 481 - protein, 580 aa, Brachypodium distachyon
MDKGHLGGGGGGGGLVALDASPRPLGFLNLLSPAPSFHRSMEADDVGTGAGGGGGGRGRRSVEVDFFSDEKKNMKKSRVSAGGTDAEGHKDAGAGLAIKKEDLTINLLPGRSDRSMVVDDDAASRPDNDKNGRQDTNELAAMQAELGRMNEENQRLRGMLTQVTNSYQALQMHLVALMQQRTQLLPTQPQQQQPPPTHEDGKIEGAIVPRQFLDLGPSGAGAGSEVAEEPSNSSTEVGSPRRSSSNGNEDPERSDNPEGPSTAGWLPGRAMNQQQLGAAAKGHDQQAQEATMRKARVSVRARSEAPIIADGCQWRKYGQKMAKGNPCPRAYYRCTMATGCPVRKQVQRCAEDRTILITTYEGTHNHPLPPAAMAMASTTSAAASMLLSGSMPSADGSAGLMSSNFLARTVLPCSSSMATISASAPFPTVTLDLTHAPPGAPNAMPLSALRPPAPAPGQFQVPLPGAGGGMAGPTFAMPQQMLYNQSKFSGLHMSSSSDTAEFAQPRPQMGQLSDTVSAAAAAITADPNFTVALAAAITSIIGGQHAAAAAGNNNGSNNNVTTTSNNTTTTTSNNTNSETQ

SEQ ID NO: 482 - protein, 345 aa, Brachypodium distachyon
MDPWIGSQPSLSLDLHVGLGHHHRHQAQPVVALVKPKILVEENFLPLKKDPEVAGLEAELQRVSEENRRLGEMLREVAAKYESLQGQYSDMTNAANNYSHPSSASTEGGSVSPSRKRKSSDSLDGHTPSPPPPPQLSFVPEQQAECTSGEPCNKRVRPAAASEECKPVVSKRYVHADPSDLSLVVKDGYQWRKYGQKVTKDNPCPRAYFRCSFAPACPVKKKVQRSAEDRTVLVATYEGEHNHGQPPPAQPQQQQQHDGKNGAAKPPQAPVAAAAALHQQHQQQKQEQEAAVVNGEAAAAASELIRRNLAEQMAMTLTMDPSFKAALVTALSGRIFELSPTKDLN

SEQ ID NO: 483 - protein, 169 aa, Brachypodium distachyon
MAMRALALPHSQSSTFGLHQSLPSFKPSSASTRSVRAYAKSDEEEEKVPKQSLFGSITEALDFSQVRSEKDAELLYEARDSIKEEGKMTREQYAALRRKIGGTYKDFFKSYVDVDGEYVEEGWVDKTCKVCKKDTRGEPRQVDKLGRYVHVACAENSKPTNFFAKLFGG

SEQ ID NO: 484 - protein, 261 aa, Unknown
  Sequence found in Organisms: Brassica napus, Brassica rapa
MAFSPINCLIFDLDDTLYPLKTGIAPAVKKNIDDFLMEKFGFSESKASSLRVELFKSYGSTLAGLRALGHDVHPDEYHSVVHGRLPYGSIQPNSKLRNLLNKIKQKKIIFTNSDRNHAMKVLERLGLEDCFEEIICFETMNPNLFGATTRPDEHPVVLKPSLTAMDVCIRAANVDPRRAVFLDDNVHNITAGKSVGLRTVLVGRSEKTKDADYAVETVTEIATAVPDIWATATAGCDDGGERISRSKSELEGMASITAVGA

SEQ ID NO: 485 - protein, 287 aa, Gossypium hirsutum
MDSPFNCLLFDLDDTLYPSSTGIAQGIKKNIDDFLIEKCGMSATKASNLRVELFKTYGSTLAGLRALGYDIDADDYHDFVHGRLSYDVIKPDPQLRSLLRSITQRKIIFTNSDRVHAVKVMKRLGIEDCFDQIICFQTLNPNLSESKCVVLKPSTDAIKIALHVARVDPPRTLFLDDNVQNISAGKTLGLWTCLVVSNFLNKKNYSFKMHESNIIVWSKVGKSGEGKEADYAIEEVKNLGDVIPEIWVNKQDGGDRSRSESELDQFNISGDLIEKDVGLALTAPLCT

SEQ ID NO: 486 - protein, 523 aa, Gossypium hirsutum
MGSEHELPADRSYSKPLGIRFLEYIKKVKLSYESHQAIVLIVTFFAYASYHATRKTTSIVKSALDPQSSDVGLKFPWRITYLSAPESKGLSWALGDGWAPFNGSDGTALLGQLDVAFLSVCALGMYFSGHMGDRMNLRIFLTVGMVGTGLFTSLFGAGYWAKIHSFYYYLIVQMIAGLFQSTGWPSVVAVVGKWFGKKKRGLIMGIWSAHTSVGNITGSLIASALLSYGWGWSFVVPGLLIAFMGLVVFFFLPVSPESVGAYREEDEVDSLRKNEEEEGVTEPLLGSNTELKEKAVGFIEAWKIPGVAPFAFCLFFAKLVAYTFLYWLPYYISHTAIEGKYLSNEAAGNLSTFFDIGGVLGGILAGHISDRLDARAITAATFMYCAIPALYFYRSYGHVSVVMNVALMFICGMFVNGPYALITTAVSADLGTHSSLKGSSKALATVTAIIDGTGSVGAAIGPLLTGYISAESWSAVFTMLMGAALVAGLLLTRLVVAEVAARISESRSQGGSQTGSEAPELDV

SEQ ID NO: 487 - protein, 328 aa, Vitis vinifera
MANEDLERGGGMKNRGNNGHPPGYYSSTYYAEASETHWTSWLIPMFVVANVAVFVVVMYVNDCPKKNTGIEGACVAKFLRRLSFQPLRENPLFGPSSSTLEKLGGLEWNKVVYGDQGWRLVTCIWLHAGVIHLLANMLSLVFIGIRLEQQFGFVRIGIIYMVSGFGGSILSSLFIQHNISVGASGALFGLLGAMLSELITNWSIYTNKAAALFTLVVIIAINLAVGILPHVDNFAHIGGFLTGFLLGFILLLRPQFGWVKRQHRPADARVQSKHKVYQYVFWLVAMALLIVGFTVGLVMLFRGENGNDHCSWCHYLSCVPTSKWKCDN

SEQ ID NO: 488 - protein, 315 aa, Vitis vinifera
MTEMMANHSDSQHFELKNLKEMIFNVNERDVVKSCAQHSNGECMEIKEPTDHVEITEKELLEKGYMQYGCPHYRRRCRIRAPCCNEIFDCRHCHNEAKNSIKVDKAQRHDIPRHQVQQVICSLCNTEQEVRQVCINCGVCMGKYFCETCKLFDDDTSKKQYHCNGCGICRIGGRENFFHCYKCRCCYSVLLKNSHPCVEGAMHHDCPVCFEYLFESTDDVTVMPCGHTIHQNCLKEMREHLQYACPLCSKSVCDMSKVWEKFDMEIAAIPMPEPYQNKMVWILCNDCGKTSKVHFHVLAQKCLNCKSYNTRQTRG

SEQ ID NO: 489 - protein, 439 aa, Vitis vinifera
WRKNLGRPVSWALGSGWAPFDGADGTALLGDIDVAFLGVYAIGMYFSGHLGDRLNLRIFLTVGMVGTGLFTSLYGVGYWANIHIFYYFLIDQMFAGLFQSTGWPSVVAVVGNWFGKSKRGLIMGIWNAHTSVGNIAGSVIASVLLAYGWGWSFVVPGLMIAFVGLVVFLLLPVSPESVGAVAEEDQVHSPRKNGEEVTEPLLQSDTEVKKKAIGFIEAWKIPGVAPFALCLFFAKLVAYTFLYWLPFYISHTDIDGKYLSSEAAGNLSTVFDVGGVVGGILAGHISDRLGARAITAASFMYCAIPALFFYRSYGSISVPVNVVLMFITGLFVNGPYALITTAVSADLGTHSSLEGDSRALATVTAIIDGTGSVGAALGPLLTGYISAKSWSAVFTMLMASALVAGLLLTRLVVAEVAAKIAESRRQGGPTSRSPVPLEV

SEQ ID NO: 490 - protein, 386 aa, Oryza sativa
MMMMGEGVSSVPPWSHLPVSGVDVLGGGGGGGDEMTPYVIAALRDYLPANDVGVGADEEEEAAAMAAAVDAYACDEFRMYEFKVRRCARGRSHDWTECPFAHPGEKARRRDPRKYHYSGTACPDFRKGGCKRGDACEYAHGVFECWLHPARYRTQPCKDGTACRRRVCFFAHTPDQLRVLPAQQSSPRSVASSPLAESYDGSPLRRQAFESYLTKTIMSSSPTSTLMSPPKSPPSESPPLSPDGAAAIRRGSWPGVGSPVNDVLASFRQLRLNKVKSSPSGGWSYPSSSAVYGSPKAATGLYSLPTTPLASTATVTTASSFMPNLEPLDLGLIGDEEPVQRVESGRALREKVFERLSRDGAISGDATAFATAGVGLDVDWVSDLIN

SEQ ID NO: 491 - protein, 617 aa, Oryza sativa
MGGAHSREDLDLTSSDDEDDDEEYDAQTATSAASREDILRTSTPSSLEFLDAKLKALDLKYQAPNAAKLYLHVGGASASARWVPAERRATYAFVDKATAAGDSDCGGPRWVLEVGPGPRVSAPVGPALQLKALPAQRRADFAAGGSVWALRLPTDAAFRRFRQEYDRCLFENTYGVEATDEGRKEVFGADFAAWARPGESDDAVWADAEDSFTPPVATPARDLLEEFEEEAGDGSIQSLALGALDNSFLVGGSGIQVVKNFRHGVHGKGVSVRISDGRGGGNAYMTPQKALLMRGETNMLLMSPGETGTRHSNGVHHVDIETGKVVAQWRFEKDGTDITMRDIANDSKGAQLEPSGSTFLGLDDNRLCRWDMRDSRGRVQTIGSSSESPVLQWSQGHQFSRGTNFQCFASTGDGSIVVGSVDGKIRLYSKSSMRMAKTAFPGLGSPITHVDVTYDGKWILGTTDTYLILICTIFKDKDGKEKTGFSGRMGNRIAAPRLLKLSPLDSILAGSENKFHGGQFSWVTENGKQEKHLVATVGKFSVIWNFQQVKDSNHECYRDQEGLKSCYCYKVVLKDESIVDSRFMHEKFATTDSPEAPLVVATPMKVSSFSLANRRLH

SEQ ID NO: 492 - protein, 437 aa, Oryza sativa
MRVLEDDMFPSTPGKVKIERATAMNRQLHRCFASTSTMFLWALFLVAMTASYLSFQSFVDTSSKYFAASWGGLHWERQIRASAAPRRPPGSAAGAGMSVLVTGAAGFVGTHCSLALRKRGDGVVGIDNFNSYYDPSLKKARRSLLASHGVFVIEGDINDGRLLAKLFDVVPFTHVLHLAAQAGVRYAMENPASYVHSNIAGLVTLLEACKDADPQPAIVWASSSSVYGLNDKVPFTESDRTDQPASLYAATKKAGEEITHTYNHIYGLSITGLRFFTVYGPWGRPDMAYFSFTRNILQGKPITVYRGKNRVDLARDFTYIDDIVKGCLGSLDTAGKSTGTGGKKRGPAPYRIFNLGNTSPVTVPNLVSILEKHLRVKAKKNVVEMPGNGDVPFTHANISLARQQLGYKPTTNLDVGLKKFVKWYLSYYGYTRGSKNL

SEQ ID NO: 493 - protein, 645 aa, Oryza sativa
MASVNTGGLRLVRCPKCYNILPEPPSVEVYKCGGCDTILRVKIRPSNGQNVATKQVRQDSDDFSVATTASNGVHPQKKDIAFSGATMDRSRTPDAPSTDTEHASNGTSSNDNGHAMSVENNASEVADTDNKEDCNLDGQNTSGRIEGPSEEIPPNANGMDIDSDREETYNVEGIAENSEDCRVRGGGDIDTECNLSLPEHELPLHQESKSDSELKEATKTEDEATKKGHLVRVQSRSCDLRESHRASAGSSMDFHSARTSLQSKSFRASEPLQSKIMKTVDELRGDLSEFFSKPEEEGEDDDDRKPKTAAYPPRPSKQDGYSKPRAPFTSSVPLTAYHPAAKHSGHVSRLSRSGQVPPPPHHHRELSSLRYRRRRRAYSCCHSDQMETMRRPCSHDCCHYHSCRPPPCHHHDRPWKSQEGAMQRPPVQETTRRRAPPRHHCRPVLRGAPFVVCSGCNRLVQLPTDFAVPSKGTRRLQCGSCSEILSYSYRDPAKKKLQSPSGDGEECQYSTDDYEIHQAAGDADPFSYSEEYGVISYSTEEEQQPLHVSRNSSFDTVDDERSAKLHRLMGYSSASELLRLRRSPDLYESFGERTPAARTSDTKGKAICVADEEEHPSAKVRRGRGLPLPGILKKGIHGLESLKLR

SEQ ID NO: 494 - protein, 329 aa, Oryza sativa
MPSEFVAARKKPPPELLFAAGRKKQQPPPPGMAFVPSEFAAAGVGRKRQPAPPVEIRRVWAHNVEEEFRIIRNAIDHFPYVSMDTEFPGVIHRPTKHPALLTAGDRYDLLRRNVDALHLIQVGITLAASPTAAPALAFEINLSDFDQRVHRHAAESVQLLAEHGVDLAAHRRHGVRASALAPLLMSSGLVCSHGAVKWVTFHSAYDFAYLVKLLMGRKLPRSMAEFLNLVRVFFGDEVYDVKHMMRHCGGELYGGLERVAAALQVKRAAGRCHQAASDSLLTWDVFRRMRELYFLKHGVEAYQGVLFGLELDMDMPSNKTPSLPLVAAR

SEQ ID NO: 495 - protein, 172 aa, Oryza sativa
MASPSALIAMLLVMVVGCAAVASAMELSFIVGDAQGWNTGVDYTAWAKGKTFEANDTLVFRYARKQHTVTEVTKSDYDACTVSGKPISDFEGGALVTFIALSPGEHYFICKIGNHCASGMKLAVTVSNSSDTPRPQPWIGPYSTPASASAHLHAGGAVVAAAVGILLNLALF

SEQ ID NO: 496 - protein, 322 aa, Oryza sativa
MAPTSTFPVINMELLAGEERPAAMEQLDDACENWGFFEILNHGISTELMDEVEKMTKDHYKRVREQRFLEFASKTLKEGCDDVNKAEKLDWESTFFVRHLPESNIADIPDLDDDYRRLMKRFAAELETLAERLLDLLCENLGLEKGYLTKAFRGPAGAPTFGTKVSSYPPCPRPDLVEGLRAHTDAGGIILLFQDDRVGGLQLLKDGEWVDVPPMRHSIVVNLGDQLEVITNGRYKSVIHRVVAQTDGNRMSIASFYNPGSDAVISPAPALVKEEEAVVAYPKFVFEDYMKLYVRHKFEAKEPRFEAFKSMETETSNRIAIA

SEQ ID NO: 497 - protein, 332 aa, Oryza sativa
MAAAAARYDVEKGGRKREGEEERCGSPAAVAQYPQREGEREWVPWLVPAILVANVVVFAVAMYVNNCPSHASRGGACVAGFLRRFSFQPLSENPLLGPSSATLQKMGALVWDKVVHEHQGWRLVTCIWLHAGVVHLLANMLSLVLIGLRLEQQFGYMRIGIIYLVSGIGGSVLSSLFIRNSISVGASGALFGLLGAMLSELFTNWTIYTNKAAALVTLLIVIAINLAIGILPHVDNFAHIGGFLTGFLLGFIFLMRPHYGWMQRYVLPSSVKYTSKKYLAYQWILLAVASVLAVIGFAVGLSMLFRGVNANERCHWCHYLSCIPTSRWTCGN

SEQ ID NO: 498 - protein, 379 aa, Sorghum bicolor
MMMMGEGVSVPPWTHHVPVSGVDVGGGDEMTPYLLAALRQYLPCNDAAAGAEADDEDAAAMAAGVDGYGCDEFRMYEFKVRRCARARSHDWTECPFAHPGEKARRRDPRKYHYSGTACPDFRKGGCKRGDNCDFAHGVFECWLHPARYRTQPCKDGTACRRRVCFFAHTPDQLRVLPTTQHQQSSPRGAAACSPLADSYDGSPLRRQAVESFRTKSIMSSSPTSTLMSPPKSPPSESPPLSPDGAAAFRRGSWPGVGSPVNDVLATLRQLRLSKANSSPSGGWGGYPASAVGYASPTAGGFYSLPTTPTTLATASGYMANMEPLDVSFCGDEEPVERVESGRALRTKVFERLSRDGAVSGDATAGISGPDVGWVSDLIN

SEQ ID NO: 499 - protein, 326 aa, Sorghum bicolor
MATRADVEKGGVVRKEPGKVPSPLYPQHEGEREWVPWIVPVFFVANITVFVITMYVNNCPTHTTTPRDAKCVARFLGRFSFQPLRQNPLLGPSSATLTKMGALVWEKVVHHHQGWRLLSSMWLHAGVLHLVANMLCLLFVGMRLEQQFGYVRIGAIYILSGLGGAVLSSLFIRNHISVGASGALFGLLGAMLSELITNWTIYTNKAVAVATLLFVAAVNLVLGILPHVNNFAHIGGFLAGFLLGLVVLMRPHFGWMERYSMPAGAPCTARKYLAYQWILLAVALLLLVVGFAVGMAMVFRGSNANDSCHWCHYLSCVPTARWNCTN

SEQ ID NO: 500 - protein, 281 aa, Sorghum bicolor
MEFEDRCHKVQEPKFDCLLFDLDDTLYPLSSGIAGHVKNNIEDYMVEKLGIDESKIENLGNLLYKNYGTTMAGLRAIGYSFDYDEYHAFVHGRLPYDNIKPDPVLKHILKNLRIRKLIFTNGDMVHAVRALERLGLEDCFEGIICFETLNPPCPPQGDEEPEIFDIAGHFARSGTADELPKTPVLCKPNVDAMEEALRIANVNPHKAIFFDDSVRNIQAGKQIGLHTVLVGKSQRVKGADHALESIHNIREALPELWEEAEKAKEDVLYAERVAMETSVTA

SEQ ID NO: 501 - protein, 124 aa, Sorghum bicolor
MSYSRGSSERYGSRSPYSRSSYSRYRSRSRSVDSSDAENPGNNLYVTGLSTRVTDRDLEKHFSTEGEVIDASVVHDPWTRESRGFGFVTMATVKEADRCIKYLDRSVLEGRVITVEKILLTATG

SEQ ID NO: 502 - protein, 161 aa, Sorghum bicolor
MAVVSGSGGGRLNPWAEPFVPSGVRYRGLMQTPEQQEVEDFSPEWWRLVSASPAFRDRWLREYGALGLLDAEEDLDDAEVDGFLPDDFFSAPAPRQESEREGGVAGAGKKVGGGLEVAAWGIDKWWRAHGGPPEAPRYAEKAPRRVAAGARVSPRPIQQPR

SEQ ID NO: 503 - protein, 344 aa, Sorghum bicolor
MADAAAAAAPTKTANIPTTMRAVQYDAYGGGATGLKHVEVPVPMAKKNELLLKLEAASINPVDWKIQKGLLQPFLPRKFPFIPVTDVAGVVADVGPGINGFQAGDQVVAMLNSLNGGGLAEYAVASENLTVKRPPEVSAAEGAGLPIAAGTALQVLRTIGAKFDGTGQPLNVLITAASGGVGLYAVQLAKLAGLHITATCGARNVELVKSLGADEVLDYRTPEGAILQSPSGKKYDGVVHCTVGISWSTFEPVLATNGRVIDITPNFTVFLKSALHKVTFAKKRLVPLLLSPNKADLEFLVGLLKDGNLKTLIDSRFPLSEVSKAWEKSIEGHATGKIIVEMVG

SEQ ID NO: 504 - protein, 272 aa, Sorghum bicolor
MAANSPFDCVLLDLDDTLYPGNTGIGPALKRNIDEFLQAKLGVSAEKAAAMRVELFRTHGSSLAGLIALGYDVHPDEYHSYVHGRLPYDMIPADPQLARLLQSIPQRKVLFTNSDRAHMKRALERLGVDEAVFDAVVCFETMNPHLFGGEAREERVDGGDHPVVVLKPAVDAIVAGLRAAGSNPRRTLFLDDSERNITAGKALGLRTALVGKRVRSKDADYALENIGALRRVIPEIWGVVAGGESERSDHSIDKMPMRSDLDSIIQPTSIQA

SEQ ID NO: 505 - protein, 357 aa, Sorghum bicolor
MSMAQVCCDSAAAATAAAAQVVGAEAEARARARAERRRRAGEAAGRWRHAGAAAGGTPDAATRKRSLEAGELLVARKHGAASVAGRRREMEDAVSVREAFALAEGSHGGRRDFYGVFDGHGCSHVAEACRDRMHELLAEELAVAAAADDVSWTAAMERSFARMDSEVMSAGGASGACGCDAHKCDHVGSTAVVAVVEERRVVVANCGDSRAVLCRGGDGAPPVPLSSDHKPDRPDELARIEAAGGRVIFWEGARVLGVLAMSRAIGDGYLKPYVSSVPEVTVTDRSDGDECLILASDGLWDVVSNEAACEVARACLRRGRAKWCAEAAALLTKLALARRSSDNVSVVVVDLRRRNHH

SEQ ID NO: 506 - protein, 362 aa, Sorghum bicolor
MSTATAALAAARSPAVALLSLRRRAHAAAPIRFPGLRVGSGCRHVAMASAAHARAPTDPLPKGADSFFRAVISNMEKVYLSRNPTAKTILELVRSYDGDHICYDHLAFRTFGVNGYGINSLSEFFTDFGYVPREELRFPAKKLRALWFSPPTNGGYSGTGTYGPLPRIFISELLVDELTTQSQEIIHKYIKTSGNGNNHAALASTSGELTWEKPIYSDFQILSSESEYAAWTLVNGYALNHATIATHRLESDIRNINKFNKFVEDNGFKLNSEGGILKVSPDGLLQQSSTVADSSLFTFADGITESIPRSYIEFAERLLLPQFKDLQDEEVKEYHRRDGFEVGNADKIFESTSRDQLTRTSA

SEQ ID NO: 507 - protein, 699 aa, Sorghum bicolor
MDLVGSLLMNTTRLLDPSGLHFLGWLVTAGSIGLAALIYALLRLQREAALYWTKAAREKRAAWRRSRCPSSCHSWSEDRFHGGQPSTCCVCLSSLSGSAQGADDVVHRCSVCGVAAHSSCSPHAEKDCKCVAQAGTSPLLHHWSERWVELDDNPEISSFCYYCDEPCGVPFLGVSPIWRCLWCQRQIHVDCHAKLLKETTNTCDLGLLRRLIVPPQSVKEVGQGSGISGMLNSIKDGFANSTAGNRRRPRNKKRGNNHPGGKANSIPAKGSVLDSVLEGFARLKGLDGKYALAKPLSQNSLKQTYRSGIPNERVRKYELVDLPQDSRPLLVFINGKSGGRNGPSLRRRLNMLLNPIQIFELSAPQGPDVGLQLFHNVKHFRILVCGGDGTVAWVLDAIEKQNYESPPPVAILPLGTGNDLSRVMRWGGGLSSVEREGGIYALLNDVDHAAVTVLDRWNVAIKEKNGTEGQCTKQVKFMTNYLGIGCDAKVAYDFHTSREEKPDKFCSQFVNKLIYAREGAKDMMDRSCSDLPWHVSLEVDGENIEIPEDAEGVIVMNIPSYMGGVDLWQNDNDHDDDFSLQSIHDKILEVVCISGTWHLGKLQVGLSRAHRLAQGKVIRLHLHSSFPVQVDGEPWIQPPGCLEISHRGQMFMLRRTSEEPTGHAAAIMSEVLVNAECNGVIDASQKRLLLHEIALRLSS

SEQ ID NO: 508 - protein, 511 aa, Sorghum bicolor
MASAARTTPGPGRSVVVLVSLATLLLVTFVSTVESYDGRHAVAHSVMARRSRLGTRHVQHHHRRTTTVPHRYVLAEKSSPTGGGSSPKNRSSSPATANNASAPAPAASQSDGGRRHRSHKHRVRNWIIGFVVGSVAGVISGLVLSVLFRLALNCVRGRYRSRSGVMIFTPKLIRRPEHLAFLEKEDGLASLAVIGRGGCGEVYKAQLPVEREGDAPRFIAIKKIKKHGGDAPATNNNLSDEESRQLDKRSRQIQSEIRTVGHIRHRNLLPLAAHVPRPDCHYLVYEYMKNGSLHHALKAGNSAVEVEDGGGGEDGGTGTCTGTSGGLSWPARLRVAVGVAAGLEYLHVSHQPQIIHRDLKPANILLDDDLEPRIADFGLAKAMPDSHTHVTASNVAGTLGYIAPEYYQTVKFTAKCDVYSFGVILAVLATGKEPSDQFFTETEEVVGLVKWLRRVMESGEHAQAIDPAIAGAGHDEQILLLLRIALFCTKDDPKERPTAKDVRCMLSQIKT

SEQ ID NO: 509 - protein, 641 aa, Sorghum bicolor
MANTEGFRLVRCPKCLNILPEPPKVTVYKCGGCGTTLRAKIRASNGQHVAAKQVRQDSDSYSVATAVSNGVPPQNKDQGSIGAVTENFSFNADAPSTEHDSNGTRSSENGDDMLAGQNAVVVEDTENKDNRNFEDQDSSSRMEGPADQTRLNANGMYLNSGETENHTVEQPMENSETYRVSGHDDTECHLNPSENKPISSEISKAAVSMQDPEQKEAGESEHAANKKSYLVRVLSRSCDLRSSINSIDFHSARTSLQSKSFRASEPLQSKIMNTMDELKGDLSELFNKPAADCKPKAHNPPRPSKQDGHMTRAATTTSAPLAAYHPAAKYSGYVSRLSRSGQVPLPPRGLPSLRYRRHRVYSFHHHSMQTEMRPCRHECCHSCQPPCYRSCNQESSAMHRPPIMEIRRRPPPRNHCLPVLRGAPFVICSNCVSLVQLPTDFAVPSRGTRRVQCGSCSEVLSYSYRDPARKRLQSPFGGDEYSTDEYEIHHQAAAAGGGFEQADPVSYSEEYGLSFGVSHSTSTEDGQPLYVSRNSSFNTVDERMMGKDGKLHRLMGYSSASELLRRHSPDLFESFDRRTPTIERTHVVDRKGKGVCVAENDAGERDGGAVVKRSKARSGGLPLHGILKKGIHGLESLKLRS

SEQ ID NO: 510 - protein, 206 aa, Solanum lycopersicum
MAKGRKLATSRSEMLLGNYPSYRNGTATVNGSSELGEDDVWATVDDMDDHDSRGEWSPRAAAEGNNGYVNRKVQQSDHHHHSHRGRQVGGLSLAFDDSGKTASPRILHQFRGQDAPSPRVAHMATSAPVNVPDWSKIYRVNSVESLHDSDDGVDDHDSEMVPPHEYIARSRNSNAHSVFEGVGRTLKGRDLSRVRDAVWSQTGFDG

SEQ ID NO: 511 - protein, 256 aa, Solanum lycopersicum
MDSSSPFDSIIFDLDDTLYSSATGIGQSLKKNIDDFLVEKCGFPVSKASALRVELFKTYGSSLAGLRAIGYDVDADDYHSYVHGRLPYDLIKPDPQLRSILRSINQRKIIFTNSDRIHAMKALDRLGITDCFEQIICFETMNFNLSKATRPEEIPVILKPSMEAMNIAIEAAQVDPYRTLFLDDNVKNIAAGKAVGLQTVLVGRSTKTKEADYALEIVTDLVQVVPAIWFKEEEKDQKVTRTRSEMDFLATTSVGA

SEQ ID NO: 512 - protein, 386 aa, Solanum lycopersicum
MSYSRRSRYSRSPSYDRYSKSVSRSRCVSRSRSRSCDSSDVENPGNNLYVTGLSTRVKERDIEKHFSAEGKVEDVRLVLDPWTHESRGFGFVTMSSVEEADRCIKSLNRSILEGRVITVEKARRRRGRTPTPGKYLGLRTVRVRRESRTYPHYSRNHSPCYSSESYRSRSRSYSPYYRQEHRSYSYYRGRQRSHSSYYSRHHCYSESPYSPYYSRGRSYSRSLSPYNGRDRSYSPDDCYYRRSRYHDYSPDNHRRDRSYSPDDRYYRRSRYRDYSPESHDLSDSPDVRDNRMSRYRDYSPNNSYYYRRNRYRSISRSISPRYRRSYSRSVSPRWSKRSYSRSVSRSSCSRSSYSPNQKKSSKKSRSVSASSRFVSRSVTPRSSPSS

SEQ ID NO: 513 - protein, 625 aa, Solanum lycopersicum
MTSNIHFFLLYVVSLFLFVQARLNLYPPDHAALLLVQKDLGIISVNNPCTLAGISCERRPGNTTQVVRVTRIVFRSNGLKGTLSSAIGKLTELKELSLSDNQLSEQIPVQIIDCRKLEILQLQRNRFSGKIPSELSALNRLRIVDFSSNEFSGNLDFLKYFPNLEKLSLADNMFTGKIPFSLKSFRNLRFLNISGNSFLEGPVPVMSQIEHLSADLNRKNGVPKRYILAENSTRISAMGPASVPAPAPAPVNRVVPAMHKRKNKKRKLRSWFLGFLAGTFAGGISAVLCSLLFKMVMFFVRRGNNDSSLTIYSPLIKKAEDLAFLEKEDGVASLEMIGKGGCGEVYRAELPGSNGKIIAIKKIIQSPMDAAEITEEDTKALNKKMRQVKSEIQIVGQIRHRNLLPLLAHMPRPDCHYLVYEYMKNGSLQDILQQVTEGTRELDWLGRHRIAAGVAAGLEYLHINHTQRIIHRDLKPANILLDDDMEARVADFGLAKAVPDAHTHITTSNVAGTVGFIAPEYYQTLKFTDKCDIYSFGVVLAVLVIGKGPSDDFFQHTSEMSLVKWLRNVMTSDDPKIAIDPKLIGNGYDEQMLLVLKIACFCTLDNPKERPNSKDVRCMLTQIKH

SEQ ID NO: 514 - protein, 182 aa, Solanum lycopersicum
MGLRAIPFSPSQNYYLSGSEYLPKCSVLGSSRTGSSKLVLTISAKAKKDDAQEEEEEPKNKRKQSLFSSVTEALDFSQVRSAKDAELLDEAREKTQSGERMSKEQYGALRRKIGGTYKDFFKSYVEVDGQYVEEGWVDKTCKVCKKDTSGEARQVDKMGRYAHVACLQKSNPGNFFTKLFSR

SEQ ID NO: 515 - protein, 521 aa, Solanum lycopersicum
MGSLPEPIMDETYSKPPGIRVMERTKKANLSFKTYQGIVLIVTFLAYTSYHATRKTTSIVKSALDPQSPDVGLKFPWQRRNTTYDQNQSSKLSWMLKDGWVPFNGPDGTAMLGELDVSFLFVYAMGMYFSGHVGDRMDLRIFLTIGMVGTGVFTALFGVGYWANVHIFYYYLIVQMMAGLFQSTGWPSVVAVVGNWFGKKKRGLIMGIWNAHTSVGNIAGSVVASLLLKYGWGWSMVVPGTLIAVVGVVVFLLLPVNPESVGANKDEDEVFSPRKEGEEVTEPFLRSDGEEESAVGFIEAWKIPGVAPFAFCLFFAKLVAYTFLYWLPFYISHTAIEGRYLSNEEAGNLSTLFDVGGVVGGILAGYISDRLDARAITAASFMYCAIPVLYFYRSYGHVSMTINIILMLITGVFVNGPYALITTAVSADLGTHSSLKGNSRALATVTAIIDGTGSIGAAIGPLLTGYISTNSWSGVFTMLMGSAFIAGLFLTRLVVAEVGAKIQELGSQGSSPTSRSPDFLV

SEQ ID NO: 516 - protein, 154 aa, Solanum lycopersicum
MSLIPRIFGDRRSTSVFDPFSIDVFDPFKELGFTVSNSGETSAFANTRIDWKETPEAHVFKADLPGLKKEEVKVEIEEDRVLQISGERNVEKEDKNDTWHRVERSSGKFMRRFRLPENAKMDQIKASMENGVLTVTVPKEEVKKPDVKSIEISG

SEQ ID NO: 517 - protein, 286 aa, Solanum lycopersicum
MAAYRWKSFNDDGDRPEKPRRYGVTEMKGPNYSLFSRGLLEDVLESMGHFVDGLKLCDGSHTVMPKNYIKEVTDMAHKHNVYVSSGDSADQMLFRGPSSLKEYIEECKQLGFDSIELDVASLGLPEETLLRYVRLIKSSGLRAKPQFSVKFNKSDIAFAGDRAFGAYVIPAPQTSEMVEDVDLLVRRAERCLEAGADMIMINADDLCRQAGLLRSDIVAKIVGRLGLEKTMFEASNPKISEWFVKRYGPKVNLIVDHSQVMDLECLRGRNLGQNHSSVLGRSYFLL

SEQ ID NO: 518 - protein, 239 aa, Solanum lycopersicum
MFDTGEFSPSSSTAAVSAECFSSSSCFSSLSSSKKKKIHSSNNARRFSDEQIKSLETMFETETKLEPRKKLQLARELGLQPRQVAIWFQNKRARWKSKQLERDYSILKSNYDNLASQYEALKKEKQSLLIQLQKLKEIESDNRCSVIKKNEMEGMPSLSFDLSSQHGTNGVMSDDDIDSSIRADYLGLDDDAKYHLLKIVETGDSSLTSPENWGCLDDDGILNHQPNSSSYDQWWDFWS

SEQ ID NO: 519 - protein, 289 aa, Solanum lycopersicum
MTRRKCRHAPYTDDSRRRFAPPEAQPQPQLQLQLRIHPSDLIDDREVAQQREIEKLLQENRSLAGAHVSLNQELSAIQHELRLLSSTAATVKTERDAEVREVYDEARKKESDVCILDELRVDLARVRSDIQNLVDDRKELTAKLQNMEEDLVKVGSELQQFPVIKAEMESMHKEVQRGRAAIDYEKKMHTSNLEYSQAMEKHKITLASEIEKLHAELANAEKRARAAAAAAAPSNLNHQISAATPNFTYSANYGNPETGYGENLYPAPYAVHQVQGSADANTQYVGGHH

SEQ ID NO: 520 - protein, 657 aa, Solanum lycopersicum
MDSQSSPHGSIIFSTVGRTNYGFDIFSIKSPFSFLNSPVEHRLTDGTSINYNGQFVDEDQTLVFVSERSGAPRIYLRHPSSQVQMEQLPTPIDSLFLDRPFLRNKQLYYISAHQQPKQVFTSSSALYSTNIEDNSNIIRLTPYGCVDYSPAISQSGHLIAVASYGDRRWPTGEFHDLTTDIVVFPESDPEKRIVVCQHGGWPTWSGDSTIYFHRQADDGWWSIFRVDLLEDSLNLRTDPIRVTPPGVHCFTPAASHSSKSMIAIATRRQGTKYRHIEIFDVESHKFYSVTELLNPTTHHYSPFFSPKSSFLSYHRFRGESSSGDATIPSLAPIISPEKGLRMLRLNGSFPSFSPSGDFIAFNHDFNPNSGLKIIKSDGSKKWTLFRGRTAFCNSWSPAEPNVIFTSIGPVFDSVKATVQIARVSFNSLNLTNDDCREIPVEIKVLTKEETGNNAFPSCSPDGKHIVFRSGRAGHKNLYIMDSVKGELEGGGIRQLTEGPWIDTMPSWSPDGKLIAFSSNRHNPDNVTCFSIYVIHPNGTGLRRIHVAGPEGSDEVDKERLNHVCFSKDCEWLLFTGNLGGVTAEPVSLPNQYQPYGDLYLVKLDGSGLRQLTCNAYENGTPAWHPSGTPMTALDIERNVIVGDKLRGEFDDVLWMNC

SEQ ID NO: 521 - protein, 780 aa, Solanum lycopersicum
MGKKQQKKVQNQEELLKTLGDFTSKENWDSFFTIRGSDDAFEWYAEWSQLKEPLLSNLTIPSSNDAVSAKELQILVPGCGNSKLSEYLYDEGFCNITNVDFSKVVISDMLRRNIRARPVMKWRVMDMTNMQFAKESFGAILDKGGLDALMEPELGSKLGTQYLSEVKRLLKVGGRFICLTLAESHVLGLLFPKFRYGWKMGIHPIALKPSDRSSLQTFMVVAEKENSPALCQILSTVNQSSLGGPKNQVHGLFQALEDENKIRADYSSGSDITYALEDLKIGVEGNLAELHPSRRVQLSLGEPGVSLFCYRAVLLDAQRNFGPFAYQCAVFLVPKTRAHEWLFSSEEGQWAVVESSKAARLIMILLDSSHSDASMDDIQKDLSPLIMQLAPGDFDDEAQIPFMAASDGIKQRKIVQEITSPLTGPIIVDDVIYEKVDENISRLFASEDVIFRRLTFQRTESLVQSEAVLSKEGSPKSLADINQKIGQSSSKSKKKGNQKKSGSNVSSSDGLSKDLKVDHSYLASSYHTGIISGFTLISSHLDGLASTGGMVRSVVIGLGAGLLPMFLRKHLSFAEIEVLELDPVVVDLARDYFDFRDDERLKVHVTDGLKYVKDAAHAVTNGYENDVSEAKVPSSNGNSTLSNAPLKSTEKIDMLIVDVDSSDSSSGLSCPAADFIEESFLMAAKDSLSDQGLFVINLVSRSQAIKDSIYSKLKSVFPHLFHLQLDEDVNEVIFALKTETCITEDKFHKASQRLTRLLNLENSSWGQNITEATSKIKRLR

SEQ ID NO: 522 - protein, 289 aa, Solanum lycopersicum
MGSSFSVLIPQFSSTVTQQTHPSLGDLPESCVASVLVYMDPPQICKLSMLNRAFRGASSADFVWESKLPMNYTSIIQRVFAGRNFPANLCKRDIYAKLCRPNSFDGGSKKVWLDKKTGRVCMSISSSGLVITGIDDRRYWSRIETDESRFKSVAYLQQIWWFEVDGEVDFPFPVGSYSIFFRLQVGRASWRFGRRVCNSEHVHGWDRKPVRFQLSTSDGQQATTQCYLNEPGIWKYHHVGDFVATGSVEPMKVKYSLTQIDCTHTKGGLCVDSVLICPVEFTERLKQSF

SEQ ID NO: 523 - protein, 311 aa, Solanum lycopersicum
MGDIVIEHSGSPHYEALNLQNVTTSENDADLVRSYCGGFFPEGSTHEEKSTCTEALDRGFFEYGCSHYRRRCRIRAPCCDEMFDCRHCHNESKNNINIDQKLRHEIPRHKVERIICSLCNTEQEVRQVCINCGVCMGRYFCETCKLFDDDISKRQYHCSGCGICRIGGMENFFHCPKCRCCHSVLLRNSHPCVEGAMHHDCPVCFEYLFESINDVTVMPCGHTIHKNCLKEMQEHYQYACPLCCKSVCDMSKVWEKFDMEIAATPMPEPYQDKKVWILCNDCGITSEVQYHFVAQKCPCCKSYNTRQTRGG

SEQ ID NO: 524 - protein, 100 aa, Solanum lycopersicum
MAPMSGKPFALTGSSSKNDGVLARISQSTIVTKGKQAACDATYVGKKLAKSTGKAAWLVATTFLVLGLPLIIVMDREQQLNDLDLQQASLLGASPATTQN

SEQ ID NO: 525 - protein, 195 aa, Solanum lycopersicum
MKKIEDPTSRQQFYSKRKDTILKKSNELAVLCDVDVGLLMFSPAGEVTSYSSKERLEDVMLLAMNKAGELNKLSPENPNEQALMDSLTQSKHEAEMVEKIAIVEAHEEKLNGVKERLSEAQQKIRYYEPQVESINSVQEADAYEKFILSALELIQLSKAKLLGDQEFLQRNENVAVSSVNAEAMAAEGTSGGWMY

SEQ ID NO: 526 - protein, 329 aa, Solanum lycopersicum
MAGKIMHAVQYDSYGGGAAALKHVEVPVPTPKKDEVLLKLEAASINPVDWKIQKGVLRPLLPTKFPFIPTTDVGGEVVEVGSNVKSFKAGDKVVAMLNTLNGGGLAEYAVANESLTVPRPAEVSAAEGAGLVIAGLTALQALVNPAEVKLDGTGPRKNILVTAASGGVGHYAVQLAKLGNTHVTATCGARNIDFVKSLGADEVLDYKTPEGAALKSPSGQKYDAVIHCTTGIPWSTFEPNLSSSGKVVDITPGVSAMWTFAVKKLTFSKKQLVPLLLIPKKENLELIVGLVKEGKLKTVVDSRFPLSKAEDAWSKSIDGHATGKIVVEP

SEQ ID NO: 527 - protein, 160 aa, Solanum lycopersicum
MDGSNYYLMNRSHIPAFGSWDCNNDFPIPFTQCFESAKKVGLLRYSYSDDRDLYVAGDLYQNDILTPAMIVVPRRKRKSSISDGVGKARKERWVVCNCEYEYDEEKKDITIVPPPPPPIRASKAVDEDLYKISPQLLHYKPTRKGVRRFFSSCLLPTCAS

SEQ ID NO: 528 - protein, 722 aa, Triticum aestivum
MATTPALHDALLDFTSRENWDKFFALRGDGDSFEWYAEWPQIKAPLLSLLLGEEGTEILVPGCGSSSLSEQLYDLGFRRITNVDFSRVIVADMLRRHARVRPQMRWRVMDMTNMQFPDGSFDFILDKGGLDALMEPEVGTKLGMKYLDEAKRVLKSGGKFACFTLAESHVLDLLLSEFRFGWDMTIQAIASEPSSKSAFQTFMVVMVKGKMGVVHTIKSLVDQPAEYCNMQQANAVIHALQNENKIRESHNSGVDILFSLRDLQLGTIGDLKVIVPGRRRQLILGEQGSSLYCYKAVLMDAKNQNETFVYHCGVFIVPKARAQEWLFASEEGQWLVVESAKAARLIMVFLDSRHASADIDVVKKDLSPLVMDLEPEYPEETDPMPFMMASDGVKQRDILQEVTSEITGPMVVEDVLYENVDGDQSCMSEKMFRRLIFKRSSGLVQSEALLMRESPSDETDSKTKNSSASSKKKSQKKGLTGSKDSLRVDHSYLGSSYHSSIICGLSLVASALSAAASSGERVSTTIVGLGAGSLPMFLRGCLPHLNIEVVELDPMMEEVAAKYFGFSMDEQLKVHLGDGIKFIEENAHSEPNGKDSDAVRILIVDVDSSDLSSGLSCPPANFVEDAFLMSAKRFLSAGGLLIINLVARSSAVKEMVISRLKAVFENLYSLQLEEDVNEVLFASPSKRYLEIDHLDEAATKLKAMLKFPVDVESDMKNLQRLQ

SEQ ID NO: 529 - protein, 287 aa, Triticum aestivum
MGAVGSSARRGGGTALGDLPENCVAEVMLRLNPTEICGMARLSRTFRGAASGDAVWEAKLPRNYARLLAAAGGDEEAAALEAEAIPKKELYARLCRRNSLDGGTKEFWLDKAGGGTCMTIYSRALSITGIDDRRYWNFIPNGESRFRSVAYLWQIWWFEVRGEVEFCFPEGTYSLFFRIHLGRPFKRVGSRVYSSEHIHGWDVKPVRFQLWTSDGHQAQSKCYLTDPGVWIYHHVGDFLVKDSNEPLNIQFAMVQIDCTHTKGGLCMDSVVIKPKCLARKKGPGRYE

SEQ ID NO: 530 - protein, 413 aa, Triticum aestivum
DNNTASRTAEADRLHTMLLAMADARAVLIKLADRVHNMRTLEALPLVKQQRFAKETMEIFVPLANRLGIASWKDQLENLCFKHLNPEEHTKLSSKFAETFDEALITSAVDTLDEGLREAGISYHNLSGRNKNLYSVYSKMQKKNLTMDEVHDIHGLRLVVDKEEDCYRALDVVHKLWPQVTGRFKDYISRPKLNGYRSLHTVVMSDGDHTFEVQIRTKEMHLQAEYGFAAHWRYKEGSCRHSFVLQMVEWARWVLTWQCEALNKEHSSSQVKSDSIKPPCPFPLHSEECPYSYTRQCNHDGPLFVILLEHDKMSVQEFPAGSTVMDLMHRVGANSPRWSPYSIPMKEDLRPKVNHEPISDLGRALSMGDVVELTPALPDKSLTEYREEIQRMYDRGGFALAATRSGSGGSRRR

SEQ ID NO: 531 - protein, 65 aa, Oryza sativa
MSSSAKTSWPEVVGLSIEEAKKVILKDKPDADIVVLPFGTAVPEDFRFNRVRIFVDTVAETPRVG

SEQ ID NO: 532 - protein, 140 aa, Oryza sativa
MVVSCQLKPAPAPAAASRGGGAPHLQQLRRACVAAAAACAVLGTAGGPGEGAVMARAPEATAAAAAGPARWSDRRQCPPWRANSLENIVPENLPRPSARRRFNSITAAAAAESAPPPASASPDAVLPFLAPRSGMGCFSL

SEQ ID NO: 533 - protein, 269 aa, Sorghum bicolor
MRKRERENPCGICGHYHKYEEGEVCGVCGHRLKPSDGEGAPSSHESAFPTEVLKEFLFLGSYDNASRSEVLRTLSISHILNTVPDCHNLYKNSFTYHSLQRDRPLDFDEANQYLEKCERDKSRVLVHCMTGKNRSAAIVAAFLMKSRGWRLAQSFQWVKDRRPQVQLTDASQNELLEYELKLFGPSAQPLVPTESFASLGFGYEKPAGDIQAPMFNQMTMPSIFERVNPNDHPTNFTFGAERIAEVNPHDNNSDGGVNPTKTENLMDGS

SEQ ID NO: 534 - protein, 254 aa, Sorghum bicolor
MASLQVSGAGVGAAAFAAKGKASIGALRLPSTVTVGEVCPARRAFRGLVVRAATVVAPKYTTLKPLADRVLVKINSSEEKTTGGILLPTTAQSKPQGGEVVAVGEGRIIGDKKVDVSIQVGAQVVYSKYAGTEVELNDYNHLVLKEDDIIGILETDDVKDMKPLNDRVLIKVAEAEVKTPGGLLLTETSKEKPSIGTVVAVGPGPLDEEGKRSPLSVSAGSTVLYSKYAGSEFKGADGTNYIVLRVSDLMAVLS

SEQ ID NO: 535 - protein, 337 aa, Sorghum bicolor
MARWAIAIHGGAGVDPNLPQHSQEEAKRVLARCLQVGVDLLRAGAQALDVVEAVVRELETDPFFNSGRGSALTRAGTVEMEASIMDGRGRRCGAVSGVSTVKNPVSLARRVMDKSPHSYLAFHGAEEFAREQGLETVDNSYFITEDNVGMLKLAKEAGTILFDYRIPLTGADTCSALAAAAVDSGNHHHKAGMVMNGLPISVYAPETVGCAVVDASGACAAATSTGGLMNKMTGRIGDSPLIGSGTYACGACAVSCTGEGEAIIRCTLARDVAAVMEYKGLPLQQAVDYCVKERLDEGFAGLIAVSSTGEVAYGFNCTGMFRGCATEDGFMEVGIWE

SEQ ID NO: 536 - protein, 157 aa, Sorghum bicolor
MAVSSISCSLRPPAPVREASARLTPPQPSPPKTTATPWADGLRRACVAAAATAACVVIGTAGGGDVVAASMPRDTPVLAVDARPAAAAPRWSDRRECPPWRANSLENIVPENLPRPSARRRFNTVKRAPRKAPALGRQAVAPPFLALRSGVDDCFTL

SEQ ID NO: 537 - protein, 401 aa, Sorghum bicolor
MGCGPSIPEKYSIRGKSGKRRSIIQEVAVFVPTIRIPLASDIAHPLRGIVSKDLVDRLSTLRAHVVALAEEIYSADVSAVQELQHALEEYLPVVLGLTMKESRLESSVQFTWKTLDDDQECCLASAWYEVLSVVHMMAMLALFEANLLLIPKNSQVGGERKVSEDAKKDVVDSLLRASGCLDYLVHRILVQIPAQCVEIQLGLASECEKATLSVKRRLACEQVSYFSQAHYCLSGCDTSDSYGKKLLLFLKWKCMEAKAVAYYYHGLVLDKGGEPANHISAVCCLSAADDLLSDSKRACLSFCLANPVTRVPPPWGVMKNMHKKIPDVAYKKFQVYGHLFEQNKNSTLQSVPDLPEFALSLRPEGYELPTTDSIWENVNGQPQIQSLKEHLDDGEDEVDTK

SEQ ID NO: 538 - protein, 646 aa, Sorghum bicolor
MLIRADGGHATRRSKKNKITCNDDRDTTEPLISGDIHQDSEQGIWSELSEEVALNLPGSVVSVAVLCGSSVLFACSGIAIGCQGCVTRILTSASLVRALNDKTKHPANLKVEVRYGGNVVTGFLGKYDLDYGIAIVNVTACLDVQAIRLTHVVEMEFRPSTKVVALGRDLSGKLMTTGGILTRDSRESEDSEELMLSTCKICEGWEGGPLFNVEGNLVGMNLFFVKERTVFLPTSIIFERLEHFRVFFRRGEFLERLRNLKACSTGETLVPENSGADLTRCSKEKRTDDLTSLDIKTDLTRSSKKKRTCSGGGKTTKSLISGNSDVLSDDPFEDLDISGYPKPPIEMSDGMVLVNTFEDTFGDKYGGGVWSELSETVCSNISRNVVALASCYGKRRIFACTGFFVEWNGCTTILTSASLLSDFVDDEKILEDLRIKVLLPTKHIREGTLLHYNIHYNVALVSVKDFCSPHPMDIEHQRHSRPRQLVSVGRCIESGTLMAARGIHLNRFGRLDCKLLQYSTCKITKAGIGGPVVDLDGKFIGMNFYDMQRTRPPYLSWDVILDVLAHFKTKRSVPEVGHASYYQFAVLFNWTIDGDKSVRPNSWPVPKAFWCPAEYVDMVGQSCVQKRGKRSRPRIRVINGREYRYA

SEQ ID NO: 539 - protein, 381 aa, Sorghum bicolor
MALQVTGGVGCCCPRPQPGCGGRRLAQAAAALCRPPRAVASSGTTTTVVEEDEGKVRLGGSSVAVTKLGIGAWSWGDTTYWNDSEWDDRRLREAQDAFDASIDNGMTFFDTAEVYGTALMGAVNSESLLGGFIKERQQKDQIEVAVATKFAALPWRFGRGSVLSALKKSLDRLGLSSVELYQLHWPGIWGNEGYLDGLADAYEQGLVKAVGVSNYNEKRLRDAHARLKKRGVPLAANQVNYSLIYRTPELNGVKAACDELGITLIAYSPIAQGVLTGKYTPEKPPTGPRANTYTPEFLTKLQPLMNRIKEIGASYGKSPTQVSLNWLTCQGNVVPIPGAKNASQAKEFAGALGWSLTGDEVEELRTLAREIKGIKMPIEES

SEQ ID NO: 540 - protein, 336 aa, Sorghum bicolor
MADPVEWSRENITFLHENEVNADAENWLAVTVVLKVPPTANQDSVNRELIRCAILDKCRIIVFKSDIMQYDHGYLVRTSGREETQLILNTDFLDVGPNKLIVYPWSPYNGSTCQYFDHIPPNIGMVTPAKRPRESDVLENLKVRGHGLPPHLCTSNVIRKVFSSICRFHKMEIYQGDLSFAIWTFASRQCIPDTWTVAVIKDTMLYMWPLWLFVEGCAPPPAPRSEVLKNTRVKFNLYPGTSLGGGGGGASGSGGGGTAGGHDGHSREAMLLGYVVESPSSSDSSSDSDSSQPDSPCQSDLFAEPTLRVSTSDTVSQVPETPLGSGETELVPAYNY

SEQ ID NO: 541 - protein, 462 aa, Sorghum bicolor
MAGKKRKSGSEKPAKHRLPLGADADAVAEASKRRRSGAAKQHQADEEASIPPSLSAKILREARKQQQEEMRADDSSDEQRPSAAEAAAGPSTSSSFPVPAADGEEEEDDDVDEFDGFDAQTEYDGGEVEINEEDERALAAFMSKDKAAERTLGDIILQKIMEKDAEVATEGRPRVKLDNSIIELYKEVGKFLSRYTSGKIPKAFKRIPSLECWADVVQLTEPENWSPNAVYQATRLFSSNMNTKNAERFYEAILLPRVRNDIRKNKRLHFALYQSLKKALYKPAAFNKGILLPLCRERNCTLREAVIIGSIIQKVSIPFLHASVALVKLAEMEYCGTTSYFIKLFLDKKYALPYRALDAVLAHFMRFLNDERTMPVIWHQSLLAFVERYKNELEKKDKENLARLLDHQKHYLVTPEIRRELRGSCNRGEKDMNLQTLSPISVITKPIEEDKWDVPQVPMEED

SEQ ID NO: 542 - protein, 207 aa, Sorghum bicolor
MFPCRPLAPRPPPRALSLLRLPPSSLRPPPSSLRVVRCMAKERRVRMVAKQIQRELADMLTRDPVLQRAVLPEAALGADRYLSSLTTIADVELSNDLQVCKVYVSVFGDERGKKVAIEGLKAKTKYVRSQIGKRMKLRLTPEIRFIEDESMERGSRILAILDKLKEEREQQEGKDGEEDVEGSYISEEEDGDWDADDPDEEDIIYVK

SEQ ID NO: 543 - protein, 73 aa, Sorghum bicolor
MSHEAGIVEFCLPACLPCCDQELHVSVAGAKPCRTGRGNSRHITYRQEDRELCKSGSPRLLLQVLRCLHAFLT

SEQ ID NO: 544 - protein, 227 aa, Sorghum bicolor
MARGKVQLRRIENPVHRQVTFCKRRAGLLKKARELSVLCDAHIGIIIFSAHGKLYDLATTGTMEELIDRYKTASGEAADGSGDNRMDPKQETMVLQQEINLLQKGLRYIYGNRANEHMNVDELNALERYLEIWMYNIRSAKMQIMIQEIQALKSKACQKLEGMLKAANEILREKIVEQSSLLDVGMVVADQQNGHFSTVPLIEEITNPLTILSGYSNCRGSEMGYSF

SEQ ID NO: 545 - protein, 484 aa, Sorghum bicolor
MSSGKAQQRPHAVLIPQPAQGHVTPMLHLAKALHARGFRVTYVNSEYNHRRLLRSRGQDSLAGTDGFRFEAVPDGLPQSDNDDVTQDIAALCLSTTEHSAAPFRDLLARLNATPGSPPVSCVIADGVMSFAQRVAEEMGILALVFWTTSACGFMGYLHFAELIRRAYVPLKDESDLSNGYLDTAIDWIPGMPGIRLKDIPSFIRTTDPDDVMLNFDGGEAQNARKARGVILNTYDALEQDVVDALRREFPRVYTVGPLATFANAAAGGGLDAIGGNLWKEDTSCLRWLDTQRPGSVVYVNFGSITVMTAAQLAEFAWGLASCGSPFLWVIRPDLVSGENAMLPEGFVTDTKERGILASWCPQELVLSHPSVGLFLTHCGWNSTLESICAGVPMLCWPFFAEQPTNCRYVCDKWGIGMEIDSDVRRQEVARLVREAMDGERGKAMRLKSMVWKEKARQAVDEGGSSRKNMDRMVEFLLAGNDVPS

SEQ ID NO: 546 - protein, 599 aa, Sorghum bicolor
MQQRLLALVAAAALLLALRPALATDPYAFFDWDVSYVTEAPLGVKQQVIGINGKFPGPVVNVSTNWNVVVNVLNDLDEPLLITWNGIQHRKNCWQDGVLGTNCPIPSGWNWTYEFQVKDQIGSFFYFPSTGLQRAAGGFGGIVVNNRDVIAVPFGRPDGDITIFIGDWYNKNHTDLRKMLDKGNDLGMPDGVLINGKGPYRYNHSLVPAGIEYETFNVHPGRTYRIRVHNVGTSTSLNFRIQGHNMVLVETEGSYTSQQNYTNLDVHVGQSYSFLVTTDQNASSDYYVVASARQVNESLWRRVTGVAVLRYSNSRAPASGPLPDPPQDQNDRTFSMNQARSVRWNLSAGAARPNPQGSFRYSSINVTQAYLLRSTAPVSIDGRRRATLNGLSYAPPETPLRLADAYGVKGVYTLDFPERPLNKGAPRIARSVINGTYRGFMELIFQNNDTRMQSYHMDGYAFFVVGMDYGEWTEDSRGTYNKGDGVARSTIQVYPGAWAAVLVSLDNVGVWNVRSENLDSWYLGQEVYVRVVNPEDTGNKTEMGIPDNALYCGQLHKYQKEQTPHHKMGVSAVAPSSLSLARRLVASALLVAGSFVLAP

SEQ ID NO: 547 - protein, 73 aa, Sorghum bicolor
MSSTATAADCGGAKTSWPEVVGKSVEEAKKVILKDKPDADIVVLPVGTIVTADFVPNRVRIFVDTVAQTPHIG

SEQ ID NO: 548 - protein, 320 aa, Sorghum bicolor
MEYRDKLVLAPMVRVGTLPFRLLAAEYGADITYGEEIIDHKLLKCERVTNESLGTTDFVEKGTDSVVFRTCPEERGRVVFQMGTSNAVRALKAAQLVCQDVTAIDINMGCPKSFSLSGGMGAALLSKPELIHDILTTLRRNLDTTVTCKIRLLNTPKDTVELARRIEKTGVPALAVHGRKIKDRPRDPAKWDEIADVVSALSIPVIANGDVFEYEDFKRIKDATGAASIMVARGAMWNASIFCAKGKTPWEDVKREYVRKSILWDNDVKSTKHTLKEMIMHYSCLELPEGKGVIKCDTSEDLARLYGEEDYYNFVVSNRK

SEQ ID NO: 549 - protein, 729 aa, Sorghum bicolor
MGRGGIGGAVGMAMENADSARAFVKDVKRIIIKVGTAVVTGQNGRLAMGRLGSLCEQVKQLNFQGYEVILVTSGAVGVGRQRLQYRKLIHSSFADLQNPQMNFDGKACAAVGQSGLMAIYDTLFSQLDVTSSQLLVTDRDFKDPSFGDQLRETVFALLNLKVIPLFNENDAISTRRQSDEDSSGVFWDNDSLAALLAAELNADLLIMLSDVEGLYSGPPSDPQSKIIHTYVNEKHGKLISFGEKSNVGRGGMQAKVAAAANAASKGVPVVIASGFATDSIIKVLKGEKIGTLFHNEANLWECSKEATAREMAVAARDCSRRLQKLSSDERKKILLDIADALEANEGAIRSENEADVEAAQGAGYEKSLVARMTLKPGKITNLARSIRAIADMEDPISHTLKRTEVAKDLVFEKAYCPLGVLLIIFESRPDALVQIASLAIRSGNGLLLKGGKEAMRSNAILHKVITGVIPDIVGKKLIGHVTSKDEIADLLALDDVIDLVIPRGSKNLVSQIKATTKIPVLGHADGICHVYIDKSADMDMAKRIVLDAKVDYPAACNAMETLLVHKDLNKSEGLDDLLVELEKEGVVIYGGPVAHDKLKVPKVDSFRHEYSSMACTLEFVDDVQSAIDHINRYGSAHTDCIITTDESAAEAFLQQVDSAAVFHNASTRFCDGTRFGLGAEVGISTGRIHARGPVGVDGLLTTRCILRGSGQVVNGDKGVVYTHKDLPLQ

SEQ ID NO: 550 - protein, 247 aa, Sorghum bicolor
MEEREKLVCLAKLAEQAERYDDMVEFMKNLARMDVDMSAEERHLFSVGFKNTIGAKRASWRIICSHEQKVTTDRQTGVMIDAYKKIVEDELRKVCNEVLSVIAIHCLPLANTSENVVFFYKMKGDYYRYLAEFSSGTEKKAASDQSLMAYQHAMVVASSELSPAHQIRLGLALNLSVFFYEIMNSHERACQVAKQAFNEALTEINSGEGVYKDSTLMMQLLKDNLALWTSELTGGEASKDNDVDMEG

SEQ ID NO: 551 - protein, 301 aa, Sorghum bicolor
MGAWVSVLLGMDDGAAAAAAARPAAVGLGDLPELCAAQVLLRLDPPEICSLAGLNHAFRGAAGADFVWEAKLPENYSYLMEFVGGSGDEGRRRRRRAGKKEIYARLARPVPFGDGQKEFWLDKSKGMICMALSSKALVITGIDDRRYWQHMPTSESRFQSVAYLQQIWWFEVVGEVDFCFPVGTYSLYFRVHLGKFYKRFGRRHCTSEHVHGWDKKPVRFQLSTSDGQQALSQCYLEEPGSWVLYHAGDFVASKPDQPMKLKFSMAQIDCTHTKGGLCIDSVLIYPKGKGFQQERVVRSQK

SEQ ID NO: 552 - protein, 190 aa, Sorghum bicolor
ETVIPSSIPSFFLRTHAPLLLTLLAERHPPLSPRLARRALPCPPSAALSPRPPSATSPAERRLASRPREPRPPPPRDRPPSDVRREARAPSAARPAASRRSSSATSPERSRSTPRRERRPPRDCPRERRPRSPTATAPSLSALRGRVVLVRYRPREPRPRAPPVTALFLAATSTVAPVTTTWNLNIKTQG

SEQ ID NO: 553 - protein, 214 aa, Sorghum bicolor
MKLKLLSPFLLLAFLAAAAYAAPASREAAAAAVTTTLQSASSDPENQCVYTVYVRTGSIWKGGTDSTIGVTLLGADGTGIRIRDLVAWGGLMGSGHDYYERGNLDIFSGRGPCMSQRPCAMNLTSDGSGAHHGWYCNYLEVTVTGPHLGCAQTLFTVEQWLATDASPYRLYAVVDECESETTTKRRQRQETETQTRSPAGEAEADEATVSVTAL

SEQ ID NO: 554 - protein, 419 aa, Sorghum bicolor
MAAGKARKRARQAAPASDGGDRIGALPDETLHHVLSFLPAQEAVRTCVLARRWLHLWKSATGLRIVGANGEAPVPFEEVREFVDSLLLLRGSSPLETFELRVAGDDIDVRHVRLWVRYAVQCKAQVLRLSFLGNTHVGPVARLRPDDPPLASRHLTKLELRGLVFNDDFLDFSRCPELQDLHIQDCSLEYAERISSQSLRHLYIRGAFNPSSRAGILAPNLASLVLEVTFGMTPVIQKMPLLVKGTVGFRGLCEDLCSSPAPNYVSYVDCDKSCRGCIRDGSACVILCAVSQAEDLVLIASPDTFIFRRDLKGCPTFNRLKSLCLDENWCVPDEYPLSCILELSPVLEKLAIILYFKIHLLEANVQIKGRFNPKELPPTISSHLKEVEILCGGVDGNVLKVLRFLSKLNISFSFPPIEA

SEQ ID NO: 555 - protein, 72 aa, Sorghum bicolor
MLLRAQDHLKLRACGKVLLKNSLISSILKRDGDDKIKIVDLYPTHDKNEIRTIEKWVLSYLDHDMTLKVRWL

SEQ ID NO: 556 - protein, 475 aa, Solanum lycopersicum
MEKKGHAVCVPFPAQGHVIPFMKLAKLLHSRGFYVTFVNTEYNHRRLIRSQGPDFVKGFQDFQFETIPEGLPPSDRDATQDPASLCDSIRKNCSTPFRELLSKLISSPKVPPISCVISDGVMSFANKAAHEFGILDVQFWTASACGYMGYLQLDELTKRGIIPFKDYSFMEDGTLDRVVDGIPGMRNIRFKDLPSFIMTTDPHDILLNYLRDEAQNCLKSSAMIINTFTELERQVLEAIEARHPNIYVTGPLSLMEKTIPENELSSFRPSLWKEEFHCLEWLNKQEPSSVVFVNYGCVTLMSDNHLKEFAWGLANSKHPFLWIVRPDIVMGNSAVLPDEFLGEIKDRGLLATWCPQDQILSHPSIGVFLTHCGWNSTMESLSSGVPLICWPFFAEQQTNCRYACVEWGIGVEVNKDVKRQEIEAIIKDMLEGEKGKELKDKALEWKKKAAEATNIGGPSWKHFDTFLERLLLNRE

SEQ ID NO: 557 - protein, 249 aa, Triticum aestivum
MEERGKVVCMAKLAEQAGRYDDMVDFMKKLARMDVDMSVEERHLFSVGFKNTIGARRASWRILSSLEQKVAAGEQAGRMISVYRTKVEDELRMVCNEILSIIAIHCLPLANAGENVVFFHKMKGDYYRYLAEFSTGVEKKSAADQSLMAYQHAMVVASTELSPAHPIRLGLALNFSVFFYDIMNCHQRACQVAKQAFDEATTEINSAGMDGNNDSTLMMQLLNDNLALWKSELTEGETSKDSDIDMEEG

SEQ ID NO: 558 - protein, 190 aa, Arabidopsis thaliana
MTSSIHELSDNIGSHEKQEQRDSHFQPPIPSARNYESIVTSLVYSDPGTTNSMAPGQYPYPDPYYRSIFAPPPQPYTGVHLQLMGVQQQGVPLPSDAVEEPVFVNAKQYHGILRRRQSRARLESQNKVIKSRKPYLHESRHLHAIRRPRGCGGRFLNAKKEDEHHEDSSHEEKSNLSAGKSAMAASSGTS

SEQ ID NO: 559 - protein, 308 aa, Arabidopsis thaliana
MQVFQRKEDSSWGNSMPTTNSNIQGSESFSLTKDMIMSTTQLPAMKHSGLQLQNQDSTSSQSTEEESGGGEVASFGEYKRYGCSIVNNNLSGYIENLGKPIENYTKSITTSSMVSQDSVFPAPTSGQISWSLQCAETSHFNGFLAPEYASTPTALPHLEMMGLVSSRVPLPHHIQENEPIFVNAKQYHAILRRRKHRAKLEAQNKLIKCRKPYLHESRHLHALKRARGSGGRFLNTKKLQESSNSLCSSQMANGQNFSMSPHGGGSGIGSSSISPSSNSNCINMFQNPQFRFSGYPSTHHASALMSGT

SEQ ID NO: 560 - protein, 396 aa, Arabidopsis thaliana
MGFWSLLEVASMPVIQVLFMSLVGAFMASDRCKLFPVEARNSMNKVVFVLFAPALMFANLAQTVTLEDIISWWFMPVNMGLTFLIGGLLGWLVVKILKPPPYLEGLIVATCSAGNMGNLPIILVPAICDEDKSPFGNRSVCRTVGLSYASFSMALGGFYIWTYTFRLIKGSAMKVQAIEESEKIAIKSSNSDLEADHKTHLLGAPEDKENKVVKEKTGFWRKGVDFLHEILEELLAPPTLGAIIGFIFGAVRWLRNLIIGDDAPLRIVQSTAKLLGDGTIPCMTIILGGNLIQGLRSSAVKPMVVLGIVCVRYIAMPIIGIGIVLTAANLGFLPADPLFQYVLMLQFTLPPAMNIGTMTQLYNVAQDECSVLMLWTYLVAILALTVWSTIFLHLLV

SEQ ID NO: 561 - protein, 162 aa, Arabidopsis thaliana
MATSKCYYPRPSHRFFTTDQHVTASSDFELDEWDLFNTGSDSSSSFSFSDLTITSGRTGTNRQIHGGSDSGKAASSLPVNVPDWSKILGDESRRQRKISNEEEVDGDEILCGEGTRRVPPHELLANRRMASFSVHEGAGRTLKGRDLSRVRNTIFKIRGIED

SEQ ID NO: 562 - protein, 633 aa, Arabidopsis thaliana
MSASWADVADSENTGSGSSNQNSHPSRPAYVPPHLRNRPAASEPVAPLPANDRVGYGGPPSGSRWAPGGSGVGVGGGGGYRADAGRPGSGSGYGGRGGGGWNNRSGGWDRREREVNPFENDDSEPEPAFTEQDNTVINFDAYEDIPIETSGDNVPPPVNTFAEIDLGEALNLNIRRCKYVKPTPVQRHAIPILLEGRDLMACAQTGSGKTAAFCFPIISGIMKDQHVQRPRGSRTVYPLAVILSPTRELASQIHDEAKKFSYQTGVKVVVAYGGTPINQQLRELERGVDILVATPGRLNDLLERARVSMQMIRFLALDEADRMLDMGFEPQIRKIVEQMDMPPRGVRQTLLFSATFPREIQRLAADFLANYIFLAVGRVGSSTDLIVQRVEFVLDSDKRSHLMDLLHAQRENGIQGKQALTLVFVETKRGADSLENWLCINGFPATSIHGDRTQQEREVALKAFKSGRTPILVATDVAARGLDIPHVAHVVNFDLPNDIDDYVHRIGRTGRAGKSGLATAFFNDGNTSLARPLAELMQEANQEVPEWLTRYASRSSFGGGKNRRSGGRFGGRDFRREGSFGSGRGGYGGGGGGYGGGGGYGGGGGYGGGGGYGGGYGGASSGGYGGEPPSAWD

SEQ ID NO: 563 - protein, 399 aa, Arabidopsis thaliana
MAGICCGVVGETEPAAPVDSTSRASLRRRLDLLPSIKIVADSAVAPPLENCRKRQKRETVVLSTLPGNLDLDSNVRSENKKARSAVTNSNSVTEAESFFSDVPKIGTTSVCGRRRDMEDAVSIHPSFLQRNSENHHFYGVFDGHGCSHVAEKCRERLHDIVKKEVEVMASDEWTETMVKSFQKMDKEVSQRECNLVVNGATRSMKNSCRCELQSPQCDAVGSTAVVSVVTPEKIIVSNCGDSRAVLCRNGVAIPLSVDHKPDRPDELIRIQQAGGRVIYWDGARVLGVLAMSRAIGDNYLKPYVIPDPEVTVTDRTDEDECLILASDGLWDVVPNETACGVARMCLRGAGAGDDSDAAHNACSDAALLLTKLALARQSSDNVSVVVVDLRKRRNNQASS

SEQ ID NO: 564 - protein, 537 aa, Arabidopsis thaliana
MSVVLLSSTSATITKSQSKKIPFLSPTTKFPLKVSISPSRSKLFHNPLRVAAPPSVPTSDSTEEKRIEEEYGGDKEEEGSEFKWRDHWYPVSLVEDLDPNVPTPFQLLGRDLVLWFDRNDQKWAAFDDLCPHRLAPLSEGRLDENGHLQCSYHGWSFGGCGSCTRIPQAATSGPEARAVKSPRACAIKFPTMVSQGLLFVWPDENGWDRANSIEPPRLPDDFDKPEFSTVTIQRDLFYGYDTLMENVSDPSHIDFAHHKVTGRRDRAKPLPFKVESSGPWGFQGANDDSPRITAKFVAPCYSMNKIELDAKLPIVGNQKWVIWICSFNIPMAPGKTRSIVCSARNFFQFSVPGPAWWQVVPRWYEHWTSNLVYDGDMIVLQGQEKVFLAKSMESPDYDVNKQYTKLTFTPTQADRFVLAFRNWLRRHGKSQPEWFGSTPSNQPLPSTVLTKRQMLDRFDQHTQVCSSCKGAYNSFQILKKFLVGATVFWAATAGVPSDVQIRLVLAGLSLISAASAYALHEQEKNFVFRDYVHSEIE

SEQ ID NO: 565 - protein, 646 aa, Arabidopsis thaliana
MSSNSWADVSESERAPSGGGWGYSRPSRTNYVPPHLRSRTPSSEFVAPSPGNNDRGGYGGANSGYGGRGQGYGGRGSGYGGRGGPVGGWNARSGGWDRRDTETNPFGNDGNADPAVNEQENTVINFEAYEDIPIETSGDNVPPPVNTFAEIDLGEALNLNIQRCKYVKPTPVQRNAIPILAAGRDLMACAQTGSGKTAAFCFPIISGIMKDQHIERPRGVRGVYPLAVILSPTRELACQIHDEARKFSYQTGVKVVVAYGGTPVNQQIRELERGVDILVATPGRLNDLLERGRVSLQMVRFLALDEADRMLDMGFEPQIRKIVQQMDMPPPGVRQTMLFSATFPREIQRLASDFLSNYIFLAVGRVGSSTDLIVQRVEFVHDSDKRSHLMDLLHAQRENGNQGKQALTLVFVETKKGADSLENWLCINGFPATTIHGDRSQQEREVALRSFKTGRTPILVATDVAARGLDIPHVAHVVNFDLPNDIDDYVHRIGRTGRAGNSGLATAFFNDNNTTMAKPLAELMQEANQEVPDWLTRYASRASFGGGKNRRSGGRFGGRDFRRESFSRGGGGADYYGGGGGYGGVPGGGYGAMPGGYGPVPGGGYGNVPGGGYAPYGRGGGAYYGPGGYGTVPNQGYGPGVASAWD

SEQ ID NO: 566 - protein, 469 aa, Arabidopsis thaliana
MVNEEMESSLKVIDVARVTPSNSDSSESLTLPLTFFDLLWYKLHAVERVIFYKLTDASRPFFDSVIVPNLKTSLSSSLSHYLPLAGKLVWEPLDPKPKIVYTPNDAVSFTVAESNADFSRLTGKEPFPTTELYPLVPELHVSDDSASAVSFQVTLFPNQGFCISVNAHHAVLDGKTTTNFLKSWARTCKNQDSFLPQDLIPVYDRTVIKDPMDLDTKILNAWHRVAKVFTGGKEPENPKSLKLLWSPEIGPDVFRYTLNLTREDIQKLRERLKKESSSSSVSSSPKELRLSTFVIVYSYALTCLIKARGGDPSRPVGYGFAVDCRSLMVPPVPSSYFGNCVSACFKMSLTAETFMSEEGFLAAARMVSDSVEALDENVALKIPEILEGFTTLSPGTQVLSVAGSTRFGVYGLDFGWGRPEKVVVVSIDQGEAISFAESRDGSGGVELGFSLKKHEMDVLVDLLHKGLEN

SEQ ID NO: 567 - protein, 190 aa, Arabidopsis thaliana
MGDSDRDSGGGQNGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEVGEHQRDAVGDGGGFYGGGGGMQYHQHHQFLHQQNHMYGATGGGSDSGGGAASGRTRT

SEQ ID NO: 568 - protein, 387 aa, Hordeum vulgare
MAGKKSAAVTPAPSDGEESAGVPSSAAKRQSGRHKKDPAAASPGSTAKRAAGRPKKVAGPAEGSAMNPAKGDMGEEEKGATPKKKEKGATPKKGEKAATPKKTEKKGEKAATPKKTEKKGEKAATPKKAEKKGEKAATLKKAGEKAAIPKKAGEKAATPKKEEEKAATPKKTEKKGEKAATPKKEEKAAAPKKEDEEKATAPKKKEKGEKAAAKKKKDKGEKAATPKKTEKKGEMGDTLANMKKKKKEKEEMGDTLANMRKRKHGDLESPKAAKKHKGKAAGAAPAATEPGTCSFPMARVRVLMRDKDATIRSNTETVFLVNKASELFLEAFVEDAYQNALKGRKKSIAYDNLSAGVCNEKRYKFLSDFVPLRVTAGDALKAVVERS

SEQ ID NO: 569 - protein, 272 aa, Hordeum vulgare
IQKNKLNLWCLKFRVLDEADEMLNMGFKDDVELILGKVEDVTKVQTLLFSATLPDWVKKLSMSFLKADRKTVDLVGNEKMKASASVRHLALPCNKAARSQIIPDIIKCYSHGGRTIIFTETKESASELSSLIPGSRALHGDIAQAQREVVIAGFRSGKFLVLVATNVAARGLDINDVQLIIQCEPPRDVEAYIHRSGRTGRAGNTGIAVMLFDPRYKFGVSRIERESGVKVEHISAPSLLMWHNLLAMKQQRPFQVFLTVLFLFFGNKQRNC

SEQ ID NO: 570 - protein, 243 aa, Hordeum vulgare
MRRKQNMHENGTIMIQFGQQVPNYESSASDSPREVSGMSEGSFNEQNDQSGNRDGYTKSDEGKMMSALSLGNSETAYTPPKPDRTHPFAISYPYADPYYGGAVAAYGTHAIMHPQMVGMVPSSRVPLPIEPAAAEEPIYVNAKQYHAILRRRQLRAKLEAENKLVKSRKPYLHESRHQHAMKRARGTGGRFLNAKEKSEAASGGGNASARSGHASVPADGGMFSKHDHTLPSGDFHYRARGGA

SEQ ID NO: 571 - protein, 55 aa, Unknown
  Sequence found in Organisms: Hordeum vulgare, Brachypodium distachyon, Triticum aestivum
MAGTANCIDIILAIILPPLGVFLKFGCGHEFWICLLLTFLGYIPGIIYAIYAITK

SEQ ID NO: 572 - protein, 155 aa, Hordeum vulgare
MEVVTGSNGGRLNPWAEPFVPGSWCRPAPVEAAASAEVEDFSPEWWRLVASSPSFRDSWLRDYGDMGLLDADECPDDGDAFFPPPALPRNAEGEGRKEEAAVKKSGGEVAPWGIEKWWRAHVASPPEVPKYAEKAPAKVLGGGGRFSPRTIQQPR

SEQ ID NO: 573 - protein, 178 aa, Hordeum vulgare
MVTMKRCMVPTILLMLGLQAAQLVAGDDVGAILLPSQAQGEAAMAAAKKRPWKCCDEPFCTRSFPPICTCMDQVFKCPKTCKSCGPSAADPSRRICQDQYIGDPGPICRPWKCCDKPTCTKSNPPTCRCGDEVDKCAPTCKTCLPSRSRPSRRVCIDSYFGAFPPPCTPREAVAAGGK

SEQ ID NO: 574 - protein, 511 aa, Hordeum vulgare
MSWLPATRALSCVVLLLLLVVAVAPPASAAAITRGDFPTGFVFGTGSSAYQIEGAVAEDGRKPSIWDTFTHSGYSPGGATADVTADQYHKYKEDVKLLSEMGVDAYRFSIAWPRLIPDGRGAVNAKGLEYYNNLINELLRHGIQPHVTVYHFDLPQALQDEYNGMLSRKFIDDYTVYADVCFKNFGDRVKYWSTLNEPNIEPIGGYDQGFFPPQRCSLPFGISCNNGNSTTEPYIVTHHLLLAHASAVSLYKEKYQDKQGGKIGLTLLGSWNKPATQTPEDIAAAARMNDFHIGWYMHPLVHGDYPPVMRKNVGSRLPSFTAEELKRVLGSFDFVGFNHYAASYVKADLSKLDQKLRDYMGDAAVRFESVPFFDLKNQSSPWVLREMLEHLQVKYKNPVVMIHENGAASVADPSGDKALDDEFRSRYLQDYIEATLQSSRNGSNVQGYFVWSFVDMFEFLFGYRMGFGLYGVDFNSEERTRYRRHSAKWYAGFLRGGELRPVAVPGQAYSQ

SEQ ID NO: 575 - protein, 180 aa, Hordeum vulgare
MSDAPASPPGGGNGGGGGGVGSDDGGGGGYGGVREQDRFLPIANISRIMKKAIPANGKIAKDAKETVQECVSEFISFITSEASDKCQREKRKTINGDDLLWAMATLGFEEYIEPLKVYLQKYRETEGDSKLAGKSGDVSVKKDALGPHGGASAQGMGQQVAYNPGMVYMQPQYHNGDISN

SEQ ID NO: 576 - protein, 294 aa, Hordeum vulgare
MRGWREEVVALSLEARGPGDDRPEKPRRYGVTEMRSPCYSFRPAHHALQEILDSLGPFVDGLKFSGGSHSLMGKELIREITDLAHKHDMYVSTGDWAEHLLRQGPSSFKQYVEECKELGFDTIELNAGSLKLPEEAILRLVRLIKNTGLRAKPLFSVKFDSSEMPAAGDRAFGAYIAPVKRSSERVEDVDLLIRRAERCLEAGADMIMIDADDVCQRTDSLRADIIAKIVGRLGLEKTMFETSNANTSEWFVKRYGPRVNLFADHSEVMNLERLRGLDVRRRVRPLLPSPFFLM

SEQ ID NO: 577 - protein, 229 aa, Hordeum vulgare
MMRPCCLSLALLVALSAVGCAAAQAADYDFFYLVLQWPGSYCDTKKSCCYPRTGKPAADFGIHGLWPNRDDGSYPQNCNPANAFDPSKVSDLLSSLRAEWPTLACPASDGLQFWAHEWEKHGTCAQNLFNEHGYFQTALHLRDQLRVLDALASAGVAPDGGYYTLSAVKGAIQQGTGFEPFVECNRDESGNSQLYQLYFCVDARASGFVKCPVQPGGRPCGDRIEFPAF

SEQ ID NO: 578 - protein, 178 aa, Gossypium hirsutum
MATSAPVPASPGGGGSHESGGEQSPRSNVREQERFLPIANISRIMKKALPANAKIAKDAKETVQECVSEFISFITSEASDKCQKEKRKTINGDDLLWAMATLGFEDYIDPLKIYLTKYREMEGDTKGSVKGGDTFAKKDVQPGPNAQLAHQGSFSQGVYYGNSQSQSQAHMMASDARH

SEQ ID NO: 579 - protein, 766 aa, Gossypium hirsutum
MGKKKNQKQQPSASKDDLLNTLGDFTSKENWDSFFTIRGSDDSFEWYAEWPQLRDSLLPLIQQHPSPSSPSPSSSLQILVPGCGNSRLSEHLYDAGFGDITNIDFSKVVISGMLRRNVRDRPNMRWRVMDMTQMQFPDDTFNVVLDKGGLDALMEPELGPQLGTKYLSEVKRVLKSRGKFICLTLAESHVLGLFFPKFRFGWNVCLYAIPQKPSTKPDLQTFMVVAEKESSNELHQIISSFDHSSLACNPNQTSGLLEALESENQIRGEYLNGSDVLYSLEDLQLGAKGDLKKLSPGRRVQLTLGDQGVSHFCYKAVLLDAKQQSGAFSFHCGVFIVPKTRSHEWLFSSEEGQWQVVESSKAARLIMVLLEASHANTGMEDIQKDLSPLVKPLAPADNDKGNQIPFMTASDGIKQRSVVYQGSSSLTGPVVIEDVVYENTDDDVSHSLPFRRLVFERTEGLVQSEALLTRDGLFDKSVYGTEKKKASSSSKSKRRGALKRNNESSGKMKVYHGYLASSYHTAIISGFSLISSYLESVASSGNRVKAVVIGLGAGLLPMFLHGCMQSMQIEGVELDPVMLNLARDYFGFTEDKRMKVHIADGIQFVRDYRNLFSAGNEVLLSSNGSCKLSDAESRSTAIDIIIVDVDSSDSSSGLRCPAADFVEDSFLQNVKDTLSEQGLFVINLVSRSPAIKDAVVSRMKEVFSHLFCIQLEGEVNLVLFGLCSESHIEEDCIPDAALKLDKLLKSEHPEISQSITDAAKKLKRLK

SEQ ID NO: 580 - protein, 294 aa, Zea mays
MLSEQTAASTSSSGGGVERQDRWLQPVAENEEEEEEFRDIHALSPPPSQPSSYRRARGGEPWGSAAGGSRHTSVRSVGSDTAPSEPFPTMTREFSAMVAAAASAAADSRDAGSDVVGRAEEEEEEELEETNPLAIVPDSNPIPSPRRGPPPAAPGADAAALVAADGHGSREGGGVSVGQVRKEEVESKIAAWQVAEVAKVNNRFKREEVVINGWEGDQVEKASAWLKKYERKLEEKRAKAMEKAQNEVAKARRKAEEKRASAEAKRGTKVARVLELANFMRAVGRAPSTKRSFF

SEQ ID NO: 581 - protein, 301 aa, Zea mays
MCLLREMEDHYVHPKSKSNHGSLSGNGYEMKNPGHEVCDRDSSSESDRSHPEASAVSESSLDEHTSTQSDNDEDHGKDNQDTLKPVLSLGKEGSAFLAPKIDYNPSFAYIPYTADAYYGGVGVLTGYAPHTIVHPQQNDTTNSPVMLPAEPAEEEPIYVNAKQYHAILRRRQTRAKLEAQNKMVKGRKPYLHESRHRHAMKRARGSGGRFLNTKQQPQEQNQQYQASSGSMCSKTIGNSVISQSGPICTPSSDAAGASAASQDRGCLPSVGFRPTANFSEQGGGGSKLVVNGMQQRVSTIR

SEQ ID NO: 582 - protein, 271 aa, Zea mays
MLLPSSSSSSASASKGNSFGKTVNDHLRSTLSFDNKQPPFASQNFDYGQTIACISYPYNRSRSGDVWAAYESRTSTATVFRSQIAGGGSSTRIPLPLELAENEPIYVNPKQYHGILRRRQLRAKLEAQNKLVRARKPYLHESRHLHAMKRARGSGGRFLNTKQLQQSHTALTRSTTTSGTSSSGSTHLRLGGGAAAAGDRSVLAPKTMASQDSSKKAVSSALAFTATPMLRRDDGFLQHPSHLFSFSGHFGQASAQAGVHNGSQHRVPVMR

SEQ ID NO: 583 - protein, 413 aa, Oryza sativa
MDKGHLGGGGGGGGGLLALDASPRPLGFLNLLSPPPFHRSTMEADDSGGGGGRARRSVEVDFFSDEKKNMKKSRVSGGVAAEADDAKGPAAAGLAIKKEDLTINLLPAGNNARSDRSMVVDDDAASRPDHEEKSRSSNELAAMQAELGRMNEENQRLRGMLTQVTTSYQALQMHLVALMQQRPQMMQPPTQPEPPPPHQDGKAEGAVVPRQFLDLGPSSGAGGEAAEEPSNSSTEAGSPRRSSSTGNKDQERGDSPDAPPGAPNAVPLNAARPGAPAPQFQVPLPGGGMAPAFAVPPQVLYNQSKFSGLQMSSDSAEAAAAAAAAAQFAQPRPPIGQLPGPLSDTVSAAAAAITADPNFTVALAAAITSIIGGQHAAAAGNSNANNTNTNTTSNTNNTSSNNTTSNNTNSETQ

SEQ ID NO: 584 - protein, 302 aa, Oryza sativa
MGAMDVQLESTAVQHGQAKINVEEHALVSLLSDEKYATEKTEDVDPDDYEKLEEGIMQYGCAHYRRRCRIRAPCCNEIFDCRHCHNETKNSIKIDAVKRHELPRHEVQQVICSLCGTEQEVRQVCISCGVCMGKYFCEVCKLFDDDVSKQQYHCNGCGICRIGGKENFFHCSKCGCCYSIVLKNSHACVEGAMHHDCPICFEYLFESTNDVSVLPCGHTIHVKCLREMEEHCQFACPLCSKSVCDMSKAWERLDEELATISDTCDNKMVRILCNDCGATSEVQFHLIAHKCQKCKSYNTRQI

SEQ ID NO: 585 - protein, 571 aa, Oryza sativa
MNPYDLRYADPSSYRDRRSDLAGAPVLAASAPAAANPYAAAYAPAPAAPVAPAGGDFSRFGGRGRGGGAGGGGWGRGGGGGGGAGGYRGGGGRGGGRDALDSLSLPKPDFRSLIPFEKNFYVECPAVQAMSDMDVSQYRRQRDITVEGHDVPKPVRYFQEANFPDYCMQAIAKSGFVEPTPIQSQGWPMALKGRDMIGIAQTGSGKTLSYLLPGLVHVGAQPRLEQGDGPIVLILAPTRELAVQIQQESGKFGSYSRTRSTCIYGGAPKGPQIRDLRRGVEIVIATPGRLIDMLEGGHTNLRRVTYLVLDEADRMLDMGFEPQIRKIVAQIRPDRQTLYWSATWPREVESLARQFLQNPYKVIIGSPDLKANHSIQQIIEVISEHEKYPRLSKLLSDLMDGSRILIFFQTKKDCDKVTRQLRMDGWPALSIHGDKAQAERDYVLAEFKSGKSPIMAATDVAARGLDVKDIKCVINFDFPTTLEDYIHRIGRTGRAGASGTAFTFFTLSNAKFSRNLVKILREAGQVVNPALESMAKSASSMGGGNFRSRGRGGFGNRSGSNSIPIRGRRPY

SEQ ID NO: 586 - protein, 727 aa, Oryza sativa
MDASAGSSAPHSHGNPGKQGGGGGGGGGRGKAPAAEIRGEAARDDVFFADDTFPLLPDFPCLSSPSSSTFSSSSSSNSSSAFTTAAGGGCGGEPSEPASAADGFGELADIDQLLDLASLSVPWEAEQPLFPDDVGMMIEDAMSGQPHQADDCTGDGDTKAVMEAAGGGDDAGDACMEGSDAPDDLPAFFMEWLTSNREYISADDLRSIRLRRSTIEAAAARLGGGRQGTMQLLKLILTWVQNHHLQKKRPRTAIDDGAASSDPQLPSPGANPGYEFPSGGQEMGSAAATSWMPYQAFTPPAAYGGDAMYPGAAGPFPFQQSCSKSSVVVSSQPFSPPTAAAAGDMHASGGGNMAWPQQFAPFPVSSTSSYTMPSVVPPPFTAGFPGQYSGGHAMCSPRLAGVEPSSTKEARKKRMARQRRLSCLQQQRSQQLNLSQIHISGHPQEPSPRAAHSAPVTPSSAGCRSWGIWPPAAQIIQNPLSNKPNPPPATSKQPKPSPEKPKPKPQAAATAGAESLQRSTASEKRQAKTDKNLRFLLQKVLKQSDVGSLGRIVLPKEAEVHLPELKTRDGVSIPMEDIGTSQVWNMRYRFWPNNKSRMYLLENTGDFVRSNELQEGDFIVIYSDIKSGKYLIRGVKVRRAAQEQGNSSGAVGKHKHGSPEKPGVSSNTKAAGAEDGTGGDDSAEAAAAAAAGKADGGGCKGKSPHGVRRSRQEAAAAASMSQMAVSI

SEQ ID NO: 587 - protein, 266 aa, Oryza sativa
MSWWKKSSGKSSSSSSQYYAGSDSSSFAGGGGDDRYGRAGSGNGRSPWTTSEEYPRYTSDDDNRSGSGSDDDDDHGDRNRRRGKKSNKKKSSSSSSSYKYDDDGGERDRSYSNYGGYGNNEGYSSSAPSGYNPYNNGGGYGGPSYGNGGGYGGSTYGNGGGYGGSSYGNGGAIVAGGGGGSAPASYGYGSNSGWGAPAPPRQEGGSGSAPTYLNVIYMTQPGSSSSQNENSGERRDNGGGGGGRNGLFGPTFQAVGGYMDRRFGFD

SEQ ID NO: 588 - protein, 950 aa, Oryza sativa
MEQLRTIGRELAMGSQGGWGQSKEFLDLVKSIGEARSKAEEDRIISRELDHLKRRLADPDVPRRKMKELLLRLVYAEMLGHDASFGHIHAVKMTHDESLPLKRTGYLAVSLFLDERHDLVILVVNTIQKDLRSDNYLVVCAALTAACRLIGEEAIPAVLPQVVELLAHPKEAVRKKAVMALHRFYQRSPSSVSHLVSNFRKRLCDNDPGVMGATLCPLYDLILEDPNSYKDLVVSFVNILKQVAERRLPTSYDYHQMPAPFIQIKLLKILAVLGSGDKQASGNMYMVLGDIFRKGDTASNIGNAILYECICCISSIFPNAKMLDAAAETTSKFLKSDSHNLKYMGIDALGRLIKINPDIAEEHQLAVIDCLEDPDDTLKRKTFELLYKMTKSTNVEVIVDRMIEYMINITDHHYKTEIASRCVELAEQFAPSNQWFIQTMNKVFEHAGDLVNIRVAHNLMRLIAEGFGEEDEGADSQLRSSAVDSYLRIVGEPKLPSSFLQIICWVLGEYGTADGKYSASYIIGKLYDVAEAHPTDDTVRAYAISAILKIFAFEIALGRKIDMLPECQSLIDELSASHSTDLQQRAYELQALLGLDKQAVENVMPADASCEDIEIDRNLSFLNGYVQQAIENGAAPYIPESERSGVVSVGNYKAQDQQETSAHALRFEAYELPPAASQASISPTTDLVPVPEPSYYKEDHQMSRSQPSGDSLSGEFGLKLRLDGVQKKWGRPAYSSSSTPSSSTSSQQATNGGVSSEVGGSTSSQARESTYGSKRQQATEVSAEKQRLAASLFGKADRKTQAGRKTAKESSSTEKVATANATPQPAKEQVIPSAPPPDLLDLGEPVSSSPPLADPFTQLEGLLGPASASPVVSETPASSTSKTPDLMSIFSDDVQTGVTSGSTEPSLGVNVVAAKKGPSLQDALQKDAAARQVGVTPTGNNPILFKDLLG

SEQ ID NO: 589 - protein, 524 aa, Oryza sativa
MDNSHEQPLPPGVGAWPPPPSIHPAKFQPNPQPYATPYGATPNNGSNHNAASYSAAAQPTMPFPNMDAGGAQSNQTAHEVSNHNDSAADIESAVQEAVLREQDIETQQVIQNQRQAKATIEPTQYGEDLLSNRRNPNALKEHLLKMTAEHRAEMANKRGKPLHADNGNVEIGNGYGVPGGGAYYAANMSSGQMNKPKDIADKAKGADDLPEFLRQRLRARGILKDEATNNRFTIKQNVDSPVGQIKAAQELPPGWVEAKDPTSGASYFYNQSTGTTQWDRPGAPLNTMQHQAPPSSSLPENWEEALDQSTGQKYYYNTNTQATQWEPPTAVNPGVAPHAPTNAAVEMAAQNTDIWNSQMQRCLGCGGWGVGLVQPWGYCNHCTRVQNLPFQQYPSYPNNTTHSSSNKNPGNVAAKDRSSAKPPFGKANRKDHRKRNRPEDDELDPMDPSSYSDAPRGGWVVGLKGVQPRAADTTAAGPLFQQRPYPSPGAVLRKNAEVASHGKKRGMAPITKRGDGSDGLGEAD

SEQ ID NO: 590 - protein, 1803 aa, Oryza sativa
MSPPLQAPDYKHVTEECLREWKGQPAAAAAFRVPDPVPMARFLYELCWAVVRGDLPPQKCRVALDSVEFVEEAQRGEVGSVLADIIAHLGQDVTISGEYRSRLVKMTKSFVESSLIAPRLLQERCEEEFLWEVELSKSKGQDLKAKEVRVNTRLLYQQTKFNLLREESEGYAKLVTLLCQIGSDLACQNSSSVTMSIIKSLIGHFDLDPNRVFDIVLECFELYPDNTIFCQLIPLFPKSHAAQILGFKFQYYQRLDVNSTVPPGLFRIAALLVKSGFIDLDSLYAHLLPNDDEAFEHFDSFVTRKIDEASNIGKINLAATGKDLMDDEKQEITIDLYTALEMENDIIDERAPEIEKNQKLGLLLGFLSVHDWDHAQLLFERLARLNPVEHVEICDSLFRLIERSISSVYDIIFQTHYKMPRNPVYMMDTSPSSSQSFSVDPPKEFFQMLSACGPYLHRNTQLFQKVCRVLKAYHLSAKESIRTAGVMSPDSRIEEALGSCLLPSLQLIPANPAVDMEIWGVLSLLPYETRYRLYGEWEKDTEQNPIVLAARQTAKLDTRRLLKRLAKENLKQLGRMVAKLAHANPMTVLRTIIQQVEAYRDMITPVVDAFKYLTQLEFDILQYIVIERLAQGGREKLKDDGLNLSDWLQCLASFWGHLCKKHHSVELRSLFQYLVNQLKKDTGIELVVLEELIQQMANVQYTENMTEEQVDAMAGSETLRLQASSLFGSTRNSKVLTKSTNKLRDSLLPKEEPKLAIPLLLLIAQHRSKIIINADATYIKMVSEQFDRCHGILLQYVEFLSTAVTPTTYVQLIPPLEDLINKYHIEPDVAFLIYRPVMRLFKSTNGGDTYWPLDDNEEGESVSCDDLILHPDTSHKSIISVDIIRMKKVKARQWMTLGSLEGWWSDLLSTVRNTFPAKTWNGLSPDLYATFWGLTLYDLHFPKDRYDAEIKKLHENLKQLEDNSDNSSIAISRRKKDKERIQDLLDKLNNESHKHQQHIASVLQRLGREKVKWLNSSPDALKINMEFFQRCIFPRCVFSMQDAVYCAMFVQTLHSLETPFFNTVNHIDVFICKTLQPMICCCTEYEAGRLGRFLHETLKMAYRWKSDESLYERECGNKPGFAVYIRYPNSQRVSYSQFVRVHWKWSGRITKVLNQCMESKEYMEIRNALIVLTKISSIFPVIRKSGVNLEKRVAKLKGDEREDLKVLATGVAAALAARKSSWLSEEEFGMGLLDLKQGPAKIVPGNQSADPLTAKDQSVRAKSIEGRHERSEAAMKPDAQQKKNALAANGSDNQMPSSSAQGKVSGIIRGSDEPPKLLSDEGVKVSKPTAESETRVPQKRVAHNAGKVSKHDMVKEDTKSGKSTNRGVTQQGSSVPVDKEVLSQAADGVQDTTSNSLAASNGNLHTAPRKVSASSQKSTLLATHTGGAANSSGESTDLIDSNMKQQKRFVPTEEQDRGTKWRKGESEGRDGDFTEHTDKDRNLDSRLVDKFRPMDHDKSASEEQILSRPEKSKEKADDKYDRDPREKADRTERRRGEDIERPTDKSLERRERSIERMQERGTDRAPDKGREDRNKEERNKVKHAEPSIDRAHPSDERFRGQSLPPPPPLPASFVPQSVGNRRDEDTDRRGGSTRHNQRSSPRRDDKEKWHLEDNAASLQDDGKHRREEDIRDRKREDRDVSSSKVDDRDRDKSSIVKDESDPNSASKRRKIKRDQSGLEAGEYAPSAPQLPSHGTSSSQVFETRERERKGAISQHRISHADDLPRIHGKDSSKTSRREADQVHEREWEEEKRSRTETKRKHRK

SEQ ID NO: 591 - protein, 220 aa, Oryza sativa
MAPGAGSSSSARRGRRVAAAEPPRRALRMRASSPMYYTSDDEDLPEIVLTPPAPAPPRTGTRSLRMHASPPDYGRRRTNRPRRVARTRSPPVVQEAEREPPAPQQPAAVVVERVFYMVGSPPDVITATGEGPGGRTVAGFRCRRLTSTRTLVDGEDAAARAAAISGARALVMCSCHGAPFTHAEFLLHAGGTDLGRNVTGYPWLGDEMELTPPGAGGPHL

SEQ ID NO: 592 - protein, 439 aa, Oryza sativa
MDDAGRASAPAVVTVTASAAAPTPPLPPPPPPPPPSQLPATAAATDEPSHDPAALYGEGMWQQMTMSGSGAMQPGPYPERSGEPDCTYYLRTGLCRFGMSCRFNHPQDRNLAIASARMKGEYPERMGQPECQYYLKTGTCKFGPTCKFHHPREKAGIAGRVQLNTLGYPLRPSEKECAYYLKTGQCKYGNTCKFHHPELFNAMASSRGSPIYPSVHSSATAGPPYTGTMASWAFPRGSFIPSPRWQNPSNYAPMIVPQGLVQVPSWNSYTGQMMPVSSSESRLQSPGAQQTYGTSQQVDASAGNQGMLSPYRSSSYPVPQYALQRENVFPERPDQPECQYYMKTGDCKFGAVCKFHHPRVRSMPTPDCVLSPVGLPLRPGEELCKFYSRYGICKFGANCKFDHPTMAPPMGVYAYGSASTNVPMVRRLLQSPSASAYTS

SEQ ID NO: 593 - protein, 348 aa, Oryza sativa
MDPWISTQPSLSLDLRVGLPATAAVAMVKPKVLVEEDFFHQQPLKKDPEVAALEAELKRMGAENRQLSEMLAAVAAKYEALQSQFSDMVTASANNGGGGGNNPSSTSEGGSVSPSRKRKSESLDDSPPPPPPPHPHAAPHHMHVMPGAAAAGYADQTECTSGEPCKRIREECKPKISKLYVHADPSDLSLVVKDGYQWRKYGQKVTKDNPCPRAYFRCSFAPACPVKKKVQRSAEDNTILVATYEGEHNHGQPPPPLQSAAQNSDGSGKSAGKPPHAPAAAPPAPVVPHRQHEPVVVNGEQQAAAASEMIRRNLAEQMAMTLTRDPSFKAALVTALSGRILELSPTKD

SEQ ID NO: 594 - protein, 938 aa, Oryza sativa
MEVCCCSTSSAVPGRRFAAAGAAAAAVAARWGAVGVGRAVVLAHPLRPAPRGGHAHAQQAGARRARRAVVRAVFERFTERAVKAVVLSQREAKGLGEGAVAPRHLLLGLIAEDRSAGGFLSSGINIERAREECRGIGARDLTPGAPSPSGSGLEMDIPFSGSCKRVFEVAVEFSRNMGCSFISPEHLALALFTLDDPTTNSLLRSLGADPSQLASVALTRLQAELAKDCREPAGASSFKVPKKSPAGAGRSAFSKSLNSKKEKGALDQFCLDLTTQASGGFIDPIIGREEEIERVVQIICRRTKNNPILLGEAGVGKTAIAEGLALRIANGDVPIYLVAKRIMSLDVGLLIAGAKERGELESRVTSLIREVREAGDVILFIDEVHNLIGSGTVGKGKGAGLDIGNLLKPPLARGELQCIAATTLDEHRMHFEKDKALARRFQPVLVEEPSQDDAVKILLGLREKYETYHKCKFTLEAINAAVYLSARYIPDRQLPDKAIDLIDEAGSRARMESFNRKKEGQSSILLKSPDEYWQEIRAAQNMHEVVSSNQMKYSPRQENGSAAIKAPSEDMNELTSELQVEEPIVVGTEEIARVASLWSGIPVQQLTADDRKLLVGLDGELRKRVIGQDDAVMAISRAVKRSRVGLNDPDRPIATLLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLSDSQGRRVSFKNTLIVMTSNIGSTSISKGRRSMGFMTEDTESSSYVAMKSLVMEELKAFFRPELLNRIDEMVVFRPLEKTQMLAILDIILQEVKGRLLALGIGLEVSDAMKDLICEEGYDKSYGARPLRRAVTHLIEDVISEAILFGEYKPGDTILMDIDAGGKLCMSHLNEKVVQLSDPTRTF

SEQ ID NO: 595 - protein, 314 aa, Oryza sativa
MATLTVPAAVPPVAEDCEQLRKAFKGWGTNEKLIISILAHRDAAQRRAIRRAYAEAYGEELLRALNDEIHGKFERAVIQWTLDPAERDAVLANEEARKWHPGGRALVEIACTRTPSQLFAAKQAYHERFKRSLEEDVAAHITGDYRKLLVPLVTVYRYDGPEVNTSLAHSEAKILHEKIHDKAYSDDEIIRILTTRSKAQLLATFNSYNDQFGHPITKDLKADPKDEFLGTLRAIIRCFTCPDRYFEKVIRLALGGMGTDENSLTRIITTRAEVDLKLIKEAYQKRNSVPLERAVAKDTTRDYEDILLALLGAE

SEQ ID NO: 596 - protein, 557 aa, Oryza sativa
MMSLNLAHQTGAAAAVAPAAPRTAVVAAAAGTVSAPAVAPAAAPSLQLQTQTVDPAAPAQGPDLPMAFQALVESLPEEQHPDVGGEERRKVGVPVYVMMPLDTVRKDGNGLNRRKAVEASLKALKSAGAEGIMVDVWWGIAECEGPGRYNFTGYMELMEMAKKNGLKVQAVMSFHQCGGNVGDSVTIPLPKWVLEEMDKDQDLAYTDRSGRRNYEYLSLGADAMPVLKGRTPVQCYGDFMRAFRDHFAAFMGNTIVEIQVGMGPAGELRYPSYPESNGTWRFPGIGEFQCYDRYMLSSLKAAAEAVGKPEWGNAGPGDSGGYNDWPEDSPFFRREGGWNTPYGEFFMSWYSQMLLEHGERILSAASGVYTGTPGVKISVKVAGIHWHYGTRSHAAELTAGYYNTRHHDGYQPIARMLARHGAVLNFTCVEMRNHEQPQDAQCRPEELVQQVAAAARESGVGLAGENALPRYDETAHDQIVTTAAEKAEEERMVAFTYLRMGPDLFQPDNWRRFAAFVKRMTESGVRDVCREQVEREAQGVAHATGSLVHEAAVALSN

SEQ ID NO: 597 - protein, 654 aa, Oryza sativa
MRAPAAHLSPASSAVPSRNHGLLLHLRFLLSSSVSHLSARENSNPPSGCWFSCQKQAILPVPVSSRLPPPPSCYYSVLLEEHWSPRLPQSPLTTPGASYKNRHAKNLQNHTETSDLRGFPSESTKMPVMAPTASLLLSPRPLPASRRVPSLPALSASGRLRLRRARADTRLRVAAPPSVPGEADQAPGETEPSTSSADEKFVWRDHWYPVSLVEDLDPSVPTPFQLLNRDLVIWKDPKSGEWVALDDRCPHRLAPLSEGRIDETGCLQCSYHGWSFDGSGACTRIPQAAPEGPEAKAVRSPKACAIKFPTLVSQGLLFVWPDENGWEKATATKPPMLPKEFEDPAFSTVTIQRDLYYGYDTLMENVSDPSHIEFAHHKVTGRRDRARPLPFKMESSGAWGYSGSNSGNPRISATFVAPCYALNKIEIDTKLPIFGDQKWVIWICSFNIPMAPGKTRSIVCSARNFFQFSMPGKAWWQLVPRWYEHWTSNLVYDGDMIVLQGQEKIFLSASKESSADINQQYTKITFTPTQADRFVLAFRAWLRKFGNSQPDWFGNPSQEVLPSTVLSKREMLDRYEQHTLKCSSCKGAYNAFQTLQKVFMGATVAFCATAGIPADVQFRLLLAAAALVSAAVAYAFYTLQKNFVFVDYVHAEID

SEQ ID NO: 598 - protein, 347 aa, Oryza sativa
MSYSRGSRYESDSYSTSPRRSSRSRYRSRSRSVDSSDVENPGNNLYVTGLSARVTDRDLEKHFSAEGEVIDASIVLDPWTRESRGFGFVTMATVKEADLCIKYLDRSVLEGRVITVEKAKRRRGRTPTPGRYLGTKSSCVTPARRYSPSYSPVERDRYSSRYSPERERSYSPYGRRRSYSPYNRRRSYSPYERRRSYSPHERRQSYSPYGRSPSPYGRRRSYSPYDTRGSRRRSYSSYRGSRYRSRSPYRYRRERSCSYDHSVSPYYRRCYSPSARGRSYSRSVSPQRSYSHSCSPDSQRSGSYSPRKRYSERKPSRSRSSGKRHSRESYSHSRSSYSRSVSRERSE

SEQ ID NO: 599 - protein, 276 aa, Oryza sativa
MASTAAASSPFDCVLFDLDDTLYPGSAGIGLATKRNIDEFLMARCGVTAERAAALRVELFRSYGSSLAGLIALGYDVHPDEYHSYVHGRLPYDRIAADPQLAGLLRSIPQRKILFTNSDRAHMRKALQRLSVDEGCFDAVVCFETMNPHLFGEAPCASGDDRPGVILKPSPDAIVAALRIAGTNPHRTLFLDDSERNIAAGKALSLRTVLVGKRVRSKEADYALESIGSLRRAIPEIWGGVAVAVAGEQLDHGAAEKTKGMRSDLDSIIQPTSVLA

SEQ ID NO: 600 - protein, 173 aa, Oryza sativa
MEVARGGGKLNPWAEPFVPAGWSATYWRCGGVAAVEPAVAEVEDFSPEWWRLVGSSPAFRDRWLRDYSALGLLDDNDNGDGYDLEGFLLPDDLFSSTPHLVGEPADEKEGKGFGGAGGKKVKGGSAEVVAWGIDKWWRAHSSPPEVPRYADKAPRRVAAAAARVNPRPIQQPR

SEQ ID NO: 601 - protein, 200 aa, Oryza sativa
MASHQDQASYRAGETKAHTEEKAGQVMGASKDKASEAKDRASEAAGHAAGKGQDTKEATKEKAQAAKERASETAQAAKDKTSSTSQAARDKAAESKDQTGGFLGEKTEQAKQKAAETAGAAKQKTAETAQYTKDSAIAGKDKTGSVLQQASEQVKSTVVGAKDAVMSTLGMTEDEAGTDDGANKDTSATAAATETTARDH

SEQ ID NO: 602 - protein, 445 aa, Oryza sativa
MEDLALPAAPPAPTLSFTLLAAAAAVAEAMEEALGAALPPLTAPVPAPGDDSACGSPCSVASDCSSVASADFEGFAELGTSLLAGPAVLFDDLTAASVAVAEAAEPRAVGATARSVFAMDCVPLWGLESICGRRPEMEDDYAVVPRFFDLPLWMVAGDAAVDGLDRASFRLPAHFFAVYDGHGGVQVANYCRKRIHAVLTEELRRAEDDACGSDLSGLESKKLWEKAFVDCFSRVDAEVGGNAASGAPPVAPDTVGSTAVVAVVCSSHVIVANCGDSRAVLCRGKQPLPLSLDHKPNREDEYARIEALGGKVIQWNGYRVLGVLAMSRSIGDKYLKPYIIPVPEVTVVARAKDDDCLILASDGLWDVMSNEEVCDAARKRILLWHKKNAATASTSSAQISGDSSDPAAQAAADYLSKLALQKGSKDNITVVVIDLKAHRKFKSKA

SEQ ID NO: 603 - protein, 718 aa, Oryza sativa
MSVPAIAVYTSPPGAVYTSSSSSELEASSRGSAPCATAAPPSPASSHRHQAIAGGLSCLFSSPTAAPRAAAAQDELGALWHDRSGEATAVGGGGGGGGYSYPQPSSPFKWRDMLHHSPVPLFHSPASSPASRSPSASWLAGRERERLFSSFVRNALGSCVDYAPVAALPLGVSAAVGVGAGELAFELDEHLSEAEPSCEPYARDLLAGAQARHRIFHDELVVKAFFEAERAHRGQTRASGDPYLQHCVETAVLLAKIGANATVVSAGLLHDTIDDSFMDYDQIFRMFGAGVADLVEGVSKLSHLSKLARDNNTASRTVEADRLHTMFLAMADARAVLIKLADRLHNMKTIEALPLVKQQRFAKETMEIFVPLANRLGIASWKDQLENICFKHLNPEEHKELSSKLVISFDEALLTSTLDKLDKGLRDEGISYHSLSGRHKSLYSIYSKMIKKNLTMDDVHDIHGLRLVVDTEQDCYQALDIVHKLWPRVAGRFKDYILHPKLNGYRSLHTVIMCEGIHPFEVQIRTKEMHLQAEYGFAAHWRYKEGGCKHSFVLQMVEWARWVLTWQCEAMSKERSSGLGRSDAIRPPCPFPSHSEDCPYSYTRQCNHDGPIFVIMLEHDKMSVQELPANSTVVDLMERVGANSPRCSPYSFPLKEELRPRVNHKPISDPNRKLCMGDVVELTPALPHKSLTEYREEIQRMYERGGFALATTRDGPAS

SEQ ID NO: 604 - protein, 358 aa, Oryza sativa
MSMAEVCCDSAVVVGAEAEARARARAGRRRRAGVEGAGRWNATATAAGVAAEEAATRKRRASGGEAGLVVVAKRHGAASVAGRRREMEDAVSLREAFAAPANGEVAAARCDFYGVFDGHGCSHVADACRERMHELVAEEMGAGSPAAAAREPASWTETMERSFARMDAEVIAGCRAESGSCRCEGQKCDHVGSTAVVAVVEESRVVVANCGDSRAVLCRGGAPVQLSSDHKPDRPDELERIEAAGGRVIFWEGARVLGVLAMSRSIGDAYLKPYVTAVPEVTVTGRSDFDECLILASDGLWDVVSNEAACEVAQSCLRRGRQRWCAEAAAVLTKLALARRSSDNISVVVVDLRRGNAL

SEQ ID NO: 605 - protein, 140 aa, Oryza sativa
MQIFVKTLTGKTITLEVESSDTIDNVKAKIQDKEGIPPDQQRLIFAGKQLDDGRTLADYNIQKESTLHLVLRLRGGSRGGYTIQEPTLRALALKYREKKKVCRKCYARLPIRSHHCRKKKCGHSKELRLKKKFINSLSIA

SEQ ID NO: 606 - protein, 881 aa, Oryza sativa
MSDADGFGCEHRRPSKRRRDGPDHALLPVSREVLMGHPDDPAAAAAAVGAESSSASSYLGVVAAAASASASAAGGFSCGAHFFVRATDSRTVSMHAAWGDTVGAVLAHLADRGYGRDLRLVYAGRQLAPETALADLRLPPDSTLHLLSRLRSTPYPDAWQLASYIASTAAAAKSDPAHTSSAANINELVKEFILCAHRANMRQRHDRDSPLFDAQPTGDHAAQYLEIFRQAGAPFALVRLYAANPSSASHHHAENAIKCFLTMDPSALPPDVLPVMAPVLLEFCGLLSFSVGKRDELYISSRSMLATVLSLPSGLPPCIKSPSKLIEQVLPFAEEIVGVVMDELASLDMTVSSKNLEDLSNFFKVLRQQALRWVPNGGPLPKNLYNSERGHNDTWVWKLHEMSMNLLNRVDECLKRLEMDLSLSSENRGVNISQSRWVARSHMLVMLTQLDFISMIYEDLAHNLRLVLLAHRDPLNALVRCSKRNEHLHWLVKHKDLLCFESRRNLVLMMLPEGKDEYGELHEMLIDRQHLLDESFEYIIQARPSELRSGLFMEFKNEEATGPGVLREWFCMVCQALFSPQQVLFSPCPSDRQRFFLNGTSAVDPLHLKYFIFSGRIIGLALMHRVQVGITLDRTLFLHLAGRSIKLEDISAADPVMYASCKRILEMDAAVVDGLELTFSRDVHELGSRRTIELCSGGKDLHVNIRNRELYIDLLIKSTFVDSISVQLTHFVRGFSDILVDPELQKVFFEFLDLEDFDGMLGGSNKTINLEDWKLHTQYNGYKEKDRQIIWFWKLVESLSIEQQRQLLFFWTSVKYLPSDGFGGLASKLYIYKVSESADRLPSSHTCFYRLCLPAYPSLKVTRNQLQKITQEHVSCSFGTW

SEQ ID NO: 607 - protein, 413 aa, Oryza sativa
MGLLELFITACVPVLNMLLVTGVGSFLATDFVGILNKDARKYLNNIVFYVFNPSLVATYLAQTITLEGLAKLWFMPVNILLACTFGLILGWIVVHVTRAPARLRGLILGCCSAGNWGNIFLIIIPALCKEKGSPFGAPDVCHTYGLAYSSLSMALGAVFLWTVAYNIMRATSKVADEGNARTNDTKVSNSGSSTGTASEENLSIPNDNNQCTLPLISNSSVPSSKTKVTLSERAKRFVSSMFGAIDFKKIFAPSTIAVIIGFIIGGTPLIRNAIIGENAPLRVIHESADLIGGGAIPSVTLIMGGNLLNGLRGEASVQPSVIASVIVVRYILLPSLGTLLVKSAVHLGLIHPDPLYQFILLLQYAVPPAMNIGTITQLFGVGESECSVIFVWVYALASVAVTVWSAFFMWTLS

SEQ ID NO: 608 - protein, 290 aa, Oryza sativa
MAEHLASIFGTEKDRVNCPFYFKIGACRHGDRCSRLHNKPSVSPTLLLSNMYLRPDMITPGIDAQGNPIDPEKIQADFEDFYEDIFEELSKYGEIESLHVCDNFADHMIGNVYVQFREEDQAARALQALTGRYYSGRPIIVEFSPVSDFREATCRQYEENSCNRGGYCNFMHVKEIGRDLRKRLFGHLHRSRRSHSHGRSRSPSPYHYRRDYDRRSSSRSRDHDDYYRGGSHDYYRGGSRRSSERHRSSYDSDGSRRRHRSRTRSPVRDGSEERRAQIEQWNREREAAQV

SEQ ID NO: 609 - protein, 335 aa, Oryza sativa
MPIPEKDGVEDNQEDDTFSRLQLLAQQRHAMEKFWRMSQEQIEESAGNEELILPISRVKNIIHAKEGGMMLSADTPAFVTKLCELFVQELILRAWVCANSHNREIILGTDIAEAITTTESYHFLANVVHGHQALGSNIPEIGVSAWKRHKLDEMTSLCHPPQAVQVTDLANHPPNIPVCPPIGQSGTQHTTSTHVLMMQGESIHKASKEKSPLKEVMVPTNKVGMTNSSYGVPNGGGATSSKVVIDSPKGETAQVFSSQHACPSLEDNYVIPIPAGHGDSFRTLDEANIPQLHQEQKNFISQDAIVGENIPLNESLEKSKHKDEDLLFPDKDLPE

SEQ ID NO: 610 - protein, 378 aa, Oryza sativa
MGSSEKNGTAYGEYTYAELEREQYWPSEKLRISITGAGGFIGSHIARRLKSEGHYIIASDWKKNEHMTEDMFCHEFHLVDLRVMDNCLKVTNGVDHVFNLAADMGGMGFIQSNHSVIMYNNTMISFNMLEAARINGVKRFFYASSACIYPEFKQLETNVSLKESDAWPAEPQDAYGLEKLATEELCKHYTKDFGIECRVGRFHNIYGPFGTWKGGREKAPAAFCRKAQTSTDRFEMWGDGLQTRSFTFIDECVEGVLRLTKSDFREPVNIGSDEMVSMNEMAEIILSFEDRELPIHHIPGPEGVRGRNSDNTLIKEKLGWAPTMKLKDGLRFTYFWIKEQIEKEKTQGVDIAGYGSSKVVSTQAPVQLGSLRAADGKE

SEQ ID NO: 611 - protein, 425 aa, Oryza sativa
MAIGVGGCCAVLLAAALLFSSPATTYAYDSLDPNGNITIKWDVMQWTPDGYAAVVTLSNYQQFRHIQPPGWQLGWTWQQKEVIWSMYGAQAIEQGDCSMSKEGSNVPHSCKKHPTVVDLLPGAPIDLQIANCCKAGSLSAFSQDPANSAASFQIIVGHSGNSNETVRVPKNFSLMAPGPGYTCSRAMIVKPSRFLSPDGRRATQVLMTWNVICTYSQFLAQKVPSCCVSLSSFDNDKTVDCPTCSCGCRNEKSTTGKCVKKNAPDLQSIIHGPGRWTWQPLLQCTSHMCPVKINWHLMLKDKEHYRVKITVTNLNYRMNFTEWNLVVQYHPILDITQISGFNYKSIQVGKINDTTMLWGVKPYYDLLMQAGPLGNVQGELIVRKDFRASSTTNNNKGRAFPVRVYFNGDNCVMPPPDAYPVSITA

SEQ ID NO: 612 - protein, 143 aa, Oryza sativa
MEVFGKSVIAEPSNVIYLSSILNTEGPIPSHKCDKNCQNEHVFGNMYRCKLTGTTHICDKNCNQRILYDNHSSLCRVSGQLFPLSPLEQQAVRGIRRKHEVDSNEGCSFKRRRGAQLHPSPFERSYTAVSPIPSQVGDGMDLS

SEQ ID NO: 613 - protein, 464 aa, Oryza sativa
MAHVMAASELVTATIKRPFQNDDDNSSNGNGNADGKPKARRREADPAAALAAARHEFGEHGGVNMSIEASATFTVMEPDTMRRLFSGELGPERGDLYIYSRHFNPTVLALGRQMAALEGTEAAYCTASGMSAISSVLMQLVGAGGHVVASRCLYGGTHALLSRFLPRASGVRATFVDADDEAAVRAAVRPGETRVVYVETMSNPTLAVADIPMLARVAHDAGAKLVVDNTFTPMVVSPARLGADVVVHSVSKFISGGADIIAGAICGPASLVNAMMDLQEGALMLLGPTMNAKVAFELSERLPHLPLRMQEHSRRAAEYASRMRRLGLRVAYPGLPDHPHHARLLAIANPGYGAGGMLCVDMGTEDRANRLMHHLQNTTRFGLMAVSLGYYETLMSCSGSSTSSEMPPEDRARAGISPGLVRMSVGYNGTLEQRWAQFERALSLMQQQQQQHPDRDAAAKYCKV

SEQ ID NO: 614 - protein, 217 aa, Oryza sativa
MTSVVHDVSGNHGADERQKQQRQGEPEDQQEASVTSTDSHTMVATPSTDYATPYAHHDMAHAMGQIAYANIDPYYGSLYAAYGGQPMMHPPLVGMHPAGLPLPTDAIEEPVYVNAKQYNAILRRRQSRAKAESEKKLVKGRKPYLHESRHQHALKRARGAGGRFLNSKSDDKEEHSDSSSRDKQDGVAPRDSGQPSTSPSSKGASSAKQNKKSKTSN

SEQ ID NO: 615 - protein, 913 aa, Sorghum bicolor
MNPDNFTHKTNEALVAAHEMASEAGHAQLTPLHLAAALAADKGGILRQAITGASGGDGAAGESFERVLSNALKKLPSQSPPPDSVPASTALIKVIRRAQSAQKKRGDSHLAVDQLLLGLVEDSQISDCLKEAGVSAARVRAELEKLRGGEGRRVESASGDTNFQALKTYGRDLVEQAGKLDPVIGRDEEIRRVVRILSRRTKNNPVLIGEPGVGKTAVVEGLAQRIVRGDVPSNLLDVRLIALDMGALVAGAKYRGEFEERLKSVLKEVEEAEGKVILFIDEIHLVLGAGRTEGSMDAANLFKPMLARGQLRCIGATTLEEYRKYVEKDAAFERRFQQVFVAEPSVPDTISILRGLKEKYEGHHGVRIQDRALVVAAQLSARYIMGRHLPDKAIDLVDEACANVRVQLDSQPEEIDNLERKRIQLEVELHALEKEKDKASKARLVEVKKELDDLRDKLQPLTMKYRKEKERIDEIRKLKQRREELQFSLQEAERRMDLARVADLKYGALQEIDAAISKLESETGENLMLTETVGPEQIAEVVSRWTGIPVTRLGQNDKERLVGLADRLHQRVVGQTEAVNAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGKNSMKVARDLVMQEVRRHFRPELLNRLDEIVIFDPLSHEQLRKVARLQMKDVAVRLAERGIALAVTDAALDIILSLSYDPVYGARPIRRWIEKRVVTQLSKMLIQEEIDENCTVYIDAAPAKDELAYRVDRSGGLVNAETGLKSDILIQVPNDAVRSDAAQAVKKMRIMEEEDEDGMDEE

SEQ ID NO: 616 - protein, 103 aa, Artificial Sequence
  Sequence found in Organisms: Arabidopsis thaliana, Brassica napus, Gossypium hirsutum, Zea mays, Oryza sativa, Sorghum bicolor, Glycine max, Solanum lycopersicum and additional organisms as disclosed in Tables 53 and 54
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 617 - protein, 159 aa, Sorghum bicolor
MDVSGAGSGGKAKKGAGGRKTGGGPRKKSVTRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNIHSVLLPKKVAEKAAAAAKEPKSPKKAAKSPKKA

SEQ ID NO: 618 - protein, 729 aa, Sorghum bicolor
MSGWDEGAVFYSDQAQFPRGGPGGDPAADLTRHSALRKFKEFLRGFTGPTGDFPYRESLVHNRDHVTVAIEDLDAFDAELSDRIRKSPADYLPLFETAAAEVLASLRSKVAGETGEMEEPVTGDVQIFLSSKENCLSMRSVGADYMSKLVKIAGITIAASRVKAKATHVTLICKNCRSVRTVPCRPGLGGAIVPRSCDHVPQPGEEPCPLDPWIAVPDKSKYVDLQTLKLQENPEDVPTGELPRNVLLSVDRHLVQTIVPGTRLTVVGIYSVYQASATQKGAVGVKQPYIRVVGLEQSRDNNSNGPSNFTLDEEMEFKEFAQRPDAYAKLCSMIGPSIYGHSDVKKAIACLLFGGSKKRLPDGVRLRGDIHVLLLGDPSTAKSQFLKFVEKTAPIAVYTSGKGSSAAGLTASVTRDGSSREFYLEGGAMVLADGGVVCIDEFDKMRPEDRVAIHEAMEQQTISIAKAGITTVLNSRTSVLAAANPIAGRYDDLKTAQDNIDLQTTILSRFDLIFIVKDIRMYDQDKRIASHIIKVHASGAAASSTGTEASDGENWLKRYIEYCRATCRPRLSEKAAEMLQNKYIEIRQKMRQQAHETGRAAAIPITVRQLEAIIRLSESLAKMRLTSVATPEHVEEAFRLFNVSTVDAARSGINEHLNLSPEIANEIKQAEAQIKRRMGIGSHISERRLIDELNRMGMNESIVRRALLIMHQRDEVEYKRERHVIVRKA

SEQ ID NO: 619 - protein, 291 aa, Sorghum bicolor
MSGGGQDLQLPPGFRFHPTDEELVMHYLCRRCAGLPIAVPIIAEIDLYKFDPWQLPRMALYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGLEKPSAVAGGDHKPMFAAAAVSSPPEQKPFVAAPGGLPPFPDLAAYYDRPSDSMPRLHADSSCSEQVLSPEQLACDREVQSQPKISEWERTFASDPVNPAGSMLDPVVGGHAGDPLLQDILMYWGKPF

SEQ ID NO: 620 - protein, 609 aa, Sorghum bicolor
METLLVGNPANGVAKPMCNGVGALPVANSHAVIGAAPPATTAAPAGATLGRHLARRLVQIGASDVFAVPGDFNLTLLDYLIAEPGLSLVGCCNELNAGYAADGYARSRGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSRDPVPLFISPRLSNKANLEYAVEAAADFLNKAVKPVMVGGPKIRVAKAREAFAGVADASGYPFAVMPSAKGLVPEHHPRFIGTYWGAVSTTFCAEIVESADAYLFAGPIFNDYSSVGYSLLLKREKAIIVQPDRVVVGNGPAFGCILMSEFLRGLAKRLRRNTTAYDNYRRIFVPDREPLNGKPDEPLRVNILFKHIKGMLSGETAVVAETGDSWFNCQKLRLPEGCGYEFQMQYGSIGWSVGATLGYAQAAKDKRVIACIGDGSFQVTAQDVSTMLRCGQKSIIFLINNGGYTIEVEIHDGPYNVIKNWDYTGLINAIHNGDGNCWTMKVRTEAELKEAIATATGAKKDCLCFIEVIVHKDDTSKELLEWGSRVSAANSRPPNPQ

SEQ ID NO: 621 - protein, 502 aa, Sorghum bicolor
MERLIAGLLGFLLIASVGSHAARAPDQYWKSALPDTPMPTSLSQLLNTPAGGTTVNVGWGGVHVDAGHGKPGGTTVDVGKGGVGVNVNPGSSGRKPGGTTVGVGGKGGVGVKVNPGYGKPGGTTVGVGKGGVGVNVNPGYGKPGGTTVGVGKGGVGVNVNPGKPGGTTVGVGKGGVGVDVNPGYGKPGGTTVGVGKGGVGVNVNPAKPGGTGTTVGVGKGGVGVGVNPGYGKPGGTTVGVGKGGVGVHVNNPRKKPVNVNAGPFQYLYAASETQLHDDPSVALFFQEKDLQQPGKKVTVQFANTATAGAKFLPRSDAEAIPFSSEKVPEILSRFSVDPDSVEAAEMAQTLRDCEAPAAKGEKKACATSLESMVDFATTSLGTSHVRAVSTVVAKEGSPKQEYTVTGVKPAAGTGHDGRLVACHAEPYAYAVFACHLTQQTRAYSVSMLGRDGTAVDAVAVCHADTSGWNPKHIAFQVLKVKPGTVPVCHFLPQDHVVWTRSG

SEQ ID NO: 622 - protein, 275 aa, Sorghum bicolor
MDPSAVSFDSGGARRGGGGGGAQMLLFGGGGSANSNGFFRGVPMAVLGMDDATRVGKRPFFTTHEELLEEEYYDEQAPEKKRRLTAEQVQLLERSFEEENKLEPERKTELARRLGMAPRQVAVWFQNRRARWKTKQLETDYDRLKAAYDALAADHQGLLADNDSLRAQVISLTDKLQRKETSPSATTAAQEVDQPDEHTAASGTEKLLVQQLKDDLHSSGDFTGHGALSSEEEDGGVVSDEGCSFDLPDAMFAAGVTHHGAEEAQLANWTSWFWN

SEQ ID NO: 623 - protein, 479 aa, Sorghum bicolor
MAMAPDQQQPPAGAGAGASSTTGSTSPRLRVHVHDTTLVPPSPSPPETSLPLTFFDVFWLQSHPVERLFLYRLAHDADVEAIISNLRSSLHKALAAFYPLAGRVRLTPGTSDRYELHYRPGDAVTFTVAECDDDVDGDAHFDALATDEPREVAKIAALVPTLPRGGRLLAVRATLLPARRGLAIGVTLHHAACDGSGSTHFLHTWAATCRGGGAESPPPPVIDRTLLADPRRLYDAFVQTAPSSEEYEFVKMSADQLFATFTLSKDDLKRVKDAVADEAARRGVAPPRCSSLVATFGLVWSCYQRGKEGSGGGAGEGSMACMAFPVDHRSRMKPPLPEKYLGNCVGPAFALAPTGELAAAGAGGLFSACAAVASAIDEAVRDIGTSSMDAWMDRIREVLPMGLLTVAGSPRFRVYDLDFGFGRPAKVDIVSVARTGAVAVAESRSGDGGIEVGVSLQPAAMERYRKCFADATLWLHQKT

SEQ ID NO: 624 - protein, 193 aa, Sorghum bicolor
MAMALALGGGQDAERKVKVAEVALRALLCGLGALAAALVATDTQTRTFFSLQKKASYTDMKAMVFLVDAAAVAAGYSLLQLAARCCGGGAMSSGRGDGGGRGRALSWCVFSCDQALAYVLLAAVAAALQASVVAKRGQPELQWMGICALYGAFCRQAGAGLATAVVAGLAAVLLAFLSAFNLFRLYGSGGTKS

SEQ ID NO: 625 - protein, 547 aa, Sorghum bicolor
MAFNLAQCATAAASVAPRTPRPARSAVAASVSVSTRKAADGRLRLQRQASCEPSVAPSRSVFCRAAVSGKSAADRAASTRRRSGVPVFVMMPLDTVKKCGSALNRRKAVQASLSALKSAGVEGIMVDVWWGIAESDGPGRYNFAGYMELMEMARKAGLKVQAVMSFHQCGGNVGDSVNIPLPRWAVEEMEKDQDLCYTDQWGRRNYEYVSLGCDAMPVLKGRTPVECYTDFMRAFRDHFADYLGNTIVEIQVGMGPAGELRYPSYPESNGTWKFPGIGAFQCNDRHMRSSLKAAAEAAGKPEWGHGGPTDAGGYNNWPEDTLFFRADNGGWSTQYGDFFLSWYSQMLLEHGDRILSGATSVFGASSPVEVSVKVAGIHWHYGTRSHAPELTAGYYNTRHHDGYRPIADLLARHGAVLNFTCVEMRDHEQPQEAQCMPEHLVRQVGAAARAAGVGLAGENALPRYDGTAHDQVVATAAQRAAEDRMVAFTYLRMGPDLFHPDNWQRFAAFVRRMNGAGSCREAAEREAHGVAQATGSLVHEAAVALRS

SEQ ID NO: 626 - protein, 310 aa, Sorghum bicolor
MEAAIPNPSALKTRIAVVTGGNKGIGLEVCRQLAGDGATVVLTARDETRGAAAAEKLREAGLSNVIFHQLEITDAPSIARLAEFLKTRFGKLDILINNAAIGAVEYVQDPADSPASEEKFSGMDQGQRLECMFKGVRETYDAAREGVKTNYYGVKHVIEALLPLLQASSDGRIVNVSSEFGLLRLINNEELRQELNDVEKLTEERLDEVLATFLRDFEAGEVEARGWPMAFSAYKVAKVAMNAYSRILARRHPELRINCAHPGYVSTDMTIHTGPLTPEEGAANLVKVALLPEGGPTGAYFAWGVEASFV

SEQ ID NO: 627 - protein, 402 aa, Sorghum bicolor
MLGTSAEKHTTVMGHDHISRIKMHMAEGSFGDRNRCQQPGCNEVVDGRVVYCKTHSGEFSCQQFSHLHSGMESSGLSVPHVNDNQFKGSISIAVPCTEQELHVKHEGNDRGKLKDSSGYTLDQTAQFVFSGAGLLCKNENCSKQAHENSIYCKLHSGVSKGCMVRGCTRGAHGGTPLCIGHGGGKRCVIPQCPNAACGQGRSDRCVRHGGGKRCKFEGCAKGAQGNTDYCIRHGGGRRCKFEGCTKSAQGRTDFCIKHGGGSRCKFQGCGTSAKWGTDFCSVHRKSLLGGDSAIPEALPAPSEKRRRAKKPKKAAKLSETSQENVTTAAIAGNSTQHMGVLLIATPVTNHDMLTKGVTVAAPAAIAPTQIVAPLAIKSPTPSGSVAAGAEREAGASREMLGL

SEQ ID NO: 628 - protein, 319 aa, Sorghum bicolor
MGLPVMRRERDAEAELNLPPGFRFHPTDDELVEHYLCRKAAGQRLPVPIIAEVDLYKFDPWDLPERALFGVREWYFFTPRDRKYPNGSRPNRAAGNGYWKATGADKPVAPRGRTLGIKKALVFYAGKAPRGVKTDWIMHEYRLADAGRAAASKKGSLRLDDWVLCRLYNKKNEWEKMQLGKESAAGVGTAKEEAMDMTTSHSHSHSQSHSHSWGETRTPESEIVDNDPFPELDSFPAFQDPAAAMMMVPKKEQVDDGSAAANAAKSSDLFVDLSYDDIQGMYSGLDMLPPPGEDFFSSLFASPRVKGNQPAGAAGLGPF

SEQ ID NO: 629 - protein, 335 aa, Sorghum bicolor
MPSVEVGGAAGWRPKHLHKQYQQKHHHYTQQQQHQPPSHPHPHPPPQQQPLEIREVWADNVDREFKLIRAAIEHFPYVSMDTEFPGVIHHPPASVHHSTLTPSQRYALLKSNVDALHLIQVGLVFAASPSSPPALAFQINLREFDPRVHRHAPDSVRLLASSGVDLAAHRARGVSARAFAALLMSSGLVCNPDVAWVTFCSAYDFAYLVKVLMGRKLPRALPEFLRYVRVYFGAAVYDVKHMARVAVDSYGEVALLGGLERVAGALRVRRAAGRGHQAASDSVLTWDTFREMARLYFPKECSLDVCAGVIYGLELRHGDATTKPKPAKVRAALRC

SEQ ID NO: 630 - protein, 187 aa, Sorghum bicolor
MGIDLVAGGRNKKTKRTAPKSDDVYLKLLVKLYRFLVRRTKSNFNAVILKRLFMSKTNRPPLSLRRLVNFMEGKENQIAVIVGTVTDDKRVYEVPAMKVAALRFTETARARIVNAGGECLTFDQLALRAPLGQNTVLLRGPKNAREAVKHFGPAPGVPHSHTKPYVRSKGRKFEKARGRRNSRGFKV

SEQ ID NO: 631 - protein, 299 aa, Sorghum bicolor
MVWFQCEDCGENLKKPKLASHFRCCSAYKLSCIDCGEFFSQETVQGHTQCISEAEKYGPKGQNKPSNGVQGKADKPKPNADVDINVGLSTRPPWFCSLCKTTTTSKQTLLLHADGKKHRAKAKAFHASQKQTNGAEQTPDVKEAGAVPTKESVQVNGGMSGDRERNDDKDAAKRKRMDDMTIEEPDNTKKQHLTQSRDEKSENKVKSKADELTSGADCKSVQKQKIKWKKIITKALKTNADGVMKLKKLQKLVSKELQECGVSKDEGLHATLMDKIASSSRFSVDGKHVRLVAKNEEES

SEQ ID NO: 632 - protein, 360 aa, Sorghum bicolor
MAPALLAAVVLAAAASLAAHVALNCPVKPLPSPPPPPTPPPNNLLQRLERLGEGALDAPEDVYVDAAAGGALYTATRDGWLQRMHPNNGSWERWRFVGGTGLLGITPSADGTMLVCDADKGLLRVGEEGVTHLASEVDGSTIRFADAAIEGSDGTVYFSDASTRFGFDRWYHDFIESSATGRLLRYDPRSGKTSVVLDGLGFANGVALPRDEAFVVVCESSRFRCMKVWLKGEKAGKAETFVDLPGCPDNIRLGSDGHFWIALIQLRSPWLDFITRWTFTKRVVASFTGLIEWSKGTAKGAMVAQVTEDGNIVRILDDSEGKVINFVTSVTEFNGDIFLGSLATNFVGKLSLAQVIQQEQ

SEQ ID NO: 633 - protein, 344 aa, Sorghum bicolor
MEAEKKTPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLVILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPIPRNKSDMLDGEDVPLKARVSGVPTGDLEDGEMKS

SEQ ID NO: 634 - protein, 490 aa, Sorghum bicolor
RFVTGGAACCNGNGAVRGPHVAMLATPGMGHLIPLAELAKRLASRHGATATLITFASTASATQRAFLASLPPAVTSLSLPPVDLSDLPRGAAIETLMSEECARSVPALTSILLDLKRTTGGRLAAFVADLFGADSLDAARAAGVRRRCIFFPTNLHALTLMLHLPELDASVSCEFRDLPEPLRLPGCVPIPGPDILMPLQDKANPCYRWMVHHGGKYRDADAILVNSFDAVEPGPAKILRQPAADHRPVVYPIGPLIHADGRKDEKDALCLEWLDRQPARSVMFVSFGSGGALPTEEMRELALGLELSGQRFLWVVRSPSDEGAVNDNYYDAESKKDPFAYLPEGFVDRVTATGVGLVVPSWAPQTKVLAHAATGGFLTHCGWNSVLESLVYGVPMVAWPLFAEQRQNAVMLSDGVGAALRVPESSKGREEIAATVREVMQGEGKGAAVRAKVAELQKAAAEGLRDGGAAATALAEVVEGWTTTGGQEED

SEQ ID NO: 635 - protein, 324 aa, Sorghum bicolor
MLSMTMTAMPHRLARFLLILLLAATATGAGAATPRQLFLVSQPPVTLTNHHGQLLTGNYSVNLLWYGRFTPAQRAVVADFILSLSPSVSGTASVAAWWATTARYHPGAARLSLGRQVVDPTLSLGRRLSESSLASLASRLGPHRGTVAVVVTAADVLVDGFCLSRCGLHASSSSSTRNATSSSGRGGRGRFAYAWVGNPAEQCPGECAWPFHQPPYGPQAAPLVSPNADVGMDGAVITLATLLAGAVTNPYGGGFFQGPAEAPLEAVSACAGVFGNGAYPGYPGQVRVDAATGASYNAVGVAGRRFLLPAMWDPATAQCSTPLV

SEQ ID NO: 636 - protein, 579 aa, Sorghum bicolor
MDPAARGGGHSIAEEAARLWADFPVRVDWAAVAAQCASLWAHARALVLVPAVRLLVFLSLAMTVMILLEKLFVCAVCLAVRAFRLGPHRRYRWEPITAAGSNGAAAGDDEESGGGGHGEAKYPMVLVQIPMYNEREVYKLSIGAACALEWPTERFVIQVLDDSTDPVVKDLVEMECQRWKSKGVNIKYEVRGNRKGYKAGALKEGLKHDYVKDCEYIAMFDADFQPESDFLLRTIPFLVHNPEIALVQTRWKFVNSDECLLTRFQEMSLDYHFKYEQEAGSSVYSFFGFNGTAGVWRISAIDDAGGWKDRTTVEDMDLAVRAMLQGWKFVYVGDIKVKSELPSTFKAYRFQQHRWSCGPANLFKKMMVEILENKKVSLWSKIHLWYDFFFVGKVAAHTVTFIYYCFAIPVSVLLPEIQIPLWGVVYVPTAITLLKALGTPSSFHLVILWVLFENVMSLHRIKAAISGLLDAGGRVNEWVVTEKLGDTNKAKPGTNGSDAVKVIDVKLTEPLIPKLVKRRARFWERYHCSELFVGTCILMCGFYDLLLAKKGYYIFLFLQGTAFLVAGFGYVGTLPPCTA

SEQ ID NO: 637 - protein, 623 aa, Sorghum bicolor
MENLRRLLNPLVLNLQKMELELTCPVCLKLLTSPTTLPCYHTSCSKCALTPTSKGYSCAICKSGYCSQDLRPASHLESIVSIHRSLSSTVCTMIEQQDAQVNIPVAKTASHGTPESGNRSGVMEKYDQMKSYNPVASKLVYDQSTGPAFGNMEGVQAKDPAVENNAGAAAVAPTAIVQKGHSGSQSSDGPGDLDCDSNDLEGELITSRSLLQTALKRETNVMDDHTRELKRQKSNDQVQRQTTMASAWKCEFCHSSQVTECTGPLSHYLNGEPIEADQAWKSSVHHVHEKCVEWAPQAFFTGDIANNLEPELARASKIKCSVCGLKGAALGCLVKSCRNSFHVPCAYNIKGCKWDQENFVMLCSTHSSKKLPCERSKSKKKAKLQQPSSDTDGLNSPSPMQRDELWTASPFLTSGWVICGSALIGHEKEILDQFECHTGITVTNTWSSDVTHVIANTDERGACARTLKVLMAILAGKWVLNVNWLKDCIEARKPIPEEPYEISCDVHGSVNGPRSGRLRAMQQAPNLFAGLTFYFSGHFMPGYKANLEDLIAAGGGSILEKTQLSCASLILYSMEPPQGNSPNTLETINKRIAEAQELAATVGCKAIPHTWLLDSIASCNLSV

SEQ ID NO: 638 - protein, 1051 aa, Sorghum bicolor
MVFLHLAPLQTAVGGCGDGDLPEMLFMFSVCHVIIFLQDGFRFNTQTLKKFRLLQSSKHALAPFVKSLVAAAMPAKTVASDTPTRATHRASSISPPARRGGHAGRQSSAISLMSGTSSNPSVLPGQCIPVLLFVFEDDVLDVSSAAASSDDMGDSSSSNQCSTSDGLSKQSLASKSSGSVVMLARAANKSEGNSAKKLHSSLEGQIRVLLKKCRVLAGMEPGHIGPRGVSNMSHHLPLFSLDTSRVVALLERYINKKQEPLDIIAGLFEDSLCSKLSLDILSLENNYHPTNHDDFQLIKDFIFRQSDALRGRGGYSSNASAGSVSGVGMVAAAAAAAAASAASGKPVNAPDLPTFDKWLSISTSILTALLSGRNVLSGQSESKTHTSPIEKNDQLPAAGSNAIEIALSCLESNNGLNMKFSSSWCQRVLPAAKEIYLKGLPAFYPTSMHEVQLQKALRSFGSMVKGPAVRVFLKKLEDECRAIWESGRQQCDAVSLTGRPCKHRRHGDFSSSDAMKQHSSGYVFLHACACGRSRRLRDDPFDFETANVSFNCFQNCDDLLPTLALPRGSDAGSFSVSSWRLVRLGGARYYKPTKGLLQSGFSSKERYLLRWIISVGKGQVRNGIRSNTVTSSTRSGMNPQTPPIVTGEVKSAVTQVTAQIKSAKLESSGKQPDMEPMSNSGINFGKGLPNFTMKKPFAEVVAGTTSKDSEFPALQQMRPPKPGGRKDERQMNIGDHPNGRGHAAVSQGPVAETESAKASRNKSSENSDGKPFLQIGSNIVPVIVGNETRETSQQVQQFVVYVGFEHECPYGHRFLLSEKHMKEIDSSCLLYQRPHVNKEAEGKHAQKLLQNASGLIASAVDINSAQKNSKPLQSSGRNSQQQSLQLRVDAETSQPSPWLSDPQNGKRGEHYFPSITIDDGGEAFSLMNRNLPIYMHCPHCKISERKEHQDVKFAGAVSQLQRIFIGSCLPSNVSDHDREGSFSIGCRVILPPESFLTMRLPFVYGVETKEGSTFPLKNFEQQPELTAWLVGGTALQIVSVGDVTEKETVMK

SEQ ID NO: 639 - protein, 510 aa, Sorghum bicolor
MRSRKPLGIQLFECARGSPISFRSCQALVLVLTFLSYASYHATRKTTSIVKSVLDPKTNLGMLHWPSHLYLQNLKGAENNNATLSGGWAPFNAEDGTVLLGEIDLAFLGVYAIGMFFAGHLGDRVDLRILLTIGMIGTGLFTAAFGAGYWFNVHSFYYFLGMQMVSGLFQSSGWPSVVAVVGNWFGKSKRGLIMGIWNAHTSVGNISGSLIAAAMLKYGWSWSFVVPGIMIALVGLTVFLFLPVGPDVIGIQEDLHLKDSEKSDMDAPLLERRSSDVKEKAVGFIEAWRIPGVAPFALCLFFCKLVAYTFLYWLPFYISHTAIGGQYLSDSEAGVLSTLFDVGGVVGGILAGHISDHLDARALTAASFTFSAIPALFFYRIYGNVSLAWNIALMFITGMLVNGPYALITTAVSADLGTHSSLNGNSRALATVTAIIDGTGSIGAAVGPLLTGYISARSWSAVFTMLMASALVAGLLLSRLVVAEVAAKMESRRTPAHAASDLPVSTMDEP

SEQ ID NO: 640 - protein, 356 aa, Sorghum bicolor
MASADAGETSTPGPAAREKPIVVRIKRKPSQTRPDAFWLEINERPAKKAMLDFSRLSISEPSSSSSSASAKASEEPRVKKLLVQHIETVHHSEAVEDVLQSLLLADSNAKEIKSKTKEWNDKIKQDNKPEQLRSAARQRHEDMGRNARFAQIWKSRKGEKDDADDSLREICHLYDAVQVDPDDEKHPAEPRQVLISDNLSGHLECRVALFHVPYNIPCRITSFEEGAVLCNFLPLLRKYLPSTAEEIEADIISLAQSEDSEVYDIYTVKEVDDTNMEATSAASYPRLQVDDGEDECYEDCPYDTDDSNAEDNPLFDYPDEFSEDEDDDRNDEDPFGDEEGSDTDYEKEEVEVEEDE

SEQ ID NO: 641 - protein, 504 aa, Sorghum bicolor
MAPSPRRPVLVLLLLLALLCSHVALCSSAEPGKPKPKPKVSGGRKALLADDDGEEVPAAKPAKTAAAGKTKKKLLAGDAASKNQTKVAKAKKPESAAAAAAKGTTKKPAGKAAAGGDAAIAKVSKAPKVPKAEKADKAKVPKPDKAAAAAAGAKAKGADSTKPAKVSKTGAKAVKPPKTGAKSEVAAVAGKAKKPAAANSTADAGAKPVKSGKKAAQVVADAKPKVNATVVSKEESAATETAEVEVEEDVVFAKEAEEGTDDLISEFRDLPSRLQETLMPDLARLSHHSKAYLSAANAGIADGVRPILGGRWAAVAASAASVAVLLLPLFMLTALVRRMGPYLPLLHRALLLAQAYLAIYFATLALAAAATGLEPLRFFHAASPAAYAWTQAAQSLGFMGYLVLQMVDLVAVFSGAASPEDDGNGDAAKALGLAQMVVGLAVGLHYYAAVFHRAAAGEAPRANWRVYAVYAACFAIVCACARAERRKKAYLAGTDGAAEEWKKS

SEQ ID NO: 642 - protein, 437 aa, Sorghum bicolor
MAGGGEAPLLEGKPRVYFDGCPGCANDRRKAENLGIPYGQFFHIWIIILVSCLPISLLFPFIYFMIRDLHIAERVEGIGFYAGFVGASYMLGRALTSTAWGMIADRIGRKPVIILSIISTLLFNTLFGLSVNYWMAIATRFLLGSLNGLLGPIRAYAVEVCRTEHQAIGLTLVSTSWAIGLIIGPAIGGYLAQETLHKHKLHKTEDQGIEDFAEQQNSSTTNKSLLKNWPLMSSIILFCVTSFDDMAYTEIFSLWAESDKKYGGLGFSSEDVGQVLAVTGASILLYQTFVYPRIVKVLGPVNASRIAAILSMVLLFTYPPMTHLSKPWLSVVVNIASMLKNNLVVTVVTCSFILQNNSVPQEQRATANGLATTLMSFFKAFAPAGAGIVFSWAQKRQHAFLFPGDQMVFFLLDIVIFVELIWTFKPFLAIPEQIPRS

SEQ ID NO: 643 - protein, 233 aa, Sorghum bicolor
MRSVLSEKTSYRSWRGSSHLVISNNRSVLGILFRQKTSFYKLILRTIINCDNIKEFIALCEVLELIPQDELELSRQKQPDTMANRRAQKVARFKRQKAAETKLQEIRERKERRGRSLRAAALSAPIEAGEEDDLEDDGEEEREAWLATISLALCKAFDLLDMLKKEEEMLLAVKERKAKVWYDHLAVVLPLRDATLETSSGVNILFVLTSSARTYTYLHGKLFQWLLIKQYTG

SEQ ID NO: 644 - protein, 116 aa, Sorghum bicolor
MAPPISASQSTITILKIFPKPPAPDTSSNNFTVGAKFDNRRALLCGLVAAAAGTVLSPDIAGAASKRRPPPPGPAEEKKDPNVSGVQAKVLASRKRKEAMKEAVAKLRERGKPVDK

SEQ ID NO: 645 - protein, 396 aa, Sorghum bicolor
MEVCNLGNNAMEAQQQREQSQAGGCTDDDPAAVLTCLTFLEQKIAHLRAIIGAAPRPPRQMVSAELSCIAVQLVSISKSLAATGGGGAAAADQDDGAARSPAPNDGDSDSSDHDLLHAEDDYGDGDGDSDGRMPPAGSYEVIELGKEEILAPHVHSCKVCGKGFKRDANLRMHMRGHGEEYKTAAALAKPASAPSSSLARCFYSCPFVGCKRNREHRSFQPLKTAVCVKNHYRRSHCDKSYTCRRCNVKRFSVLADLRTHEKHCGRDRWVCSCGTSFSRKDKLFGHVAAFDGHAPALPPEDDDAVTNAVGLGTGSGRLTTMDTEAVSRMASMEFFPDAVLDGLVCSDIKGFALMDGGQGQYLEDDDGRGSLSPLPMGLDSCDFDGFDLFGAPAIDF

SEQ ID NO: 646 - protein, 194 aa, Sorghum bicolor
PLPRHARSLSMDSLIGKLNFSAGATGAASGVIPGPNMFKLEFGSGEFTPGEMKKIMADDKLAEMALADPKRVKRVLANRQSAARSKERKMRYIAELEQKVQILQTEATTLSAQLTLLQRDSAGIATQNNELKFRLQAMEQQAQLRDALNEALTGELQRLKVATAELGDSCSSNNLAQQIQISVQEQMFQLHQHQ

SEQ ID NO: 647 - protein, 485 aa, Glycine max
MGEENVKQPLLERKYYKDCPGCKVDQAKELSEGKGVPVKNLFIMWMVVLCAALPISSLFPFLYFMVRDFNIAKTEADISSYAGYVGSSFMLGRCLTSVLWGIVADRYGRKPVIVMGIIAVVIFNTLFGLSTNFWMAVIMRFLLGSLNGLLGPVKAYASELFREEHQAIGLSTVSAAWGIGLIIGPALGGYLAQPVEKYPHIFTKDSFWDKFPYFLPNLIISAFAFVVAIGCIWIPETLHNHNCSNESTDDAKALESGNSGAGNEKIIQKNDNLLLNWPLMSSIIVYCVFSLHDIAYQEVFSLWAVSPQRLGGLNFTTDNVGDVLSISGLALIIYQLTLYPFVEKASGPIVIARFSGMLTIPLLQSYPFIALLSGLALYIVISIASILKNIMSVSAPLHLFNHLLEQHQRGAANGISMTAMSLFKAIGPATGGAVLTWSQKRMDASFLPGTHMVFFVLNIVEALGILMMFKPFLVEKKKTHSDQLH

SEQ ID NO: 648 - protein, 300 aa, Glycine max
MASELQLPPGFRFHPTDQELVLHYLCRKCASQPIAVPIIAEIDLYKYDPWDLPGLASYGEKEWYFFSPRDRKYPNGSRPNRAAGTGYWKATGADKPIGHPKPVGIKKALVFYAGKAPKGDKSNWIMHEYRLADVDRSVRKKNSLRLDDWVLCRIYNKKGTIEKFQPSSDVVVSRKMESSEIEDRKPEILKSGGGCLLPPVPPPQAKAAVKKDYMYFDPSDSIPKLHTDSSCSEHVVSPEFASEVQSEPKWKEWEKSLEFPFNYVDATLNNSNSFTTQFQGNNQMMSPLQDMFMYWPNKPF

SEQ ID NO: 649 - protein, 545 aa, Glycine max
MALPHSISALATTLTLSSPITKPHKVNPFPFSSNRNSQFLTKQTRPRSRRNLSLTPARVAAPPSTVEADRLYPEAENNETEEEFSDESSSSKFTWRDHWYPVSLIEDLNPLLPTPFQLLGREIVLWYDKSISQWVAFDDKCPHRLAPLSEGRIDEDGKLQCSYHGWSFDGCGSCVKIPQASSEGPEARAIGSPKACATRFPTLVSQGLLFVWPDENGWEKAKASKPPMLPDDFDKPEFATVNIQRDLFYGYDTLMENVSDPSHIEFAHHKVTGRRDRAKPLPFKMDSRGSWGFSGANEGNPQISAKFVAPCYMMNKIEIDTKLPVVGDQKWVVWICSFNVPMAPGKTRSIVCSARNFFQFSVPGPAWWQVVPRWYEHWTSNKVYDGDMIVLQGQEKIFLSETKEGGDINKQYTNITFTPTQADRFVLAFRNWLRRHGNGQPEWFGNSSDQPLPSTVLSKRQMLDRFEQHTLKCSSCKAAYEGFQTWQKVLIGATVVFCATSGIPSDFQLRVLLAGLAVVSAAIAFALNQLQKNFEFVDYVHAEID

SEQ ID NO: 650 - protein, 228 aa, Glycine max
MKPFLFLNLPNTEFNSSQVDCNHSMAHSSYPYGDPIFAYGPQAISHPQMIPPMLGLASTRVALPLDLAEDGPIYVNAKQYHGILRRRQSRAKLEAQNKLIKNRKPYLHESRHRHALNRVRGSGGRFLSTKQLAQSNAEFVTGAHSGSDPTNRYQKEHLSEVESHSSKDGDNSSFITTCSDRPCLSGNNVNFRQQECMFLGNSANMGGSPQFSGGLTFGGAKQRTSVVR

SEQ ID NO: 651 - protein, 414 aa, Glycine max
MGCTYSVYRKKKSSFPEVVVFVPSTRIPVQSDLQRMVKGVIPRDLADKLTSLRNQIVLIAEDTGGSAIAELRRALKEYLSVLIGLTKKEYGPEGLIDFKWKNLEDGRQDSSISNTWFEVLSSVHLMAMLTLSDADSLMIPKDPSGSGFRVVSSDSKREAIDLLLKASGYLEFCVRDVLTRIPAETKKTFPHDLQEGVLEAIAIQTLGQGTEIQLGLAVESQKATLSVKRRLACEQLIYFTQAYHCLSGCDINQGHGRKQIRFIKWKFLEAKAAAYYYHGLILDKGSEPSIHIGSVSCFLAAEELLAESKKACLSFCLAPPVTRAPPLWGAMKFLHQKIPEVASRKSQMYGYLWEQEKGLQSLPDLPEFQLSLRPDDYELPEIDPAWDSENWESLGQPLKEHLRDSDEHDENPTD

SEQ ID NO: 652 - protein, 398 aa, Helianthus annuus
MRFFLLHVCTLFSVALIGSHAVTPEVYWKSVLPNSPMPKSIKDLLYTEWNDEKSTAVGVGKGGVSVHTGKPGKRTDVGVGKGGVGVHTGKPGKRTDVGVGKGGVGVHTGKPGKRTDVGVGKGGVGVHTGKPGKGTHVGVGKGGVNVHTRHKGKPVYVGVRKGPNPFVYKYAASENQLKDNPNVALFFKENDLHQGKEMNLHFTKNDEKATFLPRQIADSIPFSSNKLPQIYEEFSVKPDSMEAEIMKQTLSECESTGIEGEEKYCATSLESMVDFSTTKLGKNVKAISTEVSAKESTPLQKYKIEVAKKLAANKAVVCHKQNYAYAVFYCHKTASTQAYAVSMVGADGTKVNAVAVCHTDTAKWNPKHLAFQVLKVKPGTVPICHFLPEDHVVWVPYK

SEQ ID NO: 653 - protein, 316 aa, Solanum lycopersicum
MSSLKVPASVPDPYEDAEQLKKAFKGWGTNEELIIQILAHRNAAQRKLIRDSYAAAYGEDLLKDLDSELTSDFQRVVLLWTLSPAERDAYLVNEATKRLTASNWVIMEIACTRSSDDLFKARQAYHARYKKSLEEDVAYHTSGDFRKLLVPLITAFRYEGDEVNMTLARKEANILHEKISDKAYNDEEIIRIISTRSKAQLSATFNHYNDHHGHEIIKDLEADDDDEYLKLLRAAIECLKTPEKHFEKVLRLAIKKLGTDEWDLTRVVATRAEVDMERIKEEYHRRNSVTLDRAIAGDTSGDYEKMLLALIGHGDA

SEQ ID NO: 654 - protein, 327 aa, Solanum lycopersicum
MASTISYTSLCSLLKLNQTNQKTPFSPSLSSPSSLVKIKNQLCFSSNFCSHLNKASIFMVKASETEATQSEKEEEDKYEEYEVEIIQPYGLKFTKGRDGGTYIDAIAPGGFADKTGKFTVGDKVIATSAVFGEEIWPAAEYGRTMYTIRQRIGPLLMKMQKRYGKVEEVGELTEKEIIRAERNAGFISDRVREIQVTNARRKKEQKEQRERELREGLKLSKNGKYEEALEKFESVLGSRPTGDELAVASYNVACCYSKLNQLQAGLSALKDAMEAGFEDFKRIRTDPDLANLRTSEDFETLMKKFDESFINENAINAIKSLFGFNKK

SEQ ID NO: 655 - protein, 200 aa, Solanum lycopersicum
MSNRQLCSLDSEKSHLMNTCNLLTQFFNGKANINDLNLTISNNGEAKASATKDLLTNMEELSTKTTEQDQKLIDHVPKSAINKASGSKEIPHKEQKLAQLSIFYGGKVVVFDDFPAEKARAVMLLASKGISNNSCAIFQTPTTTQTNGSNNFDLPIARRSSLYRFLEKRKDRDTARAPYQMHNPLQSSSRTRGDHFDLNF

SEQ ID NO: 656 - protein, 447 aa, Solanum lycopersicum
MSLFRFFASTILLLFLISCFSFSSTDAFDPLDPNGNITIKWDVISWTPDGYVAVVTMYNFQQYRHIQAPGWSLGWTWAKKEVIWTMMGAQTTEQGDCSKYKGNIPHCRKKDPTVVDMLPGTPYNQQIANCCKGGVINSWGQDPATAVSSFQVSVGAAGTTNKTVRVPKNFTLKAPGPGYTCGPAKIVKSTKFVSADGRRVTQAMMTWNVTCTYSQFLAQKTPTCCVSLSSFYNDTIVPCPTCTCGCQSNGTQRGSCVDPETPHLASVVSDHGKNNYVPLVQCTKHMCPIRIHWHVKLNYKEYWRVKITITNFNYRMNYTQWNLVVQHPNFDNLTTLFSFNYKSLTPYGSINDTAMLWGVKFYNDLLMQAGPSGNVQSELLFRKDASTFTFEKGWAFPHRIYFNGDNCVMPPPDAYPFLPNAGSRWEASLITLVVTLMSSMAVVLTYI

SEQ ID NO: 657 - protein, 320 aa, Solanum lycopersicum
MMMIGRSPPTVQIPPWDVTDDPTVDVYSPFSVSPDSAFDALTALQRYLPSNGNDVIFDSDGLDIPVDAFSCDNFRMYEFKVRKCARGRSHDWTECPYAHPGEKARRRDPRKYHYSGTSCPDFRKGQCKKGDACEYAHGVFECWLHPARYRTQPCKDGTHCRRRVCFFAHTPEQLRVLPQNSPRSFNESSDSFDGSPGRVGFESFSSSPPLESPPMTPRGLAESMRNMQIGMVRGMRSMQMGSPAFGSPRSPSILRPGFMSMPTTPTRSGASVFDHCEEEPAMERVESGRDLRARIYAKLSMENSLDSGAPDVGWVSELLK

SEQ ID NO: 658 - protein, 410 aa, Solanum lycopersicum
MAEVCFGVVTETDSSSPCESSSRAVRRRRMELRKIKVIAGVTQPETENGIKRPKMKLISGSVSRICDNAVESSSTDDDEEQLRLVETKGSPPTIILTPYLGPLNSTLLVQSVAYPKFGFASVCGRRRDMEDAVAIHPSFCQMEQGNSGELHYFAVYDGHGCSHVATKCKERLHELVKEELENTEGDHEEWEHLMNRSFNRMDKEVIEWNKSVTGATCRCELHTPECDAVGSTAVVAVVTPDKIIVANCGDSRAILCRNGKAIPLSNDQKPDRPDELNRIQEAGGRVIYWDGPRVSGVLAMSRAIGDNYLKPYVICEPEVTITDRTSEDDCLILASDGLWDVVSNDTACGVAGMCLKGNASPASMPEIGTDGEVNSDQCCSDASVLLTKLALARRSYDNVSVVVVDLKNYK

SEQ ID NO: 659 - protein, 303 aa, Solanum lycopersicum
MPTIAKHDGRQLETGLRITSLSTTQMQPWWHGYGDNTMPLASENAVAQEKSEGGNQDKETKALAMESGSDGNNEQYKQHLKHFAPTTAAIMAEQQKELTGHSAMLASYPYPDMQYGGMMTYGAPVHPHLFEIHHARMPLPLDMEEEPVYVNAKQYHGILRRRQIRAKAELERKAIKARKPYLHESRHQHAMRRARGTGGRFLNTKKLNDMDCTPTETQKYGATIATHSGNSSGSGSSDQGGKEGSTVQDMHKGHSQSFTTGNGHGSSVYFSASSGSEQGNGHYGHGSWSLLVNQASQGAASSN

SEQ ID NO: 660 - protein, 311 aa, Solanum lycopersicum
MNTTIFSKGNERVVQNQSVGTLCSAPWWSNGFMSQSVAYAEPFGQLKSASVEQQPKGNATEFTISSGDCKSSANGQKLPNIQAASSVRAANMDYRGHFELGFGQSLIYAKHPYGEQCIGLFSAYAPQLSGRIMLPLNLASDEGPIFVNAKQYHGILRRRKTRAKEMEKKALKPRKPYLHLSRHLHALRRPRGCGGRFLNTRNMNGTMKAGKTNNMFKTGDVQNFYPTGSQNSEVLQSDSSNLSSPKETSGSRFFDSSGVANMYSSDNLDPFLFQNLRPPVQAIPDMMNTGHGIFVSGKWVCTADSCCNLKV

SEQ ID NO: 661 - protein, 484 aa, Solanum lycopersicum
MASEERRETLLNKREEKHYYENCPGCKMDLHKAGQTGLPVKELFTIWVVVLGTALPISSLFPFLYFMVRDFHIAKREEDIGSYAGYIGSAFMFGRTLTSAFWGVVADQYGRKPVIIFGTSIVIIFNTFFGLSANFWMAVVTRFLLGSLNGLLGPIKAYAAEIFREEYQALGMSTISSAWGIGLIIGPALGGFLAQPAEKYPDLFSKGSLFGRFPYFLPCLCISVFALVVAVGSFWIPETLHNHDSERPRPDSYKALEAASDTKDGNESAPKENLFKNWPLMSSIISYCVFALHDMAYSEIFSLWAVSPRKFGGLSYSTADVGEVLSISGFGLLVFQLTLYSSVAKYIGPVMTARAGGVLSIVLLTTYPYIAMLSGTTLSVVMNVVSMMKNILSISIITGLFILQNKAVDQRQRGAANGLAMTGMSFFKALGPAGGGALFSWAQKRLHASILPGNHVVFFVLNMIEAIGVLLTFKPFLVEAQNTN

SEQ ID NO: 662 - protein, 241 aa, Solanum lycopersicum
MGRGRVELKRIENKINRQVTFAKRRNGLLKKAYELSVLCDAEVALIIFSNRGKLYEFCSSSSMLKTLERYQKCNYGAPEPNISTREALEISSQQEYLKLKGRYEALQRSQRNLLGEDLGPLNSKELESLERQLDMSLKQIRSTRTQLMLDQLTDYQRKEHALNEANRTLKQRLMEGSQLNLQWQPNAQDVGYGRQTTQTQGDGFFHPLDCEPTLQIGYQNDPITVGGAGPSVNNYMAGWLP

SEQ ID NO: 663 - protein, 291 aa, Solanum lycopersicum
MVELQFPAGFRFHPTDEELVMHYLCRKCDAQPIAVPIIAEIDLYKYNPWDLPDLALYGEKEWYFFSPRDRKYPNGSRPNRAAGSGYWKATGADKPIGRPKSMGIKKALVFYAGKAPKGEKTNWIMHEYRLAHVDRSARNKNNSLRLDDWVLCRIYNKKGTIEKNQLNIRKMNGEMSPAVSEGDVKPEIVPISVSTNPSSTSYHVYNDFTYFNSPDSLTKLHADSSCSEHVPSPEFTYEKEVQSEPKPKPSEWEKTALDFPFNYTDATASELQSCYEMSPLQDIFMYLQKPF

SEQ ID NO: 664 - protein, 721 aa, Solanum lycopersicum
MASSIVQNGHVNGEAMDLCKKSINVNDPLNWEMAAESLRGSHLDEVKKMVDEFRKPIVKLGGETLTVAQVASIANVDNKSNGVKVELSESARAGVKASSDWVMDSMGKGTDSYGVTTGFGATSHRRTKNGGALQKELIRFLNAGVFGNGTESSHTLPHSATRAAMLVRINTLLQGYSGIRFEILEAITKLINSNITPCLPLRGTITASGDLVPLSYIAGLLTGRPNSKAVGPNGEKLNAEEAFRVAGVTSGFFELQPKEGLALVNGTAVGSGMASMVLFESNILAVMSEVLSAIFAEVMNGKPEFTDYLTHKLKHHPGQIEAAAIMEHILDGSSYVKAAQKLHEMDPLQKPKQDRYALRTSPQWLGPQIEVIRAATKMIEREINSVNDNPLIDVSRNKALHGGNFQGTPIGVSMDNTRLALASIGKLMFAQFSELVNDYYNNGLPSNLTAGRNPSLDYGLKGAEIAMASYCSELQFLANPVTNHVQSAEQHNQDVNSLGLISARKTAEAVDILKLMSSTYLVALCQAIDLRHLEENLKSAVKNTVSQVAKKTLTMGANGELHPARFSEKELLQVVEREYLFTYADDPCSSNYPLMQKLRQVLVDQAMKNGESEKNFNSSIFQKIVAFEDELNAVLPKEVESVRAVFESGNPLIPNRITECRSYPLYRLVRQELGTELLTGEKVRSPGEEIDKVFTAFCNGQIIDPLLECLKSWNGAPIPIC

SEQ ID NO: 665 - protein, 413 aa, Solanum lycopersicum
MARLAPEGAQFDARQFDSKMNDLLAAEGKDFFTSYDEVYDSFDAMGLQENLLRGIYAYGFEKPSAIQQRGIVPFCKGLDVIQQAQSGTGKTATFCSGILQQLDYGLIQCQSLVLAPTRELAQQIEKVMRALGDYLGVKVHACVGGTSVREDQRILAAGVHVVVGTPGRVFDMLRRQSLRPDCLRMFVLDEADEMLSRGFKDQIYDIFQMLPTKVQVGVFSATMPPEALDITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTTDDERMLFDIQKFYNVVIEELPSNVADLL

SEQ ID NO: 666 - protein, 130 aa, Solanum lycopersicum
MAQYGNQDQMRKTDEYGNHVQETGVYQGTGTGGMMGGTGTGGMMGGTGGEYGTQGMGTGTHHHEGQQQLRRSDSSSSSEDDGEGGRRKKGLKEKIMEKMPGQHEGEYGQTTGEEKKGMMDKIKDKIPGMH

SEQ ID NO: 667 - protein, 385 aa, Triticum aestivum
MEGGGARNVSAAAAQTKESADDGSCKPLPPCCVKAQAAVAESEAKCHATVVSGWFTGTRSRSGKPSKAQYFNNPMWPGEAHSLKVEKILYQGKSPYQEVLVFESSTYGNVLVLDGIVQLTDKDECAYQEMVTHLALCSIPSPKNVLVVGGGDGGVLREIAKHDSVESIDICEIDQLVIDVCKDFFPRLYVGYKDPRVKLHVGDAVEFLRNSPEGKYDAIIVDSSDPIGPAQELVEKPFFQTIARALKPGGVLSNLAESMWLHTHLIQDMLSICREVFKGGVHYAWASVPTYPSGVIGFLLCAKEGPPVDFLTPVNPIEKIEGATKDGREMRFYNSEIHKAAFILPTFVKRELEAYNSSTEKERPEKPTAKPVKMKVMRDSAITAS

SEQ ID NO: 668 - protein, 75 aa, Triticum aestivum
MAGVVGVWFAKFGREAAPAVEAEAEVVGRRHQGDGLLEVEAVKTVQIQERRRRNSAVLANSEDTVCMLMDRFAPA

SEQ ID NO: 669 - protein, 136 aa, Triticum aestivum
MDGKKKPTAATGSSIVDDLFGPKDGAASSSAGYFSTVFPTPSGATGKDASLRAAAAAGNKSSSAGHQQQGKQHGGSPESPYFGSSSVHYGGRDFYAGAESQRQYPAAAAAPAPKHKDDGDTSAATRGDWWQGSLYY

SEQ ID NO: 670 - protein, 327 aa, Triticum aestivum
MGMPAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRAAASKKGSLRLDDWVLCRLYNKKNEWEKMQLQQQGGEEMMVEPKAENTASDMVVTSHSHSQSQSHSHSWGEARTPESEIVDNDPSLFQQAAAFQAQSPAAAAAHQEMMATLMVPKKEAAEEAGRNDLFVDLSYDDIQSMYNGLDMMPPGDDLLYSSLFASPRLRGSQPGAGGMPAPF

SEQ ID NO: 671 - protein, 620 aa, Triticum aestivum
FRKFDGLAWDIERAQPPVDLWRKFVYCTSLSGSILGSVDHMKQEDFNKVISPISVAHFSQYKLVDLLLKKLDGVGFQTCFPDELGGSSTQDLLLENKILMGHECSSIQLTDDGILVGASFNNGGRVHERKLHCGLLLGADGARSKVRELAGISMKGERDLQKLVSVHFVSRDLGKYLSSERPGMLFFIFNPDAIGVLVAHDLEHGEFVLQVPFYPPQQMFEDFNAKVCEQIIVKLVGWEPADIQVLDIKPWAMHAEVAEKYVGCDNRVILVGDAAHRFPPAGGFGMNTGVQDAHNLAWKLCLLLNGIADPSIIQTYESERKPVATFNTELSLENFKAAMSIPATLGLDPTIANSVHRVINSSLGSIIPRNLQKVVLEGLFSIGRTQVSDYILSENNPLGSLRLARLRSILDEGKSLQLQFPAEDLGFRYGKGALVAEDCAESTYQAEELKHSKRSSGEYIPSAKVGSRLPHMLVRPLSASSEGVFSTLDLVSGDKIEFVIIIAPLKESYKLAQAMLMIADEFELSAKVCVMWPQGSRDVEAKGSISELAPWTNYVDVEEIPRATVNSSWWEMCQVNNKSVILVRPDEHIAWRAEPDMVRDAYSDVRRVFSQILSLNRPQV

SEQ ID NO: 672 - protein, 253 aa, Brachypodium distachyon
MSSAVEAMSCSKVDVAAVPEEAKERVVVMEHGINGGGADAAATNGKRGEAQCGRKDDGGEEEDDEDGEKVPEAIELGPILSIKDQLEKDKDDDSLRRWKEQLLGSVDLNSVGETLEPDVKIMSLSIISPGRPDIFLPLPVEPNGKGVWFTLKEGSLYKLKFTFSVSNNIVSGLRYTNRVWKTGIKVDSTKEMLGTFSPQQEPYTYVTPQETTPSGMFARGSYSARTKFLDDDRKCYLEINYTFDIRKDWPSSS

SEQ ID NO: 673 - protein, 248 aa, Brassica napus
MSGAVSGSRDMGFVDNNNNKKDGDDGNTSKTASSHQHEGTDDEGAGSLGRQMSEASLSAAEEEEDDDSKLQLGPQYTIKEHLEKDKDDESLRKWKEQLLGSVDVTNIGETLDPEVKIISLVILSPGRPDIVLMVPENGNPKGMWFTLKEGSRYCLKFTFQVKNNIVSGLRYTNTVWKTGVKVDRGKEMLGTFSPQSEPYNHVMPEETTPSGMFARGSYSARTKFLDDDNKCYLEINYSFDIRKEWPAV

SEQ ID NO: 674 - protein, 208 aa, Zea mays
MASDRVLGTVKWFNGTKGFGFITPDDGSEDLFVHQSSIKSDGYRSLNDGDAVEYTVGSGNDGRAKALDVTAPGGGPLAGGERPDGGNGGGRGGYGGGDRGYGGGGDRGYGGGGDRGYGGGDRGYGGGGDRGYGGDRGYGGGGGYGGGYGGGGGGGGRGCFKCGEEGHMARDCSQGGGYGGGGGGGRGSECYNCGQEGHISRDCPNKRR

SEQ ID NO: 675 - protein, 377 aa, Oryza sativa
MRADRAELRELKPPYPLSAPGLPLLDPTICPRHASSRASRLACVRARRAAPSFWSLAPRYFPLVPNPESASASVLALLLWYLCSRLLCLATLLPPPHCLLPWFGSFCSWVDAGCVRACVRAEAMSSAVDAISCSKGIAAPPTEEATKERVAVVGKNGGVEHGGDAATMNGKQCGEAPHCRKESNEEEEDDEEKAPKAIDLGPRVSIKDQLEKDKDDESLRRWKEQLLGSVDLNSVGETLEPDVKIMSLAILSPGRPDIFLPLPVEPNAKGVWFTLKEGSLYKLKFTFSVSNNIVSGLRYTNAVWKTGIKVDSHKEMLGTFSPQPEPYTYVTPEETTPSGMFARGSYSARTKFLDDDRKCYLEINYTFDIRREWPALS

SEQ ID NO: 676 - protein, 509 aa, Oryza sativa
MAFAATKPSKSPLLILLVSGVAFLLLASAAECYGGGRHDVTRSAVARRSGVGSRRQYVRHRLTGGAVDVPHRYMLAEKGSNSTRANHTSPAASNSTPSATTTEAPAAGKHHRSHKHRVRNWIIGFVVGSLAGVVSGLAMSVLFRMALNCVRGGYRSKSDTVIFIPKLIKSKEHLAFLEKDQDGLASLAVIGRGGCGEVYKAQLPPEREGDAPRFIAIKKIKKRSGDGSGGQNNNLSDEESRQLDKWTRQIQSEIRTVGHIRHRNLLPLAAHVPRPDCHYLVYEFMKNGSLHNALKATTTDTTTNDYNDNNSGEHPPPSPALPWPARLRIAVGIAAGLEYLHVSQRPQIIHRDLKPANILLDDDMEARIADFGLAKAMPDAHTHMTTSNVAGTLGYIAPEYHQTLKFTAKCDVYSFGVILAVLGTGKEPTDKFFAQQVVDDVGIVRWLRRVMQEGDPAAQAGVIDAAIAGAGHDEQILLVLRIAVFCTADDPKDRPTAKDVRCMLSQIKN

SEQ ID NO: 677 - protein, 309 aa, Sorghum bicolor
MQMDSYNYASFFHDEAAFYPHVAVPPSSPELPFGLIASPGEMEPEPPFAPPMPTAFQDYDYPGAAVGVGAGAPFGGPSVHRQVMDALGGDGQREQSMAMAEDGEEEQEQEPRRQRQRQQPAGAAAAAVESSRGFRHMMRERQRREKLSQSYADLHALVASRSRGDKNSIVQAAAIYIHELRGAREQLQRRNEELKARILGHDARQQCVKVQFEVDEPASAIDSMIGALRRLKGMDVRARGIRSNLSGRRLCTEMNVETTIAAGEVEKAVEEALMQEVERKQQQQLGAGSAAAAPGFAGPQASSHVQNVF

SEQ ID NO: 678 - protein, 438 aa, Sorghum bicolor
MPVTPTMEIDLHDVRAARVLGRGAMGTVFLAVDGAASSGEAYALKVFDKRSPAASRPAAGADAARRARWEVSVLSRLAHPHLPSLLGCAETPDLLAWALPYCPGGDLNELRHAQPDRVFSPAAIRFYVAEVVSALAELHATGIAYRDLKPENVLLRADGHVMLTDFDLSRQLPPRSPAASTSTSTSSSCSATSSPPPPQAQSHRRLKNIFKRSESAVTASTSGQEEEPRNLAWYLDRSIEGGVDQIKKAKSARVSPMERAKKLSSFLSAAAGERSFSFVGTEEYVAPEVVRGDGHEFAVDWWALGVLVYEMCHGRTPFRGRNRKETFRNVLLREPEFTADARRRWPELTDLIARLLEKDPSRRLGFAGGADEVRAHPFFAGVAWDLLGEVSRPPYIPAPADDIVSCDGFSVVEYFDKLHQPPLSPAEHSPEDDLLPEF

SEQ ID NO: 679 - protein, 636 aa, Glycine max
MAEKMKTHYFPLFSFFFFFFLISINAKLDLYPSDYKALLTLQKDLRVNGQLAAATEACETEGVLCERRRLSGKETYALRITRLVFKSNNLNGVLSPSIGRLTELKELSLSDNQLVDRVPPQIVDCRKLEILDLANNIFSGEVPSELSSLTRLRVLDLSTNRLSGNLNFLKYFPNLETLSVADNLFTGRVPPSVRSFRNLRHFNFSGNRFLDPSLQSSSPDTILSRRFLSEDGDGDVPAPAPAPNNSQKKKSNASTHAAAAAPGPAPNHTNKHKHSKRKLLGWILGFVAGALGGTLSGFVFSLMFKLALALIKGRGRKAGPDIYSPLIKKAEDLAFLEKEEGIASLEIIGRGGCGEVYKAELPGSNGKMIAIKKIVQPPKDGAELAEEDSKVLNKKMRQIRSEINTVGQIRHRNLLPLLAHVSRPECHYLVYEFMKNGSLQDTLSKVERGESELDWLSRHKISLGVAAGLEYLHMNHNPRIIHRDLKPANILLDDDMEARIADFGLAKAMPDYKTHITTSNVAGTVGYIAPEYHQILKFTDKCDIYSYGVILGVLVIGKLPSDDFFQHTEEMSLVKWMRKTLSSENPKEAINSKLLGNGYEEQMLLVLKIACFCTMDDPKERPNSKDVRCMLSQIKH

SEQ ID NO: 680 - protein, 221 aa, Panicum virgatum
MAAERAQGTVKWFNGTKGFGFISPDDGGQDLFVHHSSVKADGFPNLKDGDAVEFTVGADNDGRAKAIDVSAPGGGALAGGERPDNGYGGRGGGGYGGGGDRGYGGGGDRGYGGGGDRGYGGGGDRGYGGGGDRGYGGGGGDRGYGGGGGFGGGGDRGYGGGGGGGRGSGCYKCGEEGHIARDCSHGGGGYGGGGYGGGRGSGCYNCGEDGHISRECPNKRR

SEQ ID NO: 681 - protein, 314 aa, Triticum aestivum
MASRDFLGRFGGEKGASSDKAGGGAGEPDEVVELSLGLSLGGCFGANSGRDAKKPRLVRSSSLAAMCSLPGTSDDIAAATPPPAPLMRTSSLPTETEEERWRRREMQSLKRLQAKRKRLERRTSMNSGKSGGSSSRDDAQEPLYPSAFQLRRSVVDQGNASSSMPEQGSGDGAEAKSTSSMEISSDNNNNASNQNKSLPPPAPSPAGKLPNGIVKEQPPLRTLRSLTMRTTSTGDLRKSMMEDMPMVSSKVDGPNGKKIDGFLYKYRKGEEVRIVCVCHGNFLTPAEFVKHAGGGDVTNPLRHIVVNPAPSVFL

SEQ ID NO: 682 - protein, 285 aa, Triticum aestivum
MQMDSYYFHDDAHFFAGCGVPGSPDLPFADLIASLSEPLPEVASQSAFREYRGVGLELPGTARGGTGNGINIHRRMMGVLGRMVPVTEEEERPQQQHQQQQQQAAGAVESSRGFRHMMRERQRREKLSQSYADLYAMVSSRSKQDKNSIVQSAAVYIHELKVAKEQLQRRNDELKAKILGHDAQQQCVKVQFEVDEPSSSVDSMIGALRRLKSMNVKTRGIHSTLSGQRLTTEMNVETTIAACEVENAVEEALQEVERNQLPDSEAPFPGSRSAWPQTSHVQNVF

SEQ ID NO: 683 - protein, 201 aa, Brachypodium distachyon
MEPKSTTPPPPAPVLGAPVGYPPAAVYPPSAAAAGYPHAPALYAPPPPPPPAAASQQAAAAQQQQLQMFWAEQYREIEATTDFKNHNLPLARIKKIMKADEDVRMIAAEAPVVFARACEMFILELTHRGWAHAEENKRRTLQKSDIAAAIARTEVFDFLVDIVPRDEAKDAEAAAVAAGMPHPAAGMPTADSMAYYYVPPQ

SEQ ID NO: 684 - protein, 143 aa, Brassica napus
MADTPSSPAGDGGESGSGSVREQDRYLPIANISRIMKKALPPNGKIGKDAKDTVQECVSEFISFITSEASDKCQKEKRKTVNGEDLLWAMATLGFEDYLEPLKVYLARYRELEGDNKGSGKSGDGSNRDAAAGGVSNEDMPSW

SEQ ID NO: 685 - protein, 174 aa, Populus trichocarpa
MADNPTSPAAGSHESGGEQSPRSGVREQDRYLPIANISRIMKKALPANGKIAKDAKDTVQECVSEFISFVTSEASDKCQKEKRKTINGDDLLWAMATLGFEEYIDPLKVYLARYRELEGDAKGSARGGDGSSKREAVGGLPAQNAQFALQGSMNYISPQGQGQHMILPSMQGNE

SEQ ID NO: 686 - protein, 172 aa, Glycine max
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREGDTKGSARSGDGSARPDQVGLAGQNAQLVHQGSLNYIGLQVQPQHLVMPSMQGHE

SEQ ID NO: 687 - protein, 472 aa, Zea mays
MAVSPDQQQPPAGVGSPLPSPRLRVRVRDTTLVPPSPSPPETSLPLTFLDIFWLHSPPVERLFIYRLAPDADVDAIISRLRDSLHQAVRAFYPLAGRLRLTPGTSDRYELHYRPGDAVTFTVAECDDDDADAHFDALATDEPREVAKIATLVPPLPERGGLFAVQATLLPARRGLSIGVTVHHAACDGSGSTHFLHTWAVACRAGAEAPPPPPPVIDRSLIADPRRMYDVFIQGAPSTEEYEFVKMSADQLFATFALSKDELKRIKDAVAEEAARRGVAPPRCSSLVATFGFVWSCYQQAKEASSGAGEFPMTCMAFPVDHRSRMEPPLPDKYLGNCVGPAFALAPTGELAQAGAGGFFSACAAVASSIDEAVRDIETSNVEVWFDRIRDLIPMGFLTVAGSPRFRVYDMDFGFGRPAKVDVVSVARTGAVAVAESWDGNGGIEVGVSLQPAAMKRYRKCFADAIAWLHQRT

SEQ ID NO: 688 - protein, 502 aa, Zea mays
MDNGGSNGSATASACCNGKINRGPHVAMLATPGMGHLIPLAELAKRLASRHGATATLITFASTASPTQRAFLASLPPAVSSLSLPPVDLSDLPRAAAIETRMSEECARSVPALTAVLAGLRRSTAGRLAAFVADLFGADSLDAARAAGVRRRCIFFPSNLHVLTLILHLPDLDAAVPGAFRDMPEPLRLPGCVPVPGPDVLMPLQDKADPCYRWMVHHGAKYRDAHAILVNSFDAVEPGPAKVLRQPESGGPSRRWPAVYPIGPLIHADGGRKDGASSSPCLEWLDRQPPRSVVFVSFGSGGALPAEQMRELALGLELSGQRFLWVVRSPSDGGAVNDNYYDAESKRDPFAYLPEGFVDRTCAAGVGLVVPSWAPQTQVLAHAATGAFLTHCGWNSVLESLVYGVPMVAWPLYAEQRQNAVLLSDGVGAALRVPESSKRREIIADTVREVMRGEGKGAAVRAKVAELQKAAAEGLRDGGAAAAALAEVVQGWTTTTGGGEKD

SEQ ID NO: 689 - protein, 299 aa, Zea mays
MQMDSYNYNYASFFHDEAPSFYPHVAVPPSPELPIGLIASPGEPEPPFAPPMPASFQDYTGAVGVGVGVRAPFGGASVHGQAIDALGGGDGQREQSMAMAEDGEEPAPRRRQPAGGPAAAAVESSRGFRHMMRERQRREKLSQSYADLHALVAARSRGDKNSIVQAAAVYIHELRGARDQLQRRNEELKARILGHDAGQQCVKVQFEVDEPASAIDSMIGALRRLKGMDVRARGIRSSLSGRRLWTEMNVETTMAADEVERGVEEALLQEVERKQQQQLGAGSAAPGFPGPSSHVQNVF

SEQ ID NO: 690 - protein, 92 aa, Hordeum vulgare
RFIPYSQFPPRMVRKDCCTYSTTPAMSVPKTLQNVHSCENWLPRRVMSAWRIAGMVHALEGWDEHECGDKVLDMDKVWSAALLHGFRPVTED

SEQ ID NO: 691 - protein, 202 aa, Hordeum vulgare
PGDLTSTGDTYGHQEDTKMTGMGRHSAPATGGSYGQHAHTGETGTGTHGTGEKKGVMENIKEKLSGGHDDHQQTGGIYGQQAHVGTGTHDTPATGGTYGQHGHTGVTGTGTHGTGEKKGVMENIKEKLPGGHSDHQHTTETYGQHRHTGVAGTETHGTTATGGTYGQQAQTGTTGAGTHGTDGTGEKKSLMDKIKDKLPGQH

SEQ ID NO: 692 - protein, 445 aa, Hordeum vulgare
MEHQAHVAGEKKGLMEKIKEKLPGGHGDHKQAADTHGQQGHAGTGTHGAPATGGAYEQQGRTGVTGTGLNGADAGEKKGLMEKIKDKLPGGHGDQQTTAGTYGQQGHTGTAAHGTPAGGGTYDQEGHTGMSGMGAHDTHATGGAYGQHAHTGGTGTGTHGTGEKKGVMENIKDKLPGGHGDHQKTSDTYGHQEDTEMTGMGRHSTPATGGSYGQHHAHTGETGTGTHGTGEKKGVMENIKEKLSGGHDDHQKTAGTYGQQGHLGTGTHGTPATGGAYGQHEHTGATGTETYSTGEKKGVMENIKEKLPGGHGDHQQTGGTYGQQAHVGTGTHDTPATGGTYGQHGHTGVTGTGTHGTGEKKGVMENIKEKLPGGHSDHQHTTETYGQHRHTGVAGTETHGTTATGGTYGQQAQTGTTGAGTHGTDGTGEKKSLMDKIKDKLPGQH

SEQ ID NO: 693 - protein, 81 aa, Hordeum vulgare
GTRPRPRRTHARVGARPGGVRPGGGHGGRGEARRRRHGQRQRRRQRQHQELLVSVSVSGDLSVLCTFRFSKLSLVLAPLPP

SEQ ID NO: 694 - protein, 272 aa, Gossypium hirsutum
LPVSPESVGAYREEDEVDSLRKSEEEEGVTEPLLGSNTELKEKAVGFIEAWKIPGVAPFAFCLFFAKLVAYTFLYWLPYYISHTAIEGKYLSNEAAGNLSTFFDIGGVLGGILAGHISDRLDARAITAATFMYCAIPALYFYRSYGHVSVVMNVALMFICGMFVNGPYALITTAVSADLGTHSSLKGSSKALATVTAIIDGTGSVGAAIGPLLTGYISAESWSAVFTMLMGAALVAGLLLTRLVVAEVAARISESRSQGGSQTGSEAPELDV

SEQ ID NO: 695 - protein, 329 aa, Oryza sativa
MAAAAARYDVEKGGRKREGEEERCGSPAAVAQYPQREGEREWVPWLVPAILVANVVVFAVAMYVNNCPSHASRGGACVRIPPPLLLPASLREPAPRPLLRHKMGALVWDKVVHEHQGWRLVTCIWLHAGVVHLLANMLSLVLIGLRLEQQFGYMRIGIIYLVSGIGGSVLSSLFIRNSISVGASGALFGLLGAMLSELFTNWTIYTNKAAALVTLLIVIAINLAIGILPHVDNFAHIGGFLTGFLLGFIFLMRPHYGWMQRYVLPSSVKYTSKKYLAYQWILLAVASVLAVIGFAVGLSMLFRGVNANERCHWCHYLSCIPTSRWTCGN

SEQ ID NO: 696 - protein, 342 aa, Sorghum bicolor
MSYSRGSSERYGSRSPYSRSSYSRYRSRSRSVDSSDAENPGNNLYVTGLSTRVTDRDLEKHFSTEGEVIDASVVHDPWTRESRGFGFVTMATVKEADRCIKYLDRSVLEGRVITVEKAKRRRGRTPTPGKYLGTKSSRGRRYSPSYSPVRRDRYSSRYSPDRRDRYSSRYRRDRYSSRYSPERDLSYSPDGRGRSYSPYDRRRSYSPHGRHGSYSPDDRRRSYSPYYRNRYRSRSPYRYRRRRSPSVSPYYSRHRYRSVSKSPSVSPTRTRERSYSHSLSPQRSYSRSHSPESERSTSYSPKKGSRREPSCSRYSGKRRRSRESYSHSRSSYSRSVSRERSA

SEQ ID NO: 697 - protein, 346 aa, Sorghum bicolor
MSYSRGSSERYGSRSPYSRSSYSRYRSRSRSVDSSDAENPGNNLYVTGLSTRVTDRDLEKHFSTEGEVIDASVVHDPWTRESRGFGFVTMATVKEADRCIKYLDRSVLEGRVITVEKIFQRAKRRRGRTPTPGKYLGTKSSRGRRYSPSYSPVRRDRYSSRYSPDRRDRYSSRYRRDRYSSRYSPERDLSYSPDGRGRSYSPYDRRRSYSPHGRHGSYSPDDRRRSYSPYYRNRYRSRSPYRYRRRRSPSVSPYYSRHRYRSVSKSPSVSPTRTRERSYSHSLSPQRSYSRSHSPESERSTSYSPKKGSRREPSCSRYSGKRRRSRESYSHSRSSYSRSVSRERSA

SEQ ID NO: 698 - protein, 281 aa, Sorghum bicolor
KHGAASVAGRRREMEDAVSVREAFALAEGSHGGRRDFYGVFDGHGCSHVAEACRDRMHELLAEELAVAAAADDVSWTAAMERSFARMDSEVMSAGGASGACGCDAHKCDHVGSTAVVAVVEERRVVVANCGDSRAVLCRGGDGAPPVPLSSDHKPDRPDELARIEAAGGRVIFWEGARVLGVLAMSRAIGDGYLKPYVSSVPEVTVTDRSDGDECLILASDGLWDVVSNEAACEVARACLRRGRAKWCAEAAALLTKLALARRSSDNVSVVVVDLRRRNHH

SEQ ID NO: 699 - protein, 525 aa, Sorghum bicolor
RRTGSDRSCPCPTTMASAARTTPGPGRSVVVLVSLATLLLVTFVSTVESYDGRHAVAHSVMARRSRLGTRHVQHHHRRTTTVPHRYVLAEKSSPTGGGSSPKNRSSSPATANNASAPAPAASQSDGGRRHRSHKHRVRNWIIGFVVGSVAGVISGLVLSVLFRLALNCVRGRYRSRSGVMIFTPKLIRRPEHLAFLEKEDGLASLAVIGRGGCGEVYKAQLPVEREGDAPRFIAIKKIKKHGGDAPATNNNLSDEESRQLDKRSRQIQSEIRTVGHIRHRNLLPLAAHVPRPDCHYLVYEYMKNGSLHHALKAGNSAVEVEDGGGGEDGGTGTCTGTSGGLSWPARLRVAVGVAAGLEYLHVSHQPQIIHRDLKPANILLDDDLEPRIADFGLAKAMPDSHTHVTASNVAGTLGYIAPEYYQTVKFTAKCDVYSFGVILAVLATGKEPSDQFFTETEEVVGLVKWLRRVMESGEHAQAIDPAIAGAGHDEQILLLLRIALFCTKDDPKERPTAKDVRCMLSQIKT

SEQ ID NO: 700 - protein, 284 aa, Solanum lycopersicum
RTGTLIAVVGVVVFLLLPVNPESVGANKDEDEVFSPRKEGEEVTEPFLRSDGEEESAVGFIEAWKIPGVAPFAFCLFFAKLVAYTFLYWLPFYISHTAIEGRYLSNEEAGNLSTLFDVGGVVGGILAGYISDRLDARAITAASFMYCAIPVLYFYRSYGHVSMTINIILMLITGVFVNGPYALITTAVSADLGTHSSLKGNSRALATVTAIIDGTGSIGAAIGPLLTGYISTNSWSGVFTMLMGSAFIAGLFLTRLVVAEVGAKIQELGSQGSSPTSRSPDFLV

SEQ ID NO: 701 - protein, 614 aa, Solanum lycopersicum
QNVMPNVKSPHLLTIRRRFLLQLRFLYHNICHFQPAKHINHSIMDSQSSPHGSIIFSTVGRTNYGFDIFSIKSPFSFLNSPVEHRLTDGTSINYNGQFVDEDQTLVFVSERSGAPRIYLRHPSSQVQMEQLPTPIDSLFLDRPFLRNKQLYYISAHQQPKQVFTSSSALYSTNIEDNSNIIRLTPYGCVDYSPAISQSGHLIAVASYGDRRWPTGEFHDLTTDIVVFPESDPEKRIVVCQHGGWPTWSGDSTIYFHRQADDGWWSIFRVDLLEDSLNLRTDPIRVTPPGVHCFTPAASHSSKSMIAIATRRQGTKYRHIEIFDVESHKFYSVTELLNPTTHHYSPFFSPKSSFLSYHRFRGESSSGDATIPSLAPIISPEKGLRMLRLNGSFPSFSPSGDFIAFNHDFNPNSGLKIIKSDGSKKWTLFRGRTAFCNSWSPAEPNVIFTSIGPVFDSVKATVQIARVSFNSLNLTNDDCREIPVEIKVLTKEETGNNAFPSCSPDGKHIVFRSGRAGHKNLYIMDSVKGELEGGGIRQLTEGPWIDTMPSWSPDGKLIAFSSNRHNPDNVTCFSIYVIHPNGTGLRRIHVAGPEGSDEVDKERLNHVCFSKDCEW

SEQ ID NO: 702 - protein, 168 aa, Solanum lycopersicum
VNLQYSPKMDGSNYYLMNRSHIPAFGSWDCNNDFPIPFTQCFESAKKVGLLRYSYSDDRDLYVAGDLYQNDILTPAMIVVPRRKRKSSISDGVGKARKERWVVCNCEYENDEEKKDITIVPPPPPPIRASKAVDEDLYKISPQLLHYKPTRKGVRRFFSSCLLPTCAS

SEQ ID NO: 703 - protein, 84 aa, Sorghum bicolor
AMLVIINLLSCLTGLLMEIRVCVQTVGLCPRHFGALLSMLTWWVNRVFKSEANAAAPELELLMEGSTDMRRAFLFPSLFCIYSC

SEQ ID NO: 704 - protein, 122 aa, Sorghum bicolor
EGCAPPPAPRSEVLKNTRVKFNLYPGTSLGGGGGGASGSGGGGTAGGHDGHSREAMLLGYVVESPSSSDSSSDSDSSQPDSPCQSDLFAEPTLRVSTSDTVSQVPETPLGSGETELVPAYNY

SEQ ID NO: 705 - protein, 427 aa, Sorghum bicolor
MAGKKRKSGSEKPAKHRLPLGADADAVAEASKRRRSGAAKQHQADEEASIPPSLSAKILREARKQQQEEMRADDSSDEQRPSAAEAAAGPSTSSSFPVPAADGEEEEDDDVDEFDGFDAQTEYDGGEVEINEEDERALAAFMSKDKAAERTLGDIILQKIMEKDAEVATEGRPRVKLDNSIIELYKEVGKFLSRYTSGKIPKAFKRIPSLECWADVVQLTEPENWSPNAVYQATRLFSSNMNTKNAERFYEAILLPRVRNDIRKNKRLHFALYQSLKKALYKPAAFNKGILLPLCRERNCTLREAVIIGSIIQKVSIPFLHASVALVKLAEMEYCGTTSYFIKLFLDKKYALPYRALDAVLAHFMRFLNDERTMPVIWHQSLLAFVESYVHGWIDCRCSFTKCLCSLFHCFSHVFYTKNFMADTRMS

SEQ ID NO: 706 - protein, 481 aa, Sorghum bicolor
MSSGKAQQRPHAVLIPQPAQGHVTPMLHLAKALHARGFRVTYVNSEYNHRRLLRSRGQDSLAGTDGFRFEAVPDGLPQSDNDDVTQDIAALCLSTTEHSAAPFRDLLARLNATPGSPPVSCVIADGVMSFAQRVAEEMGILALVFWTTSACGFMGYLHFAELIRRAYVPESDLSNGYLDTAIDWIPGMPGIRLKDIPSFIRTTDPDDVMLNFDGGEAQNARKARGVILNTYDALEQDVVDALRREFPRVYTVGPLATFANAAAGGGLDAIGGNLWKEDTSCLRWLDTQRPGSVVYVNFGSITVMTAAQLAEFAWGLASCGSPFLWVIRPDLVSGENAMLPEGFVTDTKERGILASWCPQELVLSHPSVGLFLTHCGWNSTLESICAGVPMLCWPFFAEQPTNCRYVCDKWGIGMEIDSDVRRQEVARLVREAMDGERGKAMRLKSMVWKEKARQAVDEGGSSRKNMDRMVEFLLAGNDVPS

SEQ ID NO: 707 - protein, 77 aa, Sorghum bicolor
EVYASGYQRASHRSSKILQNRRRGKRATIVTVPQIFCPKGHKCIHYVIKGSRSSEVEGLWKSPPQEFSYLQYPQEGW

SEQ ID NO: 708 - protein, 239 aa, Triticum aestivum
AKLAEQAGRYDDMVDFMKKLARMDVDMSVEERHLFSVGFKNTIGARRASWRILSSLEQKVAAGEQAGRMISVYRTKVEDELRMVCNEILSIIAIHCLPLANAGENVVFFHKMKGDYYRYLAEFSTGVEKKSAADQSLMAYQHAMVVASTELSPAHPIRLGLALNFSVFFYDIMNCHQRACQVAKQAFDEATTEINSAGMDGNNDSTLMMQLLNDNLALWKSELTEGETSKDSDIDMEEG

SEQ ID NO: 709 - protein, 342 aa, Hordeum vulgare
SFTPQRLGEGFGGGEDMAGKKSAAVTPAPSDGEESAGVPSSAAKRQSGRHKKDPAAASPGSTAKRAAGRPKKVAGPAEGSAMNPAKGDMGEEEKGATPKKKEKGATPKKGEKAATPKKTEKKGEKAATPKKTEKKGEKAATPKKAEKKGEKAATLKKAGEKAAIPKKAGEKAATPKKEEEKAATPKKTEKKGEKAATPKKEEKAAAPKKEDEEKATAPKKKEKGEKAAAKKKKDKGEIAASLDKEEMGDTLGGDPEEDGEEGGDGGHAGQHEEEEEREGGDGGHAGQHEKEEARRSGIPKGGEETQGQGGRSGAGGNRARHLQLPDGAGAGADAGQGRHHPI

SEQ ID NO: 710 - protein, 375 aa, Gossypium hirsutum
PLAPADNDKRNQIPFMTASDGIKQRSVVYQGSSSLTGPVVIEDVVYENTDDDVSHSLPFRRLVFERTEGLVQSEALLTRDGLFDKSVYGTEKKKASSSSKSKRRGALKRNNESSSKMKVYHGYLASSYHTAIISGFSLISSYLESVASSGNRVKAVVIGLGAGLLPMFLHGCMQSMQIEGVELDPVMLNLARDYFGFTEDKRMKVHIADGIQFVRDYRNLYAAGNEVLLSSNGSCKLSDAESRSTAIDIIIVDVDSSDSSSGLRCPAADFVEESFLQNVKDTLSEQGLFVINLVSRSPAIKDAVVSRMKEVFSHLFCIQLEGEVNLVLFGLCSESHIEEDCIPDAALKLDKLLKSEHPEISQSITDAAKKLKRLK

SEQ ID NO: 711 - protein, 301 aa, Zea mays
MCLLREMEDHSVHPKSKSNHGSLSGNGYEMKNPGHEVCDRDSSSESDRSHPEASAVSESSLDEHTSTQSDNDEDHGKDNQDTLKPVLSLGKEGSAFLAPKIDYNPSFAYIPYTADAYYGGVGVLTGYAPHTIVHPQQNDTTNSPVMLPAEPAEEEPIYVNAKQYHAILRRRQTRAKLEAQNKMVKGRKPYLHESRHRHAMKRARGSGGRFLNTKQQPQEQNQQYQASSGSMCSKTIGNSVISQSGPICTPSSDAAGASAASQDRGCLPSVGFRPTANFSEQGGGGSKLVVNGMQQRVSTIR

SEQ ID NO: 712 - protein, 312 aa, Zea mays
EHRKWSDAAEGARPEEGTAGRWQGAESRFAWRTHRGRRVGAMLLPSSSSSSASASKGNSFGKTVNDHLRSTLSFDNKQPPFASQNFDYGQTIACISYPYNRSRSGDVWAAYESRTSTATVFRSQIAGGGSSTRIPLPLELAENEPIYVNPKQYHGILRRRQLRAKLEAQNKLVRARKPYLHESRHLHAMKRARGSGGRFLNTKQLQQSHTALTRSTTTSGTSSSGSTHLRLGGGAAAAGDRSVLAPKTMASQDSSKKAVSSALAFTATPMLRRDDGFLQHPSHLFSFSGHFGQASAQAGVHNGSQHRVPVMR

SEQ ID NO: 713 - protein, 499 aa, Sorghum bicolor
MQLVLRINTGSLLFPTLPCRPPSPNSSTPQASACRYYNTSSLLIYAAGGTTVNVGWGGVHVDAGHGKPGGTTVDVGKGGVGVNVNPGSSGRKPGGTTVGVGGKGGVGVKVNPGYGKPGGTTVGVGKGGVGVNVNPGYGKPGGTTVGVGKGGVGVNVNPGKPGGTTVGVGKGGVGVDVNPGYGKPGGTTVGVGKGGVGVNVNPAKPGGTGTTVGVGKGGVGVGVNPGYGKPGGTTVGVGKGGVGVHVNNPRKKPVNVNAGPFQYLYAASETQLHDDPSVALFFQEKDLQQPGKKVTVQFANTATAGAKFLPRSDAEAIPFSSEKVPEILSRFSVDPDSVEAAEMAQTLRDCEAPAAKGEKKACATSLESMVDFATTSLGTSHVRAVSTVVAKEGSPKQEYTVTGVKPAAGTGHDGRLVACHAEPYAYAVFACHLTQQTRAYSVSMLGRDGTAVDAVAVCHADTSGWNPKHIAFQVLKVKPGTVPVCHFLPQDHVVWTRSG

SEQ ID NO: 714 - protein, 446 aa, Sorghum bicolor
FPSPSSCISVPSAALSHPRGDGQATAAAAEVIASDHRSTGYNRFMLGTSAEKHTTVMGHDHISRIKMHMAEGSFGDRNRCQQPGCNEVVDGRVVYCKTHSGEFSCQQFSHLHSGMESSGLSVPHVNDNQFKGSISIAVPCTEQELHVKHEGNDRGKLKDSSGYTLDQTAQFVFSGAGLLCKNENCSKQAHENSIYCKLHSGVSKGCMVRGCTRGAHGGTPLCIGHGGGKRCVIPQCPNAACGQGRSDRCVRHGGGKRCKFEGCAKGAQGNTDYCIRHGGGRRCKFEGCTKSAQGRTDFCIKHGGGSRCKFQGCGTSAKWGTDFCSVHRKSLLGGDSAIPEALPAPSEKRRRAKKPKKAAKLSETSQENVTTAAIAGNSTQHMGVLLIATPVTNHDMLTKGVTVAAPAAIAPTQIVAPLAIKSPTPSGSVAAGAEREAGASREMLGL

SEQ ID NO: 715 - protein, 406 aa, Sorghum bicolor
MECQRWKSKGVNIKYEVRGNRKGYKAGALKEGLKHDYVKDCEYIAMFDADFQPESDFLLRTIPFLVHNPEIALVQTRWKFVNSDECLLTRFQEMSLDYHFKYEQEAGSSVYSFFGFNGTAGVWRISAIDDAGGWKDRTTVEDMDLAVRAMLQGWKFVYVGDIKVKSELPSTFKAYRFQQHRWSCGPANLFKKMMVEILENKKVSLWSKIHLWYDFFFVGKVAAHTVTFIYYCFAIPVSVLLPEIQIPLWGVVYVPTAITLLKALGTPSSFHLVILWVLFENVMSLHRIKAAISGLLDAGGRVNEWVVTEKLGDTNKAKPGTNGSDAVKVIDVKLTEPLIPKLVKRRARFWERYHCSELFVGTCILMCGFYDLLLAKKGYYIFLFLQGTAFLVAGFGYVGTLPPCTA

SEQ ID NO: 716 - protein, 406 aa, Sorghum bicolor
MECQRWKSKGVNIKYEVRGNRKGYKAGALKEGLKHDYVKDCEYIAIFDADFQPESDFLLRTIPFLVHNPEIALVQTRWKFVNSDECLLTRFQEMSLDYHFKYEQEAGSSVYSFFGFNGTAGVWRISAIDDAGGWKDRTTVEDMDLAVRAMLQGWKFVYVGDIKVKSELPSTFKAYRFQQHRWSCGPANLFKKMMVEILENKKVSLWSKIHLWYDFFFVGKVAAHTVTFIYYCFAIPVSVLLPEIQIPLWGVVYVPTAITLLKALGTPSSFHLVILWVLFENVMSLHRIKAAISGLLDAGGRVNEWVVTEKLGDTNKAKPGTNGSDAVKVIDVKLTEPLIPKLVKRRARFWERYHCSELFVGTCILMCGFYDLLLAKKGYYIFLFLQGTAFLVAGFGYVGTLPPCTA

SEQ ID NO: 717 - protein, 1084 aa, Sorghum bicolor
LADRILDAHVFSPGGSAGTLAGSVRYHRDAGRRMVFLHLAPLQTAVGGCGDGDLPEMLFMFSVCHVIIFLQDGFRFNTQTLKKFRLLQSSKHALAPFVKSLVAAAMPAKTVASDTPTRATHRASSISPPARRGGHAGRQSSAISLMSGTSSNPSVLPGQCIPVLLFVFEDDVLDVSSAAASSDDMGDSSSSNQCSTSDGLSKQSLASKSSGSVVMLARAANKSEGNSAKKLHSSLEGQIRVLLKKCRVLAGMEPGHIGPRGVSNMSHHLPLFSLDTSRVVALLERYINKKQEPLDIIAGLFEDSLCSKLSLDILSLENNYHPTNHDDFQLIKDFIFRQSDALRGRGGYSSNASAGSVSGVGMVAAAAAAAAASAASGKPVNAPDLPTFDKWLSISTSILTALLSGRNVLSGQSESKTHTSPIEKNDQLPAAGSNAIEIALSCLESNNGLNMKFSSSWCQRVLPAAKEIYLKGLPAFYPTSMHEVQLQKALRSFGSMVKGPAVRVFLKKLEDECRAIWESGRQQCDAVSLTGRPCKHRRHGDFSSSDAMKQHSSGYVFLHACACGRSRRLRDDPFDFETANVSFNCFQNCDDLLPTLALPRGSDAGSFSVSSWRLVRLGGARYYKPTKGLLQSGFSSKERYLLRWIISVGKGQVRNGIRSNTVTSSTRSGMNPQTPPIVTGEVKSAVTQVTAQIKSAKLESSGKQPDMEPMSNSGINFGKGLPNFTMKKPFAEVVAGTTSKDSEFPALQQMRPPKPGGRKDERQMNIGDHPNGRGHAAVSQGPVAETESAKASRNKSSENSDGKPFLQIGSNIVPVIVGNETRETSQQVQQFVVYVGFEHECPYGHRFLLSEKHMKEIDSSCLLYQRPHVNKEAEGKHAQKLLQNASGLIASAVDINSAQKNSKPLQSSGRNSQQQSLQLRVDAETSQPSPWLSDPQNGKRGEHYFPSITIDDGGEAFSLMNRNLPIYMHCPHCKISERKEHQDVKFAGAVSQLQRIFIGSCLPSNVSDHDREGSFSIGCRVILPPESFLTMRLPFVYGVETKEGSTFPLKNFEQQPELTAWLVGGTALQIVSVGDVTEKETVMK

SEQ ID NO: 718 - protein, 285 aa, Sorghum bicolor
ASEEPRVKKLLVQHIETVHHSEAVEDVLQSLLLADSNAKEIKSKTKEWNDKIKQDNKPEQLRSAARQRHEDMGRNARFAQIWKSRKGEKDDADDSLREICHLYDAVQVDPDDEKHPAEPRQVLISDNLSGHLECRVALFHVPYNIPCRITSFEEGAVLCNFLPLLRKYLPSTAEEIEADIISLAQSEDSEVYDIYTVKEVDDTNMEATSAASYPRLQVDDGEDECYEDCPYDTDDSNAEDNPLFDYPDEFSEDEDDDRNDEDPFGDEEGSDTDYEKEEVEVEEDE

SEQ ID NO: 719 - protein, 93 aa, Sorghum bicolor
EDELELSRQKQPDTMANRRAQKVARFKRQKAAETKLQEIRERKERRGRSLRAAALSAPIEAGEEDDLEDDGEEEREYAAGLVSYHLIGSLQGV

SEQ ID NO: 720 - protein, 398 aa, Sorghum bicolor
IVMEVCNLGNNAMEAQQQREQSQAGGCTDDDPAAVLTCLTFLEQKIAHLRAIIGAAPRPPRQMVSAELSCIAVQLVSISKSLAATGGGGAAAADQDDGAARSPAPNDGDSDSSDHDLLHAEDDYGDGDGDSDGRMPPAGSYEVIELGKEEILAPHVHSCKVCGKGFKRDANLRMHMRGHGEEYKTAAALAKPASAPSSSLARCFYSCPFVGCKRNREHRSFQPLKTAVCVKNHYRRSHCDKSYTCRRCNVKRFSVLADLRTHEKHCGRDRWVCSCGTSFSRKDKLFGHVAAFDGHAPALPPEDDDAVTNAVGLGTGSGRLTTMDTEAVSRMASMEFFPDAVLDGLVCSDIKGFALMDGGQGQYLEDDDGRGSLSPLPMGLDSCDFDGFDLFGAPAIDF

SEQ ID NO: 721 - protein, 313 aa, Helianthus annuus
VHTGKPGKRTDVGVGKGGVGVHTGKPGKRTDVGVGKGGVGVHTGKPGKGTHVGVGKGGVNVHTRHKGKPVYVGVRKGPNPFVYKYAASENQLKDNPNVALFFKENDLHQGKEMNLHFTKNDEKATFLPRKIADSIPFSSNKLPQIYEEFSVKPDSMEAEIMKQTLSECESTGIEGEEKYCATSLESMVDFSTTKLGKNVKAISTEVSAKESTPLQKYKIEVAKKLAANKAVVCHKQNYAYAVFYCHKTASTQAYAVSMVGADGTKVNAVAVCHTDTAKWNPKHLAFQVLKVKPGTVPICHFLPEDHVVWVPYK

SEQ ID NO: 722 - protein, 234 aa, Solanum lycopersicum
MASTISYTSLCSLLKLNQTNQKTPFSPSLSSPSSPSSLVKIKNQLCFSSNFCSHLNKASIFMVKASETEATQSEKEEEDKYEEYEVEIIQPYGLKFTKGRDGGTYIDAIAPGGFADKTGKFAVGDKVIATSAVFGEEIWPAAEYGRTMYTIRQRIGPLLMKMQKRYGKVEEVGELTEKEIIRAERNAGFISDRVREIQVTNARRKKEQKEQRERELRGGLKLSKNGKYEEALEK

SEQ ID NO: 723 - protein, 346 aa, Solanum lycopersicum
GNIPHCCKKDPTVVDMLPGTPYNQQIANCCKGGVINSWGQDPATAVSSFQVSVGAAGTTNKTVRVPKNFTLKAPGPGYTCGPAKIVKSTKFVSADGRRVTQAMMTWNVTCTYSQFLAQKTPTCCVSLSSFYNDTIVPCPTCTCGCQSNGTQRGSCVDPETPHLASVVSDHGKNNYVPLVQCTKHMCPIRIHWHVKLNYKEYWRVKITITNFNYRMNYTQWNLVVQHPNFDNLTTLFSFNYKSLTPYGSINDTAMLWGVKFYNDLLMQAGPSGNVQSELLFRKDASTFTFEKGWAFPHRIYFNGDNCVMPPPDAYPFLPNAGSRWEASLITLVVTLMSSMAVVLTYI

SEQ ID NO: 724 - protein, 262 aa, Solanum lycopersicum
MNTTIFSKGNERVVQNQSVGTLCSAPWWSNGFMSQSVAYAEPFGQLKSASVEQQPKGNATEFTISSGDCKSSANGQKLPNIQAASSVRAANMDYRGHFELGFGQSLIYAKHPYGEQCIGLFSAYAPQLSGRIMLPLNLASDEGPIFVNAKQYHGILRRRKTRAKEMEKKALKPRKPYLHLSRHLHALRRPRGCGGRFLNTRNMNGTMKAGKTNNMFKTGDVQNFYPTGSQNSEVLQSDSSNLSSPKETSGSRFFDSSGIANM

SEQ ID NO: 725 - protein, 314 aa, Solanum lycopersicum
MASEERRETLLNKREEKHYYENCPGCKMDLHKAGQTGLPVKELFTIWVVVLGTALPISSLFPFLYFMVRDFHIAKREEDIGSYAGYIGSAFMFGRTLTSAFWGVVADQYGRKPVIIFGTSIVIIFNTFFGLSANFWMAVVTRFLLGSLNGLLGPIKAYAAEIFREEYQALGMSTISSAWGIGLIIGPALGGFLAQPAEKYPDLFSKGSLFGRFPYFLPCLCISVFALVVAVGSFWIPETLHNHDSERPRPDSYKALEAASDTKDGNESAPKENLFKNWPLMSSIISYCVFALHDMAYSEIFSLWAVSPRKFGGL

SEQ ID NO: 726 - protein, 296 aa, Solanum lycopersicum
MASSIVQNGHVNGEAMDLCKKSINVNDPLNWEMAAESLRGSHLDEVKKMVDEFRKPIVKLGGETLTVAQVASIANVDNKSNGVKVELSESARAGVKASSDWVMDSMGKGTDSYGVTTGFGATSHRRTKNGGALQKELIRFLNAGVFGNGTESSHTLPHSATRAAMLVRINTLLQGYSGIRFEILEAITKLINSNITPCLPLRGTITASGDLVPLSYIAGLLTGRPNSKAVGPNGEKLNAEEAFRVAGVTSGFFELQPKEGLALVNGTAVGSGMASMVLFESNILAVMSEVLSAIFR

SEQ ID NO: 727 - protein, 101 aa, Solanum lycopersicum
MDQNTRDIIMREFRSGSSRVLITTDLLARGIDVQQVSLVINYDLPTQPENYLHRIGRSGRFGRKGVAINFVTTDDERMLFDIQKFYNVVIEELPSNVADLL

SEQ ID NO: 728 - protein, 432 aa, Sorghum bicolor
MEIDLHDVRAARVLGRGAMGTVFLAVDGAASSGEAYALKVFDKRSPAASRPAAGADAARRARWEVSVLSRLAHPHLPSLLGCAETPDLLAWALPYCPGGDLNELRHAQPDRVFSPAAIRFYVAEVVSALAELHATGIAYRDLKPENVLLRADGHVMLTDFDLSRQLPPRSPAASTSTSTSSSCSATSSPPPPQAQSHRRLKNIFKRSESAVTASTSGQEEEPRNLAWYLDRSIEGGVDQIKKAKSARVSPMERAKKLSSFLSAAAGERSFSFVGTEEYVAPEVVRGDGHEFAVDWWALGVLVYEMCHGRTPFRGRNRKETFRNVLLREPEFTADARRRWPELTDLIARLLEKDPSRRLGFAGGADEVRAHPFFAGVAWDLLGEVSRPPYIPAPADDIVSCDGFSVVEYFDKLHQPPLSPAEHSPEDDLLPEF

SEQ ID NO: 729 - protein, 632 aa, Glycine max
MKTHYFPLFSFFFFFFLISINAKLDLYPSDYKALLTLQKDLRVNGQLAAATEACETEGVLCERRRLSGKETYALRITRLVFKSNNLNGVLSPSIGRLTELKELSLSDNQLVDRVPPQIVDCRKLEILDLANNIFSGEVPSELSSLTRLRVLDLSTNRLSGNLNFLKYFPNLETLSVADNLFTGRVPPSVRSFRNLRHFNFSGNRFLDPSLQSSSPDTILSRRFLSEDGDGDVPAPAPAPNNSQKKKSNASTHAAAAAPGPAPNHTNKHKHSKRKLLGWILGFVAGALGGTLSGFVFSLMFKLALALIKGRGRKAGPDIYSPLIKKAEDLAFLEKEEGIASLEIIGRGGCGEVYKAELPGSNGKMIAIKKIVQPPKDGAELAEEDSKVLNKKMRQIRSEINTVGQIRHRNLLPLLAHVSRPECHYLVYEFMKNGSLQDTLSKVERGESELDWLSRHKISLGVAAGLEYLHMNHNPRIIHRDLKPANILLDDDMEARIADFGLAKAMPDYKTHITTSNVAGTVGYIAPEYHQILKFTDKCDIYSYGVILGVLVIGKLPSDDFFQHTEEMSLVKWMRKTLSSENPKEAINSKLLGNGYEEQMLLVLKIACFCTMDDPKERPNSKDVRCMLSQIKH

SEQ ID NO: 730 - protein, 172 aa, Populus trichocarpa
MADNPTSPAAGSHESGGEQSPRSGVREQDRYLPIANISRIMKKALPANGKIAKDAKDTVQECVSEFISFVTSEASDKCQKEKRKTINGDDLLWAMATLGFEEYIDPLKVYLARYREGDAKGSARGGDGSSKREAVGGLPAQNAQFALQGSMNYISPQGQGQHMILPSMQGNE

SEQ ID NO: 731 - protein, 297 aa, Zea mays
MDSYNYNYASFFHDEAPSFYPHVAVPPSPELPIGLIASPGEPEPPFAPPMPASFQDYTGAVGVGVGVRAPFGGASVHGQAIDALGGGDGQREQSMAMAEDGEEPAPRRRQPAGGPAAAAVESSRGFRHMMRERQRREKLSQSYADLHALVAARSRGDKNSIVQAAAVYIHELRGARDQLQRRNEELKARILGHDAGQQCVKVQFEVDEPASAIDSMIGALRRLKGMDVRARGIRSSLSGRRLWTEMNVETTMAADEVERGVEEALLQEVERKQQQQLGAGSAAPGFPGPSSHVQNVF

SEQ ID NO: 732 - protein, 363 aa, Hordeum vulgare
MDGKGYTTPPTAPAPQAEAGAPHFYPPTEHGTAPQPGSQVSYPPMPKAMDGQDAAAPQPGAPPHPSSPLTQQAMELEGKYAAPQPGTGATPSPPTQQAVDGKDAAPTPPAESARWGTRQMGPPAAPGAHPENQQAAQWTATRGDQELPPYVIMGAPEPAPAASARRTDKEARDSPMEHILDFFNTWSRKAEELSSNIWLNLKTAPSMSDAAMGKLSLGAKAITGGGFEKLYKQTFGSGPDEHVKKTFACYLSTATGPVAGTLYLTNTNVAFCSDRPLSFAAPSGQTAWSYYKVMIPLAKLAAVEPVTAKESPPERYIHIVTVDAHDFWFMGFVSYDKAVRHLGGAVSSSQHHGAAPAPAPAYE

SEQ ID NO: 733 - protein, 619 aa, Hordeum vulgare
MATNPGLFSEWPWKKLGSFKYVVLAPWVAHVIQQVATKGWREADLGYLVILPSMMLRVLHNQAWITVSRLQNARGKRQIVDRGIEFEQIDRERNWDDQIILSAILFFLGALHLPGGQNLPLWRTDGAVLVALLHAGPVELIYYWFHRALHHHFLYTRYHSHHHASIVTEPITSVIHPFAELVAYELLFSIPMIACALTGTASIMTFELYMLYIDFMNNMGHCNFELVPAWLFKWFPPLKYFMYTPSFHSLHHTQFRTNYSLFMPLYDYIYNTMDKSSDKLHEKSLDNKQEAIDVVHLTHLTSLQSIYHMRPGFAEFASKPYASKWYMRIMWPLSWLSMVLTWVYGSWFTVERNVMEKLRIQSWAIPRYNFHYGLNWEKETINNLIGKAICEADKKGAKVVSLGLLNQAQSLNGSGELYLQKYPKLGLKLVDGTSLAAAVVVNSIPQGTDQVVLSGNISKVACAVAAALCKKNIKVTITNKQDYHFLQPKMPEDAADNLILSKTGIAKVWIIGEGVDAAEQLRAPKGTRFIPYSQFPPRMVRKDCCTYSTTPAMSVPKTLQNVHSCENWLPRRVMSAWRIAGMVHALEGWDEHECGDKVLDMDKVWSAALLHGFRPVTED

SEQ ID NO: 734 - protein, 575 aa, Hordeum vulgare
MEHQAHVAGEKKGLMEKIKEKLPGGHGDHKQAADTHGQQGHAGTGTHGAPATGGAYEQQGRTGVTGTGLNGADAGEKKGLMEKIKDKLPGGHGDQQTTAGTYGQQGHTGTAAHGTPAGGGTYDQEGHTGMSGMGAHDTHATGGAYGQHAHTGGTGTGTHGTGEKKGVMENIKDKLPGGHGDHQKTSDTYGHQEDTEMTGMGRHSTPATGGSYGQHVHTGQTDMGTHGTGEKKGVMENIKDKLPGGHDDHQKTAGTYGQQGHVGTGTHGTPATGGAYGQHEHTGATGTGTYGTGEKKGIMENIKEKLPGGHGDHQKTGDTYGHQEDTKMTGMGRHSAPATGGSYGQHAHTGETGTGTHGTGEKKGVMENIKEKLSGGHDDHQKTAGTYGQQGHLGTGTHGTPATGGAYGQHEHTGATGTETYSTGEKKGVMENIKEKLPGGHGDHQQTGGTYGQQAHVGTGTHDTPATGGTYGQHGHTGVTGTGTHGTGEKKGVMENIKEKLPGGHSDHQHTTETYGQHRHTGVAGTETHGTTATGGTYGQQAQTGTTGAGTHGTDGTGEKKSLMDKIKDKLPGQH

SEQ ID NO: 735 - protein, 193 aa, Hordeum vulgare
MAARALTAAAGRRVAGRTGTTPLLASCRNGASMSHSSATAGARREEEPYKDVHGPAAAAAMTGAQVEAALNRKNVEVLQGEEEEEEHVATVLPDETVSIPAGDGEEDASWVPDQDTGVFGPAHVDATHGDGGAAHPAPPHLFGGATATAYSTHGSVLDQAVFLREEDMEDVERPAAVDMANANADVNGSIKNF

SEQ ID NO: 736 - protein, 328 aa, Vitis vinifera
MANEDLERGGGMKNRGNNGHPPGYYSSTYYAEASETHWTSWLIPMFVVANVAVFVVVMYVNDCPKKNTGIEGACVAKFLRRLSFQPLRENPLFGPSSSTLEKLGGLEWNKVVYGDQGWRLVTCIWLHAGVIHLLANMLSLVFIGIRLEQQFGFVRIGIIYLVSGFGGSILSSLFIQHNISVGASGALFGLLGAMLSELITNWSIYTNKAAALFTLVVIIAINLAVGILPHVDNFAHIGGFLTGFLLGFMLLLRPQFGWVKRQHRPADARVKSKHKVYQYVFWLVAMALLIVGFTVGLVMLFRGENGNDHCSWCHYLSCVPTSKWKCDN

SEQ ID NO: 737 - protein, 332 aa, Oryza sativa
MAAAAARYDVEKGGRKREGEEERCGSPAAVAQYPQREGEREWLPWLVPAILVANVVVFAVAMYVNNCPSHASRGGACVAGFLRRFSFQPLSENPLLGPSSATLQKMGALVWDKVVHEHQGWRLVTCIWLHAGVVHLLANMLSLVLIGLRLEQQFGYMRIGIIYLVSGIGGSVLSSLFIRNSISVGASGALFGLLGAMLSELFTNWTIYTNKAAALVTLLIVIAINLAIGILPHVDNFAHIGGFLTGFLLGFIFLMRPHYGWMQRYVLPSSVKYTSKKYLAYQWILLAVASVLAVIGFAVGLSMLFRGVNANERCHWCHYLSCIPTSRWTCGN

SEQ ID NO: 738 - protein, 699 aa, Sorghum bicolor
MDLVGSLLMNTTRLLDPSGLHFLGWLVTAGSIGLAALIYALLRLQREAALYWTKAAREKRAAWRRSRCPSSCHSWSEDRFHGGQPSTCCVCLSSLSGSAQGADDVVHRCSVCGVAAHSSCSPHAEKDCKCVAQAGTSPLLHHWSERWVELDDNPEISSFCYYCDEPCGVPFLGVSPIWRCLWCQRQIHVDCHAKLLKETTNTCDLGLLRRLIVPPQSVKEVGQGSGISGMLNSIKDGFANSTAGNRRRPRNKKRGNNHPGGKANSIPAKGSVLDSVLEGFARLKGLDGKYALAKPLSQNSLKQTYRSGIPNERVRKYELVDLPQDSRPLLVFINGKSGGRNGPSLRRRLNMLLNPIQIFELSASQGPDVGLQLFHNVKHFRILVCGGDGTVAWVLDAIEKQNYESPPPVAILPLGTGNDLSRVMRWGGGLSSVEREGGIYALLNDVDHAAVTVLDRWNVAIKEKNGTEGQCTKQVKFMTNYLGIGCDAKVAYDFHTSREEKPDKFCSQFVNKLIYAREGAKDMMDRSCSDLPWHVSLEVDGENIEIPEDAEGVIVMNIPSYMGGVDLWQNDNDHDDDFSLQSIHDKILEVVCISGTWHLGKLQVGLSRAHRLAQGKVIRLHLHSSFPVQVDGEPWIQPPGCLEISHRGQMFMLRRTSEEPTGHAAAIMSEVLVNAECNGVIDASQKRLLLHEIALRLSS

SEQ ID NO: 739 - protein, 239 aa, Solanum lycopersicum
MFDTGEFSPSSSTAAVSAECFSSSSCFSSLSSSKKKKIHSSNNARRFSDEQIKSLETMFETETKLEPRKKLQLARELGLQPRQVAIWFQNKRARWKSKQLERDYSILKSNYDNLASQYEALKKEKQSLLIQLQKLKEIESDNRCSVIKKNEMEGMPSLSFDLSSQHGTNGVMSDDDIDSSIRADYLGLDDDAEYHLLKIVETGDSSLTSPENWGCLDDDGILNHQPNSSSYDQWWDFWS

SEQ ID NO: 740 - protein, 289 aa, Solanum lycopersicum
MTRRKCRHAPYTDDSRRRFAPPEAQPQPHLQLQLRIHPSDLIDDREVAQQREIEKLLQENRSLAGAHVSLNQELSAIQHELRLLSSTAATVKTERDAEVREVYDEARKKESDVCILDELRVDLARVRSDIQNLVDDRKELTAKLQNMEEDLVKVGSELQQFPVIKAEMESMRKEVQRGRAAIDYEKKMHTSNLEYSQAMEKHKITLASEIEKLHAELANAEKRARAAAAAAAPSNLNHQISAATPNFTYSANYGNPETGYGENLYPAPYAVHQVQGSADANTQYVGGHH

SEQ ID NO: 741 - protein, 657 aa, Solanum lycopersicum
MDSQSSPHGSIIFSTVGRTNYGFDIFSIKSPFSFLNSPVEHRLTDGTSINYNGQFVDEDQTLVFVSERSGAPRIYLRHPSSQVQMEQLPTPIDSLFLDRPFLRNKQLYYISAHQQPKKVFTSSSALYSTNIEDNSNIIRLTPYGCVDYSPAISQSGHLIAVASYGDRRWPTGEFHDLTTDIVVFPESDPEKRIVVCQHGGWPTWSGDSTIYFHRQADDGWWSIFRVDLLEDSLNLRTDPIRVTPPGVHCFTPAASHSSKSMIAIATRRQGTKYRHIEIFDVESHKFYSVTELLNPTTHHYSPFFSPKSSFLSYHRFRGESSSGDATIPSLAPIISPEKGLRMLRLNGSFPSFSPSGDFIAFNHDFNANSGLKIIKSDGSKKWTLFRGRTAFCNSWSPAEPNVIFTSIGPVFDSVKATVQIARVSFNSLNLTNDDCREIPVEIEVLTKEETGNNAFPSCSPDGKHIVFRSGRSGHKNLYIMDSVKGELEGGGIRQLTEGPWIDTMPSWSPDGKLIAFSSNRHNPDNVTCFSIYVIHPNGTGLRRIHVAGPEGSDEVDKERLNHVCFSKDCEWLLFTGNLGGVTAEPVSLPNQYQPYGDLYLVKLDGSGLRRLTCNAYENGTPAWHPSGTPMTALDIERNVIVGDKLRGEFDDVLWMNC

SEQ ID NO: 742 - protein, 780 aa, Solanum lycopersicum
MGKKQQKKVQNQEELLKTLGDFTSKENWDSFFTIRGSDDAFEWYAEWSQLKEPLLSNLTIPSSNDAVSAKELQILVPGCGNSKLSEYLYDEGFCNITNVDFSKVVISDMLRRNIRARPVMKWRVMDMTNMQFAKESFGAILDKGGLDALMEPELGSKLGTQYLSEVKRLLKVGGRFICLTLAESHVLGLLFPKFRYGWKMGIHPIALKPSDRSSLQTFMVVAEKENSPALCQILSTVNQSSLGGPNNQVHGLFQALEDENKIRADYSSGSDITYALEDLKIGVEGNLAELHPSRRVQLSLGEPGVSLFCYRAVLLDAQRNFGPFAYQCAVFLVPKTRAHEWLFSSEEGQWAVVESSKAARLIMILLDSSHSDASMDDIQKDLSPLIMQLAPGDFDDEAQIPFMAASDGIKQRKIVQEITSPLTGPIIVDDVIYEKVDENISRLFASEDVIFRRLTFQRTESLVQSEAVLSKEGSPKSLADINQKIGQSSSKSKKKGNQKKSGSNVSSSDGLSNDLKVDHSYLASSYHTGIISGFTLISSHLDGLASTGGMVRSVVIGLGAGLLPMFLRKHLSFAEIEVLELDPVVVDLARDYFDFRDDERLKVHVTDGLKYVKDAAHAVTNGYENDVSEAKVPSSNGNSTLSNAPLKSTEKIDMLIVDVDSSDSSSGLSCPAADFIEESFLVAAKDSLSDQGLFVINLVSRSQAIKDSIYSKLKSVFPHLFHLQLDEDVNEVIFALKTETCITEDKFHEASQRLTRLLNLENSSWGQNITEATSKIKRLR

SEQ ID NO: 743 - protein, 722 aa, Triticum aestivum
MATTPALHDALLDFTSRENWDKFFALRGDGDSFEWYAEWPQIKAPLLSMLLGEEGTEILVPGCGSSSLSEQLYDLGFRRITNVDFSRVIVADMLRRHARVRPQMRWRVMDMTNMQFPDGSFDFILDKGGLDALMEPEVGTKLGMKYLDEAERVLKSGGKFACFTLAESHVLDLLLSEFRFGWDMTIQAIASEPSSKSAFQTFMVVMVKGKMGVVRTIKSLVDQSAEYCNMQQANAVIHALQNENKIRESHNSGVDILFSLRDLQLGTIGDLKVIVPGRRRQLILGEQGSSLYCYKAVLMDAKNQNETFVYHCGVFIVPKARAQEWLFASEEGQWLVVESAKAARLIMVFLDSRHASADIDVVKKDLSPLVMDLEPEYPEETDPMPFMMASDGVKQRDILQEVTSEITGPMVVEDVLYENVDGDQSCMSEKMFRRLIFKRSSGLVQSEALLIRESPSDETDSKTENSSASSKKKSQKKGLTGSKDSLRVDHSYLGSSYHSSIICGLSLVASALSAAASSGERVSTTIVGLGAGSLPMFLRGCLPHLNIEVVELDPMMEEVAAKYFGFSMDEQLKVHLGDGIKFIEENAHSEPNGKDSDAVRILIVDVDSSDLSSGLSCPPANFVEDAFLMSAKRFLSAGGLLIINLVARSSAVKEMVISRLKAVFENLYSLQLEEDVNEVLFASPSKRYLEIDHLDEAATKLKAMLKFPVDVESDMKNLQRLQ

SEQ ID NO: 744 - protein, 287 aa, Triticum aestivum
MGAVGSSARRGGGTALGDLPENCVAEVMLRLNPTEICGMARLSRTFRGAASGDAVWEAKLPRNYARLLAAAGGDEEAAALEAEAIPKKELYARLCRRNSLDGGTKEFWLDKAGGGTCMTIYSRALSITGIDDRRYWNFIPNDESRFRSVAYLSQIWWFEVRGEVEFCFPEGTYSLFFRIHLGRPFKRLGRRVYSAEHIHGWDVKPVRFQLSTSDGQQAQSKCYLTDPGVWIYHHVGDFVVKDSNEPLNIQFAMVQIDCTHTKGGLCMDSVVIKPKCLARKKGPGSYE

SEQ ID NO: 745 - protein, 157 aa, Sorghum bicolor
MAVSSISCSLRPPAPVREASARLTPPQPSPPKTTATPWADGLRRACVAASATAACVVIGTAGGGDVVAASMPRDTPVLAVDARPAAAAPRWSDRRECPPWRANSLENIVPENLPRPSARRRFNTVKRAPRKAPALGRQAVAPPFLALRSGVDDCFTL

SEQ ID NO: 746 - protein, 425 aa, Sorghum bicolor
MGCGPSIPEKYSIRGKSGKRRSIIQEVAVFVPTIRIPLASDIAHPLRGIVSKDLVDRLSTLRAHVVALAEEIYSADVSAVQELQHALEEYLPVVLGLTMKESRLESSVQFTWKTLDDDQECCLASAWYEVLSVVHMMAMLALFEANLLLIPKNSQVGGERKVSEDAKKDVVDSLLRASGCLDYLVHRILVQIPAQVKKSFPCYLQEGMLEAISIQALAQCVEIQLGLASECEKATLSVKRRLACEQVSYFSQAHYCLSGCDTSDSYGKKLLLFLKWKCMEAKAVAYYYHGLVLDKGGEPANHISAVCCLSAADDLLSDSKRACLSFCLANPVTRVPPPWGVMKNMHKKIPDVAYKKFQVYGHLFEQNKNSTLQSVPDLPEFALSLRPEGYELPTTDSIWENVNGQPQIQSLKEHLDDGEDEVDTK

SEQ ID NO: 747 - protein, 646 aa, Sorghum bicolor
MLIRADGGHATRRSKKNKITCNDDRDTTEPLISGDIHQDSEQGIWSELSEEVALNLPGSVVSVAVLCGSSVLFACSGIAIGCQGCVTRILTSASLVRALNDKTKHPANLKVEVRYGGNVVTGFLGKYDLDYGIAIVNVTACLDVQAIRLTHVVEMEFRPSTKVVALGRDLSGKLMTTGGILTRDSRESEDSEELMLSTCKICEGWEGGPLFNVEGNLVGMNLFFVKERTVFLPTSIIFERLEHFRVFFRRGEFLERLRNLKACSTGETLVPENSGADLTRCSKEKRTDDLTSLDIKTDLTRSSKKKRTCSGGGKTTKSLISGNSDVLSDDPFEDLDISGYPKPPIEMSDGMVLVNTFEDTFGDKYGGGVWSELSETVCSNISRNVVALASCYGKRRIFACTGFFVEWNGCTTILTSASLLSDFVDDEKILEDLRIKVLLPTKHIREGTLLHYNIHYNVALVSVKDFCSPHPMDIEHQRHSRPRQSVSVGRCIESGTLMAARGIHLNRFGRLDCKLLQYSTCKITKAGIGGPVVDLDGKFIGMNFYDMQRTRPPYLSWDVILDVLAHFKTKRSVPEVGHASYYQFAVLFNWTIDGDKSVRPNSWPVPKAFWCPAEYVDMVGQSCVQKRGKRSRPRIRVINGREYRYA

SEQ ID NO: 748 - protein, 222 aa, Sorghum bicolor
MARGKVQLRRIENPVHRQVTFCKRRAGLLKKARELSVLCDAHIGIIIFSAHGKLYDLATTGTMEELIDRYKTASGEAADGSGDNRMDPKQETMVLQQEINLLQKGLRYIYGNRANEHMNVDELNALERYLEIWMYNIRSAKMQIMIQEIQALKSKEGMLKAANEILREKIVEQSSLLDVGMVVADQQNGHFSTVPLIEEITNPLTILSGYSNCRGSEMGYSF

SEQ ID NO: 749 - protein, 73 aa, Sorghum bicolor
MSSTATAADCGGAKTTWPEVVGKSVEEAKKVILKDKPDADIVVLPVGTIVTADFVPSRVRIFVDTVAQTPHIG

SEQ ID NO: 750 - protein, 308 aa, Arabidopsis thaliana
MQVFQRKEDSSLGNSMPTTNSNIQGSESFSLTKDMIMSTTQLPAMKHSGLQLQNQDSTSSQSTEEESGGGEVASFGEYKRYGCSIVNNNLSGYIENLGKPIENYTKSITTSSMVSQDSVFPAPTSGQISWSLQCAETSHFNGFLAPEYASTPTALPHLEMMGLVSSRVPLPHHIQENEPIFVNAKQYHAILRRRKHRAKLEAQNKLIKCRKPYLHESRHLHALKRARGSGGRFLNTKKLQESSNSLCSSQMANGQNFSMSPHGGGSGIGSSSISPSSNSNCINMFQNPQFRFSGYPSTHHASALMSGT

SEQ ID NO: 751 - protein, 399 aa, Arabidopsis thaliana
MAGICCGVVGETEPAAPVDSTSRASLRRRLDLLPSIKIVADSAVAPPLENCRKRQKRETVVLSTLPGNLDLDSNVRSDNKKARSAVTNSNSVTEAESFFSDVPKIGTTSVCGRRRDMEDAVSIHPSFLQRNSESHHFYGVFDGHGCSHVAEKCRERLHDIVKKEVEVMASDEWTETMVKSFQKMDKEVSQRECNLVVNGATRSMKNSCRCELQSPQCDAVGSTAVVSVVTPEKIIVSNCGDSRAVLCRNGVAIPLSVDHKPDRPDELIRIQQAGGRVIYWDGARVLGVLAMSRAIGDNYLKPYVIPDPEVTVTDRTDEDECLILASDGLWDVVPNETACGVARMCLRGAGAGDDSDAAHNACSDAALLLTKLALARQSSDNVSVVVVDLRKRRNNQASS

SEQ ID NO: 752 - protein, 646 aa, Arabidopsis thaliana
MSSNSWADVSESERAPSGGGWGYSRPSRTNYVPPHLRSRTPSSEFVAPSPGNNDRGGYGGANSGYGGRGQGYGGRGSGYGGRGGPVGGWNARSGGWDRRDTETNPFGNDGNADPAVNEQENTVINFEAYEDIPIETSGDNVPPPVNTFAEIDLGEALNLNIQRCKYVKPTPVQRNAIPILAAGRDLMACAQTGSGKTAAFCFPIISGIMKDQHIERPHGVRGVYPLAVILSPTRELACQIHDEARKFSYQTGVKVVVAYGGTPVNQQIRELERGVDILVATPGRLNDLLERGRVSLQMVRFLALDEADRMLDMGFEPQIRKIVQQMDMPPPGVRQTMLFSATFPREIQRLASDFLSNYIFLAVGRVGSSTDLIVQRVEFVHDSDKRSHLMDLLHAQRENGNQGKQALTLVFVETKKGADSLENWLCINGFPATTIHGDRSQQEREVALRSFKTGRTPILVATDVAARGLDIPHVAHVVNFDLPNDIDDYVHRIGRTGRAGNSGLATAFFNDNNTTMAKPLAELMQEANQEVPDWLTRYASRASFGGGKNRRSGGRFGGRDFRRESFSRGGGGADYYGGGGGYGGVPGGGYGAMPGGYGPVPGGGYGNVPGGGYAPYGRGGGAYYGPGGYGTVPNQGYGPGVASAWD

SEQ ID NO: 753 - protein, 469 aa, Arabidopsis thaliana
MVNEEMESSLKVIDVARVTPSNSDSSESLTLPLTFFDLLWYKLHAVERVIFYKLTDATRPFFDSVIVPNLKTSLSSSLSHYLPLAGKLVWEPLDPKPKIVYTPNDAVSFTVAESNADFSRLTGKEPFPTTELYPLVPELHVSDDSASAVSFQVTLFPNQGFCISVNAHHAVLDGKTTTNFLKSWARTCKNQDSFLAQDLIPVYDRTVIKDPMDLDTKILNAWHRVAKVFTGGKEPENPKSLKLLWSPEIGPDVFRYTLNLTREDIQKLRERLKKESSSSSVSSSPKELRLSTFVIVYSYALTCLIKARGGDPSRPVGYGFAVDCRSLMVPPVPSTYFGNCVSACFKMSLTAETFMSEEGFLAAARMVSDSVEALDENVALKIPEILEGFTTLSPGTQVLSVAGSTRFGVYGLDFGWGRPEKVVVVSIDQGEAISFAESRDGSGGVELGFSLKKHEMDVLVDLLHKGLEN

SEQ ID NO: 754 - protein, 154 aa, Hordeum vulgare
MEVVTGSNGGRLNPWAEPFVPGSWCRPAPVEAAASAEVEDFSPEWWRLVASSPSFRDSWLRDYGDMGLLDADECPDDGDAFFPPPALPRNEGEGRKEEAAVKKSGGEVAPWGIEKWWRAHVASPPEVPKYAEKAPAKVLGGGGRFSPRTIQQPR

SEQ ID NO: 755 - protein, 178 aa, Hordeum vulgare
MVTMKRCMVPTILLMLALQAALLVAGDEVGAILLPSQAQGEAAMAAGKKRPWKCCDEPFCTRSFPPICTCMDQVFKCPKTCKSCGPSAADPSRRICQDQYIGDPGPICRPWECCDKPTCTKSNPPTCRCGDEVDKCAPTCKTCLPSRSRPSRRVCIDSYFGAFPPPCTPREAVAAGGN

SEQ ID NO: 756 - protein, 511 aa, Hordeum vulgare
MSWLPATRALSCVVLLLLLVVAVAPPASAAAITRGDFPTGFVFGTGSSAYQIEGAVAEDGRKPSIWDTFTHSGYSPGGATADVTADQYHKYKEDVKLLSEMGVDAYRFSIAWPRLIPDGRGAVNAKGLEYYNNLINELLRHGIQPHVTVYHFDLPQALQDEYNGMLSRKFIDDYTVYADVCFKNFGDRVKYWSTLNEPNIEPIGGYDQGFFPPQRCSFPFGISCNNGNSTTEPYIVTHHLLLAHASAVSLYKEKYQDKQGGKIGLTLLGSWNKPATQTPEDIAAASRMNDFHIGWYMHPLVHGDYPPVMRKNVGSRLPSFTAEELKRVLGSFDFVGFNHYAASYVKADLSKLDQKLRDYMGDAAVRFESVPFFDLKNQSSPWVLREMLEHLQVKYKNPVVMIHENGAASVADPSGDKALDDEFRSRYLQDYIEATLQSSRNGSNVQGYFVWSFVDMFEFLFGYRMGFGLYGVDFNSEERTRYRRHSAKWYAGFLRGGELRPVAVPGQAYSQ

SEQ ID NO: 757 - protein, 294 aa, Hordeum vulgare
MRGWREDVVALSLEARGPGDDRPEKPRRYGVTEMRSPCYSFRPAHHALQEILDSLGPFVDGLKFSGGSHSLMGKELIREITDLAHKHDMYVSTGDWAEHLLRQGPSSFKQYVEECKELGFDTIELNAGSLKLPEEAILRLVRLIKNTGLRAKPLFSVKFDSSEMPAAGDRAFGAYIAPVKRSSERVEDVDLLIRRAERCLEAGADMIMIDADDVCQRTDSLRADIIAKIVGRLGLEKTMFETSNANTSEWFVKRYGPRVNLFADHSEVMNLERLRGLDVRRRVRPLLPSPFFLM

SEQ ID NO: 758 - protein, 229 aa, Hordeum vulgare
MMRPCCLSLALLVALSAVGCAAAQAADYDFFYLVLQWPGSYCDTKKSCCYPRTGKPAADFGIHGLWPNRDDGSYPQNCNPANAFDPSKVSDLLSSLRAEWPTLACPASDGLQFWAHEWEKHGTCAQNLFNEHGYFQTALHLRDQLRVLDALASAGVAPDGGYYTLSAVKGAIQQGTGFEPFVECNRDESGNSQLYQLYFCVDARASGFVECPVQPGGRPCGDRIEFPAF

SEQ ID NO: 759 - protein, 765 aa, Gossypium hirsutum
MGKKKNQKQQPSASKDDLLNTLGDFTSKENWDSFFTIRGSDDSFEWYAEWPQLRDSLLPRIQQHPSPSSLSPSSSLRILVPGCGNSRLSEHLYDAGFGDITNIDFSKVVISGMLRRNVRDRPNMRWRVMDMTQMQFPDDTFNVVLDKGGLDALMEPELGPQLGTKYLSEVKRVLKSRGKFICLTLAESHVLGLLFPKFRFGWNVCLYAIPQKPSTKPDLQTFMVVAEKESSNELLQIISSFDHSSLACNPNQTSGLLEALESENQIRGEYLNGSDVLYSLEDLQLGAKGDLKKLSPGRRVQLTLGDQGVSHFCYKAVLLDAKQQSGAFSFRCGVFIVPKTRSHEWLFSSEEGQWQVVESSKAARLIMVLLEASHANAGMEDIQKDLSPLVKPLAPADNDKGNQIPFMTASDGIKQRSVVYQGSSSLTGPVVIEDVVYENTDDVSHSLPFRRLVFERTEGLVQSEALLTRDGLFDKSVYGTEKKKASSSSKSKRRGALKRNNESSGKMKVYHGYLASSYHTAIISGFSLISSYLESVASSGNRVKAVVIGLGAGLLPMFLHGCMQSMQIEGVELDPVMLNLARDYFGFTEDKRMKVHIADGIQFVRDYRNLFSAGNEVLLSSNGSCKLSDAESRSTAIDIIIVDVDSSDSSSGLRCPAADFVEDSFLQNVKDTLSEQGLFVINLVSRSPAIKDAVVSRMKEVFSHLFCIQLEGEVNLVLFGLCSESHIEEDCIPDAALKLDKLLKSEHPEISQSITDAAKKLKRLK

SEQ ID NO: 760 - protein, 302 aa, Zea mays
MCLLREMEDHYVHPKSKSNHGSLSGNGYEMKNPGHEVCDRDSSSESDRSHPEASAVSESSLDEHTSTQSDNDEDHGKDNQDTLKPVLSLGKEGSAFLAPKIDYNPSFAYIPYTADAYYGGVGVLTGYAPHAIVHPQQNDTTNSPVMLPAEPAEEEPIYVNAKQYHAILRRRQTRAKLEAQNKMVKGRKPYLHESRHRHAMKRARGSGGRFLNTKQQLQEQNQQYQAPSGSMCSKTIGSTIISQSGPTCCTPSSDTAGASAASQDRGCLPSVGFRPTANFSEQGGGGSRLVVNGMQQRVSTIR

SEQ ID NO: 761 - protein, 271 aa, Zea mays
MLLPSSSSSSASASKGNSFGKTVNDHLRSTLSFDNKQPPFASQNFDYGQTIACISYPYNHSGSGDVWAAYESRTSAATVFRSQIAGGGTSTRIPLPLELAENEPIYVNPKQYHGILRRRQLRAKLEAQNKLVRARKPYLHESRHLHAMKRARGSGGRFLNTKQLQQSHTALTRSTTTSGTSSSGSTHLRLGGGAAAAGDRSVLAPKTMVSQDSSKKAVSSALAFTATPMLRRDDGFLQHPSHLFSFSGHFGQASAQAGVHNGSQHRVPVMR

SEQ ID NO: 762 - protein, 881 aa, Oryza sativa
MSDADGFGCEHRRPSKRRRDGPDHALLPVSREVLMGHPDDPAAAAAAVGAESSSASSYLGVVAAAASASASAAGGFSCGAHFFVRATDSRTVSMHAAWGDTVGAVLAHLADRGYGRDLRLVYAGRQLAPETALADLRLPPDSTLHLLSRLRSTPYPDAWQLASYIASTAAAAKSDPAHTSSAANINELVKEFILCAHRANMRQRHDRDSPLFDAQPTGDHAAQYLEIFRQAGAPFALVRLYAANPSSASHHHAENAIKCFLTMDPSALPPDVLPVMAPVLLEFCGLLSFSVGKRDELYISSRSMLATVLSLPSGLPPCIKSPSKLIEQVLPFAEEIVGVVMDELASLDMTVSSKNLEDLSNFFKVLRQQALRWVPNGGPLPKNLYNSERGHNDTWVWKLHEMSMNLLNRVDECLKRLEMDLSLSSENRGVNISQSRWVARSHMLVMLTQLDFISMIYEDLAHNLRLVLLAHRDPLNALVRCSKRNEHLHWLVKHKDLLCFESRRNLVLMMLPEGKDEYGELHEMLIDRQHLLDESFEYIIQARPSELRSGLFMEFKNEEATGPGVLREWFCMVCQALFSPQQVLFSPCPSDRQRFFLNGTSAVDPLHLKYFIFSGRIIGLALMHRVQVGITLDRTLFLHLAGRSIKLEDISAADPVMYASCKRILEMDAAVVDGLELTFSRDVHELGSRRTIELCSGGKDLHVNIRNRELYIDLLIKSTFVDSISVQLTHFVRGFSDILVDPELQKVFFEFLDLEDFDGMLGGSNKTINLEDWKLHTQYNGYKEKDRQIIWFWKAVESLSIEQQRQLLFFWTSVKYLPSDGFGGLASKLYIYKVSESADRLPSSHTCFYRLCLPAYPSLKVTRNQLQKITQEHVSCSFGTW

SEQ ID NO: 763 - protein, 291 aa, Sorghum bicolor
MSGGGQDLQLPPGFRFHPTDEELVMHYLCRRCAGLPIAVPIIAEIDLYKFDPWQLPRMALYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGLEKPAAVAGGDHKPMFAAAAVSSPPEQKPFVAAPGGLPPFPDLAAYYDRPSDSMPRLHADSSCSEQVLSPEQLACDREVQSQPKISEWERTFASDPVNPAGSMLDPVVGGHAGDPLLQDILMYWGKPF

SEQ ID NO: 764 - protein, 579 aa, Sorghum bicolor
MDPAARGGGHSIAEEAARLWADFPVRVDWAAVAAQCASLWAHARALVLVPAVRLLVFLSLAMTVMILLEKLFVCAVCLAVRAFRLGPHRRYRWEPITAAGSNGAAAGDDEESGGGGHGEAKYPMVLVQIPMYNEREVYKLSIGAACALEWPTERFVIQVLDDSTDPVVKDLVEMECQRWKSKGVNIKYEVRGNRKGYKAGALKEGLKHDYVKDCEYIAIFDADFQPESDFLLRTIPFLVHNPEIALVQTRWKFVNSDECLLTRFQEMSLDYHFKYEQEAGSSVYSFFGFNGTAGVWRISAIDDAGGWKDRTTVEDMDLAVRAMLQGWKFVYVGDIKVKSELPSTFKAYRFQQHRWSCGPANLFKKMMVEILENKKVSLWSKIHLWYDFFFVGKVAAHTVTFIYYCFAIPVSVLLPEIQIPLWGVVYVPTAITLLKALGTPSSFHLVILWVLFENVMSLHRIKAAISGLLDAGGRVNEWVVTEKLGDTNKAKPGTNGSDAVKVIDVKLTEPLIPKLVKRRARFWERYHCSELFVGTCILMCGFYDLLLAKKGYYIFLFLQGTAFLVAGFGYVGTLPPCTA

SEQ ID NO: 765 - protein, 625 aa, Sorghum bicolor
MENLRRLLNPLVLNLQKMELELTCPVCLKLLTSPTTLPCYHTSCSKCALTPTSKGYSCAICKSGYCSQDLRPASHLESIVSIHRSLSSTVCTMIEQQDAQVNIPVAKTASHGTPESGNRSGVMEKSDQMKSYNPVASKLVYDQSTGPAFGNMEGVQAKDPAVENNAGAAAVAPTAIVQKGHSGSQSSDGPGDLDCDSNDLEGELITSRSLLQTALKRETNVMDDHTRELKRQKSNDQVQRQTTMASAWKCEFCHSSQVTECTGPLSHYLNGEPIEADQAWKSSVHHVHEKCVEWAPQAFFTGDIANNLEPELARASKIKCSVCGLKGAALGCLVKSCRNSFHVPCAYNIKGCKWDQENFVMLCSTHSSKKLPCERSKSKKKAKLQQPSSDTDGLNSPSPMQRDELWTASPFLTSGWVICGSALIGHEKEILDQFECHTGITVTNTWSSDVTHVIANTDERGACARTLKVLMAILAGKWVLNVNWLKDCIEARKPIPEEPYEISCDVHGSVNGPRSGRLRAMQQAPNLFAGLTFYFSGHFMPGYKANLEDLIAAGGGSILEKTQLSCASLILYSMEPPQGNSPNTLETINKRIAEAQELAATVGCKAIPHTWLLDSIASCKVELSV

SEQ ID NO: 766 - protein, 1069 aa, Sorghum bicolor
MVFLHLAPLQTAVGGCGDGDLPEMLFMFSVCHVIIFLQDGFRFNTQTLKKFRLLQSSKHALAPFVKSLVAAAMPAKTVASDTPTRATHRASSISPPARRGGHAGRQSSAISLMSGTSSNPSVLPGQCIPVLLFVFEDDVLDVSSAAASSDDMGDSSSSNQCSTSDGLSKQSLASKSSGSVVMLARAANKSEGNSAKKLHSSLEGQIRVLLKKCRVLAGMEPGHIGPRGVSNMSHHLPLFSLDTSRVVALLERYINKKQEPLDIIAGLFEDSLCSKLSLDILSLENNYHPTNHDDFQLIKDFIFRQSDALRGRGGYSSNASAGSVSGVGMVAAAAAAAAASAASGKPVNAPDLPTFDKWLSISTSILTALLSGRNVLSGQSESKTHTSPIEKNDQLPAAGSNAIEIALSCLESNNGLNMKFSSSWCQRVLPAAKEIYLKGLPAFYPTSMHEVQLQKALRSFGSMVKGPAVRVFLKKLEDECRAIWESGRQQCDAVSLTGRPCKHRRHGDFSSSDAMKQHSSGYVFLHACACGRSRRLRDDPFDFETANVSFNCFQNCDDLLPTLALPRGSDAGSFSVSSWRLVRLGGARYYKPTKGLLQSGFSSKERYLLRWIISVGKGQVRNGIRSNTVTSSTRSGMNPQTPPIVTGEVKSAVTQVTAQIKSAKLESSGKQPDMEPMSNSGINFGKGLPNFTMKKPFAEVVAGTTSKDSEFPALQQMRPPKPGGRKDERQMNIGDHPNGRGHAAVSQGPVAETESAKASRNKSSENSDGKPFLQIGSNIVPVIVGNETRETSQQVQQFVVYVGFEHECPYGHRFLLSEKHMKEIDSSCLLYQRPHVNKEAEGKHAQKLLQNASGLIASAVDINSAQKNSKPLQSSGRNSQQQSLQLRVDAETSQPSPWLSDPQNGKRGEHYFPSITIDDGGEAFSLMNRNLPIYMHCPHCKISERKEHQDVKFAGAVSQLQRIFIVTPDFPVLLASCPLVQFEGSCLPSNVSDHDREGSFSIGCRVILPPESFLTMRLPFVYGVETKEGSTFPLKNFEQQPELTAWLVGGTALQIVSVGDVTEKETVMK

SEQ ID NO: 767 - protein, 510 aa, Sorghum bicolor
MRSRKPLGIQLFECARGSPISFRSCQALVLVLTFLSYASYHATRKTTSIVKSVLDPKTNLGMLHWPSHLYLQNLKGAENNNATLSGGWAPFNAEDGTVLLGEIDLAFLGVYAIGMFFAGHLGDRVDLRILLTIGMIGTGLFTAAFGAGYWFNVHSFYYFLGMQMVSGLFQSSGWPSVVAVVGNWFGKSKRGLIMGIWNAHTSVGNISGSLIAAAMLKYGWSWSFVVPGIMIALVGLTVFLFLPVGPDVIGIQEDLHLKDSEKSDMDAPLLERRSSDVKEKAVGFIEAWRIPGVAPFALCLFFCKLVAYTFLYWLPFYISHTAIGGQYLSDSEAGVLSTLFDLGGVVGGILAGHISDHLDARALTAASFTFSAIPALFFYRIYGNVSLAWNIALMFITGMLVNGPYALITTAVSADLGTHSSLNGNSRALATVTAIIDGTGSIGAAVGPLLTGYISARSWSAVFTMLMASALVAGLLLSRLVVAEVAAKMESRRTPAHAASDLPVSTMDEP

SEQ ID NO: 768 - protein, 356 aa, Sorghum bicolor
MASADAGETSTPEPAAREKPIVVRIKRKPSQTRPDAFWLEINERPAKKAMLDFSRLSISEPSSSPSSASAKASEEPRVKKLLVQHIETVHHSEAVEDVLQSLLLADSNAKEIKSKTKEWNDKIKQDNKPEQLRSAARQRHEDMGRNARFAQIWKSRKGEKDDADDSLREICHLYDAVQVDPDDEKHRAEPRQVLISDNLSGHLECRVALFHVPYNIPCRITSFEEGAVLCNFLPLLREYLPSTAEEIEADIISLAQSEDSEVYDIYTVKEVDDTNMEATSAASYPRLQVDDGEDECYEDCPYDTDDSNAEDNPLFDYPDEFSEDEDDDRNDEDPFGDEEGSDTDYEKEEVEVEEDE

SEQ ID NO: 769 - protein, 504 aa, Sorghum bicolor
MAPSPRRPVLVLLLLLALLCSHVALCSSAEPGKPKPKPKVSGGRKALLADDDGEEVPAAKPAKTAAAGKTKKKLLAGDAASKNQTKVAKAKKPESAAAAAAKGTTKKPAGKAAAGGDAAIAKVSKAPKVPKAEKADKAKVPKPDKAAAAAAGAKAKGADSTKPAKVSKTGAKAVKPPKTGAKSEVAAVAGKAKKPAAANSTVDAGAKPAKSGKRAAQVVADAKPKANATVVSKEESAATETAEVEVEEDVVFAKEAEEGTDDLISEFRDLPSRLQETLMPDLARLSHHSKAYLSAANAGIADGVRPILGGRWAAVAASAASVAVLLLPLFMLTALVRRMGPYLPLLHRALLLAQAYLAIYFATLALAAAATGLEPLRFFHAASPAAYAWTQAAQSLGFMGYLVLQMVDLVAVFSGAASPEDDGNGDAAKALGLAQMVVGLAVGLHYYAAVFHRAAAGEAPRANWRVYAVYAACFAIVCACARAERRKKAYLAGTDGAAEEWKKS

SEQ ID NO: 770 - protein, 479 aa, Sorghum bicolor
MAGGGEAPLLEGKPRVYFDGCPGCANDRRKAENLGIPYGQFFHIWIIILVSCLPISLLFPFIYFMIRDLHIAERVEGIGFYAGFVGASYMLGRALTSTAWGMIADRIGRKPVIILSIISTLLFNTLFGLSVNYWMAIATRFLLGSLNGLLGPIRAYAVEVCRTEHQAIGLTLVSTSWAIGLIIGPAIGGYLAQPVEKYPKLFPANSIFGRFPYFLPCLCVSFFCLVILISCIWLPETLHKHKLHKTEDQGIEDFAEQQNSSTTNKSLLKNWPLMSSIILFCVTSFDDMAYTEIFSLWAESDKKYGGLGFSSEDVGQVLAVTGASILLYQTFVYPRIVKVLGPVNASRIAAILSMVLLFTYPPMTHLSKPWLSVVVNIASMLKNNLVVTVVTCSFILQNNSVPQEQRATANGLATTLMSFFKAFAPAGAGIVFSWAQKRQHAFLFPGDQMVFFLLDIVIFVELIWTFKPFLAIPEQIPRS

SEQ ID NO: 771 - protein, 233 aa, Sorghum bicolor
MRSVLSEKTSYRSWRGSSHLVISNNRSVLGILFRQKTSFYKLILRTIINCDNIKEFIALCEVLELIPEDELELSRQKQPDTMANRRAQKVARFKRQKAAETKLQEIRERKERRGRSLRAAALSAPIEAGEEDDLEDDGEEEREAWLATISLALCKAFDLLDMLKKEEEMLLAVKERKAKVWYDHLAVVLPLRDATLETSSGVNILFVLTSSARTYTYLHGKLFQWLLIKQYTG

SEQ ID NO: 772 - protein, 482 aa, Glycine max
MGEENVKQPLLERKYYKDCPGCKVDQAKELSEGKGVPVKNLFIMWMVVLCAALPISSLFPFLYFMVRDFNIAKTEADISSYAGYVGSSFMLGRCLTSVLWGIVADRYGRKPVIVMGIIAVVIFNTLFGLSTNFWMAVIMRFLLGSLNGLLGPVKAYASELFREEHQAIGLSTVSAAWGIGLIIGPALGGYLAQPVEKYPHIFTKDSFWDKFPYFLPNLIISAFAFVVAIGCIWIPETLHNHNCSNESTDDAEALENGNSGAGNEKINDNLLLNWPLMSSIIVYCVFSLHDIAYQEVFSLWAVSPQRLGGLNFTTDNVGDVLSISGLALIIYQLTLYPFVEKASGPIVIARFSGMLTIPLLQSYPFIALLSGLALYIVISIASILKNILSVSAPLHLFNHLLEQHQRGAANGISMTAMSLFKAIGPATGGAVLTWSQKRMDASFLPGTHMVFFVLNIVEALGILMMFKPFLVEKKKTHSDQLH

SEQ ID NO: 773 - protein, 398 aa, Helianthus annuus
MRFFLLHVCTLFSVALLGSHAVTPEVYWKSVLPNSPMPKSIKDLLYTEWSDEKSTAVGVGKGGVSVHTGKPGKRTDVGVGKGGVGVHTGKPGKRTDVGVGKGGVGVHTGKPGKRTDVGVGKGGVGVHTGKPGKGTHVGVGKGGVNVHTRHKGKPVYVGVRKGPNPFVYKYAASENQLKDNPNVALFFKENDLHQGKEMNLHFTKNDEKATFLPRQIADSIPFSSNKLPQIYEEFSVKPDSMEAEIMKQTLSECESTGIQGEEKYCATSLESMVDFSTTKLGKNVKAISTEVSAKESTPLQKYKIEVAKKLVANKAVVCHKQNYAYAVFYCHKTASTQAYAVSMVGADGTKVNAVAVCHTDTAKWNPKHLAFQVLKVKPGTVPICHFLPEDHVVWVPYK

SEQ ID NO: 774 - protein, 330 aa, Solanum lycopersicum
MASTISYTSLCSLLKLNQTNQKTPFSPSLSSPSSPSSLVKIKNQLCFSSNFCSHLNKASIFMVKASETEATQSEKEEEDKYEEYEVEIIQPYGLKFTKGRDGGTYIDAIAPGGFADKTGKFTVGDKVIATSAVFGEEIWPAAEYGRTMYTIRQRIGPLLMKMQKRYGKVEEVGELTEKEIIRAERNAGFISDRVREIQVTNARRKKEQKEQRERELREGLKLSKNGKYEEALEKFESVLGSRPTGDELAVASYNVACCYSKLNQLQAGLSALKDAMEAGFEDFKRIRTDPDLANLRTSEDFETLMKKFDESFINENAINAIKSLFGFNKK

SEQ ID NO: 775 - protein, 447 aa, Solanum lycopersicum
MSLFRFFASTILLLFLISCFSFSSTDAFDPLDPNGNITIKWDVISWTPDGYVAVVTMYNFQQYRHIQAPGWSLGWTWAKKEVIWTMMGAQTTEQGDCSKYKGNIPHCCKKDPTVVDMLPGTPYNQQIANCCKGGVINSWGQDPATAVSSFQVSVGAAGTTNKTVRVPKNFTLKAPGPGYTCGPAKIVKSTKFVSADGRRVTQAMMTWNVTCTYSQFLAQKTPTCCVSLSSFYNDTIVPCPTCTCGCQSNGTQRGSCVDPETPHLASVVSDHGKNNYVPLVQCTKHMCPIRIHWHVKLNYKEYWRVKITITNFNYRMNYTQWNLVVQHPNFDNLTTLFSFNYKSLTPYGSINDTAMLWGVKFYNDLLMQAGPSGNVQSELLFRKDASTFTFEKGWAFPHRIYFNGDNCVMPPPDAYPFLPNAGSRWEASLITLVVTLMSSMAVVLTYI

SEQ ID NO: 776 - protein, 320 aa, Solanum lycopersicum
MMMIGRSPPTVQIPPWDVTDDPTVDVYSPFSVSPDSAFDVLTALQRYLPSNGNDVIFDSDGLDIPVDAFSCDNFRMYEFKVRKCARGRSHDWTECPYAHPGEKARRRDPRKYHYSGTSCPDFRKGQCKKGDACEYAHGVFECWLHPARYRTQPCKDGTHCRRRVCFFAHTPEQLRVLPQNSPRSFNESSDSFDGSPGRVGFESFSSSPPLESPPMTPRGLAESMRNMQIGMVRGMRSMQMGSPAFGSPRSPSILRPGFMSMPTTPTRSGASVFDHCEEEPAMERVESGRDLRARIYAKLSMENSLDSGAPDVGWVSELLK

SEQ ID NO: 777 - protein, 410 aa, Solanum lycopersicum
MAEVCFGVVTETDSSSPCESSSRAVRRRRMELRKIKVIAGVTQPETENGIKRPKMKLISGSVSRICDNAVESSSTDDDEEQLRLVETKGSPPTIILTPYLGPLNSTLLVQSVAYPKFGFASVCGRRRDMEDAVAIHPSFCQMEQGNSGELHYFAVYDGHGCSHVATKCKERLHELVKEELENTEGDHEEWEHLMNRSFNRMEKEVIEWNKSVTGATCRCELHTPECDAVGSTAVVAVVTPDKIIVANCGDSRAILCRNGKAIPLSNDQKPDRPDELNRIQEAGGRVIYWDGPRVSGVLAMSRAIGDNYLKPYVICEPEVTITDRTSEDDCLILASDGLWDVVSNDTACGVAGMCLKGNASPASMPGNGTDGEVNSDQCCSDASMLLTKLALARRSYDNVSVVVVDLKNYK

SEQ ID NO: 778 - protein, 721 aa, Solanum lycopersicum
MASSIVQNGHVNGEAMDLCKKSINVNDPLNWEMAAESLRGSHLDEVKKMVDEFRKPIVKLGGETLTVAQVASIANVDNKSNGVKVELSESARAGVKASSDWVMDSMGKGTDSYGVTTGFGATSHRRTKNGGALQKELIRFLNAGVFGNGTESSHTLPHSATRAAMLVRINTLLQGYSGIRFEILEAITKLINSNITPCLPLRGTITASGDLVPLSYIAGLLTGRPNSKAVGPNGEKLNAEEAFRVAGVTSGFFELQPKEGLALVNGTAVGSGMASMVLFESNILAVMSEVLSAIFAEVMNGKPEFTDYLTHKLKHHPGQIEAAAIMEHILDGSSYVKAAQKLHEMDPLQKPKQDRYALRTSPQWLGPQIEVIRAATKMIEREINSVNDNPLIDVSRNKALHGGNFQGTPIGVSMDNTRLALASIGKLMFAQFSELVNDYYNNGLPSNLTAGRNPSLDYGLKGAEIAMASYCSELQFLANPVTNHVQSAEQHNQDVNSLGLISARKTAEAVDILKLMSSTYLVALCQAIDLRHLEENLRSAVKNTVSQVAKRTLTMGANGELHPARFCEKELLRVVDREYVFAYADDPCSSTYPLMQKLRQVLVDHAMKNGESEKNVNSSIFQKIVAFEDELKAVLPKEVESARAVVESGNPAIPNRITECRSYPLYRLVRQELGSELLTGEKVRSPGEEIDKVFTAMCNGQIIDPLLECLKSWNGAPLPIC

SEQ ID NO: 779 - protein, 327 aa, Triticum aestivum
MGMPAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRAAASKKGSLRLDDWVLCRLYNKKNEWEKMQLQQQGGEEMMVEPKEEHAASDMVVTSHSHSQSQSHSHSWGEARTPESEIVDNDPSLFQQAAAFQAQSPAAAAAHQEMMATLMVPKKEAADEAGRNDLFVDLSYDDIQSMYNGLDMMPPGDDLLYSSLFASPRVRGSQPGAGGMPAPF

SEQ ID NO: 780 - protein, 511 aa, Oryza sativa
MAFAATKPSKSPLLILLVSGVAFLLLASAVECYGGGRHDVTRSAVARRSGVGSRRQYVRHRLTGAAVDVPHRYMLAEKGSNSTRANHTSPAASNSTPSATTTTEAAGKHHRSHKHRVRNWIIGFVVGSLAGVVSGLAMSVLFRMALNCVRGRYRSKSDTVIFIPKLIKSKEHLAFLEKDQDGLASLAVIGRGGCGEVYKAQLPPEREGDAPRFIAIKKIKKRSGDGSGGQNNLSDEESRQLDKWTRQIQSEIRTVGHIRHRNLLPLAAHVPRPDCHYLVYEFMKNGSLHNALKATTTDTTTNDYNDNNSGEHPPPQPPPSPALPWPARLRIAVGIAAGLEYLHVSQRPQIIHRDLKPANILLDDDMEARIADFGLAKAMPDAHTHMTTSNVAGTLGYIAPEYHQTLKFTAKCDVYSFGVILAVLGTGKEPTDRFFAQQVVDDVGIVRWLRRVMQEGDPAAQAGVIDAAIAGAGHDEQILLVLRIAVFCTADDPKDRPTAKDVRCMLSQIKN

SEQ ID NO: 781 - protein, 310 aa, Triticum aestivum
MASRDFLGRFGGEKGASSDKAGGGAGEPDEVVELSLGLSLGGCFGANSGRDAKKPRLVRSSSLAAMCSLPGTSDDIAAATPPPAPLMRTSSLPTETEEERWRRREMQSLKRLQAKRKRLERRTSMNSGKSGGSSSRDDAQEPLYPSAFQLRRSVVDQGNASSSMPEQGSGDGAEAKSTSSMEISSDNNNQNKSLPPPAPSTAGKLPNGIVKEQPPLRTLRSLTMRTTSTGDLRKSMMEDMPMVSSKVDGPNGKKIDGFLYKYRKGEEVRIVCVCHGNFLTPAEFVKHAGGGDVTNPLRHIVVNPSPSVFL

SEQ ID NO: 782 - protein, 174 aa, Glycine max
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQLVHQGSLNYIGLQVQPQHLVMPSMQGHE

SEQ ID NO: 783 - DNA, 1164 bp, Brachypodium distachyon
gtagtcgcgccatagctgcagctacacatctcagcgttaacaggccaagatgaagctcgttgtgctctcggccctgctcctgctttctctcgtcgccgtctcctccgccgaggaattcgatttcttctaccttgttcagcaatggccagggtccttctgtgacacgaagaaggggtgctgcttcccggacaccggcaagccggcggtggacttcggcatccacgggctctggcccaactacgccgcgtgcaagacccgcggcgagctcgacggcgccctggagatggtgaccaagcgcaagaagaagtgctggccggagaactgcaacagcgagcgcctcaagctctgggagatcaaggacctggtgacggagctggacgccaactggccgacgctggcgtgcaagggcgggaagagcatcgagttctggacccacgagtgggagaagcacggcacctgctccaacctggaccagcacggctacttcgcgacggcgctcggcttcaaggcccgccacaacctcaccggcatcctcgccgacgccgggatcgtgccgtcggacagcgagacctacttcctcagcagcatcagggacgccatcaaggaggggaccgggttcacggcgaacctggagtgcaaccgtggcgtcgccggcgagacgcagctgttccaggtgtaccagtgcatcgaccgcgccggggagaacctcatcgactgcccgctgccgatgcagggcaactgcaaagacagggtccagctgccggccttctgattaaatttgagttctaattgaacacccgttgccgccgtccgtcggggtgttgtgcggcggctgattggctcgacgcgccccggccggccgcctgcacggtgcgcggctggattacgtgatggatgtacctttgtgtttgttattggttcagttaaaatgccgtcacagtcctgagttctgggcatcgacgtaacgtttactattaattcctgatctcatcaggcgaataaagacttttaatcttgccttttgattttgctccacatattctgaacgaggtcaaaagatggaacaaagtatgtcacaagtcacaacactgagttgggatcttttgttgttttttcgagatgaccttgagttggcatgggtgcgtgcattcttgagcggccgcc

SEQ ID NO: 784 - DNA, 980 bp, Leymus cinereus x Leymus triticoides
ggcgaagatgaagctcgtcgtgctctcggccctgctcctgctttctctcctcgccgtctcctcggcggaggaattcgatttcttctaccttgttcagcaatggcctgggtccttctgtgacacgaagaaggggtgctgcttcccggacaccggcaagccggcgacggacttcggcatccacgggctgtggcccaactacgccaagtgcaagacgcgcggcgagctcgacggcgccttggagatggtgaccaagcgcaagaagaagtgctggccggagtcctgcaacagcgagcgcctcaagctctgggagatcaaggacctggtgaaggagctggacgccaactggccgacgctggcgtgcaagggcggcaagagcatcgagttctggacccacgagtgggagaagcacggcacctgctccaacctggaccagcacggctacttcgcgacggcgctcggcttcaaggcccgacacaacctcaccggcatcctcgccgacgccgggatcgtgccgtcggacagtgagacctacttcctcagcagcatcagggacgccatcaaggaggggaccgggttcacggcgaacctggagtgcaaccgtggcgtcgccggcgagacgcagctgttccaggtgtaccagtgcatcgaccgcgccggggagaacctcatcgactgcccgctgccgatgcagggcaactgcaaagacagggtccagctgccggccttctgattaatttttttgaaattctaattgaacctccttgccgccgtccgtcggggtgtggtgcggcggctgattggctcgacgcggccggccacctgaacggcgcgcggctggattacgtgatggatgtacctttgtgtttgttattggttcagttaaaaattccgtccagtcccgagttctggacatcgacgtaacgtttactattaattcctgatttcaacaggcgaataaagacttttaatcttgtctttca

SEQ ID NO: 785 - DNA, 1046 bp, Triticum aestivum
tcgtcctataagtagctgcgcgatagctgcggctacacatctcatagttgaagatgaagcttgtcgttgtgctctcggccctgctcctgctttctctcctcgccgtctcctccgccgaggaattcgatttcttctaccttgttcagcaatggcctgggtccttctgtgacacgaagaaggggtgctgcttcccggacaccggcaagccggcgacggacttcggcatccacgggctgtggcccaactacgccaagtgcaagacccgcggcgagctcgacggcgccctggagatggtgaccaagcgcaagaagaagtgctggccggagaactgcaacagcgagcgcctcaagctctgggagatcaaggacctggtgacggagctggacgccaactggccgacgctggcgtgcaagggcggcaagagcatcgagttctggacccacgagtgggagaagcacggcacctgctccaacctggaccagcacggctacttcgcgacggcgctcggcttcaaggcccgccacaacctcaccggcatcctcgccgacgccgggatcgtgccgtcggacagcgagacctacttcctcagcagcatcagggacgccatcaaggaggggaccgggttcacggcgaacctcgagtgcaaccgcggcgtcgccggcgagacgcagctgttccaggtgtaccagtgcatcgacagcgccggggagaacctcatcgactgcccgctgccgatgcagggcaactgcaaagacagggtccagctgccggccttctgattaaaattttgaattctgattgaacacccgttgccggcttgccgttgccgccgtccgtcggggtgtggtgcggcggctgattggctcgacgcggcccggccggccgcctgcacagtgcgcgggtggattacgtgatggatgtacctttgtgtttgctattggttcagttaaaatgccgtcacagtcccgagttctgggcatcgacgtaacgtttactattaattcctgatctgatcaggcgaataaagacttttaatcttgcctttt

SEQ ID NO: 786 - DNA, 1093 bp, Triticum aestivum
aattccgggaattttttccaacccagggctcccgcgatttgggcccggggaaccctaaccatggactgaaggggattagaaaacatttcaaagttaaatatgcgaagatgaagctatttgtgctgtcggccctgctcctgctttctctcgtcgccgtctcctccgccgaggaattcgatttcttctaccttgttcagcaatggccagggtccttctgtgacacgaagaaggggtgctgcttcccggacaccggcaagccggcgacggacttcggcatccacgggctgtggcccaactacgccaagtgcaagacccgcggcgagctcgacggcgccctggagatggtgaccaagcgcaagaagaagtgctggccggagaactgcaacagcgagcccctcaagctctgggagatcaaggacctggtgacggagctggacgccaactggccgacgctggcgtgcaagagcgggaagagcatcgagttctggacccacgagtgggagaagcacggcacctgctccaacctggaccagcacggctacttcaagacggcgctcggcttcaaggcccgccacaacctcaccggcatcctcgccgacgccgggatcgtgccgtcggacagcgagacctacttcctcagcagcatcagggacgccatcaaggaggggaccgggttcacggcgaacctggagtgcaaccggggcgtcgccggcgagacgcagctgttccaggtgtaccagtgcatcgaccgcgccgggaagaacctcatcgactgtccgctgccgatgcagggcaactgcaaagacagggtccagctgccggccttctgattaaatttgagttctaattgaacacccgttgccggcgtccgtcggggtgttgtgcggcggctcattggctcgacgcgccccggccggccgcctgcacggtgcgcggctggattacgtgatggatgtacctttgtgtttgttattggttcagttaaaatgccgtcacagtccggagttctgggcatcgacgtaacgtttactattaattcctgatctgatcatcaggccaataaagactttaatcttgcctttaaaaaaaaaaa

SEQ ID NO: 787 - DNA, 1044 bp, Pseudoroegneria spicata
  misc_feature (376)..(376): n is a, c, g, or t
  misc_feature (502)..(502): n is a, c, g, or t
  misc_feature (514)..(514): n is a, c, g, or t
  misc_feature (696)..(696): n is a, c, g, or t
  misc_feature (929)..(929): n is a, c, g, or t
aagttaataggcgaagatgaagcttgtcgttgtgctctcggccctgttcctgctttctctcgtcgccgtctcctccgccgaggaattcgatttcttctaccttgtccagcaatggcccgggtccttctgtgacaccaagaaggggtgctgcttcccggacaccggtaagccggcgacggacttcggcatccacggcctgtggcccaactacgccaagtgcaagacccgcggcgagctcgacggggccctggagatggtgaccaagcggaagaagaagtgctggccagagtcctgcaacagcgagcccctcaagctctgggagatcaaggacctgttgaaggagctggactccaactggccgacgctggcgtgcaanagcgggaagagcatcgagttctggacccacgagtgggagaagcacggcacctgctccaacctggaccagcacggctacttcgcgacggcgctcggcttcaaggcccgccacaacctcaccggcatnctcgccgacgcngggatcgtgccgtcggacagcgagacctacttcctcagcagcatcagggacgccatcaagcaggggaccgggttcacggcgaacctggagtgcaaccggggcgtcgccggcgagacacagctgtaccaggtgtaccagtgcatcgaccgcgccggggagaacctcatcgactgcccgctgcngatgcagggcaactgcaaagacagggtccagctgccggccttctgattaattttttgaattctaattgaacatccgttgacgtcgtccgtcggggtgtggtgcggcggctgattggctcgacgcggcccggccggccgcctgcacggcacgcggctgggttacgtgatggatgtacctttgtgtttgttattggttcagttaaaattccgtcagagtcccgagttctggacancgacgtaacgttttactattaattcctgatatgatcaggcgaataaagacttttaatcttgtctttcgattttgctccacaaattctgaacgaagtcaaaagatgaaacacagta

SEQ ID NO: 788 - DNA, 936 bp, Avena sativa
gatgaagcttgtcgcgctctcggttctgctcctgctctcgctcgtggccgtctcctccgccgaggaattcgatttcttctacctcgttcagcaatggcctgggtccttctgtgacacgaagaaggggtgctgcttcccggacaccgggaagccggcggcggacttcggcatccacgggctctggcccaactacgccaagtgcaagacccgccacgacctcctcgtcgacggcgccgcccccggcctggagatggtcaccaagcggaagaagaagtgctggccggagttctgcaacaacggcgagcccctcaagatcgcggcgatcgcggacctgctcaagcagctggaggccaactggcccacgctggcgtgcaagagcggcaagagcttcgacttctggagccaggagtggaagaagcacggcacctgctccgacctgggccagcacggctacttcgcgacgtcgctcggcttcaaggcgcagcacaacctcaccgccatcctcgccgacgccgggatcgtgccgtccgacgacaagacctacttcctcagcagcatcaaggacgccatcaaggaagggaccggcttcacggccaacatcgagtgcaacaggggcgtcgccggagagacgcagctgttccaggtgtaccagtgcgtcgaccgcgcaggggagaacctcatcgactgcccgctgcccatgaccggcaactgcaaagacagagtccagctcccggccttctgattaaattttctagttgagcctcttgccggccctcgccggctggattatttggtggatgtaccacctgtgttatttttttacaggttcagttaaaattctgcccagaccgacttctggacatgtacgtgacatttgctattaattcctgatctgatctgatctgatcaggggaataagaaatattcatttttttt

SEQ ID NO: 789 - DNA, 1412 bp, Pseudoroegneria spicata
  misc_feature (6)..(6): n is a, c, g, or t
caaccncctccatcacctccctgctccgcgagcccacgcttcccctgtcccgcagcacgagctcgaccagccatggacggcaaggactacaccacaccgcccaccgcgcccggggcgccgccgcactcctaccccccgacgcaccacgccatggacggcaaggacgccaccgcgccacagccgggagcgccgccgcacccgtcctccccccagacgcagcaggccatggagatggagggcgcgtacgccgccccacagccgggctcgggagcgccgccgcacccgtcctcccccaagacgcagcaggccatggagatggagggcaagtacgccgccccacagccgggcacgggagcgacgccgccttcgtcatctcccctggcgcagcaatccatggacggcaaggacgccgccccggcgccgcccgcggacgcgcaggaacccggagagtcggcgaaacggggcacgcggcagatgggcccgccggcggcccctggggcgcaccccgagaaccagcaggcggcgcagtggacggcctcgcgcggcgaccaggagctgccgccgtacgtcatggggggaccggagccagcgcaggcggcgtcggcgcggcagacggacaaggagaccaaggacggccccatggagcacatcctcgacttcttcaacatttggagccgcaaggccgaggagctctcctccaacatctggctcaacctcaagacggcgccgtccatgtccgacgcggcgatggggaagctgagcctgggcgccaaggcgatcacagggggcggcttcgagaagctctacaagcagaccttcgcctccggccccgatgagcacgtgaagaagacgttcgcgtgctacctgtccacggccacgggccccgtcgccggcacgctctacctcaccaacatgaacgtggctttctgcagcgaccgcccgctctccttcgccgcgccgtcgggccagaccgcctggagctactacaagatcatgatcccgctggccaagctcgccaccgtcgagcccgtcacggccaaggagagcccgcctgagaggtacatccacatcgtcaccgtggactcgcacgacttctggttcatgggcttcgtcagctacgacaaggccgtgcaccacctcagcggggccgtctcgtcgtcgcagcaccacggcgccgctcccgccgcggcgccggcgccggcacccacctacgagtgattggctgattgccgccgtgttccgtgccctcggctctgctttttattgccgtgtgtgtgctctgtttttcgggcggatctgtttagtgagtgctctggtgtgtagtggatttgcgtgggtagtgtggttggttatgtactgttgtccatacgcttttgtcgaaatttaacgtgctcttgttaatttccttcaaa

SEQ ID NO: 790 - DNA, 1467 bp, Triticum aestivum
  misc_feature (871)..(871): n is a, c, g, or t
cgtctcacacttgcggttccaaatcaaccaccgccaccatcaccttcctgctccccgagcccacgccccccctgccccgcagcaccagcaccaccagctagcagccatggacggcaagggctacaccacaccgcccaccgcccccgcggcgcaggccgaggccggggcgccgccgcactcctaccccccgacgcagcacggcaacgacgccgcggcgccacagccgggatcgcaggtttcctatccctcgatggaacacgccatggacggtctggacgccaccgcgccacagccgggcgcgccgccgcacccgtcctcccccctgacgcagcaggccatggagatggagggcaagtacgccgccccgcagccgggcacgggagcgccgccgccatcgtcctccccactggcgcagcaatccatggacggcaaggacgccgccccggcaccgcccgcggacgccgagtcggcgaaatggggcacgcggcagatgggcccgccggcggccccgggggcgcacccggagaaccagcaggcggcgcagtggacggcctcgcgcggcgaccaggagctgccgccgtacgtcatcatgggggggccggagccggcgccggcggcatccacgcggcggacggacaaggagaccaaggacagccccatggagcacatcctcgacttcttcaacgtatggagccgcaaggccgaggagctctcctccaacatctggctcaacctcaagacggcgccgtccatgtcggacgcggccatggggaagctgagcctgggcgccaaggcgatcacggggggcggcttcgagaagctgtacaagcagaccttcgcctccggccccgacgagcacgtgaagaagacnttcgcctgctacctgtccacggccacggggcccgtcgccggcacgctatacctcaccaacatgaacgtcgccttctgcagcgaccgcccgctctccttcaccgcgccgtcgggccagaccgcctggagctactacaagatcatgatcccgctggccaagctcgccgccgtcgagcccgtcacggccaaggagagcccgccggagaagtacatccacatcgtcaccgtcgactcgcacgacttctggttcatgggcttcgtcagctacgacaaggccgtgcgccacctgggcggggcagtctcgtcgtcgcagcaccacggcgccgctcccgccgcggcgccggcgccggcaccaacacccacctacgagtgattggctgactgccgtcgcgtcagtatccgcggctctgcttttttatcgccgtgtgtgtgctctgtttttcgggcggatctgtttagtgagtgctctcgtgtgtagtggattttcgtgtggttatgtactgttgtctatacgcttttgtcgaaatttagcgtcatcttcttaattccgttcaaaaatattgttctccacctcttgcccgatgtatatttgtgttc

SEQ ID NO: 791 - DNA, 1473 bp, Triticum aestivum
ctcgcactttcggtaccaaacccaaccacctccatcatctccctgcacccccgagcccacgcttcccctgtcccgcagcaccagtaccagcaccaccggctagccatggacgacaaggactacgccacaccgcccaccgctcccgcgccacaggccgaggccggggcgccgcagcactcctaccccccgacgcaccacgccatggacggcaaggacgccaccgcgccgcagccgggaccgcaggtctcctatcccttgatggaacacgccatcgacggtctggacgccaccgcgccacagccgggagcgccgccgcatccgtcttcccccctgacgcagcaggccatggagatggagggcaagtacgccgccccgcagccgggcacgggagcgacgccgccctcgtcctcccccctcatgcagcaagccgtcgacggcaaggacgccgcccaggcaccgcccggcgcgtcagtgccgcccgccgagtcggcgaggtggggcacgcggcagatgggcccgccggcggcgccgggggcgcaccccgagaaccagcaggcggcgcagtggacggcctcgcgcggcgatcaggagctgccgccgtacgtcatcatggggggaccggagccggcggcggcggcgtcggcgcggcggacggacaaggagaccaaggacagccccatggagcacatcctcgacttcttcaacgtctggagccgcaaggccgaggagctctcctccaacatctggctcaacctcaagactgcgccgtccatgtccgacgcggcgatggggaagctgagcctgggcgccaaggccatcacggggggcggcttcgagaagctgtacaagcagaccttcgcctccggccccgacgagcacgtaaagaagacgttcgcctgctacctgtccacggccacgggccccgtcgccggcacgctctacctcaccaacatgaacgtcgccttctgcagcgaccgcccgctctccttcaccgcgccgtcgggccagaccgcctggagctactacaagatcatgatcccgctggccaagctcgccgccgtcgagcccgtcacggccaaggagagcccgccggagaagtacatccacatcgtcaccgtcgactcgcacgacttctggttcatgggcttcgtcagctacgacaaggccgtgcaccacctgggcggggccgtctcctcgtcgcagcaccacggcgccgctcccgccgcggcgccggcgccggcacccacctacgagtgattggctgattgccgccgtgttccatgttcgtggctctctgcttttcattgccgtgtgtgtgcgctctgtttttcgggcggatctgtttagtgagtgctctggtgtgtagtggattttcgtgtggttatgtgctgttgtctatacgcttgtgttcttcggagttggacaatgtatttgaaatttgagcatcaagaaaaaataaataatactcaagac

SEQ ID NO: 792 - DNA, 2334 bp, Triticum aestivum
  misc_feature (2322)..(2322): n is a, c, g, or t
  misc_feature (2325)..(2325): n is a, c, g, or t
aattcggcacgaggctcaagcttgcagaagagataagctaggtagcaagaccgctccaaggccccaggacgccatggccacaaaccccggcctcttcagcgagtggccatggaagaggctcggcagcttcaagtacgtggtgctggcgccatgggtggcgcacggcgtccagcaggtggcgaccaaggggtggcgcgaggcggacctggggtacctggtgatcctcccgtcgatgatgctccgggggctccacaaccaggcctggatcacggtgtcccgcctccagaacgcgcgcggcaagcggcagatcgtcgaccgcggcatcgagttcgagcagatcgaccgcgagcgcaactgggacgaccagatcatcctgagcgccatcctcttcttcctgggcgcgctgcacctgccgggcgcgcagaacctgccgctgtggaggacggacggcgcggtgctgatcgcgctgctgcacgccggccccgtggagctcatctactactggttccaccgcgcgctgcaccaccacttcctctacacgcgctaccactcgcaccaccacgcctccatcgtcaccgagcccatcacctccgtgattcatccgtttgcggagctcgtggcctacgaactgctcttctccatcccgatgatcgcctgcgctctgacaggaaccgcgtccatcatgacgtttgagctctacatgctctacatcgacttcatgaacaacatgggccactgcaacttcgagctggtgcccagctggctcttcacatggttccctcctctcaagtatctcatgtacacaccatcgtttcattctctccaccacactcagttccggacaaactactctcttttcatgccgttctacgactacatatacaacacaatggacaagtcgtcagacacgctgcatgagaaatcgatcgagagcaaggaggaagccgtggatgtggttcacctcacccatctcaccagcctgcagtccatctaccacatgaggcccgggttcgccgagttcgcctccaagccgtacgcctcaaagtggtacatgcggatcatgtggcctctctcgtggctctccatggtcctcacctggacgtatggttcttggttcaccgctgagaggaacgtcatgaagaaactcagaatccagtcttgggccataccaagatacaatttccattatggactgaactgggagaaggaagcacttaataacctgattgtgaaggcaatatgtgaagctgacaagaagggagctaaagttgttagtcttggcctcctgaatcaggcccagagcctcaacggaagtggagaactttatctacaaaagtacccaaagttggggttgaaactggtggatggaaccagtctagctgctgcagtggttgccaatagtattccccaaggcacggaccaagttgttctttcaggaaacatttccaaggtggcctgcgctgtggctgcagctctgtgcaagaaaaatatcaaggtgataataacaaacaagcaagactatcatttccttcagcccaaaataccagaagatgcagctgacaaccttttactgtcgaaaaccggcattgccaaggtgtggataatcggagaaggtgcagatgccaccgaacagctcagggcgccgaaaggaacacggttcatcccgtactcacagttcccaccaagaatggcacgcaaggacggctgcacatactcgacgactccggcgatgagcgtgcctaaaacactgcagaatgttcattcgtgcgagaattggctgccaaggtgggtgatgagcgcgtggcgcgtcgcggggatcgttcatgcgttggagggatgggacgagcacgagtgcggggacatggtgctcgacatggacaaagtttggtctgccgcacttctgcacgggtttcgccccgttgctgaggcttgatcgtctggttgcaagtcgagtgaataagcgttacgcagataaggtcatatgctcgctgaagggccatgctgaggaagaagaagcagacttattggctagcagatgagtggcctataattaattaagtactactactagtttgatctactactaccaaggttacttggttagctattactactgcattattcatctcctacgataatgaggtaatgagacttggttcgacctagctatttctagcgccatctgcccttgcgtcaacaacagatgcaattcaacgaagaaacaattgtgggtgagtggttcggcagtgtttcaattgactcagaactgttgtgacacatgtgccgacggtagtacttgacggatgcaaacattaaaaaagnctnaccaattta

SEQ ID NO: 793 - DNA, 2146 bp, Triticum aestivum
  misc_feature (4)..(4): n is a, c, g, or t
aganaagctaggtagcaagctgctccaaggctccaggacaccatggccacaaaccccggcctcttcagcgagtggccatggaagatgctcggcagcttcaagtacgtggtgctggcgccatgggtggcgcacggcatccaacaggtggcgaccaaggggtggcgcgaggccgatctggggtacctggtgatcctcccgtcgatgattctccgggggctccacaaccaggcctggatcacggtgtcccgcctccagaacgcgcgcggcaagcggcagatcgtcgaccgcggcatcgagttcgagcagatcgaccgcgagcgcaactgggacgaccagatcatcctgagcgccatcctcttgttcctgggcgcgctgcacctgccgggcgggcagaacctgccgctgtggaggacggacggcgcggtgctgctggcgctgctgcacgccggcccggtggagttcctctactactggttccaccgcgcgctgcaccaccacttcctctacacgcgctaccactcgcaccaccacgcctccatcgtcaccgagcccatcacatccgtgattcatccatttgccgagctcgtggcctacgaactgctcttctcgatcccgatgatcgcctgcgttctgacaggaactgcttccatcatgacgtttgagctctacatgctctacatcgacttcatgaacaacatgggccactgcaacttcgagctggtgcccacctggctcttcacatggttccctccgctcaaatatctcatgtacacaccatcgtttcactctctccaccacactcagttccggacgaactactctcttttcatgccgttctacgactacatatacaacacgatggacaagtcgtcagacacgctgcatgagaaatcgatcgagagcaaggaggaggccgtagatgtggttcacctcacccacctcaccagcctgcagtccatctaccacatgaggcccgggttcgccgagttcgccgccaagccgtacgcctcaaagtggtacatgcggatcatgtggcctctgtcctggctctccatggtgctcacgtgggcgtacggttcttggttcaccgttgagaggaatgtcatggagaaactcaaaatccagtcttgggccataccaagatacaatttccattatggattgaactgggagaaggaagcaattaataacctgattgtgaaggcaatatgtgaagctgacaagaagggggctaaagttgttagccttggactcctgaatcaggcccagagcctcaacggaagcggagagctttatctacaaaagtacccaaagttggggttgaaactggtggatggaaccagtctagctgctgcagtggttgtcaatagtattccccatggcgcggaccaagttgttctttcaggaaacatttccaaggtggcctgtgctgtggctgcagctctatgcaagaaaaatatcaaggtgataataacaaacaagcaagactatcatttccttcagcccaaaataccagaagatgcagctgacaaccttttactgtcgaaaaccggtatggccaaggtgtggataatcggagaaggcgcagatgccaccgaacagctcagggcgccgaaaggaacacggttcatcccgtactcacagttcccaccaagaatggcgcgcaaggacggctgcacatactcgacgactccggcgatgagcgtgcctaaaacactgcagaatgttcattcgtgcgagaactggctgccgaggagggtgatgagcgcgtggcgcgtcgcggggatcgttcatgcgttggagggatgggacgagcatgagtgcggggacacggtgctcgacatggacaaagtttggtctgccgcacttctgcatggctttcgccccgttgctgaagcttgatcgtctggttgcaacttgcaagtcgagtgaataagcgttacgcagataaggatctggttgtatcttgtatgctcgctggagccgtgctgaggaagaaggagcagacatactggctagcagatgagtggcctataattaattaagtactactactagtttgatgatctatgccaaggttacttggttagctattactggattatttacctcctatgataatgagttgatgacttggttcgaccta

SEQ ID NO: 794 - DNA, 2260 bp, Brachypodium distachyon
tcctcatctctgtaaacacagtgagcgcgcggagcagccccaagggccagcacaaggcagacatggccacaaaccccggattcttgagcgagtggccatggaagaggcttggcagcttcaagtacctggtgctggcgccgtgggtagcgcacggattccatcaactggcgaccaaggggtggcgcgagacggacctgggctacatcgccatcctgccgtcgatgctgctccgggcgctccacaaccaggcgtggatcaccgtgtcccggctccagaacgcgcgcggcaggaagcagatcgtggaccgcgggatcgagttcgagcaggtcgaccgggagcgcaactgggacgaccagatcatcctcagcgccatcctcttctacctgggcgcgctgcacctgccgggcgggcagcacctgccgctgtggaggacggacggcgccgtgctggtcgcgctgctgcacgcggggcccgtggagctcctctactactggtttcaccgcgcgctgcaccaccacttcctctacacccgctaccactcgcaccaccacgcctccatcgtcacggagcccatcacctctgtcatccatccatttgctgagctcgtggcctacgaactgctcttctcaatcccgatgatcgcaagcgccctgactggaactgcttcgatcgttgcatttgagatgtatatgctctacatcgacttcatgaacaacatgggccactgcaacttcgagttggtgcccacctggctcttcagatggttccctcctctcaagtatttcatgtacacgccatcgtttcattcgcttcaccacactcagttccggacaaactactcgcttttcatgccattctatgactacatatacaatacaatggacaagtcatccgacaagctgcatgagaactcactcaagaacaaggaggaagcagtagatgtggtacaccttacccatcttaccagtctgcagtccatctaccacatgaggcccgggttcgctgagtatgcctccaagccgtacacctccaagtggtacatgcggatcatgtggcctctatcgtggctctccatggtcctgacatgggtgtatggttcttggttcactgttgagaggaatgtgatgaagaaactaaggatccagtcatgggctataccaagatacaatttccattatggactgaactgggagaaggaagcaattaatagcctgattataaaggcgatacacgaagctgacaagaatggagctaaagttgttagtcttggactcctgaaccaggcacagagcctcaatggaagtggggaactctatctgcaaaagtacccaaagttgggagtaaaactggtggatggctctagcctagctgctgcagtggttgccaatagtattccccaaggcacagatcaagttgttcttgcaggaaatatttcgaaggtggcccgtgctgtggccacagcattgtgcaagaacaatatcaaggtcataatgtcaaataagcaagattatcatttccttaagcccaaaataccagaagatgcagctgacaatcttatattatcaaaaaccagcattgcaaaggtttgggtaattggagaaggtctggatactgctgaacagttcagggcgccaaaaggaacacactttatcccctactcgccattcccaccaagagctgtacgcaaggactgctgcacctactccacgactccggcaatgggtgtacctaaaactctgcagaatgttcattcgtgtgagaattggctgccaaggagggtgatgagtgcatggcgcatcgctggaattattcatgcattggaaggatggaacgagcacgagtgcggagacacagtacttgacatggacaaaatatggtctgctgcaattctgcatgggttctgccctgttgcacaagcttgatgatccttttgcaagtcaatggaataagtgttgcatggatatatgacatgttctcgctggagccatgataaggaagaagaagcaggcacatttgttagcagaggagcgaagcctctgagcagtcctgcctctgagtagtatgatttccatggatgctttgttagctattatcgcattattgtcttctatgctctttcatcgtaatgaattaatgacttggttctaatcgtaccattatctgtcctcgcatcgataatgtgatgcaacaaataaacaagaatgggcggttgggcattgtttcagtagacttggagctaatgtgcagtacaacttttttt

SEQ ID NO: 795 - DNA, 1957 bp, Brachypodium distachyon
tcctcatctctgtaaacacagtgagcgcgcggagcagccccaagggccagcacaaggcagacatggccacaaaccccggattcttgagcgagtggccatggaagaggcttggcagcttcaagtacctggtgctggcgccgtgggtagcgcacggattccatcaactggcgaccaaggggtggcgcgagacggacctgggctacatcgccatcctgccgtcgatgctgctccgggcgctccacaaccaggcgtggatcaccgtgtcccggctccagaacgcgcgcggcaggaagcagatcgtggaccgcgggatcgagttcgagcaggtcgaccgggagcgcaactgggacgaccagatcatcctcagcgccatcctcttctacctgggcgcgctgcacctgccgggcgggcagcacctgccgctgtggaggacggacggcgccgtgctggtcgcgctgctgcacgcggggcccgtggagctcctctactactggtttcaccgcgcgctgcaccaccacttcctctacacccgctaccactcgcaccaccacgcctccatcgtcacggagcccatcacctctgtcatccatccatttgctgagctcgtggcctacgaactgctcttctcaatcccgatgatcgcaagcgccctgactggaactgcttcgatcgttgcatttgagatgtatatgctctacatcgacttcatgaacaacatgggccactgcaacttcgagttggtgcccacctggctcttcagatggttccctcctctcaagtatttcatgtacacgccatcgtttcattcgcttcaccacactcagttccggacaaactactcgcttttcatgccattctatgactacatatacaatacaatggacaagtcatccgacaagctgcatgagaactcactcaagaacaaggaggaagcagtagatgtggtacaccttacccatcttaccagtctgcagtccatctaccacatgaggcccgggttcgctgagtatgcctccaagccgtacacctccaagtggtacatgcggatcatgtggcctctatcgtggctctccatggtcctgacatgggtgtatggttcttggttcactgttgagaggaatgtgatgaagaaactaaggatccagtcatgggctataccaagatacaatttccattatggactgaactgggagaaggaagcaattaatagcctgattataaaggcgatacacgaagctgacaagaatggagctaaagttgttagtcttggactcctgaaccaggcacagagcctcaatggaagtggggaactctatctgcaaaagtacccaaagttgggagtaaaactggtggatggctctagcctagctgctgcagtggttgccaatagtattccccaaggcacagatcaagttgttcttgcaggaaatatttcgaaggtggcccgtgctgtggccacagcattgtgcaagaacaatatcaaggtcataatgtcaaataagcaagattatcatttccttaagcccaaaataccagaagatgcagctgacaatcttatattatcaaaaaccagcattgcaaaggtttgggtaattggagaaggtctggatactgctgaacagttcagggcgccaaaaggaacacactttatcccctactcgccattcccaccaagagctgtacgcaaggactgctgcacctactccacgactccggcaatgggtgtacctaaaactctgcagaatgttcattcgtgtgagaattggctgccaaggagggtgatgagtgcatggcgcatcgctggaattattcatgcattggaaggatggaacgagcacgagtgcggagacacagtacttgacatggacaaaatatggtctgctgcaattctgcatgggttctgccctgttgcacaagcttgatgatccttttgcaagtcaatggaataagtgttgca

SEQ ID NO: 796 - DNA, 2254 bp, Cenchrus ciliaris
  misc_feature (1013)..(1013): n is a, c, g, or t
  misc_feature (1946)..(1946): n is a, c, g, or t
  misc_feature (2121)..(2121): n is a, c, g, or t
  misc_feature (2168)..(2168): n is a, c, g, or t
  misc_feature (2175)..(2175): n is a, c, g, or t
  misc_feature (2178)..(2178): n is a, c, g, or t
  misc_feature (2199)..(2199): n is a, c, g, or t
cactgcttgctggctactgagaaaggggcggggtggtgtgtccgcaaagagtgctcgcaatcgcaatggcgacgaaccccggcctcttcaccgagtggccatggaagaagctcggcaacttcaagtacctgctgctggcgccgtgggtggcgcacggcggctacctggcggcgaccaaggggtggcgtgcggcggacgtcgggtacctggcgatcctcccgtcgctgctactccgggcgctccacaaccaggcctggatcacggtgtcccgcgtccagaacgcgcggagccggcggcagatcgtggacaggggcatcgagttcgagcaggtggacagggagcgcaactgggacgaccagatcctcctcagcggcatcctgctctacctgggcgccctctacatgcccggcgggcagcacctcccgctgtggcgcgccgacggcttcctcctcatcgccctcctccacgccggccccgtcgagttcctctactactggttccaccgcgccctccaccaccacttcctctacacccgctaccactcccaccaccacgcctccatcgtcaccgagcccatcacctccgtcatccatccatttgctgagctcgtggcttacgaactgctgtttgcaatcccattgatcacatgcgccttgagtggatgtgcttccatcattgcatttgagatctatgtactctacatcgacttcatgaacaatatgggccactgcaattttgaattggtgccaaattggctcttcaaatggttccctcctctcaagtacctcatgtacacaccctcgttccattctcttcaccacactcagttcaggacaaactactccctgttcatgccattctatgactacatatacaacaccatggacaaatcatcagatgcgctgtatgagaaatcactcaaggacaaagaggaaacagtagacgtggttcatcttacccatcttaccagcctgcagtccatctatcatatgagacctgggtttgctgaatangcttctaagccttacacttccaagtggtacatgcggatgatgtggcctgtatcatggctttccatggttctgacatggacatatggttcttcattcactgttgagaggaacgtcatgaagaaactcaagatgcagtcatgggctattccgagatacagtttccattatggattgacttgggagaaggaagcaatcaataacctgatcgaaaaggcaatatgtgaagctgacaagaaaggggcgaaagttgttagcctcggtctccttaatcaggcacataacctcaatggcaatggagaactttacctgcaaaagtacccgaagttgggggtacgacttgtggatggcaccagcttagctgctgcagtggttgtgaatagtattccccaaggcacagatcaagttgttcttgcaggaaatatttcaaaggttgcccgtgctgttgctgcagcattgtgcaagaagaatgtcaaggtggtaatgacaaacaagcaggattatcatttccttaagcccaacatgccagaagacgcagttgataactttttgttttcgaaaacagctactgcaaaggtgtggttacttggggaaggtctagatgcttctgagcagttcaaggcacagaaaggaacccagtttatcccatattcacagtttccaccaagaatggtacgcaaggacagctgcacctactcaacaactcctgcaatggctgtgcctaaaacactgcagaatgtgcactcctgcgagaattggctgccaaggagggtcatgagtgcatggcgcattgctggaatggttcatgcattggaaggatggaacgaccacgagtgcggggatattgtgctagacatggagaaagtatggtctgctgctcttctgcacggtttccgccctgttgctcaagtttgattgttcagttgcaaatgcaangcaatccaataagttctcgtgaaaactatgctagaggcatattaggatgttgatgttctatttctcccccctcttctccttatctcttaagaccttgtctatctatataagtatatagtcaagacgaactcctttagtagaaaaccattccgtgggagctagaaaaatgcatttntatattgataagcaggaatgggagcatagaagtattttgataagctnaaagatngangattcagcaccggtgattttncatcccttaatgtgtaactgaataagaaacaggtggcagtatcagattcggtcca

SEQ ID NO: 797 - DNA, 2300 bp, Panicum virgatum
aggggccggccgggtacgcgcttgcattgtccgcaagagcggcagcagctcgcaatggcgacgaaccccggccccttcaccgagtggccatggaagaagctcggcaacttcaagtacttgctgctggcgccgtgggtggcgcacggcgggtacctggcggcgaccaaggggtggcgcgcggcggacccggggtacctggccatcctgccgtcgctgctcctccgggcgctccacaaccaggcgtggatcacggcgtcccgcgtgcagaacgcgcggagccggcggcaggtggtggccgaccggggcatcgagttcgagcaggtggaccgggagcgcaactgggacgaccagatcatcctcagcggcatcctgctctacctgggcgccctctacctgcccggcggccagcgcccgccgctctggcgcgccgacggcttcctcctcatcgcgctgctccacgccggccccgtcgaattcctctactactggttccaccgcgcgctgcaccaccacttcctctacacgcgctaccactcccaccaccactcctccatcgtcaccgagccaatcacatccgtcatccatccatttgctgagctcgtggcttatgaagtgctgttcgcgatcccattgatcacatgcgccttgactggaactgcttcaatcgttgcatttgagatctatgtgctctacatcgacttcatgaacaacatgggtcactgcaactttgaactggtgccaagttggctcttcaagtggttccctcctctcaagtatctaatgtacacaccctcgttccattctcttcaccacacacagttcaggacaaactactccctgttcatgccattctatgattacatatacaacaccatggacaagtcatcggatacgctgtatgagaaatcactgaaggccaaagatgaaacagtgggtgtggttcatcttacccatcttaccagcctgcagtccatttatcatatgagacccgggtttgcagaatacgcttctaagccttacacttccaagtggtacatgcggatgatgtggcctgtatcatggctttccatggttctgacatggacatacggcacttcattcgctgttgagaggaacctcatgaagaaactcaggatgcagtcatgggccattccgagatacagtttccattatggattgtcttgggagaaggaagcgatcaataacctaatcgaaaaggcaatatgtgaagctgacaagaaaggcgctaaagttgttagcctcggactccttaaccaggcacataacctcaatggaaatggagaactttatctgcagaagtaccctaagttggaggtacgacttgtagatggtaccagcttagctgctgcggtggttgtgaacagtattccccaaggcacagatcaagttgttcttgcaggaaatatttcaaaggttgctcatgctatcgctgcagcattgtgcaagaagaatgtcaaggtagtaatgacaaacaagcaggattatcatttccttaagcccaacatgccagaagatgcagctgagaaccttttgttttcaaaaacacctactgcaaaggtgtggttaattggggagggtctagatgcttctgagcaattcaaggcacagaaaggaacccagtttatcccatattcccagtttccaccaaaaatggtacgcaaggacagctgcacctactcaacaactcctgcaatgtctgtgccaaaaacactacagaatgtgcactcctgcgagaattggttacctaggagggtcatgagtgcctggcgcattgctggaatggttcatgcattggagggatggaacgagcatgagtgcgggaacagtgtgctagacatggagaaagtatggtcggctgctcttctgcatggtttctgccctatcgctcaagtttgattccccaattgcaattgcaaagcaatgcaataagttctcatgggagctatgctacagacatagtaggatgttgatgttctatttctccccctctacttcttatcgcttaagaccttggctatccatatataagtatatagtcaagacgaactcctttatcagcataaaaccattctgctgaagagaaaatgcatttcaatattgataaacagggatgggatgtagcatataagtattctgatctatccatagctagctgtttactaagtttctccgtccaccaatgtgtaatccaacaataagcaagtatggaaattgttgttggttgttgtatgcagaggtgtcaatgtcagatttggtcaacacttctatttgatcataat

SEQ ID NO: 798 - DNA, 2380 bp, Oryza sativa
atatgagactctgacacgtacgcacagctagatcgaagccctggtcgagtttataaattgagatatatccgtcctccattctcaggccagttcttgcaagactcttgccgtgttgagactgcagaaacgagagctagctagccagaggctgcaagaagattctgcacccatagatcgtctaccatggccacaaacccaggactcttcacggagtggccatggaagaagcttggcagcttcaagtacgtgttgctggcgccgtgggtagcgcacgggtggtatgaggtggcgaccaaggggtggcgggaggtggatctcgggtacatcgccatcctcccgtcgttgctgctgcggatgctgcacaaccaagcctggatcaccatctcccgcctccaaaacgcccgtggccgccgccagattgttcgccgcggcatcgagttcgaccaggttgaccgcgagaggaactgggacgaccagatcatcctgagcggtatcctactatacctcggcgcactgtacgtaccgggcgggcaacacttaccgctgtggaggacggatggcgcggggctgatcgccttgctgcatgcggggccagtggagttcctctactactggttccatcgtgcgttgcaccaccactttctctacacccactaccactcgcaccaccactcttcaatcgtcactgagcccatcacatccgtcatccatccgtttgctgagctcgttgcctacgaattgctcttctcgatcccactgatcgcctgtgccttgactggaactgcttccataattgcattcgagatgtatttgatttacattgatttcatgaacaacatggggcactgcaacttcgagttggtacccagctggctcttcacatggttccctcctctcaagtatctcatgtacacgccatcgtttcattctctgcaccacactcagtttcggacaaactactcccttttcatgccgttctacgattatatctacaacaccatggacaagtcatcagacactctgtatgagaactcactgaaaaacaatgaggaagaagaagcagtggatgtggttcaccttacacacctgaccaccctgcattccatctaccacatgaggcccggtttcgccgaatttgcgtccaggccctacgtttccaggtggtacatgaggatgatgtggcctctgtcatggctctccatggtgctgacatggacgtacggttcttcattcactgttgagaggaatgtcatgaagaagatcaggatgcagtcatgggccataccaagatacagtttccattatggattggattgggagaaggaagctatcaatgatcttatcgaaaaggcggtatgtgaagctgacaagaatggggctaaagttgtaagccttggactcctgaatcaggcacataccctgaataaaagtggagaacaatatctgctgaaatacccaaagttgggagcaagaattgtcgatggaaccagcttagctgctgcagtggttgtcaacagtatcccccaaggcacagaccaagtaattcttgcaggaaatgtttccaaggtggcgcgtgctgtagcgcaagcattatgcaagaaaaatatcaaagtcacgatgacaaacaagcaagattatcatttactcaagccagaaataccagaaactgtagctgacaatctttcgttttcgaaaacaggcaccgcaaaggtttggttaattggtgatggtctagattctgctgaacaattcagagcacagaaaggaactctgtttatcccatactcacaatttcctccaaagatggtacgcaaggacagctgcagctactcgacaactcctgcaatggctgtaccaaaaacgctgcagaatgtgcattcatgcgagaattggctgccaaggagggttatgagcgcatggcgaatcgcgggaattcttcatgcgttggagggatggaatgagcatgaatgtggtgacaaggtgcttgatatggacaaagtttggtctgctgcaattatgcatgggttctgcccagttgctcaaggttgatgattcagttgcaaagtatcagaataagttttagctggattatgctatgtggtcaccgtatcagaaagagagatgttctgttggcaagaagagatatagtatctgagtaatttcatctgccatggtttttaaaacattgttcatcatctcctttgatcaaagactggccatggctactttctgtataagtatctgtcctttttagtccatagtgtaattcagcaacaaaacactcttggcattgttatgcagtctcatgaatgtttttccagcatacggaattacggatcaactcatgaatgctttggggttctatgagcctagctttccg

SEQ ID NO: 799 - DNA, 2247 bp, Sorghum bicolor
agttcactggtggctgggactagatcacaaatcacagggaagcagtggtagtggtaccttgcaatggcgacgaaccccggcctcttcaccgagtggccatggaagaagctcggcaacttcaagtacctgttggtggcgccgtgggtggcgcacggcgtctacctcgtggcgaccaaggggtggaaggcggccgacctggggtacatggccatcttcccgtcgctgctcctccggatgctgcagaaccaggtgtggatcaccgtgtcgcggctccagaacgcgcgcggccggcggcagatcgtggacaggggcatcgagttcgagcaggtggaccgggagcgcaactgggacgaccagatcctcctcagcggcatcctcatgtacctgggcttcatgtacatccccggcgggcagcacctgccgctgtggcgcacggacggcgccgtgctcatcgcgctgctgcacgccggccccgtcgagctcatctactactggttccaccgcgcgctgcaccaccacttcctctacacgcgctaccactcccaccaccacgcatccatcgtcaccgagccaatcacctccgtcatccatccatttgctgagctcgtggcatatgaactactgttctcgatcccattgtttgtgtgcatcttcaatggaactgcttccattcttgcatttgtgatctacgtgagctacatcgacttcatgaacaacatgggtcactgcaactttgaattggtacccaattggctcttcaaatggttccctcctctcaagtatctcatgtacacaccctcgtttcattctcttcaccacactcagttcaggacaaactactccctgttcatgccattctatgactacatatataacaccatggacaagtcatcagacacgttgtatgaaaagtcactcaagggcaaagaagaaacagtagatgtggttcatcttacccatcttaccagcctgcactccatctatcatatgaggcccgggtttgcagaatacgcttctagaccttacgcttccaagtggtatgtgcggatgatgtggcccatgtcatggatttccatggttctgacatggacatatggttcttcgtttactgttgagaggaacgtcatgaagaaactcaaaatgcaatcatgggccatcccaagatacagtttccattatggattgacttgggagaaggaagcgatcaatagcctgattgagaaggcgatatgtgaagctgacaagaatggagctaaagttgttagcctcggactccttaaccaggcacataacctcaatggaaatggagaactttatcttcagaagtatccaaagttgggagtaagactcgtagatggcaccagcttagctgctgctgtggttatgaatagtattcctcaaggcacagatcaagttgttcttgcaggaaatatttcaaaagttgctcgtgctgttgctacagcattatgtaggaagaatatcaaggtagtaatgaccaacaagcaggattatcatttccttaagcccagcatggcagaagatgcagctgagaaccttttattttcaaagacagctactgcaaaggtgtggttaattggggaaggtctagatgcttctgagcagtttaaggcacataaagggacccagtttatcccatattcacagtttccaccaagaatggcacgcaaggacacctgcacctactctataacgcctgcaatggctgtgcctaaaacactacagaatgtgcactcctgtgagaactggctgccaaggagggtcatgagtgcatggcgcattgctggaatggttcatgcgttggagggatggaacgagcatgagtgtggggacatcgtgctagacatggagaaagtgtggtctggtgctcttctgcatggattccgccctgtggctcaagtttgattctccggttgcaattgcaaggcagcgcaataagttattgaaagttatgtcatatgctcatgagaattatgctacagacatagtagtatgttgatgttctattctccatgctctgcctcttatcactttaagaccttcgctatctaaaatttaagatgaactcctttcgtgtaaaagcattctgtggaagcaggataaaaaaattacatgtctataatgataagcagggatgggatgtagcatataagtgttctgatctactgctagctgtttactactttattcacaccgtacactcaaagaccaatgatgaattaattctgc

SEQ ID NO: 800 - DNA, 2455 bp, Zea mays
ctaggacgagatcagttagtagttcaccagagttcacacaaaaatcacaagcaagcagtcgcgtgtgtagctcgcaacaatggcgacgaaccccggcctcttcaccgagtggccgtggaagaagctcggcaacttcaagtacctgctgctggcgccgtgggtggcgcacggcggctaccaagcggcgaccaaggggtggagggcggccgacctggggtacgtggccatcctcccgtcgctgctcctccgggcgctgcacaaccaggcgtggatcaccgcgtcccgcctgcagagcgcgcgcggccggcggcaggtcgtggaccgcggcatcgagttcgagcaggtggaccgcgagcgcaactgggacgaccagatcctgctcagcggcatcctcctgtacctgggctccacctacctgccggggggccagcacctgccgctgtggcgcgcggacggcgccgcgctcatcgcgctgctgcacgccggccccgtcgagctcgtctactactggctgcaccgcgcgctgcaccaccacttcctctactcccgctaccactcccaccaccacgcctccatcgtcaccgagccaatcacctccgtcatccatccatttgctgagctcgtggcgtatgaactattgttctcaatcccattgattgtgtgcaccttgaacggaactgcttcaattattgcatttgagatttacgtgatctacatcgacttcatgaacaacatgggccactgcaactttgaattggtgcccaattggctcttcaaatggttccctcctctcaagtatctcatgtacacaccctcgtttcattctcttcaccacactcagttcaggacaaactactccctgttcatgccattctatgactacatatataacaccatggacaagtcatcggacacgttgtatgagaagtcactcaagggaaaagaagaaacggcagatgtggttcaccttacccaccttaccagcctgcactccatctatcatatgaggcccgggtttgcagaatatgcttctagaccttacactgccaagtggtatgtgcggatgatgtggccgatgtcatggctctccatggttctgacatggtcatatggttcttcatttactgttgagaggaacgtcatgaagaaactcaaaatgcaatcatgggtcatcccaagatacagtttccattatggattgagttgggagaaggaagcaatcaatagcctcgttgagaaggcaatatgtgaagctgacaagaaaggagctaaagttgttaccctcggactccttaaccaggcacataacctcaacagaaatggagaactttatcttcagaagtgcccaaagttgggagtaagactcgtagatggcaccagcttagctgctgcagtagttgtgaatagtgttcctcaaggcacagatcaagttgttctcgcagggaatatttccaaagttgctcgtgctgttgccgcagcattgtgtaggaagaatatcaaggtagtaatgaccaacaagcaggattaccattttcttaagcctaacatggcagaagatgcagctgagaaccttttgttttcaaagacaactactgcaaaggtgtggttaattggggatggtctagatgcttctgagcagtttaaggcacagaaagggacccagtttatcccatattcacagtttccaccaagaatggcacgcaaggacacctgcacctactcgacaactcctgcaatggttgtacctaaaacactacagaatgtgcactcctgtgagaattggctgccaaggagggtcatgagtgcatggcgcattgctggaatggttcatgcattggagggatggaacgagcatgagtgtggggacatcgtgctagacatggagaaaatgtggtctggtgctcttctgcatggtttccgccctgtggctcaagtttgattctccagttgcaaatgcaaggcagcacaataagttattgaaagttataacataatgctcgcgagaactatgctacatacatatcagtatgttggtgttctgtacttctgtttgtccatgctctgcctcttatcacttaagacatctgctatctatgaagttaagatgaactcatgtagtgtaaaaaccattctgcagaagcagggtgaaaaatagcatctctacaatggtaagaggggatgggatgtagtatataagtgagtctgatctactgctagatgtttactactttattcacaccctacgctcaaagatcaacgatgaattaattatgcgtcgatatttctccatgcatcaatgcatatttcaacaaggaaaagtatgagaaatgctattcattctccatgtagagatgtggatgaaagatctgcttcaatgcttcattttgttcatgatccagagaaagtagagatgtcatgtaagatgtaacagtggcccatattgcccatgacgaaa

SEQ ID NO: 801 - DNA, 2337 bp, Panicum virgatum
cttccggccggctgctgagagggtgagggtgtagcgcccgaacgggtgagagcgcttgcattgtccacaagagcggcggcagctcgcaatggcgacgaaccccggccccttgaccgagtggccatggaagaagctcggcaacttcaagtacctgcttgtggcgccgtgggttctgcacgggtggtacctggcggcgaccaaggggtggcgcgcggcggacccggggtacctggccatcttcccgtcgctgctcctccgggcggcccacaaccaggcgtggatcacggcgtcccgcgtgcagaacgcgcggagccggcggcagatcgtggcggacaggggcatcgagttcgagcaggtggaccgggagcgcaactgggacgaccagatcctcctcagcggcatcctcctctacctgggcgccctctacatgcccggcggccagcacccgccgctctggcgcgccgacggcttcctcctcatcgcgctgctccacgccgggcccgtcgagttcctctactactggttccaccgcgcgctgcaccaccacttcctctacacgcgataccactcccaccaccattcctccatcgtcacagagccaatcacatccgtcatccatccatttgttgagctcgtggcttatgaagtgctgttcgcgatcccattgatcacatgcgccttgacaggaactgcttcaatccttgcattcgagatctatgttatctacgtcgacttcatgaacaacatgggtcactgcaacttcgaactggtgccaagttggctcttcaagtggttccctcctctcaagtatctaatgtacacaccctcgttccattctcttcaccacacacagttcaggacaaactactccctgttcatgccattctatgattacatatataacaccatggacaagtcatcggatgcgctgtatgagaaatcactgaaggccaaagaggacacagtagatgtggttcatcttacccatcttaccagcctgcagtccatttatcatatgaggcccgggtttgctgaatacgcttccaagccttacacttccaagtggtacatgcggatgatgtggcctgtatcatggctttccatggttctgacatggacatacgggacttcattcgctgttgagaggaacatcatgaagaaactcaagatgcagtcatgggccattccgagatacagtttccattacggattgacttgggagaaggaagcgatcaacaacctaatcgaaaaggcaatatgtgaagctgacaagaaaggcgctaaagttgttagcctcggactccttaaccaggcacatagcctcaatggaaatggagaactttatctgcggaagtacccaaagttggaggttcgacttgtagatggcaccagcttagctgctgcggtggttgtgaacagtattccccaaggcacataccaagttgttcttgcaggaaatatttcaaaggttgctcgtgctgtcactgcagcattgtgcaagaagaatgtcaaggtagtaatgacaaacaagcaggattatcatttccttaagcccaacatgccagaagatgcagctgagaaccttttgttttcaaagacacctactgcaaagttgtggttaattggggaaggtctagatgcttctgagcaattcaaggcacagaaaggaacccagtttatcccatattcccagtttccaccaaaaatggtacgcaaggacagctgcacttactcatcaactcctgcaatgtctgtgccaaaaacgctacagaatgtgcactcttgcgagaattggttaccgaggagggtcatgagtgcctggcgcattgctggaatggttcatgcattggagggatggaacgagcatgagtgtggggacagtgtgctagacatggagaaagtatggtctgctgctcttctgcatggtttccgccctattgctcaagtttgattccccaattgcagttgcaaggcaatgcaataagttctcatgggagctatgctacagacatagtagggtgttgatgttctatttctccccctctatttcttatcgcttgcgaccttttggctatccatataagtatatagtcaagacgaactcttttatcagcacaaaaccattccgctgaagtggagaaaatgcatttcaatatggataagcagggatgggatgtagcatataagtattctgatctatcaaagctagctgtttactacgtttctccatccatcaatgtgtaattctacaataagcaagtatggaaattgttgttgcttgttgtatgcagaggtgtcaatgtcagatttggtccaacacttgagtttgatcataat

SEQ ID NO: 802 - DNA, 1903 bp, Brachypodium distachyon
ttgcaatggctacgaaccccggcatcctcagcgagtggccatggaagaggctcggtagcttcaagtaccttgtgctggcgccatgggtggtgcacgggtgtcacctggcggcgaccaaagggtggcgggagctggacctggggtacgtggccatcctgccgtcgatgctgctccgggcgctccacgaccaggcctggatcaccgtgtcccgcctctacaacgcgcgcggcaagcgccagatcgtccgccgtggcatcgagttcgaccaggtcgaccgcgaacgcaactgggacgaccagatcatcctgagcgccatcctgctgcttctgggcgcggtttacctgccgggcgggcagcacctgccgctgtggaggacggacggcgcggtgctgctcgcgctgctgcacgcgggccccgtggagttcctctactactggttccaccgtgcgctgcaccaccacgtcctctacacccgctaccactcgcaccaccacgcctccatcgtcacggagcccatcacatccgttatccatccatttgctgagctcttggcctatcaactgttgttctcaatcccaatgatcacctgcgccttgactggaactgcttcaattatcacgttcgagatctatgtgatctacattgacttcatgaacaacatgggccactgcaacttcgaattggtacctaattggctcttcgaatggatcccccctctcaagtatctcatgtacacaccatcatttcattctctacaccacacccagttccggacgaactactctctttttatgccattctatgactacatatacaacaccatggacaagtcatcggagacgctgtatcaagactcactcaaggacaagaacgaggagaaagaagtagatgtggttcaccttacccatcttaccagcctgcagtccatttatcatataaggcccgggttcgcgcaatacgcttccaggccatacacttccatgtggcacctgcggatcatgtggcctgtgtcatggttgtccatggtgctgacatggtcgtatggttcttggttcactgttgagagaaatgtcatgggcaaactcaggatgcagtcttgggctataccaagatacaggttccattatggattgaaacaggaaaaggaagcaatcaacgacctgattgagaaggcgatatccgaagctgacaagaagggaactaaagttgttagtctcggactgctgaatcaggcacataacctcaatcgaagtggagaactatatctgcagaaatacccaaagttgggggtaaggatcgtggatggcaccagcttagccgctgctgtggttgtcaatagcatccccaagggcacaaatcaagttatccttgcaggaaatatttcaaaggtggcccttgctgttgcttcagcattgtgcaaaaaaaatgtcaaggtcatactgacaaacaagcaggattaccattcccttaagcccaatataccacaaaattcagccagcaatcttgtactatcaaacactgacagcgcaaaggtgtgggtgattggagaaggtctggatgctgctgaacagctcaaggcagagaaaggcacacagtttatcccatactcgcagttcccaccaagaatggtacgcaaggactgctgcacttatttgactactcctgcgatgagtgtacctaaaacaatgcaaaacctgcattcatgcgagaattggctgccaaggagggtcatgagtgcatggcgcatcgctggaattgttcatgcgttggagggatggaaggaagacgagtgcggagacacggtgctagacatggagaaagtatggtctgctgcagttatgcatgggttcagccccgttgctcatgcttgatgctctctggttgtggtcagtaagtcagtgta

SEQ ID NO: 803 - DNA, 1798 bp, Triticum aestivum
tcggcacgaggcaggcaggcaccggtcgtgaggcagagagagagaaccagagccagacatgcagcgcctcgcctcctcccggaggctcctccgggccgccctcgcccccggccgggcgcattccagcctctccgcggccgcggtcgccgccgcgccggagaatggcgccggcgcccccaagatgccgccgttcgcgtacacgccgccgccgtacgacgggccgcgggtggcggagatcgcccagaagcgcgcccagttcctcagcccctcgctcttccacttctacgaccgccctttgaacatagtcgatggaaagatgcagtacctgttcgatgaggatggccgccgctacctggacgctttcggtggcattgcgaccgtttgttgcgggcactgccatcctgatgtgatcgaagccatagtcaaccaggcaaagaagatacagcactccacagttctgtatctgaaccatgcaattgccgactttgctgaggctctggcggccaaaatgcccggtgatctgaaggttgttttcttcacaaattctggcacggaggcaaatgagcttgcactgatgatcgctcggctttacactggttcccatgacattatttcacttaggaatggataccatgggaatgcagctgcaacaatgggtgccactgctcaatccaactggaaatttaatgttgtccagaccggagtgcaccatgctcttaatccagacccatatagaggcgctttcgggtcagacggagagaaatatgccagagatattcaggaaaccattgactatgggactacaggaagagttgcaggtttcatttcagaagccatacagggagttggtggaatagtggaattagcaccaggatacctgcctgcggcctacgatatggtaaggaaagctggtggcctctgcatcgccgacgaagttcaggcgggggttgcgcgcactggaagccacttctggggattcgaagggcagggtgtcatccctgatatagtcactatggcaaagggcatagggaacggaataccgataggagcggtcgttaccacacctgagattgctaaggtgttaacccgcaggagctacttcaacaccttcggtggtaaccctgtcagcacagctgccggccacgctgttctcaaggtactggagaaggagaagctgcaggagaatgcgttcgttgttggctcctacctgaaggagaaacttaacgctctgaaagagaagcatgacattatcggcgatgttagggggaaaggcctccttctcggggttgagctggtgaccgatcgccagaagaaaactccggcgaaagctgagatcgcgcaggtcatgaaccacatgaaagatatgggcgtgctggtggggaagggcggtttcttcggcaatgtgttcagggtgacgcctccgttgtgcttctccaaggaggactccgacttcatgatcgaggtgatggacatcgcgctgtcgaagctgtgaagaggcactgctctcatcgataaataagagacgatctgcgaaacagcacctcgttgtctcgtgttctgtcttgcaaacccatgatgcgcacatgcgatctgcgcctcctgaacattagtatgatgtactgagtaggagctctatgtgaccaataagttcttcgtaataagatattcagatgtgttatggcagcttttatgatacatgtatcctgcattcttcctgctatccagaaaacaaagcattgccacatttacttgtcagaattccaggtgattaaaaaaatgaattgaccattaaaatcgt

SEQ ID NO: 804 - DNA, 1906 bp, Brachypodium distachyon
cagagcaccgtttcaggaaaccccacgcgcagagagagaaacagaggcgtccgacatgcagcgcctcgcgtcctcccggaggctcctccaggcggcgcttgcccccggcggccgggcacattccagcctctcagccgccgcggtcgccgcctcgccgcagaatggcggcggcgcccccaagatgcctccgttcgactacacgccgccgccgtatgacgggccgcgggtggcggaggtcgcccggaagcgggccgagttcctcagcccctccctcttccacttctacgaccgccctctgaacatagtggatggaaagatgcagtacctgttcgatgaggatggtcgccgctacctagatgcctttggtggcattgcaactgtttgttgtgggcactgccatcctgatgtgattgaagccatagtcaaccaggcaaacaagatacaacactccacagtcttgtatctgaatcatgcaattgcagactttgctgaggctttggcatccaaaatgcctggagatttgaaggttgttttcttcacaaattcgggcacggaggcaaatgagcttgcgctaatgattgcccggctttacactggttgccatgacattatttcgcttaggaatggataccacgggaatgcagctgcaacaatgggtgctactgctcaatgcaactggaaatttaacgttgtccagactggagtgcaccatgctcttaatccagacccatatagaggtgctttcggttcagatggagagaagtatgcaagagatattcaggagaccattgattatgggactacagggagagttggtggttttatttcagaagccatacaaggagttggtggaatagtggaattagcaccaggatacttgcctgcagcgtacaatatgataaggaatgctggtggcctctgcatcgctgacgaagttcaggcgggagttgcacgaactggaagccacttctggggatttgaagggcatggtgtcatcccagatatagttacaatggcaaagggtatagggaatggcataccgataggagcagttgttacaactcctgagatcgctcaggtgctaacccgccgaagttatttcaacacctttggtggtaaccctgtcagtaccgctgccggtcacgctgttctgaaagtactggagaaggagaagctccaggagaatgcatttgttgtcggttcctatctgaaggaccaacttaacattctgaaagagaagcatgatattattggtgatgtaaggggaagaggctttcttctgggagtcgagctggtaactgaccaccaaaagaaaactccggcgaaagttgagattgcccatgtcatgaaccacatgaaagatatgggtgtgctggtggggaagggtggtttctacggtaacgtgttcagggtaacacctccgttgtgcttctctaaagaggactccgatttcttcatcgaggtgatggacaccgcattgtcaaagctgtgaagcagtagagcgaagctaaaagggtgcacatccaggcaatggcatgggatccatatccataaataagagacgatctgtgagacagcacctcgttgtctcatgatctgtcttgcaaacccatgatgcgcatcaacttaagctgtcgtcaaatcagctgttcctgaacatggttaataagttctttgtaatcagacgatattcagatgtgtcattgtatgccagcttttagatccctacatcttcctgttaaccagaaaacaaagcaactgccattcacttccgagaatcccgatcgatacaagaatgtgaattcgccagtaccattgtacagaaaatgttagcaaattatcttgattgcaaacacttttagtcaacacacgcaaatgatgaaacgaatcagcaaattaggacaga

SEQ ID NO: 805 - DNA, 1650 bp, Brachypodium distachyon
cagagcaccgtttcaggaaaccccacgcgcagagagagaaacagaggcgtccgacatgcagcgcctcgcgtcctcccggaggctcctccaggcggcgcttgcccccggcggccgggcacattccagcctctcagccgccgcggtcgccgcctcgccgcagaatggcggcggcgcccccaagatgcctccgttcgactacacgccgccgccgtatgacgggccgcgggtggcggaggtcgcccggaagcgggccgagttcctcagcccctccctcttccacttctacgaccgccctctgaacatagtggatggaaagatgcagtacctgttcgatgaggatggtcgccgctacctagatgcctttggtggcattgcaactgtttgttgtgggcactgccatcctgatgtgattgaagccatagtcaaccaggcaaacaagatacaacactccacagtcttgtatctgaatcatgcaattgcagactttgctgaggctttggcatccaaaatgcctggagatttgaaggttgttttcttcacaaattcgggcacggaggcaaatgagcttgcgctaatgattgcccggctttacactggttgccatgacattatttcgcttaggaatggataccacgggaatgcagctgcaacaatgggtgctactgctcaatgcaactggaaatttaacgttgtccagactggagtgcaccatgctcttaatccagacccatatagaggtgctttcggttcagatggagagaagtatgcaagagatattcaggagaccattgattatgggactacagggagagttggtggttttatttcagaagccatacaaggagttggtggaatagtggaattagcaccaggatacttgcctgcagcgtacaatatgataaggaatgctggtggcctctgcatcgctgacgaagttcaggcgggagttgcacgaactggaagccacttctggggatttgaagggcatggtgtcatcccagatatagttacaatggcaaagggtatagggaatggcataccgataggagcagttgttacaactcctgagatcgctcaggtgctaacccgccgaagttatttcaacacctttggtggtaaccctgtcagtaccgctgccggtcacgctgttctgaaagtactggagaaggagaagctccaggagaatgcatttgttgtcggttcctatctgaaggaccaacttaacattctgaaagagaagcatgatattattggtgatgtaaggggaagaggctttcttctgggagtcgagctggtaactgaccaccaaaagaaaactccggcgaaagttgagattgcccatgtcatgaaccacatgaaagatatgggtgtgctggtggggaagggtggtttctacggtaacgtgttcagggtaacacctccgttgtgcttctctaaagaggactccgatttcttcatcgaggtgatggacaccgcattgtcaaagctgtgaagcagtagagcgaagctaaaagggtgcacatccaggcaatggcatgggatccatatccataaataagagacgatctgtgagacagcacctcgttgtctcatgatctgtcttgcaaacccatgatgcgcatcaacttaagctgtcgtcaaatcagctgt

SEQ ID NO: 806 - DNA, 1950 bp, Sorghum bicolor
aacccagcaagcaactccgtcccgcacccgcgccgctccggtaggacccccgacccgaccacccgcgaaaaccacagcgccgcacatgcagcgcctcgcctcctcccggaggctcctccaggcggcgctcgtccccgcccgggccaactccagcctctccgcggccgccgtcgccgcgcccgcgccagagaatggcgccgacgccgtccccaagatgccggccttcgactacacgccgccgccgtacgacgggccgcgcgccgacgagatcttccggaagcgggctcagttcctcagcccgtccctcttccacttctacgatcgccctttgaacatagtcgacggaaagaagcagtacctatttgatgaggatggccgtcgttacctggatgcttttggtggcattgcaacagtttgttgtgggcactgccatccagatgtggttgaagccatagtgaaccaggcaaagcggatccagcactccacggttctatatctcaatcatgccattgcagattttgcagaggcattggcttccaaaatgcctggtgatctgaaggttgttttcttcacaaattcaggcacggaggcgaatgagcttgcactgatgattgcacgcctttacactggttgcaatgacatcatctcacttaggaatggataccatgggaatgctgctggaacaatgggtgctaccgctcaatccaattggaaatttaatgttgttcagacgggagtacaccatgcgcttaatccagacccctacagaggtgcttttggttctgacggagagaaatatgccagagatgttcaggaaatcattgaatttggaactacagggagagttggtggtttcatttcggaagccatacagggggttggtggaatagtggaattggcaccaggatacttgcctgtggcatatgatatggtaaggaaagccggtggactctgcatcgctgacgaagttcaggcaggagttgcgcgaactggaagccacttctggggattcgaagggcatggtgtcatcccagacatagtcaccatggccaagggtattgggaatggcatacccataggagctgttgtgacaacaccagagattgctcaggtcttgacccgcagaagttacttcaataccttcggtggtaaccctgtcagcactgcgggcgggcatgcagtgctcaaagtgctggagaaggagaagctccaggagaatgcgtttgttgtaggctcctatctaaaggaacagcttaacaagcttaaagagaagcatgaaatcattggtgatgttaggggcaaaggcttccttcttggagttgagctggtgacagaccgtgaaaagaaaaccccagcgaaagctgagatctcacatgtcatgaaccatatgaaagatatgggagtgctggttgggaagggtggtttctatgggaacgtttttaggataacaccaccgttgtgcttcaccaaagaggattccgacttcttcattgaggtgatggacattgcgctctcgaagctgtgaggcaggcagggcgaagatgatgtgcatactctggtccgttggcatgggaattttacccataaataatgttgcgatttgtgagacagcacctcgttgtctcttaatctaggacgatgccatgtcatccgctgatccgtaggcatggtattcttgctcataaataagagacgagttgtgagacagcacctcgttgtctcgtaatctgtctcgcagacccatggagtagcaactgtttgtttgtgacccatatcaacttcttttcagatgctccacatatttctgctctccgttgacaaatacttatcgatgttcaatagatgctagatgcggctttacaaattacatacatacagtagcagtgatttggcaggaaagaaaacgttaacgtagaatccaaaataaaatgttcacgaattaaatgaaca

SEQ ID NO: 807 - DNA, 1817 bp, Sorghum bicolor
aacccagcaagcaactccgtcccgcacccgcgccgctccggtaggacccccgacccgaccacccgcgaaaaccacagcgccgcacatgcagcgcctcgcctcctcccggaggctcctccaggcggcgctcgtccccgcccgggccaactccagcctctccgcggccgccgtcgccgcgcccgcgccagagaatggcgccgacgccgtccccaagatgccggccttcgactacacgccgccgccgtacgacgggccgcgcgccgacgagatcttccggaagcgggctcagttcctcagcccgtccctcttccacttctacgatcgccctttgaacatagtcgacggaaagaagcagtacctatttgatgaggatggccgtcgttacctggatgcttttggtggcattgcaacagtttgttgtgggcactgccatccagatgtggttgaagccatagtgaaccaggcaaagcggatccagcactccacggttctatatctcaatcatgccattgcagattttgcagaggcattggcttccaaaatgcctggtgatctgaaggttgttttcttcacaaattcaggcacggaggcgaatgagcttgcactgatgattgcacgcctttacactggttgcaatgacatcatctcacttaggaatggataccatgggaatgctgctggaacaatgggtgctaccgctcaatccaattggaaatttaatgttgttcagacgggagtacaccatgcgcttaatccagacccctacagaggtgcttttggttctgacggagagaaatatgccagagatgttcaggaaatcattgaatttggaactacagggagagttggtggtttcatttcggaagccatacagggggttggtggaatagtggaattggcaccaggatacttgcctgtggcatatgatatggtaaggaaagccggtggactctgcatcgctgacgaagttcaggcaggagttgcgcgaactggaagccacttctggggattcgaagggcatggtgtcatcccagacatagtcaccatggccaagggtattgggaatggcatacccataggagctgttgtgacaacaccagagattgctcaggtcttgacccgcagaagttacttcaataccttcggtggtaaccctgtcagcactgcgggcgggcatgcagtgctcaaagtgctggagaaggagaagctccaggagaatgcgtttgttgtaggctcctatctaaaggaacagcttaacaagcttaaagagaagcatgaaatcattggtgatgttaggggcaaaggcttccttcttggagttgagctggtgacagaccgtgaaaagaaaaccccagcgaaagctgagatctcacatgtcatgaaccatatgaaagatatgggagtgctggttgggaagggtggtttctatgggaacgtttttaggataacaccaccgttgtgcttcaccaaagaggattccgacttcttcattgaggtgatggacattgcgctctcgaagctgtgaggcaggcagggcgaagatgatgtgcatactctggtccgttggcatgggaattttacccataaataatgttgcgatttgtgagacagcacctcgttgtctcttaatctaggacgatgccatgtcatccgctgatccgtaggcatggtattcttgctcataaataagagacgagttgtgagacagcacctcgttgtctcgtaatctgtctcgcagacccatggagtagcaactgtttgtttgtgacccatatcaacttcttttcagatgctccacatatttctgctctccgttg

SEQ ID NO: 808 - DNA, 1822 bp, Oryza sativa
atcaaccacttcacacgcgcgcgccgcccgccgggaaggaagccaacgccgacgccgacatgcagcgcctcgcctcctcccggaggctcctccaggcggcgctcgcccctgtccgtgcccagtccagcctctccgccgcggcggccgccgccgcgcccgcgccggagaatgccttcgccgccgccccgaagatgccgccgttcgactacacgccgccgccgtacgacgggccgcgggcggaggagatctcccggaagcgggccgagttcctcagcccctccctcttccacttctacgaccgccctttgaacatagtcgatgggaaaatgcagtacctgttcgacgaggatggccgccgttacctggatgcttttggtggcattgcaaccgtttgttgcgggcactgccatccggatgttgttgaggcgatggtcaaccaagcaaagaggatacaacactccacagttctttacctgaatcatgctattgcagattttgccgaggcattggcagccaaaatgcctggtgatctgaaggttgttttcttcacaaattctggcacggaggcgaacgagcttgcactgatgattgcccggctttacactggttgccatgacattatttcactcaggaatggataccacgggaatgcggctggaacaatgggtgctaccgctcaatgcaactggaaatttaatgttgttcagacgggagtgcaccatgcacttaatccagacccatatagaggtgctttcggttctgatggcgaaaagtatgcccgagatgttcaggaaatcattgattttggaactacaggaagggtcggtggtttcatttcggaagccatacagggagtgggtggaatagtggaactggcaccaggatacttgcctgctgtgtacaatatggtaaggaaagctggcggcctctgcatcgccgacgaagttcaggcgggagtcgcacgaactggaagccacttctggggatttgaatcgcacggcgtcatcccagacatagttacaatggcaaagggtataggcaatggcataccgatcggagcagtcgtcacaacccctgagatcgctcaggtgttaacccgcaggagctacttcaacaccttcggtggcaaccctgtcagcacagccggtggccatgctgttctcaaggttctggagaaggagaagctccaggagaacgcatttgtggttggctcctacctgaaggaacggctcaacaagctgaaagagaagcatgacatcattggtgatgttagagggaaaggcttccttcttggggttgagctggtgaccgatcgccagaagaagacaccggccaaagttgagatcggtcatgtcatgaaccacatgaaagacatgggtgtgctggttgggaaaggtggtttctacgggaacgtgttcagagtaacacctccactatgcttcaccaaagaggactccgatttcttcattgaggcgatggacatttcactatcgaagctgtgagtcggagagggactggcaggatcaacctgtccgcatgtgatccgtatccataaataatgttggggattggtgagatagcacctcgttgtctcgtaatatgtcctgcaaacccaccatgcgctgctcaacacatggtccaataggcgctcctccggtctctaatcagatgtgttgtgactcgtgaccaataagcgcatgtcaatgtcagatgtattgttatagttattgtttacatgctgaacgacaaaacgaaccaatcacaatgcccaggcgatgtaaatgttgaaacaattatattggcaaatgtcagtgatttcgca

SEQ ID NO: 809 - DNA, 1919 bp, Zea mays
atcaaccagcgactcacacacccgcgcgccgcttctgtagggccccaaccaaccgcgcagggagaaaaccaccacagcacatgcagcgcctcgcctcctcccggaggctcctccaggccgcgctcgcccccgcccgggccaactccagcctctccgcggccgccgtcgccgcgcccgcgccagcgaatggcgccttcccgaagatgccggccttcgactacacgccgccgccgtacgacgggccgcgcgccgaggagatcttccggaagcgcgctcagttcctcagcccatccctctttcatttctacgatcgcccattgaacatagtcgaaggaaagatgcagtacctatttgatgaggatggccgtcgttacctggatgctttcggtggcattgcaacagtttgttgtgggcactgccatccagatgttgttgaagccatagtaaaccaggcaaagcggatccagcactccacagttctatatctcaatcatgcaattgcagattttgccgaggcattggcttccaaaatgcctggtgatctgaaggttgttttcttcacaaattcaggcacggaggcaaatgagcttgcactgatgattgcacggctttacactggttgcaatgacattatctctcttaggaatggataccatgggaatgctgctggaacaatgggtgctactgctcaatccaattggaaattcaatgttgttcagacgggagtacaccatgcgcttaatccagaccccttcagaggtgcttttggttctgacggggagaaatacgccagagatgttcaggaaatcatcgaatttggaactacagggagagttggtgggttcatttcggaagccatacagggggttggtggaatagtggaactggcaccaggatacttgcccgtggcatacagtatggtaaggaaagccggtgggctctgcatcgccgacgaagttcaggcaggagtcgcgagaactggaagccacttctggggattcgaagggcatggtgtcatcccggacatagtcaccatggccaagggtatcgggaatggcatacccataggagctgtagtaacgacgccagagatcgctcaggtgttgacccgcagaagctacttcaatacctttggtggtaaccctgtcagcactgcaggcgggcatgcggtgctcaaagtgctggagaaggagaagctccaggagaatgcgtttgttgtgggctcctacctaaaggaacagcttaacaatctgaaagacaagcatgagatcatcggtgacgttaggggcaaaggcttccttcttggagttgagctggtgacagaccatgaaaagaaaaccccagccaaagctgagatctcacgtgtcatgaaccatatgaaagatatgggagtgttggttggtaagggtggtttctacgggaacgtttttaggataacaccaccgttgtgcttcaccaaagaggattccgacttcttcattgaggtgatggacattgcgctctcgaagctgtgaggcaagcagggcgaagatgatgtgcaaaccctggtccgtcgccatgggatttttgcccatgaataatattaagattaatgagacagcacctcgttgtctcttaatctaagacgatgccatgtcatccggtggcatggtattcctaatcctacctgccaaatcactggtattgctcgctgtctcgtaatcagacccatggagcaatatgattcttgtaaactctagcttcatccaatctgttcctcctgatctaactagtctgaatagcagctgttcgtttgtgaccaatatcaacttcttttcagatgctccatatattcctgctctctgtaaacaaaccattatcactgttcaatagatgcggagatgtggatataaaaattacatatacgggtactctttggt

SEQ ID NO: 810 - DNA, 1845 bp, Panicum virgatum
gctcgcacacgcgccgcggccaactccgtgaggccgtccccccgcccgcccgcgccgcgcgagagagagaaccgcagaggagccgggcatgcagcgcctcgcctcctcctcctcccggaggctcctcggggccgcgctcgcccccgcccgggccaactccagcctctccgcggccgtcgccgcggcgcccgcgggagaatgcgccgccgcgtccccgaagatgccgggcttcgactacacgccgccgccctacgacggcccgcgggccgaggagatcttccggaagcgggccgagttcctcagcccgtccctcttccacttctacgaccgccccttgaacatagttgatggaaagatgcagtatttatttgatgaggatggtcgtcgttacctggatgcttttggtggcattgcaacagtttgctgtgggcactgccatcctgatgtggttgaagccatagtaaaccaggcaaagaggatccaacactccacagttctgtatctcaatcatgccattgtggattttgcagagtcattggcatccaaaatgcctggtgatttgaaggtagttttcttcacaaattcaggcacggaggcgaatgagctcgcactgatgattgcacgtctttacactggttgcaatgacattatctccctcaggaatggataccatgggaatgcttctggaacaatgggtgctactgctcaatccaattggaaattcaatgttgttcagacgggagtacaccatgcgcttaacccagacccctacagaggtgcttttggctctgatggggagaaatatgccagagatgttcaggaaatcattcaatttgggactacagggagagttgctggtttcatttcagaagccatacagggggttggtggaatagtggaattagcaccaggatacttgccagcagcatatgatatagtaaggaaagccggtggtctctgcattgctgacgaagttcaggcgggtgttgcacgaactggaagccacttctggggatttgaaggccatggtgttatcccagacatagttaccatggcaaagggtatcgggaatggcataccgataggagccgtcgtgacaacaccggagattgctcaggtgttgacccgtagaagctacttcaacacctttggtggtaaccccgtcagcactgcgggcgggcatgcagttctcaaagtgctggagaaggagaagctccaggagaatgcgtttgttgtaggctcctatctgaaggaacaacttaacaagctgaaagagaagcatgacatcatcggtgacgttagggggaaaggtttccttcttggagttgagttggtgacagaccgtgaaaagaaaacgccagccaaagctgagatctcacatgtcatgaaccacatgaaagatatgggggtgttggttgggaagggtggcttctacgggaacgtgttcaggattacaccgccgttgtgcttcactaaagaggactctgacttcttcatcgatgtgatggatatcgcgctctcgaaactgtgaggcaggctgcgcgaagatgatgccatgtacatctgttgatccgtaaataagaggagattcgcgagacagcacctcgttgtctcgtgatccgtgctcgccagcttcagcttcgtccagtctgctgttcctccttatccagtcgtttaacaactccttgtttgagatcaataataagttctttttctatgttatatgagccctgtatttctgttatccagaaacaaacccctgtggccctgtcactattaggagatgcagagatacggctttacatatgcagtgccaatgctttggctaaacataacgtgcaattc

SEQ ID NO: 811 - DNA, 1875 bp, Zea mays
cccccccccccccccccaaccaaccaaccgcgcagggagaaaaccacagcgcagcacatgcagcgcctcgcctcctcccggaggctcctccaggccgcgctcgccgcggccgccgtcgccgcgcccgcgccagcgaatggcgccttccccaagatgccggccttcgactacacgccgccgccgtacaacgggccgcgcgccgagatcttccggaagcgcgctcagttcctcagcccatccctctttcatttctacgatcgcccattggacatagtcgaaggaaagatgcagtacctatttgatgaggatggccgtcgttacctggatgctttcggtggcattgctacagtttgctgtgggcactgccatccagatgtggttgaagccatagtaaaccaggcaaagcggatccagcactccacagttctatatctcaatcatgcaattgcagattttgccgaggcattggcttccaaaatgcctggtgatctgaaggttgttttcttcacaaattcaggcacggaggcaaatgagcttgcactgatgattgcacggctttacactggttgcaatgacattatctctcttaggaatggataccatgggaatgctgctggaacaatgggtgctactgctcaatccaattggaaattcaaggttgttcagatgggagtacaccatgcgcttaatccagaccccttcagaggtgcttttggttctgacggggagaaatacgccagagatgttcaggaaatcatcgaatttggaactacagggagagttggtgggttcatttcggaagccatacagggggttggtggaatagtggaactggcaccaggatacttgcccgtggcatacagtatggtaaggaaagccggtgggctctgcatcgctgacgaagttcaggcaggagtcgcgcgaactgggagccacttctggggattcgaagggcatggtgtcatcccggacatagtcaccatggccaagggtatcgggaatggcatacccataggagctgtcgtaacgacgccagagatcgctcaggtgttgacccgcaaaagctacttcaataggagtacctttgatggtaaccctgtcagcactgcaggcgggcatgcggtgctcaaagtgctggagaaggagaagctccaggagaatgcgtttgttgtgggctcctatctaaaggaacagcttaacaatctgaaagacaagcatgagatcatcggtgacgttaggggcaaaggcttccttcttggagttgagctggtgacagaccgtgagaagaaaaccccagccaaagctgagatctcacgtgtcatgaaccatatgaaagatatgggagtgttggttggtaagggtggtttctacgggaacgtttttaggataacaccgccgttgtgcttcaccaaagaggattccgacttcttcattgaggtgatggacattgcgctctcgaagctgtgaggcaggcagggcgaagatgatgtgcaaaccctggtccgtggccatgggttttttgcccatgaataatattaagattagtgagacagcacctcgttgtctcttaatctaagacgatgccatgtcatccggtggcatggtattcctgcttgcccataaataagggacgagttgtgagacagcacctcgttgtctcgtgatcagacccatggtccatggagcaatacgattcttgtaaactctagcttcatccaatctgttcctcctgatctaactagtctgaatagcaactgttcgtttgttaccaatatcaacttcttttcagatgctccatatattcctgctctctgtaaacaaacaattatcactgttcaatagatgcggagatgtggatataaaaattacatatac

SEQ ID NO: 812 - DNA, 1123 bp, Triticum aestivum
tcccgtcctcctctcctcctgtcgcctccagagcaacagtcctccagctcgagcaagaaacaagtgtagtactagtttgatctgtgaacatgttggccatcttccagaagcaggtggcgcacgcgccgcaggagctcaacagcccgcgcggcagcaccgccaagcccaagaaccccgacgagatcctccgcgacttccacgccgcccacccctccgacgccttctccacctccttcggcggcggcgccgccctcgcctgcgtcgccgcgcagccccgcaacctcgccgccgccggctaccagaggatgttctgcgggctggacgacatctactgcgtcttcatgggcacgctggacaacctgagcgcgctgatgcggcagtacggcctcaccggccgctccaccaacgaggcgctgctggtgatcgaggcctaccgcaccctgcgcgaccggggcccctacccggcggaccaggtggtgaaggacctgtccggctccttcgccttcgtcgtcttcgacaaccgcggcaggtcggggtcgggggcggcggtgttcgcggcgcagagcacggacggcggggtgccgctgcactggggcgtggcggcggacgggtcggtggtgatctgcgacgaccgcggcgtggccaaggccgggtgcgggcggtcgtacgcgccgttcccgcccgggtgcatgttccacagcgagggcgggctcaagagcttcgagcaccccatgaaccggctcaaggcgttcccgcgcgtggacagcgagggcgtcatgtgcggcgccaacttcaaggtcgacgcattcaccaagatcaactccatgccccgcgtcggcagcgccaccaactgggccgccacctgggacgacgccgccatctagctgggctggtgtgcatcacctcgccggcgccgctcgcctagctcgtcggacttctgaatttgagcttaccgcattttacttactttttttctttggcaatgtacattctgatctgatctgagccgtgtgtgggcgtgggcgcgctgacacgtacggttgtttgcttccagtccaagagtgctactgagtcgtcacttgttttgagtaaaataaaaaatatagtacaaacaaaaaaaaaa

SEQ ID NO: 813 - DNA, 1099 bp, Triticum aestivum
gcgttcccgttctcctctccccctgtcgcctccatagcagcagcagctccagctcgagcaagaaagaactagtttgatctgtgaaaatgttggccatcttccagaagcaggtggcgcacgcgccgcaggagctcaacagcccgcgcggcagcaccgccaagcccaagaaccccgacgagatcctccgcgacttccacgccgcccacccctccgacgccttctccacctccttcggcggcggcgccgccctcgcctgcgtcgccgcgcagccccgcaacctcgccgccggcgggtaccagaggatgttctgcgggctggacgacatctactgcgtcttcatggggacgctggacaacctgagcgcgctgatgcggcagtacggcctcacgggccgctccaccaacgaggcgctgctggtgatcgaggcctaccgcaccctgcgcgaccggggcccctaccctgctgaccaggtggtgaaggacctgtcgggctccttcgccttcgtcgtcttcgacaaccgcggccggtccggctccggggcggccgtgttcgcggcgcagagcacggacggcggcgtgccgctgcactggggcgtggcggcggacgggtcggtggtgatctgcgacgaccgcgccgtggccaaggccgggtgcgggcggtcctacgcgccgttcccgcccgggtgcatgttccacagcgagggcgggctcaagagcttcgagcaccccatgaaccggctcaaggcgctcccgcgggtggacagcgagggcgtcatgtgcggcgccaacttcaaggtcgacgccttcaccaagatcaactccatgccccgcgtcggtagcgccaccaactgggccgccacctgggacgaagccgccatctgatatagccatcgtcgctccccggcgccggcgacgctcgcctagctcgtcggacttctggatttgggcttactgcattttacttatttttttctttggcaatgtacattctgaatctgatctgatctgagccgtgtgtgggcgtgggcacgctgacacgtacggttgtttgcttgtacgatggaggaataagactttgcttccagtccaaaaaaaaaaaa

SEQ ID NO: 814 - DNA, 1104 bp, Pseudoroegneria spicata
ccgtttcctctccatctactctcctgtcgtctccccagtagcagctccagctcgagcaagaagtagagaatttgtactactagctattgagatttgagttgagaatgttggccatcttccagaagcaggtggcgcacgcgccgcaggagctcaacagcccccggggcagcaccgccaagcccaagaaccccgacgagatcctccgcgacttccacgccgcccaccccgccgacgccttctccacctccttcggcggcggcgctgcgctcgcctgcgtcgccgcgcagccacgctccctcgccgccggcggataccagaggatgttctgcggggtggacgacatctactgcgtgttcatggggacgctggacaacctgagcagcctcatgcggcagtacggcctcacgggtcgctccaccaacgaggcgctcctcgtcatcgaggcctaccgcaccctccgcgaccggggcccctacccggcggaccaggtggtcaaggacctgtcgggctccttcgccttcgtcgtcttcgacaaccgtggcaggtccgggtccggggccgccgtgttcgcggcgcagagcacggacggcggcgtgccgctgcactggggcgtggcggcggacggctccgtcgtcatctgcgacgaccgcgccgtggccaaggccggctgcgggaaatcctacgcgcccttcccgcccgggtgcatgttccacagcgagggcgggctcaagagcttcgagcaccccatgaaccggctcaaggcgatgccccgcgtcgacagcgagggcgttatgtgcggcgccaacttcaaggtcgacgccttcaccaagatcaactccatgccccgcgtcggcagcgccaccaactgggccgccacctgggacgacgccgccatctgatctagccggcgttgctctccggcgccggcgacgctcgcctagctcgtcggacttctgaatttcggcttactacattttatttcctttttttttcttggcaatgtacatcctgatctgatctgagccgtgtgtggggctgtgggcatgctgacacgtacggttgtttgcttgtacgatggaggaataagactttgcttccagttca

SEQ ID NO: 815 - DNA, 981 bp, Leymus cinereus x Leymus triticoides
  misc_feature (957)..(957): n is a, c, g, or t
atgttggccatcttccagaagcaggtggcgcacgcgccgcaggagctcaacagcccccgcggcagcaccgccaagcccaagaaccccgacgagatcctccgcgacttccacgccgcccaccccaccgacgccttctccacctccttcggcggcggcgccgccctcgcctgcgtcgccgcgcagccacgctccctcgccgccggcggataccagaggatgttctgcgggctggacgacatctactgcgtgttcacggggacgctggacaaccttagcagcttgatgcggcagtacggcctgacgggccgctccaccaacgaggcgctgctggtcatcgaggcctaccgcaccctgcgcgaccggggcccctacccggcggaccaggtggtcaaggacctctccggctccttcgccttcgtcgtcttcgacaaccgcggcaggtccgggtccggggccgccgtgttcgcggcgcagagcacggacggcggcgtgccgttgcactggggcgtggcggcggacggctccgtggtaatctgcgacgaccgctccgtggccaaggccggctgcgggaaatcctacgcgcccttcccgcccgggtgcatgttccacagcgagggcgggctcaagagcttcgagcaccctatgaaccggctcaaggccatgccgagggtggacagcgagggcgtcatgtgcggcgccaattttaaggtcgacaccttcaccaagatcaactccatgccccgcgtcggcagcgccaccaactgggccgccacctgggacgacgccgccatctgatatagcggcccgccggcgacgctcgcctagctcgtcggacttctgaatttcggcttactgcattttacttctgtttttctttggcaatgtacattctgatctgatctgagccgtgtgtgggcacgctgacacgtacggttgtttgcttgtactacgatggangaataagactttgcttccagtcca

SEQ ID NO: 816 - DNA, 1186 bp, Leymus cinereus x Leymus triticoides
  misc_feature (100)..(100): n is a, c, g, or t
  misc_feature (120)..(120): n is a, c, g, or t
  misc_feature (172)..(172): n is a, c, g, or t
  misc_feature (371)..(371): n is a, c, g, or t
  misc_feature (413)..(413): n is a, c, g, or t
ctcgtgccatcctaaaaccagcgacctcccactataaagcaggcgccgatctccatccaacacctccattccattccccataccccgttcctctccaccntctactctcctgtcgtctcnccagtagcagctccagctcgagcaagaagtagagaatttgtactagctattnagatttgatttgagaatgttggccatcttccagaagcaggtggcgcacgcgccgcaggagctcaacagcccccggagcggcgccgccaagcccaagaaccccgacgagatcctccgcgacttccacgccgcgcaccccgccgacgccttctccacctccttcggcggcggcgccgccctcgcctgcgtcgccgcacagncacgctccctcgccgccggctaccagaggatgttctgcgggntggacgacatctactgcgtgttcatggggacgctggacaacctgagcagcgtcatgcggcagtacggcctcacgggccgctccaccaacgaggcgctgctggtcatcgaggcctaccgcaccctgcgcgaccggggcccctacccggccgaccaggtggtcaaggacctctcgggctccttcgccttcgtcgtcttcgacaaccgtggcaggtccgggtccggggccgccgtgttcgcggcgcagagcacggacggcggcgtgccgctgcactggggcgtggcggcggacggctccgtcgtcatctgcgacgaccgcgccgtggccaaggccggctgcgggaaatcctacgcgcccttcccgcccgggtgcatgttccacagcgagggcgggctgaagagcttcgagcaccccatgaaccggctcaaggcgatgccccgcgtcgacagcgagggcgttatgtgcggcgccaacttcaaggtcgacgccttcaccaagatcaactccatgccccgcgtcggcagcgccaccaactgggccgccacctgggacgacgccgccatctaattaatgctctccatgcggccggagtcctcgccggcgccgccgccgctcgcctagctcgtcggacttctgaatttgggcttactgcattttacttttttttttgcttggcaatgtacattctgatctgatctcagccgtgtgtgggcgtgtggacacgtacggttgtttgatagttcgatggaggaataagactttgcttccggttca

SEQ ID NO: 817 - DNA, 2346 bp, Oryza sativa
gaaaagagagaaaaaaaaaaggtgactcgctgccgagtcggacacgtgacaacacgttggtgccgcgtccggctcaaccgcttgctcgcgcggaccttatcgctccggtccgacgcgcgggtgacgtgtaccgagcgaccataccgtgccagccttatccccaatccgggcccacacttttgtcgtcgctcggtgtgggccccaccctgtcagtgtacggctcggcgctcaccggcgtttacctccccagcccacgggaaggaggcggcgcgcacgtggcagttgcggtgggtgaggctgtgagggcggtgcgcgagcctacgtggcacgccgcgtccacggaggccgtagagaggtggcccccgtgagcacgcagttcgagtaggcgatgacgtgtccgacaggtggttcagcgagcaataattacggggtaatataataaaccgctcccgccaaactaacggcggcagcccacggaaaaggcgtccctcgctgctgtttcctccgtttttcgctcacctccggtcatcctactcggctaccccggcggcaaaaacatgaagttctacagatctacgacatcagtttactagtttgtcttttgttctactttgctctttctttcttgcgaatttctttttaatcacgttttgtgtagaccatgtacagcatcctcacttgtgcagggtaggaatttcacaagaaaacagtgctcgtgcagcgactcgatagaaacggaagaaaaccgtatcaacaaccaacacgaggagggtaccgtagggggtgagggcaccgcacgtcacggttaaggtggccggttactactactggtgtcacatcggcagcggcaactggtattacgtgatgatcttatcctcgtcgtctcgccgtctttatcccgttcgctgcttgctttggcttctcacatcagcactgactccaataacacgctcatcaaacagcgcgcgcgagcgagggatggataggatattttcgttcgcgttcgtgccatcctaaatcccgtctataaagccgtgcacatctctatcctcacctccattccattccactcgccaacccgacacgtctctcatcttcacgcaacgaacagcagcagcagctcaagctaagctaagctaaagtactacgtgttctttcgtcttcgtcggcgccggagtttgattcgtcggagctagctagcaagaggaagaagaaaatgttggccatattccagaagcaggtggcgcacgcgccggcggagctgaacagcccgcggagcagcgcggcgaagcccaagaaccccgacgagatcctcagggacttccacgccctccaccccatcgaggccttctccacctccttcggcggcggcgccgccctcgcctgcgtcgccggccacgcccgcaatggcctctctggctacgagaggatgttctgtgggctggatgacatctactgcgtgttcatggggaggctggacaacctgagcagcctgatccggcagtacgggctgtgcagccgctccaccaacgaggcgctgctcgtcatcgaggcctaccgcaccctccgcgaccgcggcccctaccccgccgaccaggtcgtcaaggatctctccggctccttcgccttcgtcgtcttcgacaacaagtccggcgccgtcttcgccgccctgagtacggatggggaggtgccgttgtattgggggatcgcggcggatgggtcggtggtgatctgcgacgagagggagatcgtgaagggagggtgcggcaagtcgtacgcgccgttcccggtggggtgcatgttccacagcgagggggggctcaagagcttcgagcacccgatgaaccggctgaaggcgatgccgcgggtggacagcgagggcgtcatgtgcggcgccaccttcaaggtcgacaccttcaccaagatcaactccatgccccgcgtcggcagcgccaccaactgggccgccacctgggacgacgctgccgcctgatgatggcgctccgtacgccgtcgtctcgtcgccgtgcgcctgccctcgccgccggcctcctcgccgtttgccgccgccgctcatctcttcctcctcttcttcctcctctctatatccgatgtgcttctccgtccgaagcatgcagattattagagcgatatttgcagctagcgtggaagcgcgccaatctatttttctgcggtgtttttacttaattttcacctcttctttttaaatttttatgtccatctttgggctctcgcctctcggcaatgtatattctcggtcgcgggtggcatgtcatggtacatactatgaatgatgaataagaaagagtttgcttcactcaatcc

SEQ ID NO: 818 - DNA, 1353 bp, Panicum virgatum
ccgtcacgctataagatccggagctccgttccattccaattccccattcagatccgccactattcttcttcatttcttcttccacagctagctagctagcagccggtgggtgcagcagcagcagcagcagcaggacaccgatccgcccgactacaagcaaggatgctggccatcttccagaagcaggtggcgcacgcgccgcaggagctcaacagcccccggagcggcggcgccgccaagcccaggagccccgacgagatcctccgggacttccacgccgcgcaccccgccgacgccttctccacctccttcgggggcggcgccgcgctcgcctgcgtcggcgcgcgcgcctgccctgctgccggggccggccaccaccagcgcatgttctgcggcctcgacgacatctactgcgtcttcctcggccgcctcgacaacctcagcgccctcatccgccagtacggcctctgcggcaagtccaccaacgaggcgctgctcgtcatcgaggcctaccgcaccctgcgcgaccgcgggccctaccccgccgaccaggtcgtcaaggacctcgccggatcattcgccttcgtcgtcttcgacaacaagtccggcgccgtattcgcagccctgagcgccgacggcggcgttccgctctactggggcatcgcggcggacggctccgtggtgatctgcgaggaccgggagatcgtcaagcgcgggtgcggcaagtcgtacgcgcccttccccgtggggtgcatgttccacagcgagggcggcctcaagagcttcgagcaccccatgaacaggctcaaggcgatgccccgggtcgacagcgagggcgtcatgtgcggcgccaccttcaaggtcgacaccttcaccaagatcaactccatgccgcgcgtcggcagcgccaccaactgggccgccgcatgggacgacaaagccatctagagctgctagctactagtagaacatcatatcttttcactctctctttttttcaatcaaatcaagagcgccgctgctagccatgtgccctttctttcttgttttcttccttcttcgtcgcccgctatatatgctagctgctgctttaatttttccttccgatccactacactaatgtatctcaagaccacgtacggaagcatgccgcctttgttttactgcctgatgtcgtcctcttcctccttgtgttggcacattgtacatttccctgtgcttgtggacttggctgttgaacatgatcaataacagtttgtttgcctcaataatcttatgtaacttactgatgtttaggcgtttagcttctgtatgtaaggtttatatttttatttgttattatactaaaaaaaa

SEQ ID NO: 819 - DNA, 1174 bp, Panicum virgatum
gcagcagcacagggtactcgagtgagtgaccgcccgaccgattcacgaggatgctggccatcttccagaagcaggtggcgcacgcgccgcaggagctcaacagcccccggagcggcggcgccaagcccaggagccccgacgagatcctccgggacttccacgccgcgcaccccgccgacgccttctccgcctccttcgggggcggcgccgcgctcgcctgcgtcgccgcgcgcgcctgccctgctgctggggccggccaccaccagcgcatgttctgcggcctcgacgacatctactgcgtcttcctcggccgcctcgacaacctcagcgccctcatccgccagtacggcctctgcaacaagtccaccaacgaggcgctgctcgtcatcgaggcctaccgcaccctgcgcgaccgcgggccctaccccgccgaccaggtcgtcaaggacctcgccggctcattcgccttcgtcgtcttcgacaacaagtccggcgccgtattcgcagccctgagcgccgacggcggcgtgcctctgttctggggcatcgcggcggacggctccgtggtcatctgcgaggaccgggagatcgtcaagcgcgggtgcggcaagtcgtacgcgcccttccccgtggggtgcatgttccacagcgagggcgggctcaagagcttcgagcaccccatgaacaggctcaaggcgttgccccgggtcgacagcgagggcgtcatgtgcggggccaccttcaaggtcgacaccttcaccaagatcaactccatgccacgtgtcggcagcgccaccaactgggccgcatgggacgaccaagccatctaggagtagatcatattttcaccgtctctttaattaagagcgccgctgctcacgcacgcaccagatagccatatccgcgccctttctttctcccttcttcgtcgctcgatgtttctttcctttccttccactaatgtatctgctggctacctgctagtgcttccattggaaggccatggtctcatcaagaccacgtacggaagcataacgcctttgttttactgcatgcttgtcgtcctcttcttccggctccttgtgctggcacattgtacatttccctgtgcttggggcttttgggcttggctgttgaacattatcaataagagtttgcttcaatcttatttact

SEQ ID NO: 820 - DNA, 1210 bp, Saccharum officinarum
ctccacttcacaagcagcagtccgtcccgttccatccagacgaccctgcagcagtgcagaacgaggatgctggccatcttccagaagcaggtggcgcacgcgccgcaggagctcaacagcccccggagcggcggcgcggcggccaacaagccccggaaccccgacgagatcctgcgcgacttccacgccgcgcaccccaccaacgccttctccacctccttcggcggcggctccgcgctcgcctgcgtcggccccaccgctgccgccgcctcctccggcggctaccagcggatgttctgcggcctggacgacatctactgcgtcttcctgggccgcctcgacaacctgagcggcctcatccggcagtacggcctgtgcgggcggtccaccaacgaggcgcttctggtcatcgaggcctaccgcacgctgcgcgaccgcgggccgtacccggccgaccaggtcgtcaaggacctcgcgggcgccttcgccttcgtcgtcttcgacaaccgctccggcgccgtcttcgccgcgctgggcgggaacgacggcggcgactccgtgccgctgtactggggcgtggcggcggacgggtccgcggtcatcagcgacgaccgcgaagtggtgaagcgcgggtgcgggaagtcgtacgcgcccttccccgccggctgcatgttccacagcgagggcgggctcaagagcttcgagcaccccatgaacaggctcaaggccatgccacgcgtcgacagcgagggcgccatgtgcggcgccaccttcaaggtcgataccttcaccaagatcaactccatgccccgcgtcggcagcgccaccaactgggccgccgcctgggacgatgccatctaggacctgctctgctcaccaaccaaaccatgtcccatgtctgcactgcaacatcctctacccagcaatctctcccgttcgccgttgcccctgcccgtggtcttcctatctactagatccaaggttgcatccatccattttctgaaaccagctagaggctccatcattccgagtgggctagtgctacagagaaacaggatggaagagtctgctctgttgccataataacttagttttcttttttcccttttcctgccttttctttatcctggcatttgtacattagtttctccagtgcttgtggcttgtggacttagttgttcaacatgatgaataagaaagagtttgcttc

SEQ ID NO: 821 - DNA, 1223 bp, Saccharum officinarum
cagcagtccgtcccgttccatccagacgaccctgcactagcgcagaacgaggatgctggccatcttccagaagcaggtggcgcacgcgccgcaggagctcaacagcccccggagcggcggcgcgtcgtccaacaagccccggaaccccgacgagatcctgcgcgacttccacgccgcgcaccccaccaacgccttctccacctccttcggcggcggcgccgcgctcgcctgcgtcggccccaccgcctcctccggcgccggcagcacctaccagcgcatgttctgcggcctggacgacatctactgcgtcttcctgggccgcctcgacaacctgagcggcctcatccggcagtacggcctgtgcgggcggtccaccaacgaggcgctgctggtcatcgaggcctaccgcacgctgcgcgaccgcgggccgtacccggccgaccaggtcgtcaaggacctcgcgggcgccttcgccttcgtcgtcttcgacaaccgctccggcgccgtcttcgccgcgctgggcgggaacgacggcggcgactccgtgccgctgtactggggcgtggcggcggacgggtccgcggtcatcagcgacgaccgcgacgtggtgaagcgcgggtgcggcaagtcgtacgcgcccttccccgccgggtgcatgttccacagcgagggcgggctcaagagcttcgagcaccccatgaacaggctcaaggccatgccacgcgtcgacagcgagggcgccatgtgcggcgccaccttcaaggtcgataccttcaccaagatcaactccatgccccgcgtcggcagcgccaccaactgggccgccgcctgggacgatgccatttaggacctgctatcctctgctctgctcaccaaccaaaccatgtcccatgtctgcactgcaacatcctctacccagcaatctctcccgttcgccgttgcccctgcccgtggtcttcctatctactagatccaaggcacaagtcaagacttgcatccatccattttctgaaaccagctagaggctccatcattccgagtgggctagtgctacagagaaacaggatggaagagtctgctttgttgccataataacttagttttctttttttttccccttttcctgccttttctttatcctggcatttgtacattagtttctccagtgcttgtggcttgtggacttagttgttcaacatgatgaataagaaagagtttgcttc

SEQ ID NO: 822 - DNA, 1199 bp, Saccharum officinarum
tccatccagacgaccctgcagtagcgcagaacgaggatgctggccatcttccagaagcaggtggcgcacgcgccgcaggagctcaacagcccccggagcggcggcgcgtcgtccaacaagccccggaaccccgacgagatcatgcgcgacttccacgccgcgcaccccaccaacgccttctccacctccttcggcggcggcgccgcgctcgcctgtgtcggccccaccgctgccgccgcctcctccggcgccggcagcacctaccagcgcatgttctgcggcctggacgacatctactgcgtcttcctgggccgcctcgacaacctgagcggcctcatccggcagtacggcctgtgcgggcggtccaccaacgaggcgctgctggtcatcgaggcctaccgcacgctccgcgaccgcgggccgtacccggccgaccaggtcgtcaaggacctcgcgggcgcctttgccttcgtcgtcttcgacaaccgctccggcgccgtcttcgccgcgctgggcgggaacgacggcggcgactccgtgccgctgtactggggcgtggcggcggacgggtccgcggtcatcagcgacgaccgcgacgtggtgaagcgcgggtgcggcaagtcctacgcgccgttccccgccggatgcatgttccacagcgagggcgggctcaagagcttcgagcaccccatgaacaggctcaaggccatgccacgcgtcgacagcgagggcgccatgtgcggcgccaccttcaaggtcgataccttcaccaagatcaactccatgccccgcgtcggcagcgccaccaactgggccgccgcctgggacgatgccatctaggacctgctctcctctgctctgctcaccaaccaaaccatgtcccatgtctgcactgcaacatcctctacccagcaatctctcccgttcgccgttgcccctgcccgtggtcttcctatctactagatccaaggttgcatccatccattttctaaaaccagctagaagctccatcattccgagtgggctagtgctacagagaaacaggatggaagagtctgctttgttgccataataacttagttttcttttttcccttttcctgccttttctttatcctggcatttgtacattagtttctccagtgcttgtggcttgtggacttagttgttcaacatgatgaataagaaagagtttgcttc

SEQ ID NO: 823 - DNA, 1771 bp, Avena sativa
aacacgtttctttcttattcttctccactgttcaagatcttctccgatcgaggaggaggcctttgcagttgcatggacaagggccacctcggtggcggcggaggaggactgctcgctctcgacgcgtcgccgcgcccgctcggcttcctcaacttgctgtccccgccggcgccgttccacaggagcagcatggaggcggacgacggtggaggcggcggcggaagggggcggaggtccgtggaggtggacttcttctccgacgagaagaagaacatgaagaagacccgggtctcggccagcgccgccgatgcggaggagaacaagagtcaggccgatggactcgccatcaagaaggaggacctcaccattaacctccttccagggaacaacaacgcgaggagcgaccggtcgatggtggtcgacgacgacgcggcgtcccggcggcacgaagagggaaggaacaacaccgagctggcggcgatgcagtcggagctgagccgcctgaacgaagaaaaccagcggctgcgggggatgttgacccaggtcaccaacagctaccaggcgctgcagatgcatctcgtcgcgctcatgcagcaaaggacccagcagctgcctccgacccaaccgcaacaacctcccactcaccaggatggtaataagaccgagcagggtgctatggtgccgaggcaattcctcggtcttggtccctccggtggtgccggcgctgatgtggcggaggagccgtccaactcgtccacggaggtcgggagcccgcgccggtcgtcgtccaacgggaacgaggaccctgagcgcggcgacaaccctgacggcccgtccaccgccgccgggtggttgcccggacgcgcgatgagccagcagctgggagcggcggccaagggccacgaccagcaagcgcaggaagccaccatgaggaaggcccgcgtctccgttcgtgcacgatcagaggctccaattatcgccgatggatgccaatggaggaagtacggccagaagatggccaagggcaacccttgtccccgcgcctactaccgctgcaccatggccaccggctgcccggtgcgcaagcaggtgcaacgatgcgccgaggaccggagcatcctgatcaccacgtacgagggcacgcacaaccacccgctccctccggccgcgatggcgatggcgtccaccacgtcggccgccgcgtccatgctgctctcggggtccatgcccagcgccgacgggtcggggctgatgagctccaacttcctggcgcgcaccgtgctgccgtgctcctccagcatggccaccatctccgcgtccgcgccgttcccgacggtcacgctcgacctcacccacggcccgcacggcccgcccaacgccctgccgctcaacgccgcccggccgcccgcgccggggcagttccagattccgctgcccggcggcgggatggccccggccttcgcgatgccgccccacatgctgtacaaccagtccaagttctccggcctgcagatgtcgtccgccgagtccgtggacgccgccgccgcagcgcagttcgcgcagcccaggccgccgatgggccagatatccgacaccgtcagcgcagcggctgcggcgatcaccgcggacccgaacttcacggtggcgctcgccgcggccatcacgtcgatcataggcggccagcacgcggccgccgccggcaacaaccacaacaccaacagtaacaacaacaccaacaacgtgacgacgacgagcacaacacaacgagcgc

SEQ ID NO: 824 - DNA, 640 bp, Lolium multiflorum
ggagaaccaaacaaccagctgatcaaaccaaccatggccatgagggctctcgtgctgcccccctcgcagagctcctcgtttgggcttcaccagagtatgccatgcttcaaaccaagcagtgccagtcccagatcagtgaaggcctacgcaaaagcagatgaggaggaggagaaggtgcccaagcagtccttgttcgggaacatcacggaggcgctggacttctcccaagttcggtcagagaaggatgcggagctgctgtatgaagccagggattccatcaaagaggaaggaaggatgacaagggaacagtatgcagcccttaggaggaaaattggtggcacttacaaggatttcttcaagtcatatgttgatgttgatggggaatatgtggaggaaggttgggttgacaagacctgcaaagtttgcaagaaagacacaaggggcgagccaaggcaggttgacaaactaggaagatatatgcatgtggcatgcgcagagaactctaaaccgacgaacttcttttccaaactcttcggcagatgaacttcttttaccatcatacccattgtttgactcatggttagatcaatagatggatgttataacctcaaggaattagaactgtattgggctgtctatg

SEQ ID NO: 825 - DNA, 736 bp, Avena sativa
ctcaccaaagattcagttcttctatctgtggtgaagaagaaccaaacaaccagctgatcaaacccatccatggccatgagggctctcgcactgcccccctcccagagctcctcgtttgggcttcaccagaacatgccctcattcaggccgagcagcgccagtcctagatcagtgaaggcctacgcaaaagcaaatgatgaggaggaggagaagaaggtgcccaagcagtccttgtttgggaacatcaccgaggcgctggacttctcgcaggtccggtcggagaaggacgcggagctgctgtatgaggccagagattccatcaaagaggaaggaaggatgacaagggagcagtatggagcccttcggaggaaaatcggtggcacctacaaggatttcttcaagtcatttgttgatgttgatggggaatacgtggaggaagggtgggtggacaagacctgcaaagtttgcaagaaagacacaaggggggagccaaggcaggttgacaaactaggaagatatatgcatgtggcttgcgcagagaactcgaaaccgacaaacttctttgccaaactcttcggcggatgaacttcttttgtaccatcaaacatattgtttgcctcatggctagataaatagatggatgctataacctctcaagggattagaaaaatattgtgtactgagctgtttctgtgaattagtttttgaggagcatatgcacattctgattcagttt

SEQ ID NO: 826 - DNA, 738 bp, Avena sativa
ctgtggtgaagaagaaccaaacaaccagctgatcaaacccatccatggccatgagggctctcgcactgcccccctcccagagctcctcattcgggcttcaccagagcatgccttccttcaggccgagcagtgccagtcctagatcagtgaaggcctacgcaaaagcaaatgaggaggaggaggagaagaaggtgcccaagcagtccttgtttgggaacatcaccgaggcgctggacttctcgcaggtccgctcggagaaggacgcggagctgctgtatgaggccagggattccatcaaagaagaagggaggatgacaagggagcagtatggagcccttcggaggaaaatcggtggcacctacaaggatttcttcaagtcatttgttgatgttgatggggaatacgtggaggaagggtgggtggacaagacctgcaaagtttgcaagaaagacacaaggggggagccaaggcaggttgacaaactaggaagatatatgcatgtggcttgcgcagagaactcgaaaccgacaaacttcttttccaaactcttcggcggatgaacttcttttgtaccatcaaacctactgtttgcctcgtggttagataaatagatggatgctataatccctcaagggattagaaaaagtattgtgtactgagttgtctaagtgaattagtttttgaggagcatatgcacattctgattcagtttcgttggtaacaagtagcaaatgaaca

SEQ ID NO: 827 - DNA, 884 bp, Hordeum vulgare
ggactacgcttcttctacctacggtgaaggagaaccaagaaccagctctgatcaaagccatggccatgagggctctcgctctttcccctacccagagctcctcatttgggctccaccaaagcacgccctgcttcaagccaagcagcgccagccctactaggtcagtcagggcttatgcgaaagcagatgaggaggagggggagaagaaggtgcccaagcagtccctgtttgggaacatcaccgaggcgctggacttctcgcaggtccggtcggagaaggacgcggagctgctgtacgaggccagggattccatcaaagatgaagggaggatgacaagggaacagtatgcagcgcttcggaggaagattggtggcacctacaaggatttcttcaagtcatatgttgaagttgatggcgaatacgtggaggaaggttgggtggacaagacctgcaaagtttgcaagaaagacacaagaggggagccaaggcaagttgacaatctaggaagatatatgcatgtggcgtgcgcagagaactcgaaaccaacaaacttcttttccaaactcttcggcagatgaacttcttttgtaccatcaaacccgatgttgttcgactcatggttagataaatagatgcgtgctgtaacctcaaggtatcaggatagtaatgtgttgtccatgtgaaatattttttgatgagcatatatgcacattccagatatatcaagtagcacatgagcagagcatgactctaggagaaaactagatgaaccactgaaaactatacatatcaggacgatatactgctacaagttaacattatgatgtactgtattatctaccaacaagtgctcctcaagccctaggctgaatacaggagaagct

SEQ ID NO: 828 - DNA, 879 bp, Hordeum vulgare
tctgcgttgatcaaagccatggccatgagggctctcgctctttcccctacccagagctcctcatttgggctccaccaaagcacgccctgcttcaagccaagcagcgccagccctactaggtcagtcagggcttatgcgaaagcagatgaggaggagggggagaagaaggtgcccaagcagtccctgtttgggaacatcaccgaggcgctggacttctcgcaggtccggtcggagaaggacgcggagctgctgtacgaggccagggattccatcaaagatgaagggaggatgacaagggaacagtatgcagcgcttcggaggaagattggtggcacctacaaggatttcttcaagtcatatgttgaagttgatggcgaatacgtggaggaaggttgggtggacaagacctgcaaagtttgcaagaaagacacaagaggggagccaaggcaagttgacaatctaggaagatatatgcatgtggcgtgcgcagagaactcgaaaccaacaaacttcttttccaaactcttcggcagatgaacttcttttgtaccatcaaacccgatgttgttcgactcatggttagataaatagatgcgtgctgtaacctcaaggtatcaggatagtaatgtgttgtccatgtgaaatattttttgatgagcatatatgcacattccagatatatcaagtagcacatgagcagagcatgactctaggagagaactagatgaaccactgaaaactatacatatcaggacgatatactgctacaagttaacattatgatgtactgtattatctaccaacaagtgctcctcaagccctaggctgaatacaggagaagcttaacagaaagtttggccaacagacctactactatat

SEQ ID NO: 829 - DNA, 1208 bp, Triticum aestivum
  misc_feature (1204)..(1204): n is a, c, g, or t
tcagcaaaataaagggggtttcgcaaaattttgaacaacccgcccacataaaaacatggggggtaggggttaacgtgggaggttttaataaaacagggtttttaaggaaccctaaattccctggaaccccaacccccgtttttttaccccccaaaaagaaccccgggccgaacccccccccggattttatctaggccggggggcggaataacattttcccccggaaagcaggtatgacccttgggctttatttggtgacactaaaaaaaaagtttttccaaaaaccaaggttggtcccggtcccggaattcccgggaatatttttgacccccgggtccgcgattggggcacggaggacactaacatgggttgaagggattaaaaaacctccttctacctgcggtgaaggagaactcaaaaaacccagccgatcaagccatggccatgagggctctcgcgctttccccgtcccagagctcctcatttgggctccaccagagtatgccctccttcaagccaagcagcaccagtcctgctagatcagtcagggcctatgcgaaagcggatgagcaggaggagaagaagaaggtgcccaagcagtccttgtttgggaacatcaccgaggcgctggacttctcgcaggtccggtcggagaaggatgcggagctgctgtatgaggccagggattccatcaaagatgaaggaaggatgacaagggaacagtatgcagcccttcggaggaagattggtggcacctacaaggatttcttcaagtcatatgttgaagttgacggtgaatacgtggaggaaggttgggtggacaagacctgcaaagtttgcaagaaagacacaagaggggagccaaggcaagttgacaatctaggaagatatatgcatgtggcgtgcgcagagaactcgaaaccaacaaacttcttttccaagctcttcggcagatgaacttcttttgtaccatcaaacccgttgttcgactcatggttagataaatagatggatgctataacaccaagggattaggacagtaatgtgtactgtgttgttcatgtgaaatggtttttgatgagcatatatacacattccattatccaatttcgttggtatatcaagtagcacatgaacagaggcctgatttatggagaaatagatgaaccactgataactatacataatactagcacaatattcnacta

SEQ ID NO: 830 - DNA, 747 bp, Leymus cinereus x Leymus triticoides
ctacggtgaaggagaaccaagaaccagcgctgatcaagccatggccatgagggctctcgcgctgcccccctcccagagctcctcgtttgggctccaccagagcttcaagccaagcagtgccagtcctgctagatcagtcagggcctatgcgaaagcagatgagcaggaggagaaggagaaggagaaggtgcccaagcagtccttgtttgggaacatcaccgaagcgctggacttctcgcaggtccggtcggagaaggatgcggagcttctgtatgaggccaggggttccatcaaagaggaaggaagaatgacaagggaacagtatgcggccctccggaggaagattggtggcacctacaaggatttcttcaagtcatatgttgaagttgacggcgaatatgtggaggaaggttgggtggacaagacctgcaaagtttgcaagaaagacacaagaggggagccaaggcaagttgacaacctaggaagatatatgcatgtggcatgcgcagagaactcgaaaccgacaaacttctttgccaaactcttcggcagatgaacttcttttgtaccatcaaacccattgttcgactcatggagtcatggttagataaatagatggatgctacaacaccaagggattaggatagtaatgtgtgcttgtgttgttcatgtgaaatggtttttgatgagcatatatgcacattccaatatcaagtaacacatgaacagaggcctgatttatggaga

SEQ ID NO: 831 - DNA, 896 bp, Triticum aestivum
ctacctacggtgaaggagaaccaacaaccagctgatcaaagccatggccatgagggcgctcgcgctgtccccgtcccagagctcctcatttgggctccaccagagcatgccctccttcaagccaagcagcgccagccctgctagaccagtcagggcctatgcgaaagcagatgagcaggaggaggagaagaagaaggtgcccaagcagtccttgtttgggaacatcaccgaggcgctggacttctcgcaggtccggtcggagaaggacgcggagctgctgtatgaggccagggattccatcaaagatgaaggaaggatgacaagggagcagtatgcagcccttcggaggaagattggtggcacctacaaggatttcttcaagtcatatgttgaagttgacggagaatacgtggaggaaggttgggtggacaagacctgcaaagtttgcaagaaagacacaagaggggagccaaggcaagttgacaatctcggaagatatatgcatgtggcgtgcgcagagaactcgaaaccaacaaacttcttttccaagctcttcagcagatgaacttcttttgtaccaacaaacccgttgttcggctcatggttagataaatgatggatgctataacatcaagggattaggacagtgatgtgatgtgtgctttgtgttgttcatgcaaaatggtttttgatgagcatgcccacattccattatccaatttcgttggtatatcaagtagcacatgaacagaggcctgatttatggagaaatagatgaaccacctgaaactatacataatactagcacaatattctactacaagttaccattatgagggataatctactagggtaggctcctcaactcctaggctgaatacaggaaaaccttaccg

SEQ ID NO: 832 - DNA, 703 bp, Triticum aestivum
ctgcggtgaaggagaaccaactaccagctgatcaaagccatggccatgagggcgctcgcgctgtccccggcccagagctcctcgtttgggctccaccagagcatgccctccttcaagccaggcagcgccagtcctgctagatcagttagggcctatgcgaaagcagatgagcaggaggaggagaagaagaaggtgcccaagcagtccttgtttgggaacatcaccgaggcgctggacttctcgcaggtccggtcggagaaggacgcggagctgctgtatgaggccagggattccatcaaagatgaaggaaggatgacaagggaacagtatgcagcccttcggaggaagattggtggcacctacaaggatttcttcaagtcatatgttgaagttgacggcgaatacgtggaggaaggttgggtggacaagacctgcaaagtttgcaagaaagacacaagaggggagccaaggcaagttgacaatctaggaagatatatgcatgtggcgtgcgcagagaactcgaaaccaacaaacttcttttccaaactcttcggcagatgaacttcttttgtaccatcagacccactcatggttagataaatagatggatgctataacatcaagggattaggacagtaatgtgtactgtgttgttcatgtgaaatggtttttgatgagcatttatacacattccattatccaa

SEQ ID NO: 833 - DNA, 698 bp, Oryza sativa
accagttcagtttctacctgaggagaatcaatcaccgatctgcagactgcagccatggccatgagggcaatcacgctgtcccactcgcagagcgcctcgtttgggcaccaccaccaccaaaccatgccgtcctccttcaggccaagcactgcctccaccagatcagtgaaggtctacgcaaaggaagatgaggagaagggcagcaagcagtcattgttcgggagcatcaccgaggcgctggacttctcgcaggtccggtcggagaaggacgcggagcttctgtatgaagccagagaggccacaaaggatggaggaaggatgacaaaggagcagtatggagcacttcggaggaagatcggtggcacctacaaggatttcttcaagtcatatgtggatgttgacggggaatacgtagaggaaggttgggtggataagacctgcaaagtttgcaagaaggacactagaggggaacccaggcaggtcgacaagctaggaagatatgcacatgtcgcatgcttggagaacccaaaaccgaccaacatcttcgccaaattgttcgccagatgaacttcaattgtacaatcaaagacatatttttactcatgcttagatacatagatggtgttgtagccccaagaatttgaacaatattatgtgttcagttttgccatataaaatggtatacagggagcatgtca

SEQ ID NO: 834 - DNA, 925 bp, Brassica rapa
cctcttcgtctttgttttgctatttactccattttctcaaatatttaaaacagtatttttgcttcctttattttcttgtaatggctttctctccgatcaactgcctcattttcgatttggatgacacattataccctctgaaaacgggaatagctccagccgtcaagaaaaacatcgacgattttctaatggagaaatttggattttctgaaagtaaagcttcaagtctaagagttgaactcttcaagagttatggaagtactctcgctggtctcagggcattaggtcacgatgttcatcctgatgaatatcacagtgtcgtgcacggaaggttgccgtatggttcaatccaacctaacagcaaactaagaaaccttctgaacaaaatcaaacagaaaaaaatcatttttacgaattcagacaggaaccatgcgatgaaggttcttgagagattgggtttagaagattgtttcgaagagattatctgtttcgagacaatgaacccgaatttattcggggcaaccacccgaccggatgagcatcccgtcgttctcaagccttcgttgaccgcaatggatgtttgcattcgtgcagccaacgttgatcctcgccgggcggtgtttttggatgacaatgtccacaatattaccgcgggtaaatctgtggggcttcgcacagtcctggtgggaagatcagaaaagactaaagatgcggattacgcggtggagactgtaactgagatagctacggcggtgccggatatttgggcgacggctacagccggatgtgatgacggcggtgagaggatcagccgcagcaagagtgagctggaaggtatggcttcgatcacagccgtcggtgcttgacgtatcgagttggcgaatcgtgaccgttggatattttaacatttagtggttgggattgt

SEQ ID NO: 835 - DNA, 1061 bp, Brassica oleracea
  misc_feature (9)..(11): n is a, c, g, or t
  misc_feature (34)..(36): n is a, c, g, or t
gcgtccgcnnngcgtccgatttactccattttcnnnatatttaaaacagtatttttgcttacattattttcttgtaatggctttctctccgatcaactgcctcattttcgatttggatgacacattataccctctgaaaacgggaatagctccagccgtcaagaaaaacatcgacgattttctaatggagaaatttggattttctgaaagtaaagcttcgagtctaagagttgaactcttcaagacttatggaagtactctggctggtctcagggcattaggtcacgatgttcatcctgatgaatatcacagtgtcgtgcacggaaggttgccgtatggttcgatccaacctaacagcaaactaagaaaccttctgaacaaaatcaaacagagaaaaatcatatttacgaattcagacaggaaccatgcgatgaaggttcttgagagattgggtttagaagattgtttcgaagagattatctgtttcgagacaatgaacccgaatttattcgggtcaacaacccgacccgatgagcatcccgtcgttctcaagccttcgttgaccgcaatggatgtttgcattcgtgcagccaacgttgatcctcgccgggcggtatttttggatgacaatgtccataatattagcgcgggtaaatctgtggggcttcgcacaatcctggtgggaagatcagaaaagacgaaagatgcggattacgcggtggagagtgtaactgagatagctacggcggtgccggatatttgggcgacggctacggccggatgtgatgacggcggtgagaggatcagacggagcaagagtgagctggaaggtatggcttcaatcacagccgtcggtgcttgacgtatcgagttggcgaatcgtggccgttggatattttaacgtttagtggttgggattgtacagatggcgttaaatgttgataatgcatgtgaataaaataatagaggtggtggaggatattaatattcaccccatctggaccccaaatgtgaatacgcaatgaaaatgttaaatgtatgatgacaatgatttcgataac

SEQ ID NO: 836 - DNA, 1051 bp, Brassica napus
ggcctcttcgtctttgttttgctatttactccattttctcaaatatttaaaacagtatttttgcttacattattttcttgtaatggctttctctccgatcaactgcctcattttcgatttggatgacacattataccctctgaaaacgggaatagctccagccgtcaagaaaaacatcgacgattttctaatggagaaatttggattttctgaaagtaaagcttcgagtctaagagttgaactcttcaagacttatggaagtactctggctggtctcagggcattaggtcacgatgttcatcctgatgaatatcacagtgtcgtgcacggaaggttgccgtatggttcgatccaacctaacagcaaactaagaaaccttctgaacaaaatcaaacagagaaaaatcatatttacgaattcagacaggaaccatgcgatgaaggttcttgagagattgggtttagaagattgtttcgaagagattatctgtttcgagacaatgaacccgaatttattcgggtcaacaacccgacccgatgagcatcccgtcgttctcaagccttcgttgaccgcaatggatgtttgcattcgtgcagccaacgttgatcctcgccgggcggtatttttggatgacaatgtccataatattagcgcgggtaaatctgtggggcttcgcacaatcctggtgggaagatcagaaaagacgaaagatgcggattacgcggtggagagtgtaactgagatagctacggcggtgccggatatttgggcgacggctacggccggatgtgatgacggcggtgagaggatcagacggagcaagagtgagctggaaggtatggcttcaatcacagccgtcggtgcttgacgtatcgagttggcgaatcgtggccgttggatattttaacgtttagtggttgggattgtacagatggcgttaaatgttgataatgcatgtgaataaaataatagaggtggtggaggatattaatattcaccccatctggaccccaaatgtgaatacgcaatgaaaatgttaaatgtatgatga

SEQ ID NO: 837 - DNA, 1124 bp, Arabidopsis thaliana
acgcctcttattgttgtttgctatataaatcctccaatttctcaatattctaaacaaattatatattttcttacttacttgttctcttgtaatggatttctctccgatcaactgcctcattttcgatttggatgacacattataccctctaaaaactggaatagcgccagctgtcaagaagaatattgacgattttctagtggagaaatttggattctcagaaagtaaagcttcaagcttaagagttgaactcttcaagacttatggaagtactctcgctggtcttagggcgttaggtcatgatgttcatcctgatgaatatcacagtttcgtgcacggaaggttaccgtatgggtcgatcgaaccaaacaacaagctacgtaaccttctcaacaaaatcaaacagagaaaaattatatttacgaattcggacaagaatcatgcggtgaaggtcctcaagaaacttggtttagaagattgtttcgaagagatgatttgttttgagacaatgaacccaaatttattcgggtcaacaacccgacccgatgaatacccggttgttctcaagccttcgttgaccgcaatggatatttgcattcgtgtagccaacgttgatcctcgccgaacagtatttttggatgataatatccacaatattaccgcgggtaaatctgtcgggcttcgcacaatcctggtgggaagagcagaaaagacgaaagatgcggattatgcggtggagacggttactgagatagctacggcggtgccagagatttgggctacggcgacggcgacaggcggatttgacgttggtggtgagaggatcagacggagcaagagtgagctggagggtatggcttcaatagcagccgtcggtgcgtgacgtgatcgagtgggcggatcgtggccgttggataattttaacgtctagtggttgggattgtacaggtggcgttaaaatgttgataatgcatatgtgaatataaataatagtggtggtggacaatattcatcccatgtggacaccaaatgtgaatacgcaatcagataatattatgtatgatgattatgatttcaatatgtgtacatttttattcaactgatttttttaaagtttgattggg

SEQ ID NO: 838 - DNA, 1074 bp, Arabidopsis lyrata
acgactcctattgttgtgttgctaattcctccaatttctcaaatattctaaacaaattaattttcttacttgttctcttgtaatggatttctcctctccgatcaactgcctcattttcgatttggatgacacattataccctctgaaaactggcatagcgccagctgtcaagaagaatatcgacgattttctagtggagaaatatggattctcggaaagtaaagcttcaagtttaagagttgaactcttcaagacttatggaagtactcttgttggtctcagggcgttaggtcatgatgttcatcctgatgaatatcacagtttcgtgcacggaagattaccgtatggctcgatcgaaccaaacaataagctacgtaaccttctcaacaaaatcaaacagagaaaaattatatttacgaattcggacaggaatcatgcggtgaaggttctcaagaaattgggtttagaagattgtttcgaagagatgatttgttttgagacaatgaacccgaatttattcgggtcaacaacccgacccgatgaacacccggttgttctcaagccgtcgttgaccgcaatggatatttgcattcgtgtagccaacgttgatcctcgccgaacaatatttttggatgacaatatccacaatattaccgcgggtaaatctgtcgggcttcgcacgatactggtgggaagagcagaaaagacgaaagatgcggattacgcagtggagacagtaactgagatagctacggcggtaccggagatttggaagacggcaacggctacgggcgggtttgacgttggcggtgagaggatcagacggagcaagagtgagctggagggtatggcttcaatcacagccgtcggtgcgtgacgtgatcaagtgggcgaatcgtggccgttggatctttttaacgtctagtggttgggattgtacaggtggcgttaaaatgttgataatgcatgtgaatataataatagtggtggtggagaatattcatccaatgtggacaccaaatgtgaatacgcaatcaaatattattatgaatgatgactatgattccaatgtgt

SEQ ID NO: 839 - DNA, 811 bp, Raphanus sativus
gggcctcttcctctttgttttgttatttactccattttctcaaatattgaaaacagtatttttgcttactttattttcttgtaatggcttcctccccgatcaactgcctcattttcgatttggatgacacattataccctctgaaaacgggaatagctccagccgtcaagaaaaacatcgacgattttctaatggagaagtttggattctctgaaagtaaagcttcaagcctaagagttgaactcttcaagacttatggaagtactctcgctggtctcagggcattaggtcacgatgttcatcctgatgaatatcacagtgtcgtgcacggaaggttgccgtatggttcgatccaacctaacagcaaactacgaaaccttctgaacaaaatcaaacagagaaaaatcattttcacgaattcagacaggaaccatgcgatgaaggttcttgagagattgggtttagaagattgtttcgaagagataatctgtttcgagacaatgaacccgaatttattcgggccaacaacccgacccgatgagcatcccgtcgtgctcaagccttcgttgaccgcgatggatgtgtgcattcgtatcgccaacgttgaccctcgccgggcggtatttttggatgataatgtccacaatattaccgccggtaaatctgtggggcttcacacaatcctggtgggaagatcagaaagactaaagatgcggattatgcagtggagagtgtaactgatatagctacagcggtgccggatatttgggcgacggctacgagcggatgtgatgacgcggtgagaggatca

SEQ ID NO: 840 - DNA, 2078 bp, Manihot esculenta
aatcctccggttgtctctgcaaaatatgccgcgttttgttcgttaagcaactggaaaaccagagagaagaagagagtttctcgaggtagagtgaaagaagcgagcgaaaataattgctttagagagagagagagagagagtgacaacaagctatcaagtgagagtgagctcatataatcaagagattgttgcatttggtttaagaaaggaaagttgaaggtaccaattcctccgtataccttgcagagttaaggtttaatacatgggtcccttatcagaaccattacctgagagaaatcaaaataaaccctatggaattcaattcatagaatgcataaagaaaaagagactttcctacaaaacctgccaagccattgtcttgattgtaacttttttcgcatacgctagctaccatgctgctcggaaaaccacgagcattgttaagagtgcccttgatcctcaatcgactagggtgggtttgaagttcattccttggagaataacttacttaagtgaaccagaagaaagaagattttcatgggtacttggagatggttgggctccatttagtggatcagatggcacagccttgctcggtgaacttgaccttgcttttctctctatttatgccataggaatgtatttctctggacatataggtgacaggatggatttaaggatcttcttgacaattggaatgataggaaccggtgtatttacttcgctctttggtgttggttactgggcaaatgtacataacttttactattttttgataatgcaaatgattgctggtttattccaatcaactggatggccttcagttgttgctgtggtcggagactggttcgggaaaagcaagagaggactaattatgggcatatggaatgctcacacctcaattgggaacatttcaggatctttgattgcttctgcaatgttgagctacggatggggctggtcatttgtcgtgcctggtttccttattgcttttataggcttgatggtttttctagttcttcctgttagtcctgattctgttggaattgacagacgtgaagatgagctgcatgatccaaggaaaattggagaggaagttacagagcctcttttaggatcagactccgaggttaaggagacagcagttgggttcattgaagcatggaaaattccgggagttgctccatttgctctttgccttttctttgccaaattggtggcttacacgtttctctactggcttcctttctacattagccacacagctatcgacggcaagtacttatcggatggcacagctgggaacttatcaacattgtttgatgtaggaggggtaattggagggatcttagctggacacatttctgatcgtctagatgccagagccattacagctgcaagcttcatgtactgcgcaattcctgctctcttcttttaccgaagctatggacatatttccctgggtgtaaatattgcccttatgttcatcaccggcttgtttgtgaatgggccttatgctcttataacaacagctgtctcggctgacttgggaacccacagttctttgaaagggaactcaagggcattggcaaccgttacagcaattatagatggcacaggttcagttggggctgcaattggacctttactgacaggttatatttctgctaagagctggagtgcagttttcacaatgctaatggctgcagctttaattgctggtctgcttttgacaagacttgttgtggctgaagtggctgcaaaaattgcagaatcaaggtctcaaacatctgcaccatcaagaacaccagcagttcagcttgatgtgtgagttggagacaagatggtagggattgtatttgtgtctgttttgtgtgatactcaaaagtatctatgatctctggtgcttaaaatgatgaggaaaaatcctctgatagcggttgaagatgggagaggatgtttttataccttctccatgctctgtagtttaataggatagatggaaagaaaacgagaaggggttgatcatgtcaatgtgtctgtatgtacatttttacagcaatttaactaattaaacc

SEQ ID NO: 841 - DNA, 1919 bp, Panicum virgatum
cacgagatccccgtagaccaccggagcggaggagaaagcagccagccatgatgatgatgggcgaaggcgtgagcgtcccgccgtggtcgcaccacctcccggtgagcggcgtcgacgtcggaggcggcaccaccggcggcgacgagatgacgccgtacctgctgtcggcgctgcatcagtacctgccgtgcaacgacgccggcgcaggcgccgacgacgacgaggcggcggccgcggcggcgatggcggccggcgtcgacggctacggctccgacgagttccgcatgtacgagttcaaggtccggcggtgcgcgcgcgcccgcagccacgactggaccgagtgccccttcgcgcacccgggggagaaggcgcgccgccgggacccgcgcaagtaccactactccggcaccgcctgcccggacttccgcaagggcgggtgcaagcgcggggacgcctgcgagttcgcgcacggcgtcttcgagtgctggctccacccggcgcgctaccgcacccagccctgcaaggacggcactgcctgccgccgccgcgtctgcttcttcgcccacaccccggaccagctgcgcgtgctcctggcgcagcagtccagccccaggggcgccggcgccgcggcctcgccgctcgccgagtcctacgacggctccccgctgcggcgccaggcgttcgagacctacctcaccaagagcatcatgtcgtcctcgcccaccagcaccctcatgtcgccgccaaagtcgcccccgtcggactccccgccattgtcgccggacggggccgccgccttccgccgcggctcctggccgggcgtcgggtccccggtgaatgaggtcctcgcctcgctgcgccagctccgcctcagcaaggccaactcgtcccccgccggcggctggtccggctacccgtcctccgccgtcgcgtacggatcgcccacggctgccgggctctacagcctgccctccaccccgacgaccatgggcggcttcatggccaatctggagccgcttgatgtctccttcatcggcggcgaggaggagcccgtgcagagggtggagtctggtcgagccctccgcgcgaaggtcttcgagaggctgagcagggagggcgccgtctccggcgacgccacggccgcaaccggaggccccgacgtggggtgggtctccgatctcatcaactgaggcggctggtcagtggtttctgacgtcttttgtgagtagcaaggtggcatggcgacggcaatggcttgggagaaaggtggtggtaagccgtgatggagaagaatggcatccaaaaatttcggtcttcttttgttgcttccagtttctttcgctaattccccctgtacatatctatcgccttgtgaatattctcggctggtagaggaaggatgcaaggtggtggaaggaggggtggatttgttttggggttcttgaggtagttgaaaatctctagaaaaaaaatagtcgagaaaaaaaataagtagagatgtatttggaggtggtctgtgtcctctgttgtgcatatagggtgtggaggcaagcatggcgggcagctgatggtggccatgaagacggacggaagacggccggatttcaagcgggcacggcggcggccggccgccggctctagctgcttaatttctatgattccggagtatgctagtttgatgatgtttaaagttcatcgtttgtgcattatcatgcatcggctagtttgatcgatttcaaccttgttgattattactacccacattttgttgatgtaatctctgtttattaagaccctcattccctacagcatattttgtattaccttttgtttagtagctgaaatctcattcacccgctattagaggtgaatttcctttgtaatattttgctcaagtaaatgaccaatccatgtttatc

SEQ ID NO: 842 - DNA, 1966 bp, Hordeum vulgare
cagcccaccttcagtccactagcagatctcttccttcccgtagagcagacggtagagcagaggcagcgcccagctctcagcctagacatgatgatgatgagcgagggagtgagcgtgccgccgtggggcaacctcccggtgagcggcgtcgacgccggcggtggcgacgagacgccgttcctgttcgccgcgctgcgccagtacctgccgtgcaacgacatggcgggcgcgggcggcgacgacgaggacgaggcggcggccatggcggccgcggtggacgcgtacgcgtgcgacgagttccgcatgtacgacttcaaggtgcgccggtgcgcgcgcggccggagccacgactggaccgagtgccccttcgcgcacccgggggagaaggcgcgccgccgcgacccgcgcaagtaccactactccggcaccgcctgccccgacttccgcaagggcggatgcaagcgcggcgacgcctgcgagtacgcgcacggcgtcttcgagtgctggctccacccggcgcgctaccgcacgcagccctgcaaggacggcaccgcctgccgccgccgcgtctgcttcttcgcccacacccccgaccagctccgcgccatgccgtcccagcactccagccccaggagcacgccgctgtccccgctcgccgagtcctacgacggctccccgctccggcgccaggcgttcgagagctacctcagcaagagcatcatgtcctcctcgcccacaagcaccctgctctcctccccgcccaagtcgcccccgtccgagtcgccgccattgtctcccgacggggccgccgcctccttccgccgcggttcatggcccggcgttgggtcgcccgtgaacgacgtcctcgcctcgctccgccagctgcgcctcgccaaggcgcaggcgtcgccgtccggtgggtggcccgcctaccccacctcccctgccgcctacggctcgcccaaggccggcggcctctacagcctccccaccacccccatgggcactcagaccagcgcctccagcttcatggccaacctggagccactcaacctccgcttcctcgacgacgaggagccggttcagagggtggagtccgggagggcgctccgggagaaggtgttcgagcggctgagccgagacggcgccgcgccccgcagctgcgacgtcggtgccggagcaggaggaggccccgacgtcgggtgggtctcagacctcatcaactgaggcagcccgttccttcttccaagtttactttgcggagtcgctcaacaagatggcatgacggaggtggcggtaagaagaagaaggaagaaaaatggcaccccaaaaaaattatcctcaagtttcttttgctatttcaagttgctgcaaattcctgtacatagctgctatctatctcccatgtgaatattcctggttggcggaagggaggcaagatgaaggaggaggatgggtggatttgttttggggttcttgaggaagtaggaatttacccaaaaggaaaaattaccaaaaaaaggagggaagaggtggattggaacttggatggtggtggtcctatctgttgtgttgtgcataggtggaagggtgggtggtgaagcatggaagggaagctggctggtggtggtgacgatgagagggttggaaggtggacttgattcctgtgattactggcgctgttgttgtttctttatcgtcctcgttagtgcatcatctggactagctgaagaccgaccgatttcacattttgttaattaatgtaatccttcgtaaggatggcgatcgacgatccgatcccccacaccatattttgtactactgccttagccgcttagcggcctttaatccttggttcatccaatggcgatgaatcaactcccccccaatgtatttgtgtaatccttcgctattatcaagtaaatgatgtttatctatctcctgtcatatcatatcatatcaaaac

SEQ ID NO: 843 - DNA, 1960 bp, Hordeum vulgare
cagcccaccttcagtccactagcagatctcttccttcccgtagagcagacggtagagcagaggcagcgcccagctctcagcctagacatgatgatgatgagcgagggagtgagcgtgccgccgtggggcaacctcccggtgagcggcgtcgacgccggcggtggcgacgagacgccgttcctgttcgccgcgctgcgccagtacctgccgtgcaacgacatggcgggcgcgggcggcgacgacgaggacgaggcggcggccatggcggccgcggtggacgcgtacgcgtgcgacgagttccgcatgtacgacttcaaggtgcgccggtgcgcgcgcggccggagccacgactggaccgagtgccccttcgcgcacccgggggagaaggcgcgccgccgcgacccgcgcaagtaccactactccggcaccgcctgccccgacttccgcaagggcggatgcaagcgcggcgacgcctgcgagtacgcgcacggcgtcttcgagtgctggctccacccggcgcgctaccgcacgcagccctgcaaggacggcaccgcctgccgccgccgcgtctgcttcttcgcccacacccccgaccagctccgcgccatgccgtcccagcactccagccccaggagcacgccgctgtccccgctcgccgagtcctacgacggctccccgctccggcgccaggcgttcgagagctacctcagcaagagcatcatgtcctcctcgcccacaagcaccctgctctcctccccgcccaagtcgcccccgtccgagtcgccgccattgtctcccgacggggccgccgcctccttccgccgcggttcatggcccggcgttgggtcgcccgtgaacgacgtcctcgcctcgctccgccagctgcgcctcgccaaggcgcaggcgtcgccgtccggtgggtggcccgcctaccccacctcccctgccgcctacggctcgcccaaggccggcggcctctacagcctccccaccacccccatgggcactcagaccagcgcctccagcttcatggccaacctggagccactcaacctccgcttcctcgacgacgaggagccggttcagagggtggagtccgggagggcgctccgggagaaggtgttcgagcggctgagccgagacggcgccgcgccccgcagctgcgacgtcggtgccggagcaggaggaggccccgacgtcgggtgggtctcagacctcatcaactgaggcagcccgttccttcttccaagtttactttgcggagtcgctcaacaagatggcatgacggaggtggcggtaagaagaagaaggaagaaaaatggcaccccaaaaaaattatcctcaagtttcttttgctatttcaagttgctgcaaattcctgtacatagctgctatctatctcccatgtgaatattcctggttggcggaagggaggcaagatgaaggaggaggatgggtggatttgttttggggttcttgaggaagtaggaatttacccaaaaggaaaaattaccaaaaaaaggagggaagaggtggattggaacttggatggtggtggtcctatctgttgtgttgtgcataggtggaagggtgggtggtgaagcatggaagggaagctggctggtggtggtgacgatgagagggttggaaggtggacttgattcctgtgattactggcgctgttgttgtttctttatcgtcctcgttagtgcatcatctggactagctgaagaccgaccgatttcacattttgttaattaatgtaatccttcgtaaggatggcgatcgacgatccgatcccccacaccatattttgtactactgccttagccgcttagcggcctttaatccttggttcatccaatggcgatgaatcaactcccccccaatgtatttgtgtaatccttcgctattatcaagtaaatgatgtttatctatctcctgtcatatcatatcatat

SEQ ID NO: 844 - DNA, 2231 bp, Brachypodium distachyon
ccatgggcggcgccaatagccgcgaggacctcgacctcacctcgtcttctggcgaggaggaggaggacgacgaggagtacgacgcggaggaatcacccgcatccgggaggcagcgggaggaccccctccggaccaccacccccgcgtcgatcgagctcctcgatgccaggctcaagtcgctcgatctcaagtaccagcaccccaacgccgccaagctctacctccacgtcggcggcgcctccgccgacgcccgctggatccccgccgagcgccgcgccacctacgccttcgtcgacaaggcctcccaggacagcagcgattcctcctcctctgaacctaggtgggtcctggaggtgggcccggggcgacgggtcaccgcgcccgttgggccggagctccagctcaaggcgctcccctcgcagcgccgggcggacttcgccgcgtccgggtccgtgtgggcgctgcggctgcccaccgacgccgccttccgccggttccgtgaggagtacgaccggtgcctcttcgagaacacgtacggggtcgaggccacggacgagggccggagggaggtgttcggcgccgacttcgccgcctgggcgcgccccgggttggctgatgacgccgtctgggccgacgcggaggacgacttcagccctcctgccacagcctcggcaagggacctgctcgaggagttcgaggaggaggccggcgacggcagcagcatccagagcctcgcgcttggcgcgctcgacaacagcttcctggtcggcggcgccgggatacaggtggtcaagaacttccgccacggcgtgcacgggaagggcgtctcggtgaagatctcgggcggccgcggcggcagtagcagcactagctattcgacgccgaagaaggccctgctgatgcgcggcgagaccaacatgctgctgatgagccctggtgatgccggcgcacctcgttccaatggcatccaccatgttgacatcgagaccgggaaggttgtcaccgagtggcggtttgagaaggatggaactgacatcacaatgcgagacattgccaatgacagtaagagcgcgcagctcgagccctccggctcaaccttcttggggctggatgacaaccgtctgtgcagatgggatatgcgtgacgcaagaggcagggtgcagacgattggtagctcctcagagtcaccggtgctccactggtcacagggccatcagttctcacggggcaccaatttccagtgctttgcaagtactggggatggttcaattgttgttggttctgttgatggcaagattaggctctattccaagagttcgatgcgtatggcgaagacagtgttcccagggcttgggtcaccaattactcatgtcgatgttacttacgatgggaagtggattttgggcaccactgacacatacttgatcttgatttgcaccatctttaaggacaaagatgggaaagaaaagactgggttcggtgggcgcatgggaagtaagatcgcagcacctaggttgctgaagctcagtccactggattcaatcttggctgggactgacaacaaattccatggcggccagttttcgtgggtaacagagaacgggaagcaagaaaaacatctcgttgcgacagtcggcaagttcagtctcatatggaacttccagcaagtcaaggacagcaaccatcactgctaccgtgaccaggagggtctcaagagctgctactgttacaaggttgtcctcaaggatgaatccattgtagacagccgcttcatgcacgagaattttgccacaagcgactcccccgaagctcctctggtggtcgccaccccgatgaaagtcagctccttcagcatcgcaaacaggcgctgaccttgatgttcatttcattatgtatcttagtgttagaatttacagatttttgtgcagcttgagtactctcctcttcggttgatttcttgcttggttctttgttgtagagctgtgtattgcacgttgttcttgatccagatctgttttctgaaagtctggaggggctgttacatgtatttatttgtgtttgtgtgtccatcaacaatgtgtgcttgccagacattatgtttgactattggggtttcactcttttttttttggaaggagatttcgcttacatgtatggatgcattatcttctctttcgagatggaggatgtattctttccgaggttcgttcagtggcaaagatcatccatga

SEQ ID NO: 845 - DNA, 2229 bp, Brachypodium distachyon
atgggcggcgccaatagccgcgaggacctcgacctcacctcgtcttctggcgaggaggaggaggacgacgaggagtacgacgcggaggaatcacccgcatccgggaggcagcgggaggaccccctccggaccaccacccccgcgtcgatcgagctcctcgatgccaggctcaagtcgctcgatctcaagtaccagcaccccaacgccgccaagctctacctccacgtcggcggcgcctccgccgacgcccgctggatccccgccgagcgccgcgccacctacgccttcgtcgacaaggcctcccaggacagcagcgattcctcctcctctgaacctaggtgggtcctggaggtgggcccggggcgacgggtcaccgcgcccgttgggccggagctccagctcaaggcgctcccctcgcagcgccgggcggacttcgccgcgtccgggtccgtgtgggcgctgcggctgcccaccgacgccgccttccgccggttccgtgaggagtacgaccggtgcctcttcgagaacacgtacggggtcgaggccacggacgagggccggagggaggtgttcggcgccgacttcgccgcctgggcgcgccccgggttggctgatgacgccgtctgggccgacgcggaggacgacttcagccctcctgccacagcctcggcaagggacctgctcgaggagttcgaggaggaggccggcgacggcagcagcatccagagcctcgcgcttggcgcgctcgacaacagcttcctggtcggcggcgccgggatacaggtggtcaagaacttccgccacggcgtgcacgggaagggcgtctcggtgaagatctcgggcggccgcggcggcagtagcagcactagctattcgacgccgaagaaggccctgctgatgcgcggcgagaccaacatgctgctgatgagccctggtgatgccggcgcacctcgttccaatggcatccaccatgttgacatcgagaccgggaaggttgtcaccgagtggcggtttgagaaggatggaactgacatcacaatgcgagacattgccaatgacagtaagagcgcgcagctcgagccctccggctcaaccttcttggggctggatgacaaccgtctgtgcagatgggatatgcgtgacgcaagaggcagggtgcagacgattggtagctcctcagagtcaccggtgctccactggtcacagggccatcagttctcacggggcaccaatttccagtgctttgcaagtactggggatggttcaattgttgttggttctgttgatggcaagattaggctctattccaagagttcgatgcgtatggcgaagacagtgttcccagggcttgggtcaccaattactcatgtcgatgttacttacgatgggaagtggattttgggcaccactgacacatacttgatcttgatttgcaccatctttaaggacaaagatgggaaagaaaagactgggttcggtgggcgcatgggaagtaagatcgcagcacctaggttgctgaagctcagtccactggattcaatcttggctgggactgacaacaaattccatggcggccagttttcgtgggtaacagagaacgggaagcaagaaaaacatctcgttgcgacagtcggcaagttcagtctcatatggaacttccagcaagtcaaggacagcaaccatcactgctaccgtgaccaggagggtctcaagagctgctactgttacaaggttgtcctcaaggatgaatccattgtagacagccgcttcatgcacgagaattttgccacaagcgactcccccgaagctcctctggtggtcgccaccccgatgaaagtcagctccttcagcatcgcaaacaggcgctgaccttgatgttcatttcattatgtatcttagtgttagaatttacagatttttgtgcagcttgagtactctcctcttcggttgatttcttgcttggttctttgttgtagagctgtgtattgcacgttgttcttgatccagatctgttttctgaaagtctggaggggctgttacatgtatttatttgtgtttgtgtgtccatcaacaatgtgtgcttgccagacattatgtttgactattggggtttcactcttttttttttggaaggagatttcgcttacatgtatggatgcattatcttctctttcgagatggaggatgtattctttccgaggttcgttcagtggcaaagatcatccatga

SEQ ID NO: 846 - DNA, 2400 bp, Sorghum bicolor
cggccctcgccgtccccggcgcgtggggcgcgtcgcgtcccccacacgcaccgaccatcccctgccctccccggccccacatccacgctcccgcgccgtacttatacacgctccccgccgctccgacctcactttccccgcctccatcaccaattcaccatctcctcctcccgcaacgcagcccgggtcgcccgtctcgcaactcccgagccgaattcccctccaccgcaaccgccatgggcggctcccacagccgcgaggacatcgacctcacctcctccgacgaagagaaggagtacgaggacgactacgacgcccgatcacccatcgcggaggccgccgcgagcgcggggcagcgcgacgacgacctcctccgcaccgccacaccttcgtcgcttgaggccatcgacgccaagctcaggtcgctggatctcaagtaccagcgtccgacctccgccaagctctacctccacgtcggcggagcctcgccctccgcgcactgggtgcctgccgagcgccgcgcgacctacgccttcgtcgacaaatcgagcgacaacgactcttcgcccaggtggttcctggaggtcggtccggggccgcgggtctccgcgcccgtggactcggcgctccagctgaagacgatccccgcgcagcgccgggcggacttcgccgcgagcggctccgtatgggctctgcgactgcccaccgacgccgaattgcgccggttcagggtggagtacgagcgctgcctcttcgagaacacgtacggggtcgaggccacggacgaggggcggaaggaggtgttcggcgccgacttcgccgcgtgggctcggcccgccgaggccgacgacgctgtttgggccgatgccgaggaaagcctcacccctcccgccgccgcaccagcgaaggacctgcttgaggagttcgaggaagaggccggcgacggcgacagcattcagagcctcgcgcttggggcgcttgacaacagcttcttggtcggtggcgcggggatacaggtggtcaagaacttccgccacggcttgcacgggaagggcgcgtcggtgaagatctcgggagggcgtggcggcagtgggagcgcctattcgacgccgaagaaggcgctgctgatgcgcggtgagactaacatgctgctgatgagcccaggagaggctgtgcgttccaatggtgtccaccatgtcgatatcgagactgggaaggttgtcgctgaatggcggtttgagaaggatggggctgatattacaatgcgagacattgccaacgacagtaagggagcgcagttggaaccctccgggtcgacattcttgggcctggattgcaacaggttgtgtagatgggatatgcgcgactccagaggcagagtgcagacaatcggtagctcatcagagtcaccagtgctgaactggtcacagggtcatcagttctctcggggcaccaacttccagtgctttgcaagtactggggatggatctattgttgttggttctgtggatggcaaaatcaggctctattctaagagctcgatgcgtatggcgaagacagcattcccagggcttgggtccccaattacacacgtggatgttacttatgatgggaaatggattttgggaacaactgacacatacttgatcttgatctgcactatcttcaaggacaaagatgggaaagaaaaaactgggtttagtggccgtatgggaaataagattgctgcaccaaggctgctgaagctgactccacttgattcaattttagcaggaactgacaacaaattccatggtgggcaattctcatgggtaacggagaacggaaagcaggaaaagcaccttgttgctacagtcggcaaattcagtgtcatttggaatttccagcaagtcaaggacagcaaccatgagtgctaccgtgatcagcagggcctcaagagctgctactgctacaaagttgtcctcaaggatgaatcgattgtcgacagccgtttcatgcacgagaagtttgcaagcagcgattctccagaagctccgcttgttgtcgctacaccaatgaaagtcagctccttcagtatagcaaatcgacgctgactctgaagctctttttcccccgctgtgcaaaatagttttgagtagttgcaggttcttgttcagtttgttccttctttagacggtttggctggttggttggttggttttatagttttcttggatcgaggtttcttccggaaagaactggttcgtctgtatggccattagcagtggctcagtaaaattgtatgtctatgtttgttggacatgtaatgtgatggtgtacaagcaaagtaatgttgatctgagactgatgcttgcctctcatggaatgctaatttccattttcggcgtcttgatctttttt

SEQ ID NO: 847 - DNA, 2229 bp, Sorghum bicolor
actttccccgcctccatcaccaattcaccatctcctcctcccgcaacgcagcccgggtcgcccgtctcgcaactcccgagccgaattcccctccaccgcaaccgccatgggcggctcccacagccgcgaggacatcgacctcacctcctccgacgaagagaaggagtacgaggacgactacgacgcccgatcacccatcgcggaggccgccgcgagcgcggggcagcgcgacgacgacctcctccgcaccgccacaccttcgtcgcttgaggccatcgacgccaagctcaggtcgctggatctcaagtaccagcgtccgacctccgccaagctctacctccacgtcggcggagcctcgccctccgcgcactgggtgcctgccgagcgccgcgcgacctacgccttcgtcgacaaatcgagcgacaacgactcttcgcccaggtggttcctggaggtcggtccggggccgcgggtctccgcgcccgtggactcggcgctccagctgaagacgatccccgcgcagcgccgggcggacttcgccgcgagcggctccgtatgggctctgcgactgcccaccgacgccgaattgcgccggttcagggtggagtacgagcgctgcctcttcgagaacacgtacggggtcgaggccacggacgaggggcggaaggaggtgttcggcgccgacttcgccgcgtgggctcggcccgccgaggccgacgacgctgtttgggccgatgccgaggaaagcctcacccctcccgccgccgcaccagcgaaggacctgcttgaggagttcgaggaagaggccggcgacggcgacagcattcagagcctcgcgcttggggcgcttgacaacagcttcttggtcggtggcgcggggatacaggtggtcaagaacttccgccacggcttgcacgggaagggcgcgtcggtgaagatctcgggagggcgtggcggcagtgggagcgcctattcgacgccgaagaaggcgctgctgatgcgcggtgagactaacatgctgctgatgagcccaggagaggctgtgcgttccaatggtgtccaccatgtcgatatcgagactgggaaggttgtcgctgaatggcggtttgagaaggatggggctgatattacaatgcgagacattgccaacgacagtaagggagcgcagttggaaccctccgggtcgacattcttgggcctggattgcaacaggttgtgtagatgggatatgcgcgactccagaggcagagtgcagacaatcggtagctcatcagagtcaccagtgctgaactggtcacagggtcatcagttctctcggggcaccaacttccagtgctttgcgagtactggggatggatctattgttgttggttctgtggatggcaaaatcaggctctattctaagagctcgatgcgtatggcgaagacagcattcccagggcttgggtccccaattacacacgtggatgttacttatgatgggaaatggattttgggaacaactgacacatacttgatcttgatctgcactatcttcaaggacaaagatgggaaagaaaaaactgggtttagtggccgtatgggaaataagattgctgcaccaaggctgctgaagctgactccacttgattcaattttagcaggaactgacaacaaattccatggtgggcaattctcatgggtaacggagaacggaaagcaggaaaagcaccttgttgctacagtcggcaaattcagtgtcatttggaatttccagcaagtcaaggacagcaaccatgagtgctaccgtgatcagcagggcctcaagagctgctactgctacaaagttgtcctcaaggatgaatcgattgtcgacagccgtttcatgcacgagaagtttgcaagcagcgattctccagaagctccgcttgttgtcgctacaccaatgaaagtcagctccttcagtatagcaaatcgacgctgactctgaagctctttttcccccgctgtgcaaaatagttttgagtagttgcaggttcttgttcagtttgttccttctttagacggtttggctggttggttggttggttttatagttttcttggatcgaggtttcttccggaaagaactggttcgtctgtatggccatttgcagtggctcagtaaaattgtatgtctatgtttgttggacatgtaatgtgatggtgtacaagcaaagtaatgttgatctgagactgatgcttgcctctc

SEQ ID NO: 848 - DNA, 2459 bp, Zea mays
cgaaggaacctgctcggcctcgccgtccccggcgcgtggagcgcgtcgcgtccgccacacgcaccgaccatcccctgccctcatcagcaatccccggcccgcagcgtacaaatacacgctccccgccgctccgacctcactttccccgcctccatcaccaattcacgatctcctttcccgcaccgcgccccggatcgccggctcgcaattccggagttaaattcccctccaccgcaaccgtcatgggcggctcccacagccgcgaggacgtcgatctcacctcctccgacgaagaggaggaattcgaggacgactatgacgcccgatcacccatcgcggaggccgcagcgagcgcggggcagcgcgacgacgacctcctccgcaccgccacaccttcctcgcttgaggccatcgacgccaagctcaggtcgctggatctcaagtaccagagacctaccgccgccaagctctacctccacgtcggcggggcctcgccttccgcgcgctgggtgcccgccgagcgccgcgcgacctacgcattcgtcgaccagtcgagcgacgacgcctcctcccccaggtggttcctagaggttgggccggggccgcgggtctccgcgcccgtggactcggcgctccagctgaagacgatccccgcgcagcgccgggcggacttcgccgcgagcgggtccgtatgggctctgcgactacccaccgacgccgaattgcgccggttcagggtggagtacgagcgctgtcttttcgagaacacgtacggagtggaggccacggacgaagggcggaaggaggtgttcggcgccgacttcgccgcgtgggcgcggcctgccgaggccgacgacactgtttgggccgacgcggaggaaagcctcacccctcccgccgcagcaccagggaaggacctgcttaaggagttcgaggaggaggccggcgacggcgacagcatccagagcctcgcgcttggggcgcttgacaacagcttcttagtcggcggcgccgggatacaggtggtcaagaacttccgccacggcttgcacgggaagggcgcgtcggtgaagatctcgggaggccgtggcggcagtgggagcgcttattcgacgccgaagaaggcactgctgatgcgcggcgagactaacatgctactgatgagcccaggagaggctctgcattccaatggtgttcaccatgttgacgttgagactgggaaggttgtcgcagaatggcggtttgagaaggatggagctgatatcacaatgcgagacattgccaatgacagcaagggagcgcagttggaaccctccgggtcgacattcttgggcctggatgacaacaggttgtgtagatgggatatgcgcgacgccagaggccgggtgcagacaatcggtagctcatcagactcaccagtgctgaactggtcacagggtcatcagttctcgcggggcaccaatttccagtgctttgcaagtactggggatggttcaatcgttgttggttctgtggatggcaagatcagactctattctaagagctcgatgcgtatggcgaagacagcattcccaggccttgggtccccgattacacatgtagatgttacttatgatgggaaatggattctgggaacaactgacacatacttgatcttgatatgcactatcttcaaggacaaagatgggaaagaaaagactgggtttagtggccgaatggggaataggattgctgcaccaaggcttctgaagctcactccacttgattcagttttagccgggaccgacaacaaattccacggcgggcaattctcatgggtaacggagaacggaaagcaggaaaagcaccttgtcgctacagtcggcaaattcagcgtcatttggaattttcagcaagtcaaggacagcaaccatgagtgctaccgtgatcagcagggcctcaagagctgctactgctacaaagttgtcctcaaggatgaatcaatcgtcgacagccgcttcatgcacgagaagtttgcgacgagtgactctcctgaagctccgctcgttgtcgctacgccaatgaaagtcagctccttcagtatagcaaatcgacgctgactccgaagctcttttccccagttgtgcagaaataatctgagaagttgcaggtttttgttcagtttgttcctttttcctcttttagacggtttggttagttctgttggtacagaactgatcgaggttcctcccgagaagaactggtttttgtgtcgtgtgcatgtctggtcatttgtagcgggctagcggctcggtaaaatggtgtgtatgtctgttggataaaatgtaccatgtgacaaaaaaaaagtaattttgatttgagactctagttcaagtcttacttttaggccctgtttgtaaactccggagctaatagctagctgccaaaataggtatagaggttacaaacaccattagcta

SEQ ID NO: 849 - DNA, 2311 bp, Avena sativa
gatcactttcctctctctctctcctccaattcccccgatcacctcgcaccccgaattccccccgattcactgaaccctgcctgccatgggcggcgccaacagccgtgaggacctcgacatcacctcctcctccggcgaggaggacgaggacgactaccaggacgaggactacgacccgcgctcccccgcctccggggccaggcagagggccgacgacccgctccgggccaccacccccgcctccatccagttcctcgacgccaagctcaaggccctcgacctcaagtacaagcagccgcagaccgacaacgccgccaggctctacctccacgtcggcggcgcctccgccgacgcgcgctgggtgcccgccctgcgccacgccacctacaacttcgtcgacaaggcggcgaacgaggacgacagcgatcgggccaggtgggtcctcgaggtgggcccgggccggaaggtctcggcgcccgtggggcccgagctccagctcaaggcgctcccggcccagcgccgggccgacttcgcagcgtcgggctccgtgtgggcgctgcgcctccccgacgacgccgccttccgccggttccgggacgagtacgaccggtgcctctttgagaacacctacggggtcgaggccacggacgagggccgcaaggaggtcttcggcgccgacttcgccgcatgggcgcgccccgccgaggccgacgacgccgtctgggccgacgcggaggacggcttcacccctcctcccccggtcgccgcctcggccagggacctgctcgaggagttcgaggaggaggccggcgacggcaccggcatccagagcctcgcgctcggcgcgctcgacaacagcttcctggtcggtggcaccggcatacaggtcgtcaagaacttccgccacggcgtgcacgggaagggcgtgtccgtgaagatctccggtggccgccgtggcagtaccaccgccagcacatactcgacgccgaagaaggcccttctgatgcgcggcgagaccaacatgctgctcatgagccctggagacaccggcgcggctcggtccaatggcgtccaccatgtcgacatcgagactggcaaggttgtcacggagtggcggttcgagaaggacggaactgacatcaccatgcgagacattgccaacgacagtaagagctcccagctagaaccctccgggtcaaccttcttggggctggatgacaaccggctctgcaggtgggatatgcgtgatgcgagaggcagggtgcagacgatcggtacctcttcagagtcaccggtgctgcactggtcacagggtcaccagttctcaaggggcacaaacttcaactgctttgcaagtactggggatgggtccattgttgttggttctatagatggcaagattaggctctattctaagagttccatgcggatggccaagacagcgttcccagggcttggatcaccaattacgcatgtggatgttacttacgatgggaagtggatcttgggcacgacagatacatacttgattttgatctgcaccatcttcaaggacaaggatgggaaagacaagaccgggttcagtgggcgtatgggaaacaggatcgcggctccaaggttgctcaagctcagtccactggattctatcttggctggcaatgacaacaaattccatggtggacagttttcatgggtaacagaaaacggaaagcaagaaaagcacctggttgcaacagtgggcaaattcagtctcatctggaacttccaccaagtgaaggacagcaaccaccactgctaccgtgaccaggagggcctcaagagctgctactgttacaaggtcgtcctcaaggaggaatccattgtcgacagccgcttcatgcatgagaacttcgcgacgtccgactcccctgacgctccgctggtggtcgccacacctcagaaagtcagctccttcagcattgcaaacaggcgctgactctagtgtccttttcattctgtgtcgatagtgttagatgttacaggtttctgtgcagcttgattggtttcttgggttggtttgttactactacgttctttgtgtagagttgtgacttggctggctttcgacagggaggaccattgtttcggaaaagcttgtctgttgataatgctgttcttggttaagaactagtgggctttttctgaaagtttggagaaactgcttgtgctcgtttgtaaccattcggcgagagaaatgatgtatgtttgccagacaatacgtttgtgtttggatgttccttatgttcagctcaatgctagtagtaatcattcc

SEQ ID NO: 850 - DNA, 2350 bp, Panicum virgatum
gcacgacccatctcatctccagcgcagcccaggcggcccgagcccaaaaataggctgcaccagaacgcctccgtcgtttcccaatcccctgcggccaccctcaccgccgccggcagcggcgccaccctccggtgggtgtccgccaccgcgttcacgcgctcccctcctggctgtcggccccgctcctcctctatttatatccccgccctgcccacctccacgctttccttaggcaggagcgcgcagccggcccctgcccttcgtcttcgctccttccccccgaataaaatttcctacccaaggaaacctacccaatccattcgtccggcggccgatccatctgtccctccagggagaggaaggaataatcagtcagtcagttattcagtcaatcggagcggaggagagccggaatccagcaggagcgcgccgcgggttgatcccttgcgtctccggccctgccgcgcgggcgcggcgacgtctctgctgtgcctgtgcttgcgtcgcggaggacgaatctgtgcgggagtgtgtgtgtgaggaagaggaagaggaaggtggaggagggactcttggattggcatctccctcgctgggttgcgctgcgtcgcacggcaagacggcggccttgaagatgcgggtgctggaggacgacctcttcccctccacccccggcaaggtcaagatcgagagggcgggcaccatgaaccggcagctgcaccgctgcttcgcctccaccagcaccatgttcctgtgggcgctcttcctcgtcgccatgaccgcctcctacctcagcttccagtccttcgtcgacacctcctccaagtacttcgccgcctcctggggcgggctgcactgggagcggcagatccgagcgtccgccgcgccgaggaggccgccgggctcggcggacggggcggggatgtcggtgctggtgaccggcgccgccggcttcgtcggcacgcactgctcgctcgcgctccgcaaacgcgggcgacggcgtcgtcggcgtcgacaacttcaacgcctactacgacccctcgctcaagaaggcccgcaaggcgctgctctcctcgcatggggtgttcgtcgtcgagggcgacatcaacgacggccgcctcctggccaagctcttcgacgtcgtgcccttcacgcacgtgctccacctcgccgcgcaggccggcgtgcgctacgccatggagaacccggcgtcctacgtgcactccaacatcgccggcctcgtcacgctcctcgaggcctgcaaggacgccgacccgcagccggccatcgtctgggcgtcctcctcctccgtctacggcctcaacgacaaggtccccttctcggagcgcgaccgcaccgatcagccggcgtcgctgtacgcggcgaccaagaaggccggcgaggagatcacgcacacgtacaaccacatctacggcctctccatcaccggcctccgcttcttcaccgtgtacgggccctggggacggccggacatggcctacttctctttcacccgcaacatcctgcaggggaagcccatcacggtgtaccgcggcaaggaccacgtcgacctggcccgtgacttcacctacatcgacgacatcgtcaagggctgcctcggctccctggacacggccggcaagagcacgggcaccggcggcaagaagcgcggcccggcgccctacaggatcttcaacctcggcaacacctcgcccgtgacggtgcccaacctggtgtccatcctggagaagcacctccgcgtgaaggcgaagaagaacgtggtcgagatgcccggcaatggcgacgtgcccttcacccacgccaacatctccctcgccagggaacagctcgggtacaagccgaccaccaacctcgacgttggcctcaagaagttcgtcaagtggtacctgtcctactacggctacaccaggggatccaagaactttcggcaatagccatggtcgtctgattctttcttctcaattcttctttttcctctttggcccggccgcggccaccactcccggatcaaacattgacattctacctggattttttggtgggaatatgttttagggcgttccttgatcagacaaaaatactggggaaaaaattcttttcttggtgaggagagggaggaaggaggaagaaagcaatagagagcagcagccgttttcttttctttcttcatcttcccctttgtgtaaattggatgtgctccatgaaacttttttccctccatcctcagaattccaatgtaatatcaaattcttgccgatctgatgcgctggcaccgaattcgattggcgaatgctggtagttcccacggatgatcgctggttcaaatttg

SEQ ID NO: 851 - DNA, 2289 bp, Sorghum bicolor
aggctgggactcaactcaacgcccccgatcgcctccgtctcccaatcccgagccgcccgtgcgcccgtccgccgcggccaccacccgctccgcccgcccctcctcgtcaccagcggcggcaccacccctctgctccgccaccgcgttcacgcgctcccgtcgctgtcggccccgctcccctatttatatccccacccccatcccacctccacgctttccttaggcaggcgcgcatccagctcctgccctccttttcctctcctctcctcccgaataaaatttcctggacccggggcgcgctctcctcgctcccaaaggaaggaaacctatctatcattccggcggccgatccatctatccttccggccagggagagcaaggaataatcaatcaatcggccagtgggtcagtcggaggaggaggaggaggaggagagccggagtccgtcgtccagcgccgcgcgcgggttgatcctttgcgtctccccggccctgctccgcggcgacgccttttgcggtgcttgcgttgcgtcgaggaagcgagcagaatctgcgacgagaaggaggagcacgagaggcatccatcgggtcgcgcgggcgtccgtcgcacggcaagacggcggcgttgaagatgcgggtgctggaggaggacctcttcccctccaccccaggcaaggtgaagatcgagcgggcgggcgccatgaaccggcagctccaccgctgcttcgcgtccaccagcaccatgttcctgtgggcgctgttcctcgtcgccatgacggcgtcctacctcagcttccagtccttcgtcgacacctcctccaagtacttcgccgcctcatggggcggcctgcactgggagcggcagatccgcgcgtccgccgcgcccaggcggccaccgggttccgccgccggggccgggatgtcggtgctggtgaccggcgccgcgggcttcgtcggcacccactgctccctcgcgctccgcaagcgtggcgacggcgtcgtcggcgtcgacaacttcaacgcctactacgacccctcgctcaagaaggcgcgcaaggcgctgctcgcctcccacggggtgttcgtcgtcgagggcgacatcaacgacggccgcctactcgccaagctcttcgacgtcgtgcccttcacccacgtgctccacctcgccgcgcaggccggcgtgcgctacgccatggagaacccggcgtcgtacgtgcactccaacatcgccggcctcgtcacgctcctcgaggcctgcaaggacgccgacccgcagccggccatcgtctgggcctcgtcgtcctcagtctacggcctcaacgacaaggtccctttctcggagcgcgaccgcaccgatcagccggcctcgctctacgcggccaccaagaaggccggcgaggagatcacgcacacgtacaaccacatctacggcctctccatcaccggcctccgcttcttcaccgtgtacgggccctggggccgccccgacatggcctacttctccttcacccgcaacatcctgcaggggaaacccatcacggtgtaccgcggcaaggaccacgtcgacctggcccgcgacttcacctacatcgacgacattgtcaagggctgcctcggctccctggacacggccggcaagagcaccggcacggggggcaagaagcgtgggccggcgccctacaggatcttcaacctcggcaacacctcgcccgtcacggtgcccaacctggtgtccatcctggagaagcacctccgcgtcaaggccaagaagcacgtggtcgagatgcccggcaatggcgacgtgcccttcacccacgccaacatctcactcgccagggagcagctcgggtacaagccctccactaacctcgacgtcggcctcaagaagttcgtcaagtggtacctgtcctactacggctacaccaggggatccaagaactcgcgacaatgatccgtgctaattctttctttcttcttcgtttcccactttggcccggccgcggtcaccactcctggatcaaacattgacattcttatctggattttctttttggtggaattagggtgttccttgttgaggagagaaacaccggggggaaaaaaattctttgcatggtgaggagaggggaggaggaagaaagctaatggggagcagtattttcttttctctgttttttcctccctccaccatcttctcttctttgtgtaaattggtcgctctccattaatccttttcgggactccgatgtgctgaccctaatcaaactgtggtaatccagttcaaattgaa

SEQ ID NO: 852 - DNA, 2257 bp, Sorghum bicolor
aggctgggactcaactcaacgcccccgatcgcctccgtctcccaatcccgagccgcccgtgcgcccgtccgccgcggccaccacccgctccgcccgcccctcctcgtcaccagcggcggcaccacccctctgctccgccaccgcgttcacgcgctcccgtcgctgtcggccccgctcccctatttatatccccacccccatcccacctccacgctttccttaggcaggcgcgcatccagctcctgccctccttttcctctcctctcctcccgaataaaatttcctggacccggggcgcgctctcctcgctcccaaaggaaggaaacctatctatcattccggcggccgatccatctatccttccggccagggagagcaaggaataatcaatcaatcggccagtgggtcagtcggaggaggaggaggaggaggagagccggagtccgtcgtccagcgccgcgcgcgggttgatcctttgcgtctccccggccctgctccgcggcgacgccttttgcggtgcttgcgttgcgtcgaggaagcgagcagaatctgcgacgagaaggaggagcacgagaggcatccatcgggtcgcgcgggcgtccgtcgcacggcaagacggcggcgttgaagatgcgggtgctggaggaggacctcttcccctccaccccaggcaaggtgaagatcgagcgggcgggcgccatgaaccggcagctccaccgctgcttcgcgtccaccagcaccatgttcctgtgggcgctgttcctcgtcgccatgacggcgtcctacctcagcttccagtccttcgtcgacacctcctccaagtacttcgccgcctcatggggcggcctgcactgggagcggcagatccgcgcgtccgccgcgcccaggcggccaccgggttccgccgccggggccgggatgtcggtgctggtgaccggcgccgcgggcttcgtcggcacccactgctccctcgcgctccgcaagcgtggcgacggcgtcgtcggcgtcgacaacttcaacgcctactacgacccctcgctcaagaaggcgcgcaaggcgctgctcgcctcccacggggtgttcgtcgtcgagggcgacatcaacgacggccgcctactcgccaagctcttcgacgtcgtgcccttcacccacgtgctccacctcgccgcgcaggccggcgtgcgctacgccatggagaacccggcgtcgtacgtgcactccaacatcgccggcctcgtcacgctcctcgaggcctgcaaggacgccgacccgcagccggccatcgtctgggcctcgtcgtcctcagtctacggcctcaacgacaaggtccctttctcggagcgcgaccgcaccgatcagccggcctcgctctacgcggccaccaagaaggccggcgaggagatcacgcacacgtacaaccacatctacggcctctccatcaccggcctccgcttcttcaccgtgtacgggccctggggccgccccgacatggcctacttctccttcacccgcaacatcctgcaggggaaacccatcacggtgtaccgcggcaaggaccacgtcgacctggcccgcgacttcacctacatcgacgacattgtcaagggctgcctcggctccctggacacggccggcaagagcaccggcacggggggcaagaagcgtgggccggcgccctacaggatcttcaacctcggcaacacctcgcccgtcacggtgcccaacctggtgtccatcctggagaagcacctccgcgtcaaggccaagaagcacgtggtcgagatgcccggcaatggcgacgtgcccttcacccacgccaacatctcactcgccagggagcagctcgggtacaagccctccactaacctcgacgtcggcctcaagaagttcgtcaagtggtacctgtcctactacggctacaccaggggatccaagaactcgcgacaatgatccgtgctaattctttctttcttcttcttttcccactttggcccggccgcggtcaccactcctggatcaaacattgacattcttatctggattttctttttggtggaattagggtgttccttgttgaggagagaaacaccggggggaaaaaaattctttgcatggtgaggagaggggaggaggaagaaagctaatggggagcagtattttcttttctctgttttttcctccctccaccatcttctcttctttgtgtaaattggtcgctctccattaatccttttcgggactccgatgtgctgaccct

SEQ ID NO: 853 - DNA, 2311 bp, Zea mays
caaaataggcgccgcccgcccaggccatgggaccccaccgcccccgtctctcaattcaatcaatcccgggccgcccgtccgccgcggctaccactcgcccctcctcgtcaccagcggcggcaccatctgctccgccaccgcgttcacgcgctcccgtcgctgtcggccccgctcctctatttatataccgccccatcccagctccacgctttccctaggcaggcgcgcatccagctcctgccttgcttcctctcctcccggttcccgaataaaatttcctggacccggagcgcgcagcgcgctcccccgcctcccaaggaaacttatctaagcattccggcggtcgatccatcttcccgtccagggagagcaaggaataatcaatcaaccggccagtgaaacgttaggaggaggaggagagccggagtccgtccagcgcggcgcgggttgatcccttgcgtctccgcccctgccccgcgccggcgacacctttttgcggtgctagcgttgcgtcgaggagggacaggcgctctgcgtccttcgcacggcaacggcaagacggcggcgttgaagatgcgggtgttggaggaggacctcttcccctccaccccaggcaaggtgaagatcgagcgggcgggcgccatgaaccggcagctccaccgctgcttcgcgtccaccagcaccatgttcctgtgggcgctgttcctcgtcgccatgacggcgtcctacctcagcttccagtccttcgtcgacacctcctccaagtacttggccgcctcctggggcggcctgcactgggagcggcagatccgtgcgtccgccgcgccgaggcggccccccgggtccgccgccggggccgggatgtcggtgctggtcacgggcgccgcgggcttcgtcggcacccactgctccctcgcgctccgcaagcgcggcgacggcgtcgtcggcgtcgacaacttcaacgcctactacgacccgtcgctcaagaaggcgcgcagggcgctgctggcctcccacggggtgttcatcgtcgagggcgacatcaacgacggccgcctcctggccaagctcttcgacgtcgtgccattcacccacgtgctccacctcgctgcgcaggccggcgtgcgctacgccatgcagaacccggcgtcgtacgtgcactccaacatcgcggggctcgtcacgctcctcgaggcctgcaaggacgccgacccgcaaccggccatcgtctgggcctcctcctcctccgtctacggcctcaacgacaaggtccccttctccgagcgcgaccgcaccgaccagccggcctcgctctacgcggccaccaagaaggccggcgaggagatcacgcacacgtacaaccatatctacggcctatccatcaccggcctccgcttcttcaccgtgtacgggccctggggccgccccgacatggcctacttctccttcacccgcaacatcctgcaggggaaacccatcacggtgtaccgcggcaaggaccgcgtcgacctggcccgcgacttcacctacatcgacgacattgtcaagggctgcctcggctccctggacacggccggcaagagcaccggcaccggcggcaagaagcgcgggccggcgccctacaggatcttcaacctcggcaacaccgcgcccgtcacggtgcctaacctggtgtccatcctggagaagcacctccgcgtcaaggccaagaagaacgtggtcgagatgcccggcaatggcgacgtgcccttcacccacgccaacatcaccctcgccaggcagcagctcgggtacaagcccaccaccaacctcgatgtcggcctcaagaagttcgtcaagtggtaccagtcctactacggctacaccaggggatccaagaactcgcgacaatgatccatgctaattcttccttcttcctttctcgctttggcccggccgcggccacccactctcggatcaaacattgacattcttatcaggatttttttggtggaaatatgttatgttagggtgttcctttattaagtagagaaataccggggacaaattctttgcttggtgaggagatgggaggagagtgctggaggaagaaaagcaatcgagggctggaggaagaaaagcaatggggagcaacctttactttttctcttttctcctcctgtatctttcttctctctgtgtaaattggtcggcgctctacaggatcttaatccttttccgctccgttaatccttttccggattccgatgtgctgaccctaatcaaactgtggtagtcaagtcagattatccccagttcaaattgaattcca

SEQ ID NO: 854 - DNA, 2900 bp, Zea mays
ggatagcaaccgttttcttttcattcacatctgattaaacttggaggcaaatttgattttcttttaccacgtctccagatcgacaatctgaacatggaagcttctaaaccgggaaaagactcatctcccagacgagacgactgacaacaaatcacattaacgtccacgcgcaaaaacgccaataaatgggatgagcctggatcacaaaatttttagcgcgtccggccgttcgcccagcgcccatccatctcatcccagcgcgtccgaccaccaaaataggcgccgcccgccgcccggacccgatcgcctcccaatcccgggccgccgtgcgcccgtccgccgcggccacctccctggcctcctcgtcacctgcggcggcaccctctgcgccgccaccgcgttcacgcgctcccgtcgctgtcggccccgctcccctatttatatccccgccccgtcgctgtcggcaggcgcgcatcaagctcctgccccccctttcctcttcatcctctcctccctcgcggcgcgcacgctctccgccctcccaagtcccaaggaaacctatccaccattccggcggtcgatacatccatccgtccagggagagcaaggaataatcaaccaatcggccagcgaatcagtcgaagggaggaggagagccggagtccgaccagcgcggcgcgggttggtggtcccttgcgtctccggctctgccccgcggcgccgtcttttgtggttcttgcgttgcgtcgaggaagcagaatccgcgacgaggagaaggagggagaggcgttcatcgggttgcgctgcgtctgtcgcacggcaagacggcggcgttgaagatgcgggtgctggaggaggacctcttcccctccaccccgggcaaggtgaagatcgagcgggcgggcgccatgaaccggcagctccaccgctgcttcgcgtccaccagcaccatgttcctgtgggcgctgttcctcgtcgccatgacggcgtcctacctcagcttccagtccttcgtcgacacctcctccaagtacttcgccgcctcctggggcggcctgcactgggagaggcagatccgcgcgtccgccgtgccgaggcggccccccgggtcagccgccggggccgggatgtcggtgctcgtcacgggcgccgcgggcttcgtgggcacccactgctccctcgccctccgcaggcgcggcgacggcgtggtcggcgtcgacaacttcaacgcctactacgacccgtcgctgaagaaggcgcgcagggcgctgctcgcctcccacggggtgttcgtcgtcgagggcgacatcaacgacggccgcctcctggccaagctcttcgatgtcgtgcccttcacccacgtgctccacctcgccgcgcaggccggcgtgcgctacgccatggagaacccggcgtcgtacgtgcactccaacgtcgccggcctcgtcacgctcctcgaggcctgcaaggacgccgacccgcagccggccatcgtctgggcctcctcctcctccgtctacggcctcaacgacaaggtccccttctcggagcgcgaccgcaccgaccagccggcctcactctacgcggccaccaagaaggccggcgaggagatcacgcacacgtacaaccacatctacggactctccatcaccggcctccgcttcttcaccgtgtacgggccctggggccgccccgacatggcctacttctccttcacccgcaacatccttcaggggaagcccatcacggtttaccgcggcaaggaccacgtggacctggcccgcgacttcacctacatcgacgatattgtcaagggctgcctcgcctccctggaaacggccggcaagagcaccggcaccggcggcaagaagcgcgggccggcgccctacaggatcttcaacctcggcaacacctctcccgttacggtgcccaacctggtgtccatcctggagaagcacctccgcgtcaaggccaagaagaacgtggtcgagatgcccggcaacggcgacgtgcccttcacgcacgccaacatctccctagccagggagcagctcgggtacaaacccaccaccaacctggacgtcggcctcaagaagtttgtcaagtggtacctgtcctattacggctacaccaggggaggatccaagaactcgcgacattgatccgtgctaattctttctccttttcctgctttggcccggccgtggcccccatgctaggtcggacattgacattggattttgttggttggtggaaatatgttatgttaggatgttcgtcgaagaaaaatccttcgcttggtgtggagaggtctggaggaagaaagcaatggagagcagtcttttttttttcctttttccttcctccgtcttctttctctctgtgtaaattggccgttctccattaatcaaactgcaattctaaagtcgcgctgttcattgcgccgtcagactgtcagagtaaccgccggagacgagggagaagaaatcggcggtccggtccggtccggtcgtggcagtcctcgtgcaaatagcccgcggcaacgtgggcctcgccgtcgtggataagataagcggcctgcgactgccagcgtggtggcgtgaggtacctcgaaccgcgcgaagtggtcgccagctggctcccgcctcgctcggtccctctgcactgccggtgggccatctgcagctttgttgctccgtgggacccatatgtctgttgagtctgaatggagatgggtcatgttcatgcctgtggggttcataccccacgtaatggtagctcacatgggtggggccgtcagacgcggttgcgtgggccttcgtctttgagctgccatagaggatagtacgaactgcaattcttttatatatcaaactggatgcgaatgtgcattgtgcttg

SEQ ID NO: 855 - DNA, 1652 bp, Brachypodium distachyon
cgggcaagaagatgcgggcgctggaggacgacctctttccgtccactccagggaaggtgaagatcgagagggcaggcgggggcgccatggccatgaaccgccagctccaccgctgcttcgcctccaccagcacgatgttcctctgggcgctcttcctcgtcgccatgaccgcgtcctacctcagcttccagtccttcgtcgacacctcctccaagtacttcgccgcctcctggggcggcctccactgggagcgccagatccgcgcgtccgccgccgtcaggcgcccgcctggctccgccgcaggggcggggatgtcggtgctcgtgaccggcgcggcggggttcgtcggcacgcactgctcgctcgcgctccggaagcgcggggacggcgtcgtcggcatcgacaacttcaactcctactacgacccttccctcaagaaggcccgcaaggcgctgctcacctcgcacggcgtgttcgtcgtcgagggcgacatcaacgacggccgcctccttgccaagctcttcgacgtcgtgcccttcacccacgtgctccacctcgccgcgcaggccggggtgcgctacgccatggagaacccggcgtcctacgtgcactccaacgtcgccggcctcgtcaccctcctcgaggcctgcaagaacgccgacccgcagccggctatcgtctgggcatcgtcttcctccgtctacggcctcaacgacaaggtccctttctcggaggccgaccgcaccgaccagccggcgtcgctgtacgccgccaccaagaaggccggcgaggagatcacccactcgtacaaccacatctacgggctctccatcaccggcctccgcttcttcaccgtgtacggtccctggggccggccggacatggcctacttctccttcacgcgcaacatcctgcaggggaagcccatcacggtgtaccgcggcaagaaccacgtcgacctggcccgcgacttcacatacatcgacgacatcgtcaagggctgcctgggctccctcgacacggccggcaggagcaccggcaccggcggcaagaagcgcgggccggcgccctacaggatcttcaacctcggcaacacatcccctgtcacggtgcccaccctggtgtccatcctcgagaagcacctccgcgtgaaggccaagaagcacgtgatcgagatgcccggcaatggcgacgtgccattcacccacgccaacatctccctcgccaggcagcagctcggctacaagccaacgaccaacctcgacgccggcctcaagaagttcgtcaaatggtacctctcctactacggctacaccaggggatccaagaacttgtgactaccactactgctacattccatccctattcttcccctcctcttgctgattcttttattttccatttctttttcttctttggcctgctccccgcggcaggcacaacttccggatcaaacatttttagactcgtggcatacccggatcaaacattaacattcttgtctcaatttttttggcggaaatattttatgctgtcctccgatgaggaaagtaaaaaatccaggttcagattcttttcttggagtgacggaggggatggaagaagaagcaattggggaagcttcccctcatgatttatttcattgttcatct

SEQ ID NO: 856 - DNA, 1335 bp, Brachypodium distachyon
gcaagaagatgcgggcgctggaggacgacctctttccgtccactccagggaaggtgaagatcgagagggcaggcgggggcgccatggccatgaaccgccagctccaccgctgcttcgcctccaccagcacgatgttcctctgggcgctcttcctcgtcgccatgaccgcgtcctacctcagcttccagtccttcgtcgacacctcctccaagtacttcgccgcctcctggggcggcctccactgggagcgccagatccgcgcgtccgccgccgtcaggcgcccgcctggctccgccgcaggggcggggatgtcggtgctcgtgaccggcgcggcggggttcgtcggcacgcactgctcgctcgcgctccggaagcgcggggacggcgtcgtcggcatcgacaacttcaactcctactacgacccttccctcaagaaggcccgcaaggcgctgctcacctcgcacggcgtgttcgtcgtcgagggcgacatcaacgacggccgcctccttgccaagctcttcgacgtcgtgcccttcacccacgtgctccacctcgccgcgcaggccggggtgcgctacgccatggagaacccggcgtcctacgtgcactccaacgtcgccggcctcgtcaccctcctcgaggcctgcaagaacgccgacccgcagccggctatcgtctgggcatcgtcttcctccgtctacggcctcaacgacaaggtccctttctcggaggccgaccgcaccgaccagccggcgtcgctgtacgccgccaccaagaaggccggcgaggagatcacccactcgtacaaccacatctacgggctctccatcaccggcctccgcttcttcaccgtgtacggtccctggggccggccggacatggcctacttctccttcacgcgcaacatcctgcaggggaagcccatcacggtgtaccgcggcaagaaccacgtcgacctggcccgcgacttcacatacatcgacgacatcgtcaagggctgcctgggctccctcgacacggccggcaggagcaccggcaccggcggcaagaagcgcgggccggcgccctacaggatcttcaacctcggcaacacatcccctgtcacggtgcccaccctggtgtccatcctcgagaagcacctccgcgtgaaggccaagaagcacgtgatcgagatgcccggcaatggcgacgtgccattcacccacgccaacatctccctcgccaggcagcagctcggctacaagccaacgaccaacctcgacgccggcctcaagaagttcgtcaaatggtacctctcctactacggctacaccaggggatccaagaacttgtgac

SEQ ID NO: 857 - DNA, 2009 bp, Avena sativa
tattcctccctccacgcccaggggaagcaaggaaggaaggagagaaggggaagggattactactacatatacgcgagccgaggatcacacggaacccaccgcgccgattcttgccttgtctgttccttgatcctcccgtccggagtcggttgcgttgcgtcgtccgggaggagaagcagcagcagcagcatcagtagccagattggattcttcagcttattagcaagaagaagatgcgggcgctggaggacgacctgttcccgtccactcccggcaaggtgaagatcgagcgggcggggggcgccatgaaccggcagctgcaccgctgcttcgcctccaccagcaccatgttcctctgggcgctcttcctcgtcgccatgaccgcctcctacctcagcttccagtccttcgtcgacacctcctccaagtacttcgccgcctcctggggcggcctgcactgggagcgccagatccgggcatccgccgcgccgcgccgcccgccaggctccgccgccggcgccggcatgtcggtgctcgtcaccggcgcctccggcttcgtcggcgcgcactgctccctcgcgctccgcaagcgcggggacggcgtcgtcggcatcgacaacttcaacgcctactacgacccgtccctcaagaaggcgcgcaaggcgctcctcgcctcccacggggtctacgtcgtcgagggcgacatcaacgacggccggctcctcgccaagctcttcgacgtcgtccccttcacccacgtgctccacctcgccgcgcagccggggtgcgctacgccatggagaacccggcatcctacgtgcactccaacgtcgcggggctcgtcacgctcctcgaggcctgcaagaacgccgacccgcagccggccgtcgtctgggcctcctcatcgtccgtctacggcctcaacgacaaggtgcccttctccgagtcccaccgcaccgaccagccggcgtccctctacgccgccaccaagaaggccggcgaggagatcacccactcgtacaaccacatctacggcctctccatcaccggcctccgcttcttcaccgtctacgggccatggggccgccccgacatggcatacttctccttcacacgcaacatcctgcaggggaagcccatcaccgtctaccggggcaagaaccacgtcgacctcgcccgcgacttcacatacatcgacgacatcgtcaagggctgcctgggctcactcgacacggccggcaggagcacgggcaccggcggcaagaagcgcggcccggcgccgtacaggatcttcaacctcggcaacacatccccggtcacggtgcccaccctcgtgtccatcctcgagaagcacctccgcgtcaaggccaagaagcacgtggttgagatgccaggcaacggcgacgtgccattcacacacgccaacatctccctcgccaggcagcagctcgggtacaagcccaccaccaacctcgacgccggcctcaagaagttcgtcaaatggtacctctcgtactacggctacagcaggggatccaagaacttgtgaccgctgctgctgtgctgcgacaccaccgtcccaattcttccctcctcccttcccgttcttgctgctaattctttattccctcctcggcccgaccctcgcggcggccggccactccaggatcgaacatttttagactcaatggcatataccccgatggatggatggatcatcgagcattaacattcctgtcgcgattcttttggatgggggaaattgtttttttagggcgttcgttctccgatgaacaaagaaagaaaaattccgttatgaaattcttttcttggtgccgagacgatggtggaagaagaaagcaatggcggatagatagcttttcttaatcccattttctttctttttttgttacttctcctcaacccccaccttgttcatctgtaaagttgctcttctctcaaactttatattcagttaatttatatcaatgtaatctcgagctctgaga

SEQ ID NO: 858 - DNA, 1845 bp, Triticum aestivum
  misc_feature (34)..(34): n is a, c, g, or t
  misc_feature (64)..(64): n is a, c, g, or t
  misc_feature (77)..(77): n is a, c, g, or t
  misc_feature (79)..(79): n is a, c, g, or t
  misc_feature (86)..(86): n is a, c, g, or t
  misc_feature (170)..(170): n is a, c, g, or t
  misc_feature (178)..(178): n is a, c, g, or t
  misc_feature (180)..(180): n is a, c, g, or t
  misc_feature (190)..(190): n is a, c, g, or t
  misc_feature (202)..(202): n is a, c, g, or t
  misc_feature (215)..(215): n is a, c, g, or t
  misc_feature (221)..(221): n is a, c, g, or t
  misc_feature (251)..(251): n is a, c, g, or t
  misc_feature (424)..(424): n is a, c, g, or t
  misc_feature (536)..(536): n is a, c, g, or t
  misc_feature (594)..(594): n is a, c, g, or t
  misc_feature (597)..(597): n is a, c, g, or t
  misc_feature (922)..(922): n is a, c, g, or t
  misc_feature (931)..(931): n is a, c, g, or t
  misc_feature (956)..(956): n is a, c, g, or t
  misc_feature (969)..(969): n is a, c, g, or t
  misc_feature (988)..(988): n is a, c, g, or t
  misc_feature (1114)..(1114): n is a, c, g, or t
  misc_feature (1117)..(1117): n is a, c, g, or t
  misc_feature (1195)..(1195): n is a, c, g, or t
  misc_feature (1276)..(1276): n is a, c, g, or t
  misc_feature (1834)..(1834): n is a, c, g, or t
aataaaattcgctcgcgcaaattccttccgtccnccccggatttcccgacgggacacgcacgcncgcgccaggagtncncccgtcngacggaaggcaccgcgccgatttgcgcctgcttgcttgcttgcttgatcctccatccgtccgtggttgcgtcgtcgtccggganaaggaggngnagcaaggggngtgagggattcntggtttcttgatnggcttncttgccgcggcgggcgggcgggcagcacgncgacggcgtgctgcaagaagatgcgggcgctggaggacgacctcttcccgtcgacccccggcaaggtgaagatcgagcgggcgggcggcaccatgaaccgccagctgcaccgctgcttcgcttcgactagcaccatgttcctctgggcgctcttcctcgtcgccatgaccgcntcctacctcagcttccagtccttcgtcgacacctcctccaagtacttcgccgcctcctggggcggcctgcactgggagcgccagatccgcgcctccgccgcgccgcgcaggncgccgggctccgcggccggggccgggatgtcggtgctcgtcacgggcgcctccgggtncgncggcgcgcactgctcgctcgcgctgcgcaagcgcggggacggcgtcgtcggcatcgacaacttcaacgcctactacgacccctcgctcaagaaggcccgcaaggcgctgctgacctcccacggcgtcttcgtcgtcgagggcgacatcaacgacggccgcctcctcgccaagctcttcgacgtcgtccccttcacgcacgtgctccacctggcggcccaggccggcgtgcgctacgccatggagaacccggcctcgtacgtgcactccaacgtggcggggctcgtcaccctcctggaggcctgcaagaacgccgacccgcagccngccatcgtntgggcctcctcctcctcggtctacngcctcaacgacanggtgcccttctccgagtcncaccgcacggaccagccggcgtcgctctacgcggcgaccaagaaggccggcgaggagatcacccactcgtacaaccacatctacgggctgtccatcaccggcctgcgcttcttcacggtgtacggnccntgggggcggccggacatggcctacttctccttcacccgcaacatcctgcaggggaagcccatcacggtgtaccggggnaagaaccacgtggacctcgcccgcgacttcacctacatcgacgacatcgtcaagggctgcctggggtcgctggacacggcnggcaggagcacgggcaccggcggcaagaagcgcgggccggcgccgtaccggatcttcaacctgggcaacacgtccccggtgacggtgcccaccctggtggccatcctggagaagcacctccgcgtgaaggcgaggaagcacgtggtggagatgcccggcaacggcgacgtgcccttcacccacgccaacatctcgctcgcccggcagcagctcgggtacaagcccgccaccaacctcgacgccggcctcaagaagttcgtcaagtggtacctctcctactacggctacacccggggatccaagaacttgtgaccgccggcctgcgccccgccgcgccgcccgaattcttctcctcctcctcctcccccaacccctgctgattctttatttggatctccttctccgaccactcccggatcaaacatttttagtcccatggatgatggatggatggatcgtcgccgaacattaacagcattcttgtctcgattctttttggggaaatgctacgttttatggtgttctccgatcaagaaaaagaaaatcaatcccggatcnaaaaaaaaaaa

SEQ ID NO: 859 - DNA, 1528 bp, Hordeum vulgare
cttggtttcttcgttgattggttggcttgccgccgcgggcgggcagcacgacgacggcgggaggttcagcaagaagatgcgggcgctggaggacgactgtcccgtccacccctggcaaggtgaagatcgagcgggccggcggcgccatgaaccgccagctgcaccgttgcttcgcgtccaccagcaccatgttcctctgggcgctcttcctcgtcgccatgaccgcctcctacctcagcttccagtccttcgtcgacacctcctccaagtacttcgccgcctcctggggcggcctgcactgggagcgccagatccgcgcctccgccgcgccgcgcaggccgccggggtcggccgccggggcggggatgtcggtgctcgtcacgggcgcctccgggttcgtcggcgcgcactgctccctcgcgctgcgcaagcgtggggacggcgtcgtcggcatcgacaacttcaacgcctactacgacccctcgctcaagaaggcacgcaaggcgctgctgtcctcccacggcgtgttcgtcgtcgagggcgacatcaacgacggccggctcctggccaagctcttcgacgtcgtccccttcacccacgtgctccacctggccgcgcaggccggcgtgcgctacgccatggagaacccggcctcgtacgtacactccaatgttgcggggctcgtcaccctcctggaggcctgcaagaacgccgacccgcagccggccatcgtctgggcgtcatcctcctccgtctacggcctcaacgacaaggtgcccttctccgagtcgcaccgcacggaccagccggcgtcgctctacgcggccacgaagaaggccggcgaggagatcacccactcgtacaaccacatctacgggctgtccatcaccggcctgcgcttcttcacggtgtacgggccgtgggggcggccggacatggcctacttctccttcacccgcaacatcctgcaggggaagcccatcaccgtctaccggggcaagaatcacgtggacctcgcccgcgacttcacctacatcgacgacatcgtcaagggctgcctggggtcgctggacacggccggcaggagcacgggcaccggcggcaagaagcgcgggccggcgccctacaggatcttcaacctcggcaacacctcccctgtgacggtgcccacgctggtgtccatcctggagaagcacctccgggtgaaggcgaagaagcacgtggtggagatgcccggcaacggcgacgtgcccttcacccacgccaacatctcgctcgcccggcagcagctcgggtacaagccgaccaccaacctcgacgccggcctcaagaagttcgtcaagtggtacctctcctactacggctacacccggggatccaagaacttgtgaccgccgcgccgcgccgcgccgccccccctattcttcccctcctcacccaacccctgctgattctttatttccgaccactcccggatcaaacatttttagtcccatggatggatggatcatcgtcaagcattaacagc

SEQ ID NO: 860 - DNA, 1714 bp, Hordeum vulgare
cggcacgaggggttcttcgttgattggttggcttgccgccgcgggcgggcagcacgacgacggcgggaggttcagcaagaagatgcgggcgctggaggacgactgtcccgtccacccctggcaaggtgaagatcgagcgggccggcggcgccatgaaccgccagctgcaccgttgcttcgcgtccaccagcaccatgttcctctgggcgctcttcctcgtcgccatgaccgcctcctacctcagcttccagtccttcgtcgacacctcctccaagtacttcgccgcctcctggggcggcctgcactgggagcgccagatccgcgcctccgccgcgccgcgcaggccgccggggtcggccgccggggcggggatgtcggtgctcgtcacgggcgcctccgggttcgtcggcgcgcactgctccctcgcgctgcgcaagcgtggggacggcgtcgtcggcatcgacaacttcaacgcctactacgacccctcgctcaagaaggcacgcaaggcgctgctgtcctcccacggcgtgttcgtcgtcgagggcgacatcaacgacggccggctcctggccaagctcttcgacgtcgtccccttcacccacgtgctccacctggccgcgcaggccggcgtgcgctacgccatggagaaaccgggctcgtacgtacactccaatgttgcggggctcgtcaccctcctggaggcctgcaagaacgccgacccgcagccggccatcgtctgggcgtcatcctcctccgtctacggcctcaacgacaaggtgcccttctccgagtcgcaccgcacggaccagccggcgtcgctctacgcggccacgaagaaggccggcgaggagatcacccactcgtacaaccacatctacgggctgtccatcaccggcctgcgcttcttcacggtgtacgggccgtgggggcggccggacatggcctacttctccttcacccgcaacatcctgcaggggaagcccatcaccgtctaccggggcaagaatcacgtggacctcgcccgcgacttcacctacatcgacgacatcgtcaagggctgcctggggtcgctggacacggccggcaggagcacgggcaccggcggcaagaagcgcgggccggcgccctacaggatcttcaacctcggcaacacctcccctgtgacggtgcccacgctggtgtccatcctggagaagcacctccgggtgaaggcgaagaagcacgtggtggagatgcccggcaacggcgacgtgcccttcacccacgccaacatctcgctcgcccggcagcagctcgggtacaagccgaccaccaacctcgacgccggcctcaagaagttcgtcaagtggtacctctcctactacggctacacccggggatccaagaacttgtgaccgccgcgccgcgccgcgccgccccccctattcttcccctcctcacccaacccctgctgattctttatttccgaccactcccggatcaaacatttttagtcccatggatggatggatcatcgtcaagctttaacagcattcttgtctcgattctttttgcgggaatactacgttttagggtggtgttctccggtgaagaaaaaaagaaaaatcccggatcgaattctttcctttccttgccgccgccgccgagcgccgacgaagacgaaagcaatggagcgaaaccttttcctcattgtttattttttcgatttttt

SEQ ID NO: 861 - DNA, 1344 bp, Brachypodium distachyon
gatgcggggggtgctggaggaggacatgctgccgtcgacgccggggaaggtgaagatcgagcgcgccggcgccatgagccggcagctgcaccgctgcttcgcgtccacggggaccatgttcctctgggcgctcttcctcgtcgccatgacggccacctacctcagcttccactccttcgtcgacacctcctcccgctacttcgccgcctcctggggcggcctccactgggagcgccagatccgggcctccgcctcgccgcgccgcccccccgggtccgccgagggggccgggctctccgtcctcgtcaccggcgccgccggattcgtcggcacccactgctccctcgccctccgcaagcgcggcgacggcgtcgtcggcatcgacaacttcaacaagtactacgacccctccctcaaaaaagcccgccgcgcgctgctcgcctcccacggagtcttcgtcgtcgagggcgacatcaacgacggccgcctcctggccaagctcttcgacgtcgtccccttcacccacgtgctccacctggcggcgcaggccggggtgcgctacgccatggagaacccttcctcctacgtgcactccaacatcgcgggcctggtctccctcctggaggcctgcaaggacgcggacccgcagcccgcggtggtatgggcctcatcctcctccgtctacgggctcaacgacctcgtccccttctccgaggcgcaccgcacggaccggccggcgtcgctctacgccgccacgaagaaggccggggaagagatcacccacacctacaaccacatctacggcctctccgtaacgggcctccgcttcttcaccgtgtacggcccatggggccggcccgacatggcctacttctccttcacccgcaacatcctccaggggaagcccatcaccgtgtaccggggcaaggaccacgtcgacctcgccagggacttcacctacatcgacgacatcgtgcgcggctgcctggcatccctcgacacggcgggccggagcacggggacgggggggaagaagcgagggccggcgccgtacaggatcttcaacctggggaacacggcgccggtgacggtgccgacgctggtgtccatcctggagaggtacctgagggtggaggcgaagaagaacgtggtggagatgcccggcaatggcgacgtgccattcacgcatgccaacatcagcctggcgagggagcagctcgggtacaagcccacgacgacgctggagatggggctcaagaagttcgtccgctggtacctctcttactacggatacaaccggggaacacacaccttcagcaacttgtgatgatatatatatttagg

SEQ ID NO: 862 - DNA, 1697 bp, Zea mays
cgcgtgccggccgcctccgctcatcgtcgtgcaccatgccaactccgagaagacgatcttgcaaggaaagcgcatgcaagaacgtcgtcacatatatagaggagtagcagccagcaagaggtggaatcgacggcttgatcccgagaccgaccgagaccagctgcaaaagctcctagctagcgcattggccgccggagtgggctgcagtgcagtacaggtggatcgcatgcgaggaggatgcgagtgctggaggaggacctgtacccgtcgacgccggggaaggtgaaggtggagcgggcgggggcgatgagccggtacctgcaccgttgcttcgcgtccacggggaccatgttcctgtgggcgctcttcctggtggccatgacggccacgtacctgagcgtccactccatcgtggacacctcctcccgctacttcgcggcgtcctggggcgggctgcactgggagcggcagatccgggcgtcggcgtcgccgcggcggccgccggggtccgcggagggcgccgggctgtccgtgctcgtcacgggcgccgccggcttcgtgggcacgcactgctcgctggcgctgcgcaagcgcggcgacggcgtcctgggcctcgacaacttcaactcctactacgacccctcgctgaagaaggcccggcgcgcgctgctgggctcccacggcgtgttcgtggtggagggcgacatcaacgacggccgcctcctggccaagctcttcgacgtggtgcccttcacccacgtgctccacctcgcggcgcaggccggcgtgcgctacgccatggagaacccggcgtcgtacgtgcactccaacatcgccggcctcgtgtccctcctcgaggcctgcaaggacgccgacccgcagccggccgtcgtgtgggcgtcctcctcctccgtctacggcctcaacgaccgcgtccccttctcggaggcgcaccgcaccgaccggcctgcgtcgctgtacgccgccaccaagaaggccggcgaggagatcacccacacctacaaccacatctacggcctctccgtcaccggcctccgcttcttcaccgtgtacggtccgtgggggcgccccgacatggcctacttctccttcacccgcaacatcctccaggggaagcccatcacggtgtacaggggcagggaccgcgtcgacctcgcccgggacttcacctacatcgacgacatcgtgcgcggctgcctggcgtcgctggacacggcgggccggagcaccggcaccggcggcaagaagcgcggcccggcgccgtaccggatcttcaacctggggaacacgtcgcccgtcacggtgcccacgctggtgtccatcctggagaggtacctgcgggtgaaggccaagaagaacgtggtggagatgcccggcaatggcgacgtgccctacacgcacgcaaacatcagcctggcccgggagcagctcggctacaagcccacgacgagcctggagatggggttgaagaagttcgtcaggtggtacctctcctactacggatacaaccgtgggacgcataccttcaggaactcatgatgtcgctcgtcccttccactctcgtttgggtccacacaagttgtgggggaaattgtgttgactggctgttgtagttgggttaggacagaagaggaggggacggcgacagaacgatcaaacggagggccggcttttta

SEQ ID NO: 863 - DNA, 1334 bp, Sorghum bicolor
gatcgcatgcgaggaggatgcgagtgctggaggaggacctgtacccgtcgacgccggggaaggtgaaggtggagcggccgggcgcgatgagccgtcacctgcaccgctgcttcgcgtccacggggaccatgttcctgtgggcgctcttcctggtcgccatgacggccacctacctcagcgtccactccttcgtcgacacctcctcccgctacttcgccgcgtcctggggcggccttcactgggagcgccagatccgcgcgtcggcgtcgccgcggcggccccccgggtccgccgagggcgccgggctgtccgtgctcgtcacgggcgccgcgggcttcgtcggcacgcactgctcgctggcgctccgcaagcgcggcgacggcgtggtgggcatcgacaacttcaacaactactacgacccgtccctcaagaaggcccgccgcgcgctgctgggctcccacggcgtgttcgtcgtggagggcgacatcaacgacggccgcctcctggccaagctcttcgacgtcgtgcccttcacgcacgtgctccacctggcggcgcaggccggcgtgcgctacgccatggagaacccggcgtcgtacgtgcactccaacatcgccggcctcgtctccctcctcgaggcctgcaaggacgccgacccgcagccggccgtcgtgtgggcgtcctcctcctccgtctacggcctcaacgaccgcgtccctttctcggaggcgcaccgcaccgacaggccggcgtcgctctacgccgccaccaagaaggccggcgaggagatcacccacacctacaaccacatctacggcctctccgtcaccggcctccgcttcttcaccgtgtacgggccgtggggacgccccgacatggcctacttctccttcacacgcaacatcctccaggggaagcccatcacggtgtacaggggcagagaccacgtcgccctcgccagggacttcacctacatcgacgacatcgtgcgcggctgcctggcgtcgctggacacggcggggcggagcaccggcacgggcggcaagaagcgggggccggcgcagtaccggatcttcaacctcgggaacacgtcgccggtcacggtgcccacgctggtggccatcctggagaggtacctgagggtgaaggccaagaagaacgtggtggagatgcccggcaatggcgacgtgccctacacgcacgccaacatcagcctggcacgggaggagctcgggtacaagccgacgacgagcctggagatggggttgaagaagttcgtcaggtggtacctctcctactacggatacaacaggggaacacataccttcaggaac

SEQ ID NO: 864 - DNA, 1602 bp, Sorghum bicolor
gatcgcatgcgaggaggatgcgagtgctggaggaggacctgtacccgtcgacgccggggaaggtgaaggtggagcggccgggcgcgatgagccgtcacctgcaccgctgcttcgcgtccacggggaccatgttcctgtgggcgctcttcctggtcgccatgacggccacctacctcagcgtccactccttcgtcgacacctcctcccgctacttcgccgcgtcctggggcggccttcactgggagcgccagatccgcgcgtcggcgtcgccgcggcggccccccgggtccgccgagggcgccgggctgtccgtgctcgtcacgggcgccgcgggcttcgtcggcacgcactgctcgctggcgctccgcaagcgcggcgacggcgtggtgggcatcgacaacttcaacaactactacgacccgtccctcaagaaggcccgccgcgcgctgctgggctcccacggcgtgttcgtcgtggagggcgacatcaacgacggccgcctcctggccaagctcttcgacgtcgtgcccttcacgcacgtgctccacctggcggcgcaggccggcgtgcgctacgccatggagaacccggcgtcgtacgtgcactccaacatcgccggcctcgtctccctcctcgaggcctgcaaggacgccgacccgcagccggccgtcgtgtgggcgtcctcctcctccgtctacggcctcaacgaccgcgtccctttctcggaggcgcaccgcaccgacaggccggcgtcgctctacgccgccaccaagaaggccggcgaggagatcacccacacctacaaccacatctacggcctctccgtcaccggcctccgcttcttcaccgtgtacgggccgtggggacgccccgacatggcctacttctccttcacacgcaacatcctccaggggaagcccatcacggtgtacaggggcagagaccacgtcgccctcgccagggacttcacctacatcgacgacatcgtgcgcggctgcctggcgtcgctggacacggcggggcggagcaccggcacgggcggcaagaagcgggggccggcgcagtaccggatcttcaacctcgggaacacgtcgccggtcacggtgcccacgctggtggccatcctggagaggtacctgagggtgaaggccaagaagaacgtggtggagatgcccggcaatggcgacgtgccctacacgcacgccaacatcagcctggcacgggaggagctcgggtacaagccgacgacgagcctggagatggggttgaagaagttcgtcaggtggtacctctcctactacggatacaacaggggaacacataccttcaggaactcatgatgatcagtatgtgattagtaaatgtcgctttgtcgcgccttccactctttctctgatcacagatgggaaaatttttttgtgtgctttagacaagtcggggacggaaatgcgaggaagaatagaattctgttgtagttgggtgaggagaggagggaatggcgacagagcgatgaaatggagggggtgatgtgatcccccttcattctgtattttcttctgtaaattgtatcaatcattatagagttatcctttctttctcaaa

SEQ ID NO: 865 - DNA, 1317 bp, Brachypodium distachyon
cggggggtgctggaggaggacatgctgccgtcgacgccggggaaggtgaagatcgagcgcgccggcgccatgagccggcagctgcaccgctgcttcgcgtccacggggaccatgttcctctgggcgctcttcctcgtcgccatgacggccacctacctcagcttccactccttcgtcgacacctcctcccgctacttcgccgcctcctggggcggcctccactgggagcgccagatccgggcctccgcctcgccgcgccgcccccccgggtccgccgagggggccgggctctccgtcctcgtcaccggcgccgccggattcgtcggcacccactgctccctcgccctccgcaagcgcggcgacggcgtcgtcggcatcgacaacttcaacaagtactacgacccctccctcaaaaaagcccgccgcgcgctgctcgcctcccacggagtcttcgtcgtcgagggcgacatcaacgacggccgcctcctggccaagctcttcgacgtcgtccccttcacccacgtgctccacctggcggcgcaggccggggtgcgctacgccatggagaacccttcctcctacgtgcactccaacatcgcgggcctggtctccctcctggaggcctgcaaggacgcggacccgcagcccgcggtggtatgggcctcatcctcctccgtctacgggctcaacgacctcgtccccttctccgaggcgcaccgcacggaccggccggcgtcgctctacgccgccacgaagaaggccggggaagagatcacccacacctacaaccacatctacggcctctccgtaacgggcctccgcttcttcaccgtgtacggcccatggggccggcccgacatggcctacttctccttcacccgcaacatcctccaggggaagcccatcaccgtgtaccggggcaaggaccacgtcgacctcgccagggacttcacctacatcgacgacatcgtgcgcggctgcctggcatccctcgacacggcgggccggagcacggggacgggggggaagaagcgagggccggcgccgtacaggatcttcaacctggggaacacggcgccggtgacggtgccgacgctggtgtccatcctggagaggtacctgagggtggaggcgaagaagaacgtggtggagatgcccggcaatggcgacgtgccattcacgcatgccaacatcagcctggcgagggagcagctcgggtacaagcccacgacgacgctggagatggggctcaagaagttcgtccgctggtacctctcttactacggatacaaccggggaacacacaccttcagcaac

SEQ ID NO: 866 - DNA, 2007 bp, Sorghum bicolor
cgtctcccaatcccgagccgcccgtgcgcccgtccgccgcggccaccacccgctccgcccgcccctcctcgtcaccagcggcggcaccacccctctgctccgccaccgcgttcacgcgctcccgtcgctgtcggccccgctcccctatttatatccccaccccgtcgctgtcggcaggcgcgcatcaagctcctgccccccctttcctcttcatcctctcctccctcgcggcgcgcacgctctccgccctcccaagtccgaaggaaacctatctatcattccggcggccgatccatctatccttccggccagggagagcaaggaataatcaatcaatcggccagtgggtcagtcggaggaggaggaggaggaggagagccggagtccgtcgtccagcgccgcgcgcgggttgatcctttgcgtctccccggccctgctccgcggcgacgccttttgcggtgcttgcgttgcgtcgaggaagcgagcagaatctgcgacgagaaggaggagcacgagaggcatccatcgggtcgcgcgggcgtccgtcgcacggcaagacggcggcgttgaagatgcgggtgctggaggaggacctcttcccctccaccccaggcaaggtgaagatcgagcgggcgggcgccatgaaccggcagctccaccgctgcttcgcgtccaccagcaccatgttcctgtgggcgctgttcctcgtcgccatgacggcgtcctacctcagcttccagtccttcgtcgacacccactgctccctcgcgctccgcaagcgtggcgacggcgtcgtcggcgtcgacaacttcaacgcctactacgacccctcgctcaagaaggcgcgcaaggcgctgctcgcctcccacggggtgttcgtcgtcgagggcgacatcaacgacggccgcctactcgccaagctcttcgacgtcgtgcccttcacccacgtgctccacctcgccgcgcaggccggcgtgcgctacgccatggagaacccggcgtcgtacgtgcactccaacatcgccggcctcgtcacgctcctcgaggcctgcaaggacgccgacccgcagccggccatcgtctgggcctcgtcgtcctcagtctacggcctcaacgacaaggtccctttctcggagcgcgaccgcaccgatcagccggcctcgctctacgcggccaccaagaaggccggcgaggagatcacgcacacgtacaaccacatctacggcctctccatcaccggcctccgcttcttcaccgtgtacgggccctggggccgccccgacatggcctacttctccttcacccgcaacatcctgcaggggaaacccatcacggtgtaccgcggcaaggaccacgtcgacctggcccgcgacttcacctacatcgacgacattgtcaagggctgcctcggctccctggacacggccggcaagagcaccggcacggggggcaagaagcgtgggccggcgccctacaggatcttcaacctcggcaacacctcgcccgtcacggtgcccaacctggtgtccatcctggagaagcacctccgcgtcaaggccaagaagcacgtggtcgagatgcccggcaatggcgacgtgcccttcacccacgccaacatctcactcgccagggagcagctcgggtacaagccctccactaacctcgacgtcggcctcaagaagttcgtcaagtggtacctgtcctactacggctacaccaggggatccaagaactcgcgacaatgatccgtgctaattctttctttcttcttcttttcccactttggcccggccgcggtcaccactcctggatcaaacattgacattggattttgttggttggtggaaatatgttatgttaggatgttcggggggaaaaaaattctttgcatggtgaggagaggggaggaggaagaaagctaatggggagcagtattttcttttctctgttttttcctccctccaccatcttctcttctttgtgtaaattggtcgctctccattaatc

SEQ ID NO: 867 - DNA, 1820 bp, Malus domestica
attttaatatcccaaaacaaataaaatcttcacttgtttaccttttttcttcgatctccttctcgaaagccctctctttctttttgcatatcaaaatcaaaaacccaaattttcagaaccaatccaactgaaaaacgggttccaaattttgtcaattgtgggtcttggagaaacaaagaaaaagagatatcagagaggaaccctgaagaaaaaaggtcagaaattttacaagatatgccgtctgcattggaggatgagttgttcccgtcgacgcccggaaagttcaaaatcgagcgcagccacgccatgaaccgccagttccaccgctgtttcgcctccacaagcaccatgttcttgtgggccttatttcttatcgccttgacggcgtcctatttgagttttcagagcttcgtcgactccggcagccgctacttctccgcctcctggggcggcatccagtgggagaagcaggtccgcaactccgcccagatccaccgctccggcggcatgtccgtcctcgtcaccggcgcagccggtttcgtcggaacccacgtctccctgggcctcaaaaagcgcggagacggcgtcgtcggaattgacaacttcaacagctactacgacccgtcgctgaagaaggctcgccggtcactcctcaagacccacggcgttttcatcgtcgagggcgacataaacgacaatcgccttctggacaagctattcgatacagtggcgttcacccatgtgatgcatttggcggctcaggccggcgtccggtacgccatggagaacccccattcttacgtccacagcaacatcgccggcctcgtgacgcttctcgaagtctgcaaatcggccaatcctcagccgtccattgtttgggcctcgtccagctctgtctacggcctgaacgacaacgtcccattctccgaatcagaccggactgaccagccggctagcctctacgccgccaccaagaaagccggcgaagaaattacccacacttacaaccatatttatggcctgtcaattaccgggttaagatttttcactgtgtacggaccgtggggccgacccgacatggcatatttctctttcacccgcaacatcctccaggggaagcccatcaccatttacaggggcaagaaccgggtggacttggcccgggatttcacgtatattgacgacatcgtgaagggttgtttggggtcattggatacgtccggaaagagtaccgggtcgggtgggaagaagcggggagcggcgccgtaccggatctttaatttggggaacacatcaccggtgacagtgcccacactcgtcaacatcttggagcggcatttgaggacgaaggcgaagaaaaatgtagtggagatgcctggaaacggcgacgttccgttcacacacgcgaatataagcttggcccgaagagaactcgggtataagcccacaaccgatttgcaaaccgggttgaagaagtttgttaggtggtacctttcgtattacggctacaatcacggcaagcctgtaaattaatatttctttctttttttgacctttttaattttgtaggattttctttccccaactacaaaagggataaaccttgggaaaaaaaatcctgcggcaagaaaatgaaaaggcacattttttaacgttttctcctcggcaacgcttctctttttgtatttttgtttgtaaaggaaaagttgaggtttgttttgggcctcgtacttgcttttgattgacaagagtttatttttaatttgaatgatattgtaattgttaggatccaatacttgtttccccttgaacactttgac

SEQ ID NO: 868 - DNA, 2584 bp, Ricinus communis
caggtgcaggaaaatcattttctctcgtattttctctgcatctgtacaccactttcttatttgataatattcagtctctcttttgttatcttcaagaaaaacgaaaaaactttctttctttctttttctttcattctcttttttcaagaaacgattcaagaaaatcaaagattcaagaaaatgccctcattggaggaagagctattcccgtccacaccaggaaagttcaagatcgaccgcggaggccacacaatgaacagacaattctaccgttgttttacctccacaagcaccatgttcttatgggcacttttcttgattgctttgacggcgtcgtatttgagttttcaaagtttcatcgattccggtagcaagtatttctccgcttcttggggcggccttcaatgggaaaaacaagtgcgtaactccgctcagatccaccgtccgtccggcggcgtatcggttcttgttaccggagcagccggttttgtcggtactcatgtttctttagctttgaaaaagagaggggacggcgtcgttggacttgacaattttaataattattacgatccgtctttgaagaaagcacgcaagtctcttttaaacagtcacggtgtttttatcgtggaaggcgatgttaacgacgcgcggctcttggctaagctatttgatgtggtggcttttagtcatgttatgcatttagcggctcaagccggtgtcaggtacgctatggagaatcctcactcttatgttcattctaatatagccggcttagtcactcttttagaggcttgtaaatcggccaatcctcagccggctattgtttgggcttcgtcaagttctgtctatggcttaaatgataaagttcccttttctgaatctgatcggacggaccagcccgcgagtttatatgcggctacgaaaaaggcaggtgaggaaatcactcatacttataatcatatttacggtctgtcaattactgggttgagattttttactgtctacggtccatggggtagacccgatatggcttatttctctttcacgagaaatattttacaagggaaaccgatcactgtttatcggggcaagaatcgggttgacttggcccgcgacttcacctacattgatgatatagtgaaaggatgtgttgggtctttggatactgcgggtaagagtacgggttcaggtgggaagaaacggggacccgctccgtatcggatttttaatcttggtaatacgtcacctgttactgtaccgacactcgttagtatactggagaagcatttgaaaatgaaagctaagaggaacgttgttgatatgcctggaaacggtgacgttccgtttactcatgctaatattagtttggccagaagagaacttgggtataaaccgacaaccgatttgcaaaccgggttgaagaagtttgttaggtggtatttatcatattatggctacaatcacggaaaagctgtaaattaagttgtttttttttttttttttatccattaatctctttttgttttttttaggaattttcaatttcccaagttgaaaaagaaaaggaaaaagaaaatgggaaatggaaatttgttaagactgaaaagaaaaagaaagtaaaaaaaaaaaaaaaaaaaggaaagccacaatattctttacttgggagggcaatcctcttttccttttgttgtttctcttttgtaattaatgggaaaagaacaaaaaaaaggtatatttcagatggtacatatgctaatttctagtttatcgactccgaaaatttttcaattttaaaattatataattttcaaaatctttttattattttttaaaattagtaatttaaaaaattataatatatttgtgtatataaaatttaaaattaggttttaaaagcgactcctatatcaattattcatttaatagctgtaatgttagtagctacattttcaaattgaaagcttcttttttatttagtttttaattaattatatatataatgattgattgagaggacacattttaaagcccaaatagaaagaaagacaaaaagaaaaaaggatgggtaacttgaacttacagctaagatagaaaaggacaggcggcacaatggtgatatacggttggaggagggtcccatatttgtcaaattacaaaaaaagtaatgtcaaaattgtacggcaatccaaaactcgagcctaaatcgaagggctaatatcacatcttgccaatccagctgtacgcatcgcgcgtttggtcactgtcgcatgagattattatttatagagatggattgcttgccgacaattatgtgtaattcttagaatatttatttgttttcggaaggattttgtcaatcatgggcccatggcctttttagtggacccatttgtactattctctgtaccgtttgtaaccttttttgtgggctctatcagtttgtctgatataagctttctagtttcatccttctttctttctagtctccttatcaatatattattttatccaagaagtttaagtcacatagtttatgtttaacttgtattgttacaaaactagtatgatgaaatagattttttat

SEQ ID NO: 869 - DNA, 2554 bp, Ricinus communis
ggaaaatcattttctctcgtattttctctgcatctgtacaccactttcttatttgataatattcagtctctcttttgttatcttcaagaaaaacgaaaaaactttctttctttctttttctttcattctcttttttcaagaaacgattcaagaaaatcaaagattcaagaaaatgccctcattggaggaagagctattcccgtccacaccaggaaagttcaagatcgaccgcggaggccacacaatgaacagacaattctaccgttgttttacctccacaagcaccatgttcttatgggcacttttcttgattgctttgacggcgtcgtatttgagttttcaaagtttcatcgattccggtagcaagtatttctccgcttcttggggcggccttcaatgggaaaaacaagtgcgtaactccgctcagatccaccgtccgtccggcggcgtatcggttcttgttaccggagcagccggttttgtcggtactcatgtttctttagctttgaaaaagagaggggacggcgtcgttggacttgacaattttaataattattacgatccgtctttgaagaaagcacgcaagtctcttttaaacagtcacggtgtttttatcgtggaaggcgatgttaacgacgcgcggctcttggctaagctatttgatgtggtggcttttagtcatgttatgcatttagcggctcaagccggtgtcaggtacgctatggagaatcctcactcttatgttcattctaatatagccggcttagtcactcttttagaggcttgtaaatcggccaatcctcagccggctattgtttgggcttcgtcaagttctgtctatggcttaaatgataaagttcccttttctgaatctgatcggacggaccagcccgcgagtttatatgcggctacgaaaaaggcaggtgaggaaatcactcatacttataatcatatttacggtctgtcaattactgggttgagattttttactgtctacggtccatggggtagacccgatatggcttatttctctttcacgagaaatattttacaagggaaaccgatcactgtttatcggggcaagaatcgggttgacttggcccgcgacttcacctacattgatgatatagtgaaaggatgtgttgggtctttggatactgcgggtaagagtacgggttcaggtgggaagaaacggggacccgctccgtatcggatttttaattttggtaatacgtcacctgttactgtaccgacactcgttagtatactggagaagcatttgaaaatgaaagctaagaggaacgttgttgatatgcctggaaacggtgacgttccgtttactcatgctaatattagtttggccagaagagaacttgggtataaaccgacaaccgatttgcaaaccgggttgaagaagtttgttaggtggtatttatcatattatggctacaatcacggaaaagctgtaaattaagttgtttttttttttttttttatccattaatctctttttgttttttttaggaattttcaatttcccaagttgaaaaagaaaaggaaaaagaaaatgggaaatggaaatttgttaagactgaaaagaaaaagaaagtaaaaaaaaaaaaaaaaaaaggaaagccacaatattctttacttgggagggcaatcctcttttccttttgttgtttctcttttgtaattaatgggaaaagaacaaaaaaaaggtatatttcagatggtacatatgctaatttctagtttatcgactccgaaaatttttcaattttaaaattatataattttcaaaatctttttattattttttaaaattagtaatttaaaaaattataatatatttgtgtatataaaatttaaaattaggttttaaaagcgactcctatatcaattattcatttaatagctgtaatgttagtagctacattttcaaattgaaagcttcttttttatttagtttttaattaattatatatataatgattgattgagaggacacattttaaagcccaaatagaaagaaagacaaaaagaaaaaaggatgggtaacttgaacttacagctaagatagaaaaggacaggcggcacaatggtgatatacggttggaggagggtcccatatttgtcaaattacaaaaaaagtaatgtcaaaattgtacggcaatccaaaactcgagcctaaatcgaagggctaatatcacatcttgccaatccagctgtacgcatcgcgcgtttggtcactgtcgcatgagattattatttatagagatggattgcttgccgacaattatgtgtaattcttagaatatttatttgttttcggaaggattttgtcaatcatgggcccatggcctttttagtggacccatttgtactattctctgtaccgtttgtaaccttttttgtgggctctatcagtttgtctgatataagctttctagtttcatccttctttctttctagtctccttatcaatatattattttatccaagaagtttaagtcacatagtttatgtttaacttgtattgttacaaaactag

SEQ ID NO: 870 - DNA, 1640 bp, Castanea mollissima
gtttgaagcttatctcacttttctttctctgcatctttttccaaaaccaatacccaattttcactttctttttcttttttattctttaaaaaaaacagaaaagaaaacgtattgttcgaaacccaacatgccttctttagaggaagaactgttcccatcaacgcctgggaagttcaagatcgaccgggcccacagcatgaaccgtcaattccatcgttgtttcgcttctacgagcaccatgttcttgtgggcgctcttcttgattgcattaacggcgtcgtatttgagtttccagagtttcgtcgataccggtagcaagtatttcgccgcctcgtggggcggtctccagtgggagaagcaagtgcgggtctcctcccagatccgaagatccggcggcatgtccgttttggtcaccggcggtgcgggtttcgtcggcacgcacgtgtcgctcgctttgaagaggcgcggcgacggcgtcgttgggctcgacaacttcaacaactactacgacccgtcgttgaagaaagcgcgcagggcactcctcgaaagccacggggttttcgttgtggagggagacataaacgacagtcgtttgttggagaaactcttcgacatcgtggcttttacgcacgtgatgcatttggcggcacaagccggagttcgatacgctatggaaaatccaaattcctacgtgcacagcaatatcgccgggcttgtttcgcttctcgaggcttgtaaatcggcgaatcctcagccgtcggttgtttgggcttcgtcgagttcggtttacgggttaaacgaaaaggtaccgttttccgaatcggatcggaccgaccaacccgcaagtctctacgccgctactaaaaaagccggtgaggaaattacccacacctataaccacatttacggcctctccattaccgggttgagattttttaccgtgtacggcccgtggggacgacccgatatggcttacttctcttttacccggaatattctacaaggtaaacccattaagatctatcggggcaagaaccgggttgacttggcccgggacttcacttacattgatgacattgtgaagggttgtctgggatctttggacacgtccgggaaaagtaccgggtcgggtgggaagaaacggggacccgctccgtaccggatctttaatctgggtaacacgtcacccgtgaccgtaccgacacttgtgagtatattagagaggtatttgaagacaaaagcgaagaggaatcttgtggatatgcctggaaacggtgacgtaccgttcacgcatgcgaatattagtttggcccgaagtgaactcgggtataaacccacaaccgatttgcaaaccgggttgaagaagtttgttcgttggtatctttcttattacggctataatcacggaaaacccgtaaattaattttcttttcttcttttatctttttctgtttttcctcttttaccctttttgttattttcttggatttttttttcccgtttaaagtgaggaaaagaaaaaacctgttaaagtcaccaaaaaaaaaaaagaagacacattctttacttaggggaggagttagcaagggactcatcctctgtagttttgttgtatctcatatcctgtgtataaagtaaaa

SEQ ID NO: 871 - DNA, 1501 bp, Cucumis melo
aaattagcagatgcaaaaaaaaaaaaaactttacatctgcacaaaatttcccccattttcttcttcttcttctttttttgtttcttctaacaaaaatccccattaaattttgtcattcttgaaaaaatgccctctcttgaagacgaacttttcccttccacgcccggaaagttcaagatcgacagaaaccatcccatgaaccgtcaattccaccgctgtttcgcctccaccagcaccatgttcttatgggctctcttcttaatcgctctaaccgcttcctatttgagtttccaatccttcgtcgactccggtagccgctatttctccgcttcttggggtggcatccaatgggaaaaacaagtccgtgtttccgctcaaccccaccgtaccaacggcttctcggtcctcgtcaccggcgctgcggggttcgtgggttcacacgtttcactggctttaaagaaacgcggtgacggcgttgtgggtcttgacaatttcaattcttattacgacccatcgctgaaaaaggcacggaaatcgcttctctccaatcacgggattttcgtcgttgacggcgatattaacgacgttagattattggataaactcttcgatgtcgtcgtttttactcacgtgatgcatttagccgcacaagctggagttcgttacgctatggaaaatccaaattcctatgttcatagtaatatcgccggtttagttacgcttcttgaagcttgtaaatcggctaacccacaaccggccgtggtctgggcttcttccagttcggtttacgggcttaacgagaaagtccccttttccgaatcggaccgaaccgaccaacccgcaagtctttacgcggctacgaaaaaagccggggaggaaattacgcatacgtataatcatatatatgggttgtcgattaccgggttgaggtttttcacggtgtatggaccttggggaagaccggatatggcgtatttttcgttcacgaggaatatattacaagggaagccgattacggtattccgagggaagaaccgggtggatttggcgagggattttacttacattgatgatattgtgaaagggtgtttgggttcgttagatacgtcggggaagagtacgggttccggtgggaagaaaaccggaccggcgccatatagaatattcaatttggggaatacgtcgccggtaacagtgccgacgttggtgagtattttggagagacatttgaaggtgaaagcgaagaagaatgtggcggaaatgccaggaaacggcgacgttccgtttactcatgcgaatattagttcggctcggagggaactcgggtataaaccgaccactgatttgcaaaccgggttgaagaaatttgttagatggtatttatcctattatgtctataatcacggaaaacccgtaaattaaaaaaatatatattttacttcctttttttttttttggaatttctctctcttctctcctaattaggaatgaaatggggtaa

SEQ ID NO: 872 - DNA, 1438 bp, Cucumis sativus
aaattagcagatgcaaaaaaaaaactttattcatctgcactaaatttcccccatttttctttctttcttcttctttttttttgttctaacaaaaatcccccctatattttgtgattcttgcaaaaatgccctctcttgaagacgaacttttcccttccacacccggaaagttcaagatcgacagaaaccaccccatgaaccgtcaattccaccgatgtttcgcctccaccagcaccatgttcttatgggctctcttcttaatcgctctaaccgcctcctatttaagtttccaatccttcgtcgactccggtagccgctatttctccgcctcttggggtggcatccaatgggaaaaacaagtccgtatttccgctcaaccccaccgtaccaacggcttctccgtcgtcgtcaccggcgctgcaggtttcgtcggttcacacgtttcactcgctttaaagaaacgcggtgacggcgttgtcggtcttgacaatttcaattcttattacgacccatcgctgaaaaaggcacggaaatcgcttctctccaatcacgggattttcatcgttgacggcgatattaacgacgttagattattggataaactcttcgatgtcgtcgtttttactcacgtgatgcatttagccgcacaagctggagttcgttacgccatggaaaatcccaattcctatgtacatagtaatatcgccggtttagttacgcttcttgaagcttgtaaatcggctaaccctcaacccgccgtggtctgggcttcttccagttcggtttatggccttaacgaaaaagtccccttttccgaatcggaccgaaccgatcaacccgccagtctttacgcggctaccaaaaaagccggtgaggaaattacacatacgtacaatcatatatacgggttgtcgattaccgggttgaggtttttcacggtgtatggaccttggggaagaccggatatggcgtatttttcttttacaaggaatatattacaagggaagccgattacagtattccgtgggaagaaccgggtggatttggcgagggattttacttacatcgatgatattgtgaaagggtgtttgggttcgttggatacgtcggggaagagtacaggttcaggtgggaagaaaaccggagcggcgccatatagaatattcaatttggggaatacgtcgccggtgacagtaccgacgctagtgagtatcttggagagacatttgaaggtgaaagcgaagaagaatgtggtggaaatgccaggaaacggcgacgttccgtttactcatgcgaatattagttcggctcggagggaactcgggtataaaccgaccactgatttgcaaaccgggttgaagaagtttgttagatggtatttatcgtattatggctataatcacggaaaacccgtaaattaaaaaaaaatctctctctc

SEQ ID NO: 873 - DNA, 1912 bp, Phaseolus coccineus
gagagagagagagaggttgagctaaattcctggtggttcctcctctgtttatttattttctctctcctctgtccctcctttaacgcgttcacgcgtagactagcttgtcgtttgttcgtgggtgaccactatatataaccacccctaccattgtttcattcagcagatgcaggaaaattaatctcccatttgtttcttttctctgcatctgtaccctaccacccttttcatttttcgtaaatcaccaacaccgccaccacagccaacaacaatcaagatccatttttcaattaggaaaggaacactaaaatgccgccgttggaagacgagaccttcccctcaaccccaggcaaattcaagatcgagcgttcccacaccatgaaccgccaactctaccgctgtttcgcctccaccagcaccatgttcctctgggctctctttctcatcgccctcaccgcctcctacctcagcttccaaggtttcgtcgactccggtagccgctacctctccgcctcctggggcgggatccagtgggagaagcaagtccgcacatccgcccagatccaccgccagggaggcatgtctgtgctcgtcacgggcgcagccggttttgtcggctcccacgtctccctcgccttgaaacgccgcggagacggcgttgttgggctggataacttcaacgactactacgacccctccctcaagaaagcccgcaaatcgctactcaacacgcacgaggtcttcatcgtcgaaggcgacgtcaacgacgccaagctcctcgccaagctcttcgacgtcgtggccttcacgcacgtcatgcacctggcggcccaggccggcgtgcgctacgccatggagaatccccagtcatacgttcacagcaacatcgcgggcctcgtcacgcttctcgagacctgcaaatcggccaaccctcagcccgcaatcgtttgggcctcgtccagttccgtctacgggctcaacgagaaggttccgttctccgaatcggaccgcaccgaccagcccgctagcctctacgccgccaccaaaaaagccggcgaggagatcactcacacttacaatcacatctacgggttgtcgatcaccggtttgagattcttcactgtgtacggaccctgggggagacccgacatggcttatttctctttcacccgcaatatcttacaggggaaacccattaccgtctaccgtggtaaaaaccgcgtcgatctcgctcgtgattttacctacattgacgatattgtgaaggggtgcgttgggtcgttggataccgctggcaagagtaccgggtcgggtgggaagaaacggggacccgctccttataggatatttaacctcgggaacacttcgccggttactgtgcccactcttgtgagtatcttggagcgacatttgaaggttaaggcgaagaggaatatcgtggatatgcctggaaacggcgacgttccgtttactcacgcgaacattagttccgcccgggcagaactcgggtacaagcccaccaccgatttgcaaaccgggttgaaaaaattcgtcaagtggtacctttcctattacgggtacaatcacggcaaacctgtaaattaattttgtttcccttgttattttttcgggagggttttttttctttttttagtacggtagtcttcaatccacagattaaactcagacagtgtaaaaaaaagggaaagaacccctgctttagtagaagggaaaccagacttaatggatccaagatagtagagaagaagagaaggtaagagtagattctttacttaggaggccagctaaaccagcttgtttcttcctttcttttcttttctgattttggtattaattgttgtatttttttttttacattttctttttctgtaaagaaagaaagttcaggttc

SEQ ID NO: 874 - DNA, 1603 bp, Quercus alba
cttatatataacccatctgaacatctcttttctttaggtgcagaaataaaagtttgaagcttatctcatttttctttcactgcatctttttatttttaaaaaccaaaaaccaaaacccaaatttcactttctttttcttttttattctttaaaaaaaaagaaaaagaaaacgtattgttcgaaacccaaaatgccttctttagaggaagaactgttcccatcaacgcctgggaagttcaagatcgaccgggcccacagcatgaaccgtcaattccaccgttgtttcgcttctacgagcaccatgttcttgtgggcactcttcttgattgcattaacggcgtcgtatttgagtttccagagtttcgtcgattccggtagcaagtatttcaccgcctcgtggggcggtctccagtgggagaaacaagtgcgggtctcctcccagatccgaagatccggaggcatgtccgttttagtcaccggcgccgccggtttcgtcggcacgcacgtgtcgctcgccttgaagaggcgcggggacggggtcgttgggctcgacaacttcaacaactactacgacccgtcgttgaagaaagcgcgcagggccctcctcgacagccacgggattttcgtcgtggagggagacataaacgacagtcgcatgttggagaagcttttcgacatcgtggcttttacgcacgtgatgcatttggcggcacaggccggagttcgatacgctatggaaaatccaaattcctatgtgcacagcaatatcgccggcctcgtttcgcttctcgaggcttgcaaatcggcgaatcctcagccgtcggttgtttgggcttcgtcgagttcggtttacgggttaaacgaaaaggtgccgttttccgaatcggatcggaccgaccaacccgcaagtctctatgccgctactaaaaaagccggtgaggaaattacccacacttataaccacatttacggcctctccattaccgggttgagatttttcaccgtgtacggcccgtggggtcgacccgatatggcttacttctcttttacccggaatattctccaaggtaaaccgattaagatctatcggggcaagaaccgggtggacttggcccgggacttcacttacattgatgacattgtgaagggttgtctgggatctttggacacgtccgggaaaagcactgggtcgggtgggaagaaacggggacccgctccgtaccggatctttaacctgggtaacacgtcacctgtgaccgtaccgacacttgtgagtatattagagaggtatttgaagacgaaagcgaagaggaatcttgtggatatgcctggaaacggtgacgttccgttcacgcatgcgaatattagtttggcccgaagtgaactcgggtataaacccacaaccgatttgcaaaccgggttgaagaagtttgttcggtggtacctttcttattacggctataatcatggaaaacccgtaaattaattttcttttcttcttttatcttttttcgtttttactcttttaccccttttgttattttcttggatttttctttcccgttaaagtaaggaaaagaaaaaacctagttaaaggcaccca

SEQ ID NO: 875 - DNA, 1609 bp, Manihot esculenta
ggcaggtgcagaaattttcatcgcccaattctctctctgcatctgtgcaattcttctctcttttctcaaacccaaatccaatttcactggattagaaaccagaagcaacgaatcacaagcaaggatatgcccttgttggaggaagagcttttcccttccacgcctggcaagttcaagatcgaccgtgctcacaccatgggccgccatttccatcggtgttttgcctctacaagtaccatgttcttgtgggctcttttcttgattgctttgaccgcttcgtatttgagtttccagagctttattgattccggtagcaagtatttatccgcttcttggggcggtattcagtgggagaaacaagtccggaattctgcccagatccaacgagccggtggcatgtccgttcttgtgactggagctgctggtttcgtcggtacccatgtgtctttagcgctcaagaaacgcggagacggcgtcgttggactcgataattttaacaactattacgatccatcgttgaagaaagctcgtaaatctcttcttgccaaacacgggatctttatcgtcgaaggcgatgtcaacgacgcgcgtctcttaaccaagctgtttgatgtggtggctttcactcatgtgatgcacttggcggctcaagcaggagtcagatacgccatggagaatcctcactcgtatgttcattctaatatagccggcttggtcacgcttcttgaggtttgcaaatcggctgatccccagccggcgattgtttgggcttcgtccagctcagtttacggcttgaacgaaaaagttcctttctctgaatctgatcggaccgaccaaccggcgagtctctacgcggcgacgaaaaaggccggcgaggaaatcacccacacatacaaccacatttacggtctctcaattactgggttaagattcttcactgtgtatggcccttggggaagacccgacatggcttatttcacgttcacgagaagtattttacaggggaaaccgatcacgatataccggggcaagaaccgggtagacctggcccgagatttcaccttcattgatgatattgttaaaggctgtgtcggttctttggatactgcaggaaagagcacaggttccggcggtaaaaagcggggaccggcacaatatcggatcttcaatctggggaatacgtcaccggtaacggtaccgacgctggtgagtatattggagaagcacttgaaaatgaaagcgaagaggaagatcgtggatatgccaggaaacggtgacgtaccattcactcacgcgaatattagcttggcccgaagagaactcgggtacaaacccacaaccgatttgcaaaccggattgaagaaattcgttaagtggtatctcacgtattatggctacaatcacggaaaagttgtaaattaaggtatttttatttttttattttttttataggcattcttgttttcctaaaaatcaaggagaaatggtaaaaaaaagaaaaaaaaaatactcatttaatttctttttttagtagggcaatcgtctctttcttttactttaataagtaacgccggaaatttatttaaatatcaccatagcaaattcttac

SEQ ID NO: 876 - DNA, 1761 bp, Citrus sinensis
cgcgtccgcctcaatttgctctgcatctattactttcacaccatttcaatccaatccaaaaccaaatccaacccggtttcacctttccttctaaacaaacaaaccaacccagaaaagggaaaataataaaagattcgaagattctagagaaaaatgccgtctttagaagaggagctgttcccgtcgacgccggggaaattcaagattgaaagatccaacactatgaaccgccagtttcaccggtgtttcacctcaacgagtaccatgttcttgtgggctcttttcttggttgctttaacggcgtcgtatttgagttttcagtcttttgtcgattccggtagccggtacttttccgcttcttggggaggtatccagtgggagaaacatgtcaggagctccgctcagatccatcggtctggtgggatgtcggtgctggttaccggtgcagccggtttcgttgggacccacgtgtctttggctttaaagaaacgcggagacggcgtcgttggactcgacaatttcaataactactacgatccctcattgaagaaggcgaggaaggctttgttgaacaaccatggcattttcgtaattgaaggtgatatcaatgacgcgaaattattagccaagctctttgacgctgtggcttttacgcacgtgatgcatttagcggctcaagccggtgttagatacgcgatgcagaatccccactcgtacgtgcacagcaatatcgctggcctcgtcacgctccttgaggcttgcaaatcagccaatcctcagccgtcgattgtgtgggcctcgtcgagctcagtctacggcttaaacgagaacgtcccattctccgaggctgatcggacggaccagccagctagtctttacgcggctaccaaaaaggccggtgaagaaattgctcacacctacaatcacatttacggcctctcaattaccgggctgaggtttttcaccgtgtacggaccctggggccgacccgatatggcttacttctcgttcacgagaaatattctccaaggcaaaccaatcacggtttatcgtgggaagaatcacgtcgacttggcacgagattttacttacattgacgatatcgtgaagggttgtttaggttcgctggatacctcgggtaagagtaccgggtcgggcggaaagaagcggggcccagcaccgtaccggatctttaatttggggaacacgtcaccggtcacggtacctaagctggtgaatatattggagagacacctgaaggtaaaagccaagaagaatgtaatcgaaatgcctggaaacggcgacgtcccgttcacgcatgcgaatatcagttcggcccagaaggagttcgggtacaggcccacgacggatttgcaaaccggcttgaaaaaatttgttagatggtatctctcatattacggctataatcgtggcaaacgtgtaaattaatttttttttcctttatgttttttgcgttttaccttctttttttcttttttttttgggttttcgcgccgtgggaggtgcgggattagagggtttttttttttttgtttttttccttaaaaaaaacgaaaggaacagaaaacgttgtaaggtgaaaaaagaaaaaagaaaaaaagtgacacaattattcttttctttgggggaatggtaaaatgtggttcatcttcatccctctgtagtttctttgtttttgttttcttcactttgttccatttcttttggtaagtaaaggaaaaaagaaagcttcagatttca

SEQ ID NO: 877 - DNA, 2244 bp, Lotus japonicus
aggtgcaggaaaaaaagatagcaatctccttcttgtttttctctgcatctgcttctccttcttcatctccattttcaccaatcaaacccaacccaacccttcccattcccattccatcaacaacagaagaaaaagaaaaatcaaaaagcaaatctgggtaagaaaatgccttcattggaggaggaactcttcccctcaacccccggaaagttcaaggtcgagcgagctcacggcatgaaccgccaactctaccgctgcttcgcctccaccagcaccatgttcctgtgggccctcttcctcatcgccctcaccgcttcctacctcagcttccaaggcttcgttgactccggcagccgctacctctccgcctcctggggcgggatccagtgggagaagcaagtccgcacctccgcacagatccaccgacagggcggcatgtccgtcctcgtcaccggcgccgccggcttcgtcggctcacacgtttccctcgccttgaaaaggcgaggcgacggcgtcgtcgggctcgacaacttcaacgactactacgacccatcgttgaaaaaagcccgcaaaaccctcctcaccacccacggcgttttcatcgtggaaggcgacgtcaacgatgccaagcttctcgccaagctcttcgacgtggtggcgttcacccatgtcatgcacctcgccgcgcaggccggagtccgctacgccatggagaatcctcattcctacgttcacagcaacatcgccgccctcgtcaccctcatggaagcctgcaaatctgcaaacccgcaacccgctattgtctgggcttcttcaagctccgtctacggtctcaacgagaaggttccgttctcggaatccgatcggactgaccaacccgccagcctctacgccgcgacgaagaaagccggcgaggaaatcacccacacctacaaccatatctacggactctccatcaccgggttgagattcttcaccgtttacggaccctggggccgacccgacatggcttacttctccttcacccgcaacattctgcaaggaaaacccatcactgtttaccggggcaagaaccgggtcgatctggcccgggattttacatacattgatgatatcgtgaaggggtgtgtcgggtcgttggatactgctgggaagagtaccgggtcgggtgggaagaagaaaggagctgcaccgtaccggatcttcaacctcgggaacacttcgccggtgacggtgccgactctggtgagtattttggaggggcatttgaaggtgaaggcgaagaggaacgtggtggatatgcctggaaacggtgacgttccgttcacacatgcgaatattagttcggcccggagagaactcgggtataaaccgacaaccgatttgcaaaccgggttgaagaagtttgtgaaatggtacctttcctattacggctacaatcacgggaaacctgtaaattaactggtttaatttacctttcttttttttttaatgggaaggggttttatttatttttttcctttttagtctgttactcttagaatttttcatggaaggggtaaaaaaaaatctggtcaaagtaaaggggagaagaccaagaaaagaaaaaagaatacattctttacttgagaggccagccagctaaaacagctgtgtgccttgctgatttcttttctttttttggcatcaaaattaaatttgtgttattgggtttttaacattttgcttttgtaaagaaagaaagttggagtaacgttttttctttgttgttgtttattttatttatttgtttttaattatttttaattttgtttgtgttctcctatctaggattcgattaagcatgagttgttccgtaattttcgtatagtttgtccgttcatcaatcagcgccctgcgatttggatatggtttacttttaccaatgagtcataggaaaatgttgattatttactatttggtaaatggatgtcgataatggtaaaaaatagaagacggtaatttagggtggagagacagctaggtgatagagacaagtggagcaatttgggagatgctataatgggatccacatcgtagtgggacagagagagtacgtactagccgttggattttgggggattggatagatttgtccagctgtaaattgtaacgtagtagcaagacagtagtacagtacaggtaaaaatacttgccgacagtggtgtgatttgtttatactttatatatatatatattttttac

SEQ ID NO: 878 - DNA, 2256 bp, Lotus japonicus
ccccttaagtggaggtgcaggaaaaaaagatagcaatctccttcttgtttttctctgcatctgcttctccttcttcatctccattttcaccaatcaaacccaacccaacccttcccattcccattccatcaacaacagaagaaaaagaaaaatcaaaaagcaaatctgggtaagaaaatgccttcattggaggaggaactcttcccctcaacccccggaaagttcaaggtcgagcgagctcacggcatgaaccgccaactctaccgctgcttcgcctccaccagcaccatgttcctgtgggccctcttcctcatcgccctcaccgcttcctacctcagcttccaaggcttcgttgactccggcagccgctacctctccgcctcctggggcgggatccagtgggagaagcaagtccgcacctccgcacagatccaccgacagggcggcatgtccgtcctcgtcaccggcgccgccggcttcgtcggctcacacgtttccctcgccttgaaaaggcgaggcgacggcgtcgtcgggctcgacaacttcaacgactactacgacccatcgttgaaaaaagcccgcaaaaccctcctcaccacccacggcgttttcatcgtggaaggcgacgtcaacgatgccaagcttctcgccaagctcttcgacgtggtggcgttcacccatgtcatgcacctcgccgcgcaggccggagtccgctacgccatggagaatcctcattcctacgttcacagcaacatcgccgccctcgtcaccctcatggaagcctgcaaatctgcaaacccgcaacccgctattgtctgggcttcttcaagctccgtctacggtctcaacgagaaggttccgttctcggaatccgatcggactgaccaacccgccagcctctacgccgcgacgaagaaagccggcgaggaaatcacccacacctacaaccatatctacggactctccatcaccgggttgagattcttcaccgtttacggaccctggggccgacccgacatggcttacttctccttcacccgcaacattctgcaaggaaaacccatcactgtttaccggggcaagaaccgggtcgatctggcccgggattttacatacattgatgatatcgtgaaggggtgtgtcgggtcgttggatactgctgggaagagtaccgggtcgggtgggaagaagaaaggagctgcaccgtaccggatcttcaacctcgggaacacttcgccggtgacggtgccgactctggtgagtattttggaggggcatttgaaggtgaaggcgaagaggaacgtggtggatatgcctggaaacggtgacgttccgttcacacatgcgaatattagttcggcccggagagaactcgggtataaaccgacaaccgatttgcaaaccgggttgaagaagtttgtgaaatggtacctttcctattacggctacaatcacgggaaacctgtaaattaactggtttaatttacctttcttttttttttaatgggaaggggttttatttatttttttcctttttagtctgttactcttagaatttttcatggaaggggtaaaaaaaaatctggtcaaagtaaaggggagaagaccaagaaaagaaaaaagaatacattctttacttgagaggccagccagctaaaacagctgtgtgccttgctgatttcttttctttttttggcatcaaaattaaatttgtgttattgggtttttaacattttgcttttgtaaagaaagaaagttggagtaacgttttttctttgttgttgtttattttatttatttgtttttaattatttttaattttgtttgtgttctcctatctaggattcgattaagcatgagttgttccgtaattttcgtatagtttgtccgttcatcaatcagcgccctgcgatttggatatggtttacttttaccaatgagtcataggaaaatgttgattatttactatttggtaaatggatgtcgataatggtaaaaaatagaagacggtaatttagggtggagagacagctaggtgatagagacaagtggagcaatttgggagatgctataatgggatccacatcgtagtgggacagagagagtacgtactagccgttggattttgggggattggatagatttgtccagctgtaaattgtaacgtagtagcaagacagtagtacagtacaggtaaaaatacttgccgacagtggtgtgatttgtttatactttatatatatatatattttttac

SEQ ID NO: 879 - DNA, 1792 bp, Zea mays
gtgctgccatgccatcactgccgagaagacgatcttgcaaggacgccatcgcataaaaggagatcagcaggaggtggagccaaccgaccacggatcggtccctgcgacggaatagaccgagacctagcattggccgcgcgccggagtgggctgcactgcagtgcaggtgggtctcgcatcgcacgcgaggaggatgtaggctgtcgacgcccgggagaaaaggtgaaggtggagcgggtgggcaatgagccggcacctgcaccgctgcttcgcgtccacggggaccatgttcctgtgggcgctcttcctggtggccatgacggccacgtacctgagcgtgcactccttcgtcgacagcacctccccgcgctacttcgcggcgtcctggggcgggctgcactgggagcgccagatccgggcgtcggcgtcgccgcggcggcggtcggcgcctggggcgcccgcggggctgtccgtgctcgtcacgggcgccgcgggcttcgtgggcgcgcactgctcgctggcgctccgcaagcgcggcgacggcgtcgtcggcatcgacagcttcaactcctactacgacccctcgctcaagaaggcgcggcgcgcgctgctgggcagccacggcgtgttcgtcgtggagggcgacatcaacgacggccgcctcctggccaagctcttcgacgtcgtgcccttcacccacgtgctccacctcgcggcgcaggccggcgtgcgctacgccatggagaacccggcgtcgtacgtccactccaacgtcgccggcctcgtctccctcctcgaggcctgcaaggacgccgacccgcagccggccgtcgtctgggcctcctcctcctccgtctacggcctcaacgaccgcgtccccttctcggaggcgcaccgcaccgaccacccggcgtcgctgtacgccgccaccaagaaggccggcgaggagatcgcccacacctacaaccacatctacggcctctccgtcaccggcctccgcttcttcaccgtgtacgggccgtggggccgccccgacatggcctacttctccttcacccgcaacatcctccaggggaagcccatcacggtgtacaggggcagggaccacgtcgacctcgcccgggacttcacctacatcgacgacatcgtgctcggctgcctcgcgtcgctggacacggcgggccggagcaccggtaccggcggcaagaagcgcggcccggcgccctaccggatcttcaacctggggaacacgtcgcccgtcacggtgcccaccatggtgtccatcctggagaggtacctgcgggtgaaggccaagaagagtgtggtggagatgcccggcaatggcgacgtgccatacacgcacgccaacatcagcttggcccgggagcagctcggctacaagccgacgacgagcctggaggtggggttgaagaagttcgtcaggtggtacctcaactactacggatacaagtatacaaccggctgaggaactcgtgatgatcagtataaaatgggcccgagacatgagactgagtttccatgatgatcagtatgtgattagtataccgctctgtcgtgccttccacacacactctctcagataaaaaaaaagtcgcatttttttagtccagacaagttagggaaatgcaagaacagaattctgttgtagctaggtgggaagatgagaggggacggagacagagccatgaaatggagggggtgatccccttcattctgtattttcttctgtaaattgtatcaatcattatagggttatcctttctttctcaaa

SEQ ID NO: 880 - DNA, 1897 bp, Populus trichocarpa
tattattccaatctggccgtcctttaacgcgttcacgcgtattagttgtcgcttctttgtgggttaccactatatatatcccttctcctcctccttccattagcaggtgcagtcttcccaatattctctgcatctgtaccacttttttcttaatttcttgctcaattcattttctccaatccagaccatagcccaattttctttttgaatcaagacaaccaatacctatttcaagaatcacatatagaagcccagggggatcgtcacgaaatgccatcgttagaggaagagctattcccttcaacacctggtaagttcaagatcgaccgtgcccacaacatgaatcgccagttcaaccgttgcttcgcttcaacaagcaccatgttcttatgggcacttttcttgattgctttaacggcgtcctatttgagtttccagtcttttgtcgattccggtagccgatatttcactgcttcttggggcggcattcaatgggagaaacaaatccgaaattctgcccagatccaccgttctaagggcatgtccgttcttgttaccggagcggcaggtttcgtgggaagccacgtttctttagccctcaagaaacgcggagatggcgtcgttgggattgacaattttaacaactactacgacccatcgttgaagaaagcccgaaaatctctcctcaacaaccaagggatttttatcgttgaaggagatataaacgacgcccgtttaatagctaagctctttgatattgtggctttcactcacgttatgcatttggcggctcaagccggagtcagatacgccatggagaatccacactcttatgtccattcgaatatagcaggcttggttactcttcttgaggcttgtaaactggctaatcctcagccgtctgtcgtttgggcttcttcaagttctgtgtacggtttaaacgagaaggtccctttctctgaatctgatcggacggaccagcccgccagtctttacgcggcaacgaagaaggcaggtgaggaaattacccatacatacaatcacatttacggtctttcagttactgggttaaggtttttcactgtctacggtccgtttggaagacccgatatggcttacttttctttcacgagaaacattttacaagggaaaccgattacagtttaccggggcaagaatcgggttgacttggcccgggatttcacttatatcgatgatattgtgaagggttgtgtagggtcattggacacttcaggtaaaagcacaggttccggtgggaagaaacggggacccgctccttatcggatctttaatttgggtaacacgtcaccagtcacggtgccgacacttgtgaacatactggagaggcatttgaaggtaaaagcgaagaggaacatcgtagatatgcctgggaacggtgacgtaccattcactcatgcaaatattagtttggcccagagagaacttgggtataaaccgactactgatctggaaaccgggttgaagaaatttgtcaagtggtatctcacttattacggctataatcgtgggaaagctgtacattagtttctttgtttttctttttttttcttcttatgatttctgttttcccattgaaaaagggaaagaaagacaaatgggaaatagaaaataatctgataaggtcgacaaagtggggggaaaaagacaaattattcttttcttggaggggtaagccccagtaattttgttgtctctttatttgtttttgtatgtaaagtattcattagaaacatctcatagttttttattccccctctctttcactcttgtcgttgaacttacagcactgaattttttcagtattatatggtttaccctttctttattctatatctaaaaaatattttaaagataa

SEQ ID NO: 881 - DNA, 1790 bp, Populus trichocarpa
aggtgcagtcttcccaatattctctgcatctgtaccacttttttcttaatttcttgctcaattcattttctccaatccagaccatagcccaattttctttttgaatcaagacaaccaatacctatttcaagaatcacatatagaagcccagggggatcgtcacgaaatgccatcgttagaggaagagctattcccttcaacacctggtaagttcaagatcgaccgtgcccacaacatgaatcgccagttcaaccgttgcttcgcttcaacaagcaccatgttcttatgggcacttttcttgattgctttaacggcgtcctatttgagtttccagtcttttgtcgattccggtagccgatatttcactgcttcttggggcggcattcaatgggagaaacaaatccgaaattctgcccagatccaccgttctaagggcatgtccgttcttgttaccggagcggcaggtttcgtgggaagccacgtttctttagccctcaagaaacgcggagatggcgtcgttgggattgacaattttaacaactactacgacccatcgttgaagaaagcccgaaaatctctcctcaacaaccaagggatttttatcgttgaaggagatataaacgacgcccgtttaatagctaagctctttgatattgtggctttcactcacgttatgcatttggcggctcaagccggagtcagatacgccatggagaatccacactcttatgtccattcgaatatagcaggcttggttactcttcttgaggcttgtaaactggctaatcctcagccgtctgtcgtttgggcttcttcaagttctgtgtacggtttaaacgagaaggtccctttctctgaatctgatcggacggaccagcccgccagtctttacgcggcaacgaagaaggcaggtgaggaaattacccatacatacaatcacatttacggtctttcagttactgggttaaggtttttcactgtctacggtccgtttggaagacccgatatggcttacttttctttcacgagaaacattttacaagggaaaccgattacagtttaccggggcaagaatcgggttgacttggcccgggatttcacttatatcgatgatattgtgaagggttgtgtagggtcattggacacttcaggtaaaagcacaggttccggtgggaagaaacggggacccgctccttatcggatctttaatttgggtaacacgtcaccagtcacggtgccgacacttgtgaacatactggagaggcatttgaaggtaaaagcgaagaggaacatcgtagatatgcctgggaacggtgacgtaccattcactcatgcaaatattagtttggcccagagagaacttgggtataaaccgactactgatttggaaaccgggttgaagaaatttgtcaagtggtatctcacttattacggctataatcgtgggaaagctgtacattagtttctttttttctttttttttcttcttatgatttctgttttcccattgaaaaagggaaagaaagacaaatgggaaatagaaaataatctgataaggtcgacaaagtggggggaaaaagacaaattattcttttcttggaggggtaagccccagtaattttgttgtctctttatttgtttttgtatgtaaagtattcattagaaacatctcatagttttttattccccctctctttcactcttgtcgttgaacttacagcactgaattttttcagtattatatggtttaccctttctttattctatatttaaaaaatattttaaagata

SEQ ID NO: 882 - DNA, 2388 bp, Glycine max
ggaaaattaatgcccctttcattttctctgcatctgtagtatctatcaccaatcaattccactcttcttcccatcaaacaacaaaaaatcaatctgggaaacaaaaacaaaatgccgtcattagaggaggaactcttcccatcaaccccaggaaagttcaagatcgagcggtcccaccacatgaaccgccaactctatcgctgtttcgcctccaccagcaccatgttcctgtgggccctcttcttaatcgccctcaccgcttcctatctcagcttccaaggcttcgtcgattccggcagccgctacctcaccgcctcctggggcgggatccagtgggagaagcaggtccgcacctccgcccagatccaccgtcaaggcggcatgtccgtcctcgtcaccggcgcagccggcttcgtcggctcccacgtctccctcgccttaaaacgacgcggagacggcgtcgtcggactcgacaacttcaacgactactacgatccgtccctcaaaaaagcccgcaagtccctcctcgccacgcacgacgtcttcatcgtcgaaggcgatgtcaacgacgcgaaactcttggcgaagctcttcgatgtggttgctttcactcacgtgatgcacctcgcggcgcaggctggggttcgctacgccatggagaatccccactcgtacgtccacagcaacatcgcgggcctcgtcacgcttctcgaggcctgcaaaaccgcgaaccctcagcccgctatcgtctgggcctcgtccagctccgtctacgggctcaacgagaaggttcccttttccgaatcggaccagaccgaccagcccgctagtctctacgccgcaacgaaaaaggccggtgaggaaatcactcacacctacaatcacatctacggtttatccatcaccggtttgagattcttcaccgtgtacggaccctgggggagacccgacatggcttatttctctttcaccaggaacatcttacaagggaaacctattaccgtttaccgcggtaaaaaccatgtcgacctggctagggatttcacctacattgatgatattgtgaagggttgcgtcgggtcgttggatacttcggctaagagtaccgggtcgggtgggaagaagcgtggacccgctccgtatagaatatttaacctggggaatacttcgccggttactgttcctactcttgtgagtatattggagcggcatttgaaggtgaaggcgaagaggaatattgtggacatgcctggaaacggtgacgttccgtttactcacgcgaatattagttcggcccggagagagctcgggtacaagcccacgaccgatttgcaaaccgggttgaagaagttcgtcaagtggtatctttcctattacggctacaatcacggcaaacctgtaaattaataaattttgttttgtttcctttttattcgggaagggttttctttttctttttcttttttagtgtggtaggttttaagtcacagatagaaaaaaagaagaagaaagaacctggtcaagaagaagaagggaaactggattaaaaggaagaaagaaaagagggggaaaaaaagagaaaagaaaagaaaagaagagaaggagaagatttacattctttacttgggaggccagctaaaacagctgttgttccttcgttgatttcttttcttttttggtattaattggtgttttttgtattttattttttacattttcttattctgtaaagaaagaaagttcgagttcaacctcgatttatttagttgttgtttatatttaaatttaaatgtttactttgtcctaaagttgattagagcgagaaatgcgttgcaccgtaattttcgtttggtttgttggttcgtccgtcaatcatcgctcccttgtgaagtgtttaaccattgaactcttacatttagtcaatccaataggcataaggaggataagtataagttttgttttacatttttagacattgaatatagagtgagaagatttgcaagaaatataagcgaacaatttgttagggataaaagttcaggatagtttttggtatataatgaaagtattttatttgttaattaattacttatcgaataaaatatggtgaatttggaggaggggatttgataggtggagacagcaaggatgacaggagcaattggagaagtacggtaggatgtgggagtgtggccgttggatttggaggaattagattggtatatttgtccagctgtaaagtacttacgtagtagcaagtgcagtggcggtgggttcagcagcttgccgacactcactcgggtcaccaaaagaggcatgctggatggatggatggtgtaatttttttcttttagatttataggtggatagttcatcgttttcgttttt

SEQ ID NO: 883 - DNA, 1708 bp, Glycine max
aaaattaatctccctttcattttctctgcatctgtactctccaaaatgccgtccttagaggaggagctcttcccttcaaccccaggcaagttcaagatcgagcgggcccaccacatgaaccgccagctctaccgctgcttcgcctccaccagcaccatgttcctgtgggccctctttttaatcgccctcaccgcttcatatctcagcttccaaggcttcgttgattccggcagccgctacctctccgcctcctggggcgggatccagtgggagaagcaggtccgcacctccgcccagatccaccgtcaaggcggcatgtccgtcctcgtcaccggcgctgccggcttcgtcggctcccacgtctccctcgcgttaaaacgacgcggagacggcgtcgtcggactcgacaacttcaacgactactacgatccgtctctgaaaaaagcccgcaagtccctcctcgccaagcatgacgtcttcatcgtcgatggcgacctcaacgacgccaagctcttggcaaagctcttcgatgtggtcgctttcacccacgtgatgcacctcgcggcgcaggccggggttcgctacgccatggagaatccccactcctacgtccacagcaacatcgcgggcctcgtcacgcttctcgaggcctgcaaatcggcgaaccctcagcccgcggtcgtttgggcctcgtccagctccgtctacgggctcaacgagaaggttccattttccgaatcggaccagaccgaccggcccgctagcctctacgccgcaaccaaaaaagccggtgaggaaatcacacacacctacaatcacatctacggcttatccatcaccggtttgaggtttttcaccgtgtacggaccctgggggaggcccgacatggcttatttctctttcaccagaaacatcttacaagggaaacctatcaccgtttaccgcggtaaaaaccatgtcgacctggccagggatttcacctacattgatgatattgtcaagggttgcgtcgggtcgttggatacttcggccaagagtaccgggtcgggtgggaagaaacggggacccgctccgtatagaatatttaacctggggaacacgtcgccggttactgttcccactcttgtcagtatattggagcgccatttgaaggtgaaggccaagaggaatattgtggacatgcctggaaacggcgacgttccgtttactcacgcgaatattagttcggcccggagagaactcgggtacaagcccaccaccgatttgcaaaccgggttgaagaagttcgtcaagtggtacctttcctattacggctacaatcacggcaaacctgtaaattaattttattttattttgtttccccccccttttttttttctttttcggaaagggttttttctttttttagtgtggtaggttttaagtcacagattaaaacagacagggaaaaaaaagaagaaagaacctggtcaagaagattagaagaagaagggaaattggggctaaaaggaaggaagaaaagaaaaagaaaaaaagaaaagagaaaagaaaagaagagaaggagaagaatacaattctttacttaggaggccagctaaaacagctgttgttccttcgttgatttcttttcttttttggtattaattggtgtttttttgtattttttttaacattttctttttctgtaaagaaagaaagttccgagttc

SEQ ID NO: 884 - DNA, 1610 bp, Manihot esculenta
  misc_feature (974)..(976): n is a, c, g, or t
  misc_feature (992)..(992): n is a, c, g, or t
  misc_feature (994)..(999): n is a, c, g, or t
  misc_feature (1015)..(1015): n is a, c, g, or t
  misc_feature (1017)..(1017): n is a, c, g, or t
  misc_feature (1210)..(1210): n is a, c, g, or t
gggcaggtgcagaaattttcatcgcccaattctctctctgcatctgtgcaattcttctctcttttctcaaacccaaatccaatttcactggattagaaaccagaagcaacgaatcacaagcaaggatatgcccttgttggaggaagagcttttcccttccacgcctggcaagttcaagatcgaccgtgctcacaccatgggccgccatttccatcggtgttttgcctctacaagtaccatgttcttgtgggctcttttcttgattgctttgaccgcttcgtatttgagtttccagagctttattgattccggtagcaagtatttatccgcttcttggggcggtattcagtgggagaaacaagtccggaattctgcccagatccaacgagccggtggcatgtccgttcttgtgactggagctgctggtttcgtcggtacccatgtgtctttagcgctcaagaaacgcggagacggcgtcgttggactcgataattttaacaactattacgatccatcgttgaagaaagctcgtaaatctcttcttgccaaacacgggatctttatcgtcgaaggcgatgtcaacgacgcgcgtctcttaaccaagctgtttgatgtggtggctttcactcatgtgatgcacttggcggctcaagcaggagtcagatacgccatggagaatcctcactcgtatgttcattctaatatagccggcttggtcacgcttcttgaggtttgcaaatcggctgatccccagccggcgattgtttgggcttcgtccagctcagtttacggcttgaacgaaaaagttcctttctctgaatctgatcggaccgaccaaccggcgagtctctacgcggcgacgaaaaaggccggcgaggaaatcacccacacatacaaccacatttacggtctctcaattactgggttaagattcttcactgtgtatggcccttggggaagacccgacatggctnnnttcacgttcacgagangnnnnnnacaggggaaaccgatnangatataccggggcaagaaccgggtagacctggcccgagatttcaccttcattgatgatattgttaaaggctgtgtcggttctttggatactgcaggaaagagcacaggttccggcggtaaaaagcggggaccggcacaatatcggatcttcaatctggggaatacgtcaccggtaacggtaccgacgctggtnagtatattggagaagcacttgaaaatgaaagcgaagaggaagatcgtggatatgccaggaaacggtgacgtaccattcactcacgcgaatattagcttggcccgaagagaactcgggtacaaacccacaaccgatttgcaaaccggattgaagaaattcgttaagtggtatctcacgtattatggctacaatcacggaaaagttgtaaattaaggtatttttatttttttattttttttataggcattcttgttttcctaaaaatcaaggagaaatggtaaaaaaaagaaaaaaaaaatactcatttaatttctttttttagtagggcaatcgtctctttcttttactttaataagtaacgccggaaatttatttaaatatcaccatagcaaattcttac

SEQ ID NO: 885 - DNA, 1726 bp, Gossypium hirsutum
aaaaataaaaactcccctccctttttttctgcatctgcttttatttctttacagctcaaaattaataattataaatcaaatcaaatcaagtctctttcttccttatcctttcgatctgctaatcaagtcatttcaagattttttttctgaacaagaaaaagaaaaatagtaggacaatgccgtccttggaggatgagctgtttccgtcgacgccagggaagttcaaggtcgacagagcacacaatatgaaccgtcaattccatcgttgcttcgcttcaaccagcaccatgtttttatgggctcttttcttgatcgcattgacggcgtcgtatttgcgcttccagagtttcgttgattctggtagccgatatttcagtgcttcatggggtggtatccaatgggaaaaacaagtccgtaactccgctcagatccatcgttccggaggcatgtccgttctggtgactggagcggctggtttcgtcggtacacacgtttcccttgccctcaaaaaacgcggagatggagtcgttgggcttgacaatttcaacaactattacgacccttcgttgaaaaaggcgaggaaatccctgcttaacagccacggcattttggtggttgaaggcgatttgaacgacgccaagctgttggctaagcttttcgacgtggtggcttttactcacgtgatgcatttggcggctcaagctggagtcaggtacgccatggaaaaccccaactcttatgttcacagcaacatcgccggtctcgtcacgcttctcgaaatttgcaaatccgctaatccccagccagccgttgtctgggcctcctccagttccgtttacggtctcaacgaaaaggttcctttctctgaggccgacaggaccgaccagccggctagtttgtatgccgccaccaagaaggcaggcgaagaaataacccacacttataatcatatctacggtctttcaattactggattaagatttttcaccgtgtacggtccatggggaaggcctgatatggcgtatttttcgtttacgagaaatattctgcagggaaagcccatcaccatttatcggggaaagaatcgggttgatttggcccgagattttacctacattgacgatatcgtgaaaggctgtttgggatcgttggatacatccgggaaaagcaccggttctggtgggaagaaaaaggggaacgctccatataggatttttaatttggggaatacgtcgccggtcaaggtgccggagctggtgaacatcctggaaagacatttgaaggtgaaagccaaaaggaatatcgtagatatgcctggaaacggtgacgttccattcactcatgcgaatatcagtttggcccaaagagaattcgggtacaagccctcaaccgatttgcaaaccgggttgaagaagtttgttagatggtatttatcttattatggttataacaaccgcaaaggtctacaataaaatttatttttggttttaaatgtaaggattttcttggtttcccattagaatgaaatagaaggtaatgggaaaaccggaggaaccgcaagttaaaaacaagagaaagatgaggattacgtattcttttcttgggggagcagtgaaaaaaacacctagccccggtatttcttgtcagttctttttatttttttcctttgtaagtaaagttttcatattttgctatagcttataatttaaattcattgctctttttt

SEQ ID NO: 886 - DNA, 1724 bp, Populus trichocarpa
aggtgcagttccccattattttctctgcatctgtatttctccatttgtatttctttttttattattatttcatcttctctaatcaaaataaaaaccaccccattttcttttcaaatcaagacaaccaatacctgtttcaagaaactccaagtatcacccaagaaacacgtaatagaacccccaaggagatcgaaagaaaatgccagcactagaggatgagctattcccttcaacacctggtaagttcaagatcgatcgagcccacaccatgaatcgccacttccaccgttgcttcggttccacgagcaccatgttcttgtgggcacttttcttggttgctttaacggcgtcgtatttgagtttccaatcttttgtctataccggtagccggtatctcaccgcttcttggggtggtattcagtgggagaaacaaatccgccattctgcccagatacaccgttctaacggcatgtctgttcttgttaccggagcagccggtttcgttggaagccacgtttctttagctctcaagaaacgcggagacggcgtcgtcgggatagacaattttaacaactactacgacccgtcgttgaagagagcccgaaaatctctccttaacaaccaagggatttttatcgtcgaaggagatataaacgacgcgcggttaatagctaagctttttgatactgtggctttcactcacgttatgcatttggcggctcaagctggagtcagatacgccatggagaatccacactcttacgtgcattctaatatagccggcctggtcactcttcttgaagcttgtaaatcggcttaccctcagccgtctgtcgtttgggcttcatcaagttctgtgtacggtttaaatgaaaatgttcctttctctgagtctgatcggacggaccagcccgctagtctttatgcggctacaaaaaaggccggtgaggaaattactcatacctacaatcatatttacggtctgtcaattactggtttaaggttttttactgtgtacggtccatggggaagacccgatatggcttacttttctttcacgagaaacattttacaagggaaaccgatcacagtttatcgtggcaaggatcgggctgacttggctcgggattttacttttattgatgatattgtgaaaggttgtgttgggtcattggatacttcgggtaaaagcaccggatctggtgggaagaagcggggacccgctccttatcggatctttaatttgggtaacacgtctcctgttacggtaccgacactcgtgagcttactggagaggcatttgaaggttaaagcgaaaagaaattttgtggatatgcctggaaacggtgacgtaccgttcactcatgcgaatattagtttggcccacagagagcttgggtataaaccgactactgatttggcaaccgggttgaagaagtttgttaagtggtatctctcttactacggatataatcatgggaaagctgtaaattagatttttttttactttttttttggctgcttcgctgtttttccattaaaaaaaaagacaaatgggaaacagaaaatctgacaaggtcgaaaaagtaaaaaaaggaaaagacacgttattctttccttggaggggcaaacctcaattttgttgtttgttttattttttttaatgtaaaggaagattattcacttgacagttgacacattcgatagtaatatttcttttcctt

SEQ ID NO: 887 - DNA, 1722 bp, Populus trichocarpa
aggtgcagttcccattattttctctgcatctgtatttctccatttgtatttcttttttattattatttcatcttctctaatcaaaataaaaaccaccccattttcttttcaaatcaagacaaccaatacctgtttcaagaaactccaagtatcacccaagaaacacgtaatagaacccccaaggagatcgaaagaaaatgccagcactagaggatgagctattcccttcaacacctggtaagttcaagatcgatcgagcccacaccatgaatcgccacttccaccgttgcttcggttccacgagcaccatgttcttgtgggcacttttcttggttgctttaacggcgtcgtatttgagtttccaatcttttgtctataccggtagccggtatctcaccgcttcttggggtggtattcagtgggagaaacaaatccgccattctgcccagatacaccgttctaacggcatgtctgttcttgttaccggagcagccggtttcgttggaagccacgtttctttagctctcaagaaacgcggagacggcgtcgtcgggatagacaattttaacaactactacgacccgtcgttgaagagagcccgaaaatctctccttaacaaccaagggatttttatcgtcgaaggagatataaacgacgcgcggttaatagctaagctttttgatactgtggctttcactcacgttatgcatttggcggctcaagctggagtcagatacgccatggagaatccacactcttacgtgcattctaatatagccggcctggtcactcttcttgaagcttgtaaatcggcttaccctcagccgtctgtcgtttgggcttcatcaagttctgtgtacggtttaaatgaaaatgttcctttctctgagtctgatcggacggaccagcccgctagtctttatgcggctacaaaaaaggccggtgaggaaattactcatacctacaatcatatttacggtctgtcaattactggtttaaggttttttactgtgtacggtccatggggaagacccgatatggcttacttttctttcacgagaaacattttacaagggaaaccgatcacagtttatcgtggcaaggatcgggctgacttggctcgggattttacttttattgatgatattgtgaaaggttgtgttgggtcattggatacttcgggtaaaagcaccggatctggtgggaagaagcggggacccgctccttatcggatctttaatttgggtaacacgtctcctgttacggtaccgacactcgtgagcttactggagaggcatttgaaggttaaagcgaaaagaaattttgtggatatgcctggaaacggtgacgtaccgttcactcatgcgaatattagtttggcccacagagagcttgggtataaaccgactactgatttggcaaccgggttgaagaagtttgttaagtggtatctctcttactacggatataatcatgggaaagctgtaaattagatttttttttactttttttttggctgcttcgctgtttttccattaaaaaaaaagacaaatgggaaacagaaaatctgacaaggtcgaaaaagtaaaaaaaggaaaagacacgttattctttccttggaggggcaaacctcaattttgttgtttgttttattttttttaatgtaaaggaagattattcacttgacagttgacacattcgatagtaatatttcttttcctt

SEQ ID NO: 888 - DNA, 1831 bp, Cicer arietinum
accacgcggtggcggcgccctaaaatattggatccccgggctgcaggttcacatctccctttttattttccacaacctgcatctgtcttcttcccttcctcctctcctcaccaatcacaataacaacaaaaacgttttctccccgaaaatcaaaaatcaagaacataaaagaagtcaatttttgaattgttcaaatctgggaaagaaaatgccgtcatcgtcattagaagacgagctattcccttcaacaccaggaaaattcaagatcgaacgtaatcacggcatgatgaaccgacaggtgtaccgttgcttcgcttcaacaagcaccatgttcttgtgggctctctttttaattgccttaaccgcttcctatctaagtttccaaagcttcgttgattccggtagccggtatctgtctgcttcatggggtggaatccagtgggagaaacaagttcgtacatccgctcaaatccatcgacagggtggcatgtccgttcttgttactggttcagcaggtttcgttgggtcccacgtttctctcgctttaaaaagaagaggagacggcgtcgttggacttgataacttcaacgattattacgatccttcacttaagaaagcgcgtaaaactcttttatcaagccacggcgttttcattgttgaaggtgatataaacgacgctaagttattagccaagctgtttgacgttgtggcttttacacacgttatgcatttagcggctcaagccggtgttagatacgctatggagaatcctcactcttatgttcatagcaatatagccggtcttgtcacgcttctcgaggcttgtaaaatggctaaccctcaaccttctattgtttgggcttcttcaagctccgtttacggtttaaacgagaaagttccgttttctgaatcggatcaaaccgatcaaccggcgagtctctacgccgccacgaaaaaggccggcgaggaaattacgcacacttataatcatatttatggactttccatcactggattgagatttttcaccgtttatggaccttggggaagacctgacatggcttatttctcgttcacgcggaatattcttcagggaaaaccgataaccgtttatcgagggaagaatcatgtagatctggctcgtgattttacttacattgatgatattgtgaaaggatgcgttggatcgttggatacatcagggaagagtactggatctggtgggaagaaacggggatttgctccgtatcggatctttaaccttggaaataattcgccggtgacggttccgacgttggtgagcatattggagcgacatttgaaggtgaaggcgaagaggaatatagtggatatggctggaaacggcgacgttccgtttacacatgcgaatataagtttggcccgaagagagctcgggtataaaccgacaaccgatttgcaaaccgggttaaagaaattcgtgaaatggtacctttcgtattacggatatggcaaacctgtaaattaattgggttttttttttagtctgttagaattttttttaattacagctatggaggtaaaaatactaaacgggaaaaagaaaagaaagaaacccggtcaagaaagagagaaaaagggagaaaggaaagaaaaaaaagtgaaagaatacattctttacttgagaagaggtaacagctaaatcatacagctgtaccctgcctgatttcttttcttttttgtttatgttattttacattttttttttcttttctgtaaagaaagttaatgacttcaacctcgttgtgttgtctcctctaatgataatttatttttttattttcggtattta

SEQ ID NO: 889 - DNA, 1619 bp, Arabidopsis lyrata
gtctccttgtcccctaacctcacctgtatatatacttctccgtctcttcctcttctccttagcagatgctttttggaaaaaaaatatatatataccaaaaaaaaaatctgcatctgtcttcttccttcttccctctaaatttaattacccatttttcccgataaatttttgttgaggaagaaattttttgtaaagagagtttaattaattatgccttcaatagaagatgagctgtttccgtcaacgccgggtaaattcaaaattgaccggtcaaaccgtcagctccaccgttgtttcgcttctacgagcaccatgtttctttgggctctcttcctcatcgctctcaccgcttcttacttgagtttccaaagcttcgtcgattccggtagccgttatctaaccgcttcttggggcggaatccagtgggagaaacaggttcgtacctccgctcagatccatcgctccggcggtatctccgtcctcgttaccggcgctactggattcgtcggtagccacgtgtcacttgcgttgaggaaacgcggcgatggtgtcgttggacttgataatttcaacaattactacgatccgtcgttgaaacgcgctcgcagatctctgttgtcgtcgagagggatcttcgtcgttgaaggagatctcaacgacgcgaagctgttagcgaagcttttcgatgtcgttgctttcactcacgtgatgcatctcgctgctcaagccggagttagatacgctttggagaatcctcaatcgtatgttcatagcaacatcgccggacttgtgaatcttctcgagatttgcaaagcggcgaatcctcaaccggcgattgtttgggcttcatcgagctccgtctatggactcaacgagaaagttcccttttccgaatctgaccgtacagatcaaccggcgagtctctacgccgcaacgaaaaaagccggcgaagaaatcacccacacttataaccatatttacggtcttgccattaccggtttaagattcttcacggtttacggaccatggggtagaccggacatggcttacttctccttcaccagaaacatcctacaaggtaaaccgatcacaatctaccggggcaaaaatcgggtcgatctagcccgggattttacatacatcgacgatatagtcaaaggctgcttaggatctctagattcatcgggtaaaagtaccgggtcgggtggtaagaaacgtggagccgcaccgtaccggatatttaacctgggaaacacatctccggtaacggtaccgattctggtggatatattggagaagcatctaaaggtgaaagcaaaacggaacttcgtggagatgccaggaaacggcgacgttccgttcacacatgctaatattagctcagcacgaaatgaattcgggtataaaccgacaaccgatttggaaaccgggttgaagaagttcgttagatggtatctttcttattacggatacaatactaaagccaagcttgtacattaaccgtgactattattattattatttttaatgaaattatttttttctttctcccatacattttatatgattcgttctttaggattataaaatctaaattattcgtttctcttaagacaagc

SEQ ID NO: 890 - DNA, 1554 bp, Arabidopsis thaliana
gtctccttgtcccctaaccccacctgtatatatacttctccgtctcttcctcttctccttagcagatgcttttgggaaaaaaaatatataccaaaataaaagatctgcatctgtcttcttcttcttcttcatttcctctaaatttaattacccattttttccgataaatttttgttgaggaagaatttttgttgtaaagagagtttaattaaattatgccttcaatagaagatgagctgtttccgtcaacgccgggtaaattcaaaattgaccggtcaaaccgtcagctccaccgttgtttcgcttctacgagcaccatgtttctttgggctctcttcctcatcgctctcaccgcttcttacttgagtttccaaagcttcgtcgattccggtagccgttatctaaccgcttcttggggcggcatccagtgggagaaacaggttcgtacctccgctcagatccatcgctccggcggtatctccgtccttgttaccggcgctaccggattcgtcggtagccacgtgtcacttgccttgaggaaacgcggcgatggtgttgttggacttgataatttcaacaattactacgatccgtcgttgaaacgtgctcgtagatctctgttgtcgtcgagagggatcttcgtcgttgaaggagatctaaacgacgcgaagctgttagcaaagcttttcgatgtggttgctttcactcacgtgatgcatctcgctgctcaagctggtgttagatacgctttggagaatcctcaatcgtatgttcatagcaacatcgccggacttgtgaatcttctcgagatttgcaaagcggcgaatcctcagccggcgatagtttgggcttcatcgagctccgtttatggactcaacgagaaagttccattctctgaatctgaccggacggatcaaccggcgagtctctacgccgcaacgaaaaaagccggcgaagaaatcacccacacttataaccatatttacggtcttgccattaccggtttaagattcttcacggtttacggaccatggggtagaccggatatggcttacttctccttcaccagaaacatcctacaaggtaaaccgatcacaatctaccggggcaaaaaccgggtcgatttagcccgggatttcacatacatcgacgatatagtgaaaggatgtttaggatctctggattcatcgggtaaaagtaccgggtcgggtggtaaaaaacgtggagcagcaccgtaccggatatttaacctgggaaacacatctccggttacagtaccgattctggtggatatattggagaagcatttaaaggtgaaagcgaagaggaacttcgtggagatgccaggaaacggcgacgtaccgttcacacatgccaatattagctcagcccgaaatgaattcgggtataaaccgacaaccgatttggaaaccgggttgaagaagttcgttagatggtatctttcttattacggatacaatactaaagccaagcttgtacattaaccgtgactattattattatttttaatgaaattatttttttctttctccc

SEQ ID NO: 891 - DNA, 1290 bp, Aquilegia formosa
aagaaagaaagatgagatctttagaagatgagttgtttccatcaacaccaggaaaggtgaagatagaaagaacaaacatgttaaatcgacaattctatagatgttttgcatcaacaagtactatgtttttatgggctttattcttaattgctttaacagcatcttatttaagttttcaaagttttgttgattcaggacatagatatttaaatgcatcttggggtggtattcaatgggaaaaacaagttagaaattctgctcagacccaaaaacaaagaggtggtggtagtggtggtttctctgttcttgttactggttcagctggttttgttggttcacatgtttcaattgcactaaagaaacgtggtgatggtgttgttggtcttgataattttaataattattatgacccttctttgaaaaaagctagaaaatctcttttaaacaaaaatggtatttttgttgttgaaggtgatttaaatgatgctagacttttatcaaaactttttgatattgttgcttttactcatgttatgcatttagctgcacaagctggtgttagatatgctatggagaatcctggttcttatgttcatagtaatattgctggtttagttactcttcttgaagcttgtaaatctgcaaatccacaaccttcaattgtttgggcttcttcatcttctgtttatggattaaatgataaagtacctttttctgaattagatcaaactgatcaacctgcaagtctttatgctgctacaaagaaagctggtgaagagattacacatacttataatcatatttatggtctttcaattactggtttaagatttttcactgtttatggtccttggggtagacctgatatggcttatttttcatttacccgaaacattttacaaggaaaaccgataactgtatatcggggtaaaaatcgggttgatttagcaagagattttacttatattgatgatattgtcaaaggttgtttgggttctcttgatacttcaggaaaaagtactggaagtggtggaaaaaaacgtggaccagcaccatatcggattttcaatcttggtaatacttctcctgtaacggtaccaacacttgtttcaatacttgaaagacatttgaaggttaaagctaagaagaatattgttgatatgcctggtaatggagatgtgccttttactcatgctaatatcagtcttgcaagtagagaatttggatataaaccaacaacagatttgcaaactggtttgaagaaatttgttaaatggtatctttcttact

SEQ ID NO: 892 - DNA, 1564 bp, Oryza sativa
atgcgggtggtggtggaggaggaggaggccgaggtgatgtacccgtcgacgccggggaaggtgaaggtggagcagcggtcgtcggcggcgatgagccggcaggttcaccggtgcttcgcgtcgacggggaccatgttcctgtgggcgctgttcctggtggcgatgacggcgacgtacctgagcttccgctccctcgccggcgacgccgcggcgtcgtcgtcgcgctacttcccggcggcgtcgtggggcgggctgcactgggagcggcagatcagggcgtcggcgtcgccgcggcggccgcccgggtcggcggagggcgccgggctgtccgtgctggtcaccggcgccgccgggttcgtcggcgcgcactgctccctcgccctccgcaagcgcggcgacggcgtcgtcggcatcgacaactacaactcctactacgacccgtcgctgaagaaggcgcggcgcgccctcctgggctcgcacggcgtgttcgtcgtcgacggcgacatcaacgacggccgcctcctcgccaagctgttcgacgtcgtccccttcacccacgtcctccacctcgccgcgcaggccggcgtccgctacgccatggagaacccctcgtcgtacgtccgctccaacgtcgccggcctcgtctccctcctcgagtcctgcaaggacgccgacccgcagccggccgtcgtctgggcctcctcctcctccgtctacggtctcaacgacgccgtccccttctccgaggcgcaccgcaccgacaagccggcgtcgctctacgccgccaccaagaaagccggcgaggccatcacccacacctacaaccacatctacggcctctccatcaccggcctccgcttcttcacggtgtacggtccctggggccgccccgacatggcctacttcttcttcacccgcaacatcctgcaggggaagccggtcaccgtctaccggggccgtgatcacgtcgacatcgccagggacttcacctacatcgacgacatcgtgcgggggtgcctggcggcgctggacacggctgggcggagcacgggcgggggcgggaggaagcgcggggcggcgccgtacaggatcttcaacctcgggaacacgtcgccggtgacggtgccggcgctggtggcgatgctggagaggtgcctgatggtgaaggcgaggaggcacgtcgtcgagatgcccggcaatggcgacgtgcccttcacccacgccaacatcagcctggcgagggagcagctcgggtacaagccgacgaccagcctcgagatggggctcaagaagttcgtccggtggtacctctcctactacggctacaacagaggaactcacgcattcaggagccgcttgtgatgacgattatataaattgttagtatagttagcattagtgaatatataaatatgtgttgaacatttttgttttttttgttgttggggggtttgtggggatggaaggaggaattgattcttttgttaattttttttcccttgttgtatttttgtcatgtaaattaggttgtttataggttttctaaagtttacattgacaaaag

SEQ ID NO: 893 - DNA, 1587 bp, Fragaria vesca
  misc_feature (1356)..(1356): n is a, c, g, or t
actcgcccaaatatttcaaaacccaaaaacaaaaaattttcaattttttctctgcacttgctctcttcttcaatccctaccctccttttcggtttcttcttcaaattccaaaaaccccagttataattcaagatacaaaaagaaaaccctattcgaggattaggaagaagaacccatagtttcagcgattacgaataatcagagaagaatgccgtcgccgtcgcaattagaggacgagctgttcccgtcgacgccggggaagttcaagatcgaccggtcccacaccatgaaccgccagtttcaccgttgcttcgcctccaccagcaccatgttcttgtgggcccttttcttgatcgccctgacggcgtcgtatctgagtttccagagcttcgtcgactccggcagccgctacttctcggcctcttggggagggatccagtgggagaagcaggtccgcaactcggctcagatccaccgctccggcggcatgtccatcctcgtcaccggtgccgccggtttcgtcggcacacacgtgtccgtggccctgaaaaagcgcggagacggtgtcgtcgggcttgacaacttcaacaactactacgacccgtcgttgaagaaggcccggagaaacctcctcaaaggccacggcatcttcatcgtcgagggcgacttaaacgacaacaagctcctcgacaagctcttcgacaccgtcgccttcacccacgttatgcacctcgccgcccaggccggcgtccgctatgccatggagaaccccggctcttacgtccacagcaacatcgccggcctcgtcacgcttctcgaggtctgcaaatccgccaatcctcagccgtccatcgtctgggcctcctccagctccgtctacggcttgaacgacatggtccccttctccgaatccgaccggaccgaccagccggcgagcctctacgccgccacgaagaaggccggcgaggaaatcacccacacttacaaccacatttacgggctgtcaatcaccgggttgagattcttcacggtttacgggccctggggaagacccgacatggcgtatttcagtttcacccggaatattctccagggtaaatccatcacggtttaccgcggtaaaaaccatgttgacttggcgagggactttacatacatcgacgacattgtcaaggggtgtctggggtctttggatacctccgggaagagtaccgggtcgggcgggaagaagcggggacccgcaccgtaccggatatttaacttggggaacacgtcgccggtgacggtcccgacgctggtaaacatcttggagcggcatttgaagatgaaggccaagaggaatgtagtggagatgcncggaaacggcgacgttccgttcacgcacgccaacataagtttggcccgaacacaactcgggtacaaaccgacgaccgatttgcaaaccgggttgaagaagtttgttaggtggtatctttcttactacggctacaataacgacaaacctgtacactaatatttgttttcatttccttttcttttctttgttggggatttttgtttcccaattcaatggaaaccatgggagag

SEQ ID NO: 894 - DNA, 1673 bp, Solanum phureja
gtcctatatatattcctccctttttctgcagatactaaaacccattttcatctacatcaataacatccaattttaacaatttctttatcaatctcaaaaggggaaaaaaattattttcttcgatttgaaaaaaaaatgaggggattagaagaagaattcattccatcaacaccaggaaagttcaaagacaaaacgtattactccggtaaccggcaatttcaccggtgttttgcttcaacaagtacaatgttcttatgggcattgtttttattagctttaacggcgtcgtatttgagttttcagtccttcatggattccggtacccggtatctctcctccacatggggtagtcttcattgggagaaacaagttcgtgattccgcccaaatccaccgtgttaacggcatgtccgtactcgtcaccggcgctgccggtttcgtcggatctcacgtttcaatcgcattgaaaaaacgtggagacggtgtcgtcggaattgacaatttcaacaattactatgacccttcgttgaaaaaagctcgcaaaaatctgttgaatttgcaaaatgtgttcgtcattgaaggggatattaacgatgttcatctgttagcgaagctatttgatatcgtagcgtttacacacgttatgcatttagctgcacaagctggtgttcgttacgccatggaaaatcccaaatcttatgttcatagtaatattgctgggcttgttacgcttctcgaagcttgcaaaaatgcaaaccctcaacccgccattgtttgggcaagctcgagctcagtttacgggttgaacgaaaaggtaccgttttccgaatcggatcgaacggatcaacccgcttcgttatacgcagcaacgaagaaagctggcgaagaaattacacatacttataatcacatttacgggttatcaataaccgggttgaggttttttactgtttacggaccgtggggaagacccgacatggcttatttctcatttacccggaatatcttacaaggtaaaccgataacggtttatcggggcaagaatcgggtcgacttagcccgtgattttacctacattgatgatattgtgaaagggtgtgtcgggtcacttgatacagcagggaagagtaccgggtcgggtgggaagaaacggggcccggctatgtttcggatatttaacttgggtaatacttcaccggtgacggtaccgatgatggttgcgatgttagagaagcatttgaaagtaaaagctaagaaacatgttttggatatgcccggaaacggcgacgttccatttacgcatgcgaatattagtttggcccaaaaagaactcgggtataaaccgacaaccaatttgcaaaccgggttggggaaattcgttaggtggtatctctcctattatggctatagacaagaaaagtctgtaaaataattatttttttctttggttatttttaggatttttagattttatgttatcgcggaaaaggcgaaagaaaagaaaaagaagaggaagaaaaagaaaagaatattattcttttcttgtgggagggaggagtgaagaagattgaactccttattccatgttagagtcttattgttatagttacttgctttttcttgtaaaagaataaaaaattgctcattctatcaaatggtatttgcacttttttt

SEQ ID NO: 895 - DNA, 1463 bp, Euphorbia esula
  misc_feature (134)..(134): n is a, c, g, or t
  misc_feature (139)..(139): n is a, c, g, or t
  misc_feature (489)..(489): n is a, c, g, or t
  misc_feature (904)..(904): n is a, c, g, or t
  misc_feature (1265)..(1265): n is a, c, g, or t
tttccttcttcttcttttttttaatttctcctttttctttcttctttttcatcccccccaaattcatcctccccaattaatcatctcaaagaaagaaagaaagaaagaaagaaagaaaaggaaagaagattaanaaaanatcaagaaactatgccatctttgcatgaggagctcttcccttctactccgggtaaattcaaaattgaccggggtaaccgccaatttcaccggtgttttgcctccaccagcaccttgttcttatgggctttgtttttaattgcgttgacggcttcttacttgagtttccagagctttattgattccggtagcaagtatttctccgcctcctggggcggcattcaatgggagaaacaggtgaggaattctgcccagatccaccgtaacggcggcatgtccgttcttgtaaccggcgctgctggtttcgtcggttcacacgtgtctttggcgttgaaaaagagaggagacggngtcgttgggcttgataattttaacaactattacgatccgtcgctaaagaaagcgaggaaatctcttctttctagccacggaatttttatcgtggagggagatttaaacgacgcgctgctcttagccaagctgttcgatgtggtggcttttactcacgtgatgcacttggcggctcaagccggagtcagatacgccatggagaatcccaattcttatgttcattctaacatagccggcttggtcaatcttctcgaggttatcaaatcggctaatcctcagccggctatggtttgggcttcgtccagctctgtttatggtttaaacgacaaggttccgttctcggaatctgaccggaccgaccagccggcgagtctctacgccgccacgaagaaagccggtgaggaaattactcacncttacaatcacatttacggtttatcaatcaccgggttgagatttttcactgtttatggcccgtggggcagacccgatatggcttacttctcttttacccgaaatatccttcaaggaaaaccaataacggtttaccggggtaaaaaccgggttgatctggcccgggatttcacctacattgatgatatagtcaaaggttgtgtcggttcattggatactgctggaaaaagtaccgggtcgggcggtaagaagagaggacccgctccttatcggatcttcaatttgggtaatacttctccggttactgttccgacacttgtgaacatactagagaggcatttgaagaagaaggcgaagaggantatggtggatatgcctggaaacggtgacgttccgtttacccatgcgaatattagcttggcccaaagggaattcgggtatcaaccgacaaccgatttgcaaaccgggttgaaaaagtttgttaaatggtatctagcgtattacggctataataatggaaaggctgtaaattaaggctaatttttttttttttccttttt

SEQ ID NO: 896 - DNA, 1629 bp, Tropaeolum majus
atcgattaaacttcgattagtatcggttttttttctctattcgattccttattttcgaattcaattaagaatctctttgcaaaattttgataagaatcgaatattccggcaaaaatgccgccattggagggcgagttgttcccgtcgactccgggcaaatacaagatcgagcgcgcatacgcaatgaaccgtcaagctaaccggtgttttcatcgacaaacaccatgtttttgtggaccttgttcttgattgctcctacggtatcgtatttaagctttcagagttttgttcataccggtagtcggtacttgtctgcttcctggggtggtattcagtgggagaagcaagtgcgtaattccgctcagatccatcgtcccggtggaatggcggtgcttgttaccggtgcagcaggtttcgtcggaagtcacgtttcgcttgcattgaaaaagagaggagacggggtagttggagttgataatttcaacaactactacgatccgtcgttgaagaaagcacgtaaatcgcttttgaagaatcacggtatcttcgtcgtcgagggtgacctaaacgacgggaagctcttggctaagcttttcgatgtggtggctttcactcacgtgatgcacctagcggctcaagccggcgtcaggtacgctatggagaaccctagctcttacgtcaacagcaacatcgccggactcgtcacgcttctcgaggtttgtaaatcggcgaatcctcaaccgtcgattgtttgggcttcctccagctccgtttacggactcaacacgaaagtacccttctccgaatccgatcaaaccgaccaaccggcgagtctctacgccgcaacgaagaaagccggcaaggaaatcactcacacgtacaaccacatttacggcctttcaatcaccgggttaagattcttcacagtgtacggtccatggggtagacccgatatggcttatttctcgttcacgagaaatatcttgcaaggtaaaccgattacaatatatcggggcaaaaaccaagtggatttagcccgggatttcactttcatcgatgatatagtgaaaggttgtttagggtcgttggatacatcgggtaaaagtaccgggtcaggtgggaagaaacgtggacccgctttatatcggatctttaaccttgggaatacgtcaccggttactgtaccgatcctggtggatatacttgagaaacatttgaaggtgaaggctaaaaggaagtacgtggatatgcccggaaacggtgacgttccgttcacacatgcgaatactacattggctagacagtcattcgggtataaaccgacaaccgatttacaaaccgggttaaagaagtttgttaggtggtatctatcttactatgggtacaaaaattaattgaattccttttttttcttttttgtaatttgtaggaatatttctttttccacgaaggacaaaagaatgtgaaaacgaaaaaaagaccaaaaagaccttttttaaagttgtaagaaaatagattgaaaaagaaaatacaaaaagataaagaaaatacattcttttctttggagggtgcttgatgcaaaaacctctccagttttttcttttattatatacaatttcattcacatca

SEQ ID NO: 897 - DNA, 1636 bp, Solanum tuberosum
gctaaaacccattttcatctaccatcaataacatccaattttaaccaatttctttatcaatctcaaaaggggaaaaaaatattttcttcgatttgaaaaaaaaaaatgaggggattagaagaagaattcattccatcaacaccaggaaagttcaaagacaaaacgtattactccggtaaccggcaacttcaccggtgttttgcttcaacaagtacaatgttcttatgggcattgtttttattagctttaacggcgtcgtatttgagttttcagtccttcatggattccggtacccggtatctctcctccacatggggtagtcttcattgggagaaacaagttcgtgattccgcccaaatccaccgtgttaacggcatgtccgtactcgtcaccggcgccgccggtttcgtcggatctcacgtttcaatcgcattgaaaaaacgtggagacggtgtcgtcggaattgacaatttcaacaattactatgacccttcgttgaaaaaagctcggaaaaatctgttgaatttgcaaaatgtgtacctcattgaaggggatattaacgatgttcatctgttagcaaagctatttgatatcgtagcgtttacacacgttatgcatttagctgcacaagctggtgttcgttacgccatggaaaatcccaaatcttatgttcatagtaatattgctgggcttgttacgcttctcgaagcttgcaaaaatgcaaaccctcaacccgccattgtttgggcaagctcgagctcagtttacgggttaaacgaaaaggtaccgttttccgaatcggatcgaacggatcaacccgcttcgttatacgcagcaacgaagaaagctggtgaagaaattacacatacttataatcacatttacgggttatcaataaccgggttgaggtttttttactgtttacggaccgtggggaagacccgacatggcttatttctcatttacccggaatatcttacaaggtaaaccgataacggtttatcggggcaagaatcgggttgacttagcccgtgattttacctacattgatgatattgtgaaagggtgtgtcgggtcacttgatacagcagggaagagtaccgggtcgggtgggaagaaacggggcccggctatgtttcggatatttaacttgggtaatacttcgcccgtgacggttccgatgatggttgcaatgttagagaaacatttgaaagtaaaagctaagaaacatgttttggatatgcccggaaacggcgacgttccatttacgcatgcgaatattagtctggctcaaaaagaactcgggtataaaccgacaaccaatttgcaaaccgggttggggaaattcgttaggtggtatctctcctattatggctatagacaagaaaagtctgtaaaataattatttttttctttttttttatttggttatttttaggatttttagattttatgttaccgcgaaaagggggaaagaaaagaaaaaagaagaggaagaaaaagaaaagaatattattcttttcttgtgtgaaggaggagtgaagaagattgaactccttattccatgttagagtcttattgttatagttacttgctttttcttgtaaaagaataaaaaattgctctttctatcaaa

SEQ ID NO: 898 - DNA, 1617 bp, Solanum tuberosum
gctaaaacccattttcatctaccatcaataacatccaattttaacaatttctttatcaatctcaaaaggggaaaaaaattattttcttcgatttgaaaaaaaaaatgaggggattagaagaagaattcattccatcaacaccaggaaagttcaaagacaaaacgtattactccggtaaccggcaacttcaccggtgttttgcttcaacaagtacaatgttcttatgggcattgtttttattagctttaacggcgtcgtatttgagttttcagtccttcatggattccggtacccggtatctctcctccacatggggtagtcttcattgggagaaacaagttcgtgattccgcccaaatccaccgtgttaacggcatgtccgtactcgtcaccggcgctgccggtttcgtcggatctcacgtttcaatcgcattgaaaaaacgtggagacggtgtcgtcggaattgacaatttcaacaattactatgacccttcgttgaaaaaagctcgcaaaaatctgttgaatttgcaaaatgtgtacctcattgaaggggatattaacgatgttcatctgttagcgaagctatttgatatcgtagcgtttacacacgttatgcatttagctgcacaagctggtgttcgttacgccatggaaaatcccaaatcttatgttcatagtaatattgctgggcttgttacgcttctcgaagcttgcaaaaatgcaaaccctcaacccgccattgtttgggcaagctcgagctcagtttacgggttaaacgaaaaggtaccgttttccgaatcggatcgaacggatcaacccgcttcgttatacgcagcaacgaagaaagctggtgaagaaattacacatacttataatcacatttacgggttatcaataaccgggttgaggtttttttactgtttacggaccgtggggaagacccgacatggcttatttctcatttacccggaatatcttacaaggtaaaccgataacggtttatcggggcaagaatcgggttgacttagcccgtgattttacctacattgatgatattgtgaaagggtgtgtcgggtcacttgatacagcagggaagagtaccgggtcgggtgggaaaaaacggggcccggctatgtttcggatatttaacttgggtaatacttcgcccgtgacggtaccgatgatggttgcaatgttagagaagcatttgaaagtaaaagctaagaaacatgttttggatatgcccggaaacggcgacgttccatttacgcatgcgaatattagtctggctcaaaaagaactcgggtataaaccgacaaccaatttgcaaaccgggttggggaaattcgttaggtggtatctctcctattatggctatagacaagaaaagtctgtaaaataattatttttttttttttttttatttggttatttttaggatttttagattttatgttaccgcgaaaagggggaaagaaaagaaaaaagaagaggaagaaaaagaaaagaatattattcttttcttgtgtgaaggaggagtgaagaagattgaactccttattccatgttagagtcttattgttatagttacttgctttttcttgtaaaagaataaaaa

SEQ ID NO: 899 - DNA, 1374 bp, Brassica napus
ctctctctctaaattcaccatttttattttcatttccgtaaattttctggagaatatttaggaagttttaaatcatgccttccatagaagatgagctcatgttcccgtcaacgcccggtaagttcaagatcgaccgttcaaaccgacagctaaaccgctgtttcgcctcgacgagcaccatgttcctctgggccctcttcctcatcgccctcaccgcttcctacctgagtttccagagcttcgtcgactccggcagccgctacctcaccgcctcatggggcggcatccagtgggagaaacaagtccgaacctccgctcagatccaccgctccggcggcatctccgtcctcgtcaccggcgcgacgggcttcgtcggtagccacgtgtcactcgcgcttagaaaacgcggagacggcgtcgtggggctcgacaacttcaacaactactacgacccttcgttgaaacgcgcgaggatgtctctcctctcctcccgtgggatcttcgtcgtggaaggagacctcaacgacggtaagctcctgtccaagctcttcgacgtggtggccttcactcacgtgatgcacctcgcggctcaggccggggttcgatacgcgctggagaatcctcagtcgtatgttcacagcaacatcgccgggctagtcaacctcctcgagacttgcaaggcggcgaatcctcagccggcggtggtatgggcttcgtcgagctccgtttacggtctcaacgagaaggtgcctttctcggaatcggacaggacagatcagccggcgagtctctacgcggcgacgaagaaagccggtgaggaaatcacccacacttataaccatatttacggtcttgccattaccggtttacgattcttcacggtttacggtccgtggggtagaccggacatggcttacttctccttcacgcggaatattctccaaggtaaaccgatcacgatataccggggaaaaaaccgggtcgatttggcccgggattttactttcatcgacgacatagtcaaaggatgtttaggatctctcgactcctcgggtaaaagtaccgggtcgggtgggaaaaaacgtggatccgcaccgtaccggatcttcaatttagggaacacgtcaccggttacggttcccatcttggtggatatattggagaagcatctcaaggtgaaggcgaagaggaacttcgtggagatgcctggaaacggcgacgttccgttcacgcacgctaatattagctccgcccggagagagttcgggtataaaccgacaaccgatttggaaaccgggttgaaaaagttcgttagatggtatctttcttattacgggtacaataccaaagccaagcttgtacaataacggtgaa

SEQ ID NO: 900 - DNA, 1364 bp, Brassica napus
aattcaccatttttattttcatttccataaaattttctggagaatatttaggaagttttaaatcatgccttccatagaagatgagctcatgttcccgtcaacgcctggtaagttcaagatcgaccgttcaaaccgacagctaaaccgctgtttcgcgtcaacaagcaccatgttcctctgggccctcttcctcatcgccctcaccgcctcctaccttagcttccagagcttcgtcgactccggcagccgctacctcaccgcctcctggggcggcatccagtgggagaaacaagtccgaacctccgctcagatccaccgctccggcggcatctccgtcctcgtcaccggcgcgacgggcttcgtcggcagccacgtgtccctcgcccttagaaaacgcggagacggcgtcgtgggcctcgacaacttcaacaactactacgacccttcgttgaaacgcgcgaggatgtctctcctctcctcccgtgggatcttcgtcgtggaaggagatctcaacgacggtaagctcatgtcaaagctcttcgacgtggtggccttcactcacgtgatgcacctcgcggctcaggccggggttcgatacgcgctggagaatcctcagtcgtatgttcacagcaacatcgccggcctagtcaacctcctcgagacttgcaaggcggcgaatcctcagccggcggtggtatgggcttcgtcgagctccgtttacggtcttaacgagaaggtgcctttctcggaatcggacaggacagatcaaccggcgagtctctacgcggcgaccaagaaagccggtgaggaaatcacccacacttataatcatatttacggtcttgccattaccggtttacgattcttcacggtttacggtccgtggggtagaccggacatggcttacttctcattcacgcggaatattctccaaggtaaaccgatcacgatataccggggcaaaaaccgggtcgatttggcccgggattttactttcatcgacgatattgtcaaaggatgtttaggatctcttgactcgtcgggtaaaagtaccgggtcgggtgggaagaaacgtggagccgcaccgtaccggatcttcaatttagggaacacgtcaccggttacggttcccatcttggtggatatattggagaagcatctcaaggtgaaggcgaagaggaacttcgtggagatgcctggaaacggcgacgttccgttcacgcacgctaatattagttccgcccggagagagttcgggtataaaccgacaaccgatttggaaaccgggttgaaaaagttcgttagatggtatctttcttattacgggtacaatactaaagccaagcttgtacaataacggtgaa

SEQ ID NO: 901 - DNA, 1584 bp, Brassica napus
  misc_feature (1072)..(1072): n is a, c, g, or t
  misc_feature (1075)..(1075): n is a, c, g, or t
  misc_feature (1183)..(1183): n is a, c, g, or t
  misc_feature (1303)..(1303): n is a, c, g, or t
  misc_feature (1339)..(1339): n is a, c, g, or t
  misc_feature (1432)..(1432): n is a, c, g, or t
  misc_feature (1566)..(1566): n is a, c, g, or t
ggatgcttttggaaaaataaccaaaaacaaaaaaaatctgcatctgtcctctctctctctcttctaaattcaccatttttattttcatttccataaaattttctggagaatatttaggaagttttaaatcatgccttccatagaagatgagctcatgttcccgtcaacgcctggtaagttcaagatcgaccgttcaaaccgacagctaaaccgctgtttcgcgtcaacaagcaccatgttcctctgggccctcttcctcatcgccctcaccgcctcctaccttagcttccagagcttcgtcgactccggcagccgctacctcaccgcctcctggggcggcatccagtgggagaaacaagtccgaacctccgctcagatccaccgctccggcggcatctccgtcctcgtcaccggcgcgacgggcttcgtcggcagccacgtgtccctcgcccttagaaaacgcggagacggcgtcgtgggcctcgacaacttcaacaactactacgacccttcgttgaaacgcgcgaggatgtctctcctctcctcccgtgggatcttcgtcgtggaaggagatctcaacgacggtaagctcatgtcaaagctcttcgacgtggtggccttcactcacgtgatgcacctcgcggctcaggccggggttcgatacgcgctggagaatcctcagtcgtatgttcacagcaacatcgccggcctagtcaacctcctcgagacttgcaaggcggcgaatcctcagccggcggtggtatgggcttcgtcgagctccgtttacggtcttaacgagaaggtgcctttctcggaatcggacaggacagatcaaccggcgagtctctacgcggcgaccaagaaagccggtgaggaaatcacccacacttataatcatatttacggtcttgccattaccggtttacgattcttcacggtttacggtccgtggggtagaccggacatggcttacttctcattcacgcggaatattctccaaggtaaaccgatcacgatataccggggcaaaaaccgggtcgatttggcccgggattttactttcatcgacganatngtcaaaggatgtttaggatctcttgactcgtcgggtaaaagtaccgggtcgggtgggaagaaacgtggagccgcaccgtaccggatcttcaatttagggaacacgtcnccggttacggttcccatcttggtggatatattggagaagcatctcaaggtgaaggcgaagaggaacttcgtggagatgcctggaaacggcgacgttccgttcacgcacgctaatattagntccgcccggagagagttcgggtataaaccgacaacngatttggaaaccgggttgaaaaagttcgttagatggtatctttcctattacgggtacaataccaaagccaagcttgtacaataacggtgaaantttgttttaaacgaatttatttatttttacactcggttattgctgtttattttggggaagagatgttcatgactaggataatagaggaaaatctaaatattctttgctcttaagacaagcaaagaaaaaaaggncagcagtatcatctatgc

SEQ ID NO: 902 - DNA, 1578 bp, Brassica napus
  misc_feature (1343)..(1343): n is a, c, g, or t
  misc_feature (1361)..(1361): n is a, c, g, or t
gagcagatgcttttggaaaaataaccaaaaacaaaaaaaatctgcatctgtcctctctctctctctctctctctctctctctctctctcttctaaattcaccatttttattttcatttccgtaaattttctggagaatatttaggaagttttaaatcatgccttccatagaagatgagctcatgttcccgtcaacgcccggtaagttcaagatcgaccgttcaaaccgacagctaaaccgctgtttcgcctcgacgagcaccatgttcctctgggccctcttcctcatcgccctcaccgcttcctacctgagtttccagagcttcgtcgactccggcagccgctacctcaccgcctcatggggcggcatccagtgggagaaacaagtccgaacctccgctcagatccaccgctccggcggcatctccgtcctcgtcaccggcgcgacgggcttcgtcggtagccacgtgtcactcgcgcttagaaaacgcggagacggcgtcgtggggctcgacaacttcaacaactactacgacccttcgttgaaacgcgcgaggatgtctctcctctcctcccgtgggatcttcgtcgtggaaggagacctcaacgacggtaagctcctgtccaagctcttcgacgtggtggccttcactcacgtgatgcacctcgcggctcaggccggggttcgatacgcgctggagaatcctcagtcgtatgttcacagcaacatcgccgggctagtcaacctcctcgagacttgcaaggcggcgaatcctcagccggcggtggtatgggcttcgtcgagctccgtttacggtctcaacgagaaggtgcctttctcggaatcggacaggacagatcagccggcgagtctctacgcggcgacgaagaaagccggtgaggaaatcacccacacttataaccatatttacggtcttgccattaccggtttacgattcttcacggtttacggtccgtggggtagaccggacatggcttacttctccttcacgcggaatattctccaaggtaaaccgatcacgatataccggggaaaaaaccgggtcgatttggcccgggattttactttcatcgacgacatagtcaaaggatgtttaggatctctcgactcctcgggtaaaagtaccgggtcgggtgggaaaaaacgtggatccgcaccgtaccggatcttcaatttagggaacacgtcaccggttacggttcccatcttggtggatatattggagaagcatctcaaggtgaaggcgaagaggaacttcgtggagatgcctggaaacggcgacgttccgttcacgcacgctaatattagctccgcccggaganagttcgggtataaaccgncaaccgatttggaaaccgggttgaaaaagttcgttagatggtatctttcttattacgggtacaataccaaagccaagcttgtacaataacggtgaaaatttgttttaaacgaatttatttatttttacacccggttgttgtttattttggggaagagatgtttatgattaggataatagaggaaaatctagaattctttgtcataaggcaagcaaag

SEQ ID NO: 903 - DNA, 1174 bp, Oryza sativa
actcacttcctcactagattcttaatacacaacccagctggtgaaagagaggaacttgagagttagctagcatggcggcagcattgtcgttcccgatcatcgacatgagtctgctcgacggggcagagaggcccgcggcgatggggctgctccgcgacgcatgcgagagctggggcttctttgagatcctgaaccacggcatctcgacggagctgatggacgaggtggagaagatgaccaaggaccactacaagcgtgtgcgcgagcagaggttcctcgagttcgcgagcaagacgctcaaggaaggctgcgacgacgtgaataaggcggagaagctggactgggagagcaccttcttcgtccgccacctcccggagtccaacatcgccgacatacccgacctcgacgacgactacaggcgcctcatgaagcgcttcgcggcggagctggagacgctggcggagcggctactggacctgctctgcgagaacctcggcctcgagaagggctacctcaccaaggccttccgtggccccgcgggcgcacccaccttcggcaccaaggtcagcagctacccgccgtgcccgcgccccgacctcgtcaagggcctccgcgcccacaccgacgccggcggcatcatcctgctcttccaggacgaccgcgtcggtggcctccagctgctcaaggacggcgagtgggtggacgtgccgcccatgcgccactccatcgtcgtcaacctcggcgaccagctggaggtgatcaccaacggcaggtacaagagcgtgatgcaccgggtggtggcgcagatcgacggcaacaggatgtccatcgcgtccttctacaaccctggcagcgacgccgtcatctccccggcgccggcgctggtgaaggaggaggaggccggcgagacgtatcccaagttcgtgttcgaggactacatgaagctgtacgtgcgccacaagttcgaggccaaggagccccggttcgaggcgttcaaggccatggagaacgagacccccaaccgcattgccatcgcttgatagcgtgtgtaccacagcgacccctaccgggtcggtgtcagtaaggtttagtcgtgttcgtagtgatcagtgcgtgcatggtcagctactcagctcgcgttttctacctgaataaattaagctccgtcgtcgtc

SEQ ID NO: 904 - DNA, 1286 bp, Saccharum officinarum
ctcacttcactccagcgttcagcattagacacgcacaaggaagaaacagtagccggagagagctcctatctagccagtccagtagtcccgcgagctcgtcgagagaaacagagagagagcaacatggcgcctgcattgtcattcccgatcatcgacatggggctgctcggcggggaggagaggccggcggcgatggagctgctgcgcgatgcgtgcgagaactggggcttcttcgagattctgaaccacggcatctcgacggagctgatggacgaggtagagaagctgaccaaggaccactataagcgggtgcgcgagcagaggttcctcgagttcgccagcaagacgctcaaggacgcgcaggacgtcaaggcggcggagaacctggactgggagagcaccttcttcgtccgccacctcccggaatccaacatcgccgagataccggacctcgacgacgactaccggcgcgcgatgaggcggttcgccggcgagctggaggcgctggcggagcggctgctggaccttctgtgcgagaacctgggcctcgacaggggctacctggcgcgggcgttccgcgggccccgcacgggcgccccgacgttcggcaccaaggtgagcagctacccgccgtgcccgcgcccggacctcgtgagcggcctgcgcgcgcacaccgacgccggcggcatcatcctgctgttccaggacgaccgcgtgggcgggctccagctgctcaaggacggcgcgtgggtggacgtgccgcccctgcgccactccatcgtggtcaacctgggcgaccagctggaggtgatcaccaacggcaggtacaagagcgtgatgcaccgggtggtggcgcagcccgacggcaacaggatgtccatcgcgtccttctacaacccgggcagcgacgccgtcatcttccccgcgccggcgctggtgaaggccgaggaggcggccgcgggggcgtaccccaggttcgtgttcgaggactacatgaagctgtacgtgcggcacaagttcgaggccaaggagccacggttcgaggcgttcaagtccgtggagacggacagctccaactgcatagccatcgcgtaaaagttggtccctgcgcctagctctggtttactgtgttcgagatgtatttgcggcgttctgttctgcggcatgatcgtttatgcctgtgtctttagtccctctctgctctccttcgctcgctagttagcctgctagcttgttatatgtgtcgcgcactctgttctgtaatatgtttactattacaaagctat

SEQ ID NO: 905 - DNA, 1704 bp, Zea mays
gccgagcctataaatggcgaccgaccccggccacttccactcaccgcactccagcgttcagcattagacacgagagctcctagtagccagaccagtagtcccgcgaccctgtcgagagaaacagacagagcaacatggcgcctgcattgtcattcccgatcatcgacatggggctgctcgccggggaggagaggccggcggcgatggagctgctgcaagatgcgtgcgagaactggggcttcttcgagattctgaaccacggcatctcgacggagctgatggacgaggtagagaagctgaccaaggagcactacaagcgggtgcgcgagcagaggttcctcgagttcgccagcaagacgctcggggacggccgcgacattgcgcagggcgtgaaggcggagaacctggactgggagagcaccttcttcgtccgccacctcccggagcccaacatcgccgagataccggacctggacgacgagtaccggcgcgtcatgaagcggttcgccggcgagctggaggcgctggcggagcggctgctggacctgctgtgcgagaacctcggcctcgacaggggctacctggcgcgcgcgttccgcgggcccagcaagggcgccccgacgttcggcaccaaggtcagcagctacccgccgtgcccgcgcccggacctcgtcagcggcctgcgcgcgcacaccgacgccggcggcatcatcctgctgttccaggacgaccgggtgggcggcctccagctgctcaaggacggcgagtgggttgacgtgccgcccatgcgccacgccgtcgtcgtcaacctgggcgaccagctggaggtgatcaccaacggcaggtacaagagcgtcatgcaccgggtggtggcgcagcccagcgggaacaggatgtccatcgcgtccttctacaacccgggcagcgacgcggtcatcttcccggcgccggcgctggtcaaggccgaggaggcggcagcgggggcgtaccccagcttcgtcttcgaggactacatgaagctgtacgtgcggcacaagttcgaggccaaggagccacggttcgaggccttcaagtccatggagacggacagctccaatcgcatagccatcgcgtgaaacaccggacctgcgccgagctctggcttactgttcgagatgtacgtgcggcgtactgtactcactaccggaatccgagactttgccgagtgttggcttctttgccgagtgccttttgtcgggcactcggcaaagaaagctttgccgagtgccgtactcggtaacgttaggcactcggcaaaacgtgctttgccgagggctgaacactcggcacagaacggcactcggcaaagacaactttgccgagagtcaaacactcggcaaaggaggctctcggcgagcggccgtcccaaagctgacggccgttagtctttgccgagtgtcatccgttggctctcggcaaagaggttctgtaccgagtgccacatagtaggcactcggcaaagcatactttgccgagtgtcatctctggacactcggcaaagtatatttttatttttttattttgtctctcgaaatttttgtggtatgtttctacactatgtagacctacatgtaccattttgggataattataacagttttttctatagctagtatatttagtttgtttatttgaattttttcggaaaattcagatttgaactgc

SEQ ID NO: 906 - DNA, 1305 bp, Saccharum officinarum
ctcacttcactccagcgttcagcattagacacgcacaaggaagaaacagtagctggatacatctcctagtagccagtccagtggtcccgcgagctcgtcgagagaaaacagagagagagcaacatggcgcctgcattgtcattcccgatcatcgacatggggctgctcggcggggaggagaggccggcggcgatggagcttctgcgcgatgcgtgcgagaactggggcttcttcgagattctgaaccacggcatctcgacggagctgatggacgaggtagagaagctgaccaaggaccactacaagcgggtgcgcgagcagaggttcctcgagttcgccagcaagacgctcaaggacgcgcaggacgtcaaggcggcggagaacctggactgggagagcaccttcttcgtccgccacctcccggagtccaacatcgccgagataccggacctcgacgaggactaccggcgcgcgatgaggcagttcgccggcgagctggaggcgctggcggagcggctgctggacctgctgtgcgagaacctgggcctcgacaggggctacctggcgcgggcgttccgcgggccccgcacgggcgccccgacgttcggcaccaaggtgagcagctacccgccgtgcccgcgcccggacctcgtgagcggcctgcgcgcgcacaccgacgccggcggcatcatcctgctgttccaggacgaccgcgtgggcgggctccagctgctcaaggacggcgcgtgggtggacgtgccgcccctgcgccactccatcgtcgtcaacctgggcgaccagctggaggtgatcaccaacggcaggtacaagagcgtgatgcaccgggtggtggcgcagcccgacggcaacaggatgtccatcgcgtccttctacaacccgggcagcgacgccgtcatcttccccgcgccggcgctggtgaaggccgaggaggcggccgcgggggcgtaccccaggttcgtgttcgaggactacatgaagctgtacgtgcggcacaagttcgaggccaaggagccacggttcgaggcgttcaagtccgtggagacggacagctccaactgcatagccatcgcgtaaaagttggtccctgcgcctagctctggtttactgtgttcgagatgtatttgcggcgttctgttctgcggcatgatcgtttatgcctgtgtctttagtccctctctgctctccttcgctcgctagttagcctgctagcttgttatatgtgtcgcgcactctgttctgtaatatgtttactattacaaagctatattatggggaaaaaaaaaa

SEQ ID NO: 907 - DNA, 1328 bp, Cenchrus ciliaris
  misc_feature (412)..(412): n is a, c, g, or t
  misc_feature (421)..(421): n is a, c, g, or t
  misc_feature (427)..(427): n is a, c, g, or t
  misc_feature (444)..(444): n is a, c, g, or t
  misc_feature (521)..(521): n is a, c, g, or t
  misc_feature (546)..(546): n is a, c, g, or t
  misc_feature (550)..(550): n is a, c, g, or t
  misc_feature (567)..(567): n is a, c, g, or t
  misc_feature (589)..(589): n is a, c, g, or t
  misc_feature (653)..(653): n is a, c, g, or t
  misc_feature (1048)..(1048): n is a, c, g, or t
  misc_feature (1067)..(1067): n is a, c, g, or t
  misc_feature (1114)..(1114): n is a, c, g, or t
  misc_feature (1242)..(1242): n is a, c, g, or t
  misc_feature (1274)..(1274): n is a, c, g, or t
  misc_feature (1313)..(1313): n is a, c, g, or t
aacagttgccggagaaagagctctacctagtcctgcgaggcttggcgagagaaagagagaaagtagcatggcgccggcattgtcgttcccgatcatcgacatgggcctgctcgctggggaggagaggccggcggcgatggagctgctgcgcgacgcgtgtgagaactggggcttctttcagattctgaaccatggcatctcgacggagctgatggacgaggtggagaggctgaccaaggaccactacaagcgggtgcgcgagcagcggttcctcgagttcgcgagcaaggcgctcaaggacgacgacggcggcgacgcgcagcgtgcgaaggcggcggaaaacctggactgggagagcaccttcttcgtccgccacctcccggagtccaacctcgccgacatccccgacctngacgacgcntaccgncgcgcgatgaagcggtncgccggcgagctggaggcgctggcggagcggctgctggacctgctgtgcgagaacctcggcctggagaaggggtacntggcgcgcgccttccgcgggcccancagnggcgccccgaccttcgngaccaaggtgagcagctacccnccgtgcccgcggccggacctggtgaagggcctgcgcgcgcacacggacgccggcggcatcatcntgctgttccaggacgaccgcgtcggcgggctgcagctgctcaaggacggcgagtgggtggacgtgccgcccacgcgccactccatcgtcgtcaacctgggcgaccagctggaggtgatcaccaacggcaggtacaagagcgtggtgcaccgcgtcgtggcgcagaccgacggcaacaggatgtccatcgcctccttctacaacccgggcggcgacgcggtcatcttcccggcgccggcgctggtgagggccgacgaggccgcgggggcggcggcgtacccgaagttcgtgttcgaggactacatgaagctgtacgtgaggcacaagttcgaggccaaggagccaaggttcgaggccttcaagtccatggagaccgagacctccaaccgcatcgcnatcgcataaatttggccantaggagtacgcggccatgcacctagctctggtttactactgttcaanatgttaacacgcatgggcaggtttatacctgaataaagtcacgctatggtcgatagctcttgcactggtgtcgtgctgcagcacgatcatttatgtgcgtgtcgagtgcccctctactggcctgttanctattcatcatgtaatcatgtgtcatgccctntgttctgtaatatgtgtgttacccgaaaaaaatactagngagttaagtatcgca

SEQ ID NO: 908 - DNA, 1589 bp, Panicum virgatum
ccggagctgagcactggacacgtacaaggaagaaacagtagccggagagcgagctcgtagctagtcaagtagtcctgcgaggcttggcaagagaggttaacatggcgccggcattgtcgttcccggtcatcgacatgggtctgctcggtggggaggagaggccggcggcgatggagctgctgcgtgacgcatgcgagaactggggcttcttcgagattttgaaccacggcatctcgaccgagctgatggacgaggtggagaagctgaccaaggaccactacaagagggtgcgcgagcagcggttcctcgagttcgccggcaaggcgctccaggacggcggtgacgacgcgcgcggtgtcaaggcggagaaccttgactgggagagcaccttcttcgtccgccacctcccggagtccaacctcgccgagctccccgacctcgacgacgggtaccgccgcgtgatgaagcggttcgccggcgagctggaggcgctggcggagcggctgctggacctgctgtgccagaacctcggcctggagaagggctacctcgcgcgggccttccgcgggcccagcggcgtccccaccttcggcaccaaggtcagcagctacccgccgtgcccgcgcccggacctcgtgagcggcctgcgcgcgcacacggacgccggcggcatcatcctgctgttccaggacgaccgcgtcgccgggctgcagctgctcaaggacggcgagtgggtggacgtgccgcccatgcgccactccatcgtggtgaacctgggcgaccagctggaggtgatcaccaacggcaggtacaagagcgtgatgcaccgggtggtggcgcagcccgacgggaaccggatgtccatcgcatccttctacaacccgggtggcgacgccgtcatcttcccggcgccggcgctggtgaaggccgaggaggccgcggaggcgtaccccaggttcgtgttcgaggactacatgaagctgtacatgcggcacaagttcgaggccaaggagccacgcttcgaggccttcaggtccgtggagaccgagagctccaaccgcagcatcgccatcgcgtaaaagttgggccccggcctcggctctgcacctagctccggttcactgttcaagatgtaagcatgcatgggcagctttacctgaataaattcacgtagggtcgctagtttgtacttgtgtcgtgctgctactgctgcacgatctatcatttacgtctgtgtcgggcgtcgactgcccccttctctcgatagtagcctgctagctgctagtcatgtgtcgtgcagtccgtgctgtaatatgcttgttaagccaaaagaatcattaccgagtgagtatagcattacatgtttgtcttctccctcccgaaattactagcccatgccaaaatgaacctacttgtacaaaacagtacctagaattctctcgccaatttgaaacatcaaaagtcatgtcatgttacagtgatcttattattaatcagaggctactttcagaggtcccacaataattgtaaggtgaaacatgttacaaaataataagtgaataaaaaatcatagaaaacattggatgttt

SEQ ID NO: 909 - DNA, 1027 bp, Panicum virgatum
  misc_feature (157)..(157): n is a, c, g, or t
agtagccggagagcgagctcctagctagtcaagtagtcctgcgaggccttagtgcttgacaagagagattgacatggcgccggcattgtcgttcccggtcatcaacatgggtctgctcggtggggaggagaggccggcggcgatggagctgctgcangacgcatgcgagaactggggcttcttcgagattctgaaccatggcatttcgacggagctgatggacgaggtggagaagctgaccaaggatcactacaagcgggtgcgcgagcagcggttcctcgagttcgcgagcaaggcgctccaggacggcggtgacgacgacgcgcgcggcgtgaaggcggggaacctggactgggagagcaccttcttcgtccgccacctcccggagtccaacctcgccgagctccccgacctcgacgacgggtaccgtcgcgtgatgaagcggttcgccggcgagctggaggcgctggcggagcggctgctggacctgctgtgcgagaacctcggcctggagaagggctacctcgcgcgggccttccgcgggcccaggggcgcccccaccttcggcaccaaggtcagcagctacccgccgtgcccgcggccggacctcgtgagcggcctgcgcgcgcacaccgacgccggcggcatcatcctgctgttccaggacgaccgcgtcggcgggctgcagctgctcaaggacggcgagtgggtggacgtgccgcccatgcgccactccatcgtggtcaacctgggggaccagcttgaggtgatcaccaacggcaggtacaagagcgtggtgcaccgggtggtggcgcagcccgacgggaacaggatgtccatcgcgtccttctacaacccgggcggcgacgccgtcatcttcccggcgcccggcgctggtgaagaccgaggaggccgcggcggcgtaccccaagttcgtgttcgaggactacatgaagctgtacatgcggcgcaagttcgaggccaaggagccacgcttcgaggccttcaagtccatggagaccgagag

SEQ ID NO: 910 - DNA, 1462 bp, Hordeum vulgare
tactgggcgccaccgccgggccggcgacgagcctctataaatcacgcaccctccccgctgcattttcactcacaccactcaaacacacagcgagcgcttgcagagaagccatagagcagcaacctgggatcagctcaagcactgaccaggcgccgcagcgcgaactcgagggctaggaattaatggcgccggcttcgtcgttcccgatcatcgacatggggctgctggccgggggcggggaggagcggccggcggcgatggacctgctgcatgacgcatgcgagaactggggattcttccaggttctggaccacggcatctcgacggagctgatggacgaggtggagaggatgaccaaggggcactacaagagggtgcgcgagcagaggttcctcgagttcgcgagcaagacgctggaggacggcggcggcagggcggcggagaacctggactgggagagcaccttcttcgtgcgccacctcccggagcccaacatcgccgagatacccgacctcgacgacgagtacaggcgggtgatgaagcggttcgcgtcggagctggagacgctggcggagcggctgctggacctgctctgcgagaacctcggcctcgagaaagggtacctcacgcgggcgttccgtggctccaagggcgtccccaccttcggcaccaaggtcagcagctacccgccgtgcccgcgcccggacctcgtcaagggcctccgcgcccacaccgacgccggcggcatcatcctgctcttccaggacgaccgcgtcggcgggctccagctgctcaaggacggcgagtgggtggacgtgccgcccacgcgccactccatcgtcgtcaacctgggcgaccagctggaggtgatcaccaacggcaggtacaagagcgtgctccaccgcgtggtcgcgcagaccgacggcaaccggatgtccatcgcctccttctacaacccggccagcgacgccgtcatcttcccggcgccggcgctggcggaggcggctggcggggcgtaccccaagttcgtgttcgaggactacatgaagctgtacgtgcgccacaagttcgaggacaaggagcccaggttcgaggccttcaagtccgtggagaggcagagctccaacctcatcgccaccgcctaatagcaacaacgacgtactcccttgctctgctctccgtacgtggcctcggttattggtcgagagacgatgacgcattggatgcttgagagagttcgtacgtctagtactgtctggtgtcgaataaacgggcctgctggctgcgtgctacgtctagctagctaggatatgtacgttagcattttgtcattttcgctgtgttgtgctgcttccgaccagcatgagagctgtgctgtaatgtaatgtaatgtaatgtaccgtgtctgttcttattcctggggcatcgtatcggttgtctcttttaatatttgcgtgttgcc

SEQ ID NO: 911 - DNA, 1470 bp, Hordeum vulgare
tactgggcgccaccgccgggccggcgacgagcctctataaatcacgcaccctccccgctgcattttcactcacaccactcaaacacacagcgagcgcttgcagagaagccatagagcagcaacctgggatcagctcaagcactgaccaggcgccgcagcgcgaactcgagggctaggaattaatggcgccggcttcgtcgttcccgatcatcgacatggggctgctggccgggggcggggaggagcggccggcggcgatggacctgctgcatgacgcatgcgagaactggggattcttccaggttctggaccacggcatctcgacggagctgatggacgaggtggagaggatgaccaaggggcactacaagagggtgcgcgagcagaggttcctcgagttcgcgagcaagacgctggaggacggcggcggcagggcggcggagaacctggactgggagagcaccttcttcgtgcgccacctcccggagcccaacatcgccgagatacccgacctcgacgacgagtacaggcgggtgatgaagcggttcgcgtcggagctggagacgctggcggagcggctgctggacctgctctgcgagaacctcggcctcgagaaagggtacctcacgcgggcgttccgtggctccaagggcgtccccaccttcggcaccaaggtcagcagctacccgccgtgcccgcgcccggacctcgtcaagggcctccgcgcccacaccgacgccggcggcatcatcctgctcttccaggacgaccgcgtcggcgggctccagctgctcaaggacggcgagtgggtggacgtgccgcccacgcgccactccatcgtcgtcaacctgggcgaccagctggaggtgatcaccaacggcaggtacaagagcgtgctccaccgcgtggtcgcgcagaccgacggcaaccggatgtccatcgcctccttctacaacccggccagcgacgccgtcatcttcccggcgccggcgctggcggaggcggctggcggggcgtaccccaagttcgtgttcgaggactacatgaagctgtacgtgcgccacaagttcgaggacaaggagcccaggttcgaggccttcaagtccgtggagaggcagagctccaacctcatcgccaccgcctaatagcaacaacgacgtactcccttgctctgctctccgtacgtggcctcggttattggtcgagagacgatgacgcattggatgcttgagagagttcgtacgtctagtactgtctggtgtcgaataaacgggcctgctggctgcgtgctacgtctagctagctaggatatgtacgttagcattttgtcattttcgctgtgttgtgctgcttccgaccagcatgagagctgtgctgtaatgtaatgtaatgtaatgtaccgtgtctgttcttattcctggggcatcgtatcggttgtctcttttaatatttgcgtgttgcctcctggcg

SEQ ID NO: 912 - DNA, 1407 bp, Brachypodium distachyon
actcacaagtcacaagcacttgcagagagcagcagtagcgagacagtagcggcgatttggttgggttggtactgtgtagagtgccgagagctagaaatggcaccggcttcgtcgttcccgatcatcgacatggggctgctgggcggggaggagaggcccgcggccatggagctgctgcacgacgcatgcgagaactggggattcttccaggttctggaccacggcatctcgacggagctgctggacgaggtggagaagatgaccaaggcgcactacaagagggtgcgcgagcagaggttcctggagttcgcgagcaagacgctggagggcggcaaggctgacacggagaacctggactgggagagcaccttcttcgtgcgccacctccctgagcccaacatcggcgacataccggacctcgacgacgactacaggcgtgtgatgaagcagttcgcggcggagctggagaagctggcggagcggctcctggacctgctctgcgagaacctcggcctggagaaaggctacctcacgcgcgccttccgcgccggctccaaggccggcgtcccgaccttcggcaccaaggtcagcagctacccgccgtgccctcgcccggacctcgtcaagggcctccgcgcccacaccgacgccggcggcatcatcctgctcttccaggacgaccaagtcggcggcctccagctgctcaaggacggcgcctgggtcgacgtgccgcccacgcgccactccatcgtcgtcaacctcggcgaccagctggaggtcatcaccagtgggaggtacaagagcgtgctccaccgcgtggtcgcgcagaccgacggcaaccgcatgtccatcgcgtccttctacaacccggccagcgacgccgtcatcttcccggcgccggcgctggtgaagaaggaagccggcgccgggacgtaccccaagttcgtgttcgaggactacatgaagctgtacgtgcgccacaagttcgaggacaaggagcccaggttcgaggccttcatgtccatggagaccgacacctccaagctcatcgccaccgcttgatttaccttgctctgctccgcggccgccggccgggcttcagttttaatgtcgccgacgacgatactctacataggatgcttcaaagttcgtacgggctgctagactactggtgactggtttgtatgtactgtcgaataaacaggctaggagctagcttggacatgtattgtcattcacgctgtgtcgtgctttgtgtgctaagcctagctaggacatgtatttgtcattttcgctgtgttgtgctgcttccgaccagcatgagagttgtactgtgctgtatctgttcttattcccatactcgttgtctccttgtgtagtataagtgccttttcagtgtgctggttg

SEQ ID NO: 913 - DNA, 1347 bp, Triticum aestivum
  misc_feature (800)..(800): n is a, c, g, or t
  misc_feature (821)..(821): n is a, c, g, or t
  misc_feature (835)..(835): n is a, c, g, or t
  misc_feature (847)..(847): n is a, c, g, or t
  misc_feature (866)..(866): n is a, c, g, or t
  misc_feature (877)..(877): n is a, c, g, or t
tacagcatcaggcaagctctgaagctcggtgcaagaagaaacatccggagacgcagcttgtctcgagggtgacgtgacgaatcaagagggtaagatggcatcgacattgtcattcccgatcatcgacatgggtctgctccgcggggaggagcggccggcggcgatgaaccttctgcacgatgcatgccagaactggggcttcttccaggttctggaccacggcatctcgacggagctgatggacgaggtggagaagatgaccaaggagcactacaagagggtgcgcgagcagaggttcctcgagttcgccagcaagacgctgcaggacggcgacaaggcggcggagaacctggactgggagagcaccttcttcgtgcgccacctcccggagcccaacatcgccgagatacccgacctcgacgacgagtaccggcgggtgatgaagcagttcgcggcggagctggagaggctggcggagcggctgctggacctgctctgcgagaacctcggcctcgagaaagggtacctcacgcgggcgttccggggctccaagggcgtccccaccttcggcaccaaggtcagcagctacccgccgtgcccgcgccccgacctcgtcaagggcctccgcgcccacaccgacgccggcggcatcatcctgctcttccaggacgaccgcgtcggcgggctccagctgctcagggacggcgagtgggtggacgtgccgcccacgcgccactccatcgtcgtcaacctgggcgaccagctggaggtgatcaccaacggcaggtacaagagcgtgntccaccgcgtggtcgcgcagnccgacggcaaccgnatgtccatcgcntccttctacaacccggctngcgacgcggtnatcttcccggcgccggcgctggtggaggcggaggcggcgggcggggcgtaccccaggttcgtgttcgaggactacatgaagctgtacgtgcgccacaagttcgaggacaaggagcccaggttcgaggccttcaagtccatggacagccacagctccaacctcatcgccaccgcttagaaccaacaactacgtgctacgcccttgctctgctctccgaacgtggcctcggtcaatggttgaggacgatggcacataggatgctccagagtttgtacgtacgtacgtactaaaccactggctgctgtttggtgccgaataaacgagcctgctggcttgtgtgctacgcctagctaggaggatatgtaggaggagtgtttgtcattttcgctgtgttgtgctgcttccgaccagcatgagagctgtactgttctgtgtctgttcttattcccacgggcatcgtatcgattgtc

SEQ ID NO: 914 - DNA, 1469 bp, Leymus cinereus x Leymus triticoides
  misc_feature (24)..(24): n is a, c, g, or t
  misc_feature (1337)..(1337): n is a, c, g, or t
ccgttgctgtcgccgttgctgtcnagcgcttgcagagaagccatagagcaccaggcgccacagtgcaagcacgttggtggctggtcggcagagagtttgagagctagaaaatggcgccggcttcgtcgttcccgatcatcgatatggggctgctgggcggggaggagaggcccgcggcgatgcacctgctgcacgacgcatgcgagaactggggattcttccaggttctagaacacggcatctcgacggagctgatggaggaagtggagaagatgaccaaggggcactacaagagagtgcgcgagcagaggttcctcgagttcgcgagcaagacgctggagagcggcggcaaggcggtggactgggagagcaccttcttcgtgcgccacctcccggagcccaacatcgctgatatacccgacctcgacgacgagtacaggcgggtgatgaagcagttcgccacggagctggagaagctggcggagcggctgttggacctgctctgcgagaacctcggcctggagaaagaatacctcacgcgggcgttccgtggctccaagggcgtcccgaccttcggcaccaaggtcagcagctacccgccgtgcccgtgcccagacctcgtcaagggcctccgcgcccacaccgacgccggcggtatcatcctgctcttccaggacgaccgcgtcggcggcctccagctgctcaaggacggcgagtgggtggacgtgccgcccacgcgccactccatcgtcgtcaacctcggcgaccagctggaggtgatcaccgacggcaggtacaagagcgtgcttcaccgcgtggtcgcgcagaccgacggcaaccggatgtccatcgcctccttctacaacccggccagcgacgcggtcatcttcccggcgccggccctggtggaggcggccggcgggacgtaccccaagttcgtgttcgaggactacatgaagctgtacgtgcgccacaagttcgaggacaaggagcccaggttcgaggccttcaagtccatggagagccagagctccaactccaagctcatcgccatcgcttaacaactacgtaccttgctctgctctccgtacgtggcttcagtgaatggtctaggacgatgacgcataggatgcttcagagtccgtacgtactagactactggctactgtttggtgttgaataaacgagcctgctgtgttctacgcctagctaggatatgtagtagtactagcggcggcgttcgagcacccgtgtggttgaagttgctcgtttgtatgtctcggttttgttgtaaaatatagtgctgtcatgggctttataagtgaccctatttgccnatttggtactgccgccgcgcatcagttgaggctttacgtggggtgttgtgtaattgagtcgggctcacttctgtacgtacgtagctgctgtttggtattgttgttttggtatcgttgttttagcaagctgta

SEQ ID NO: 915 - DNA, 1331 bp, Panicum virgatum
agcattgcagtcttgcgaggaagcatatgaatacacatacatagtcgttgttacttctcggggaagatcggagttgtttcgagagctggaaatggcaccggctttgtctttcccgatcatcgacatggggcggctcgccggggaggagaggccggcggccatggacatgctgcgcgatgcgtgtgagaagtggggcttctttcagattctgaaccatggaatctcgacggagttgatggacgaggtggagcggctgaccaaggaccactacaagcgggtgcgcgagcagcggttcctcgagttcgcgagcagggcgcttcaggatggcggcggcggcggcgcgcgcggcgtcaaggcggagaacctggactgggagagcaccttcttcgtgcgccacctcccggagtccaacctcgccgagctccccgacctcgacgacgggtaccggcgcgcgatgaggcggttcgccggcgagctggaggcgctggcggagcggctgctggacctgctgtgcgagaatctcgggttggagaagggctacctcgcgcgcgccttccgcgggcccagcaaagggctccccgaccttcgccaccaaggtcagcagctacccgccgtgcccgcgcccggacctcgtgagcggcctgcgcgcgcacaccgacgccggcggcatcatcctgctgttccaggacgaccgcgtcgccgggctgcagctgctcaaggacggcgcgtgggtggacgtgccgcccacgcgccactccatcgtggtgaacctgggcgaccagctggaggtgatcacaaacggcaggtacaagagcgtggtgcaccgggtggtggcgcagcccgacgggaaccggatgtccatcgcgtccttctacaaccccggcggcgacgccgtcatcttcccggcgccggcgctggtgaaggccgaggaggccgcggcggcgtaccccaggttcgtgttcgaggactacatgaagctgtacgtgcggagcaagttcgaggccaaggagccgcggttcgaggccttcaagtccatggagacggagagctccaactgcatcatcgccatcgcgtaactacccggcagggtatgccggagtcgggagtcctatacgtgtcactagcgtaacaatgtgttcggcatcctcgctgtgtcgtttgttcgctgttgctctgctctcgaccagcatgtgttgtagttgtgcccgtaaaagcccgttttagcgagcccccttgtgcggtttctgcctgtgttctcaagttgcaggacagaaatttatcttattttgtcttttcgaagatattagaaaaatgccacgctcgttggtgcc

SEQ ID NO: 916 - DNA, 1824 bp, Triticum aestivum
  misc_feature (426)..(426): n is a, c, g, or t
  misc_feature (450)..(450): n is a, c, g, or t
  misc_feature (522)..(522): n is a, c, g, or t
  misc_feature (525)..(525): n is a, c, g, or t
  misc_feature (540)..(540): n is a, c, g, or t
  misc_feature (558)..(558): n is a, c, g, or t
  misc_feature (563)..(563): n is a, c, g, or t
caaacgcacagcaagcgcttgcagagaagccatagagctgcccgagatcggttccagcaccaggcgccgcaggccgcagaacaagttcgagagctagaaatggcgccggcttcgtcgttcccgatcatcgacatggggctgctggccggggaggagcgacccgcggccatggacctgctgcatgacgcatgcgagaactggggattcttccaggtcctggaccacggcatctcgacggagctgatggacgaggtggagaagatgaccaaggggcactacaagagggtgcgcgagcagaggttcctcgagttcgctagcaagacgctgcaggacggcggcagggcggcggagaacctggactgggagagcaccttcttcgtgcgccacctcccggagcccaacatcgccgagatacctgacctcgangacgactaccggcgggtgatgaancagttcgcgtcggagctggagaggctggcggagcggctgctggacctgctctgcgagaacctcggcctcganaangggtacctcacgcgngcgttccggggctccaanggcgnccccaccttcggcaccaaggtcagcagctaccctccctgcccgcgccccgacctcgtgaagggcctccgcgcccacaccgacgccggcggcatcatcctgctcttccaggacgaccgcgtcggcgggctccagctgctcagggacggcgagtgggtggacgtgccgcccacgcgccactccatcgtcgtcaacctgggcgaccagctggaggtgatcaccaacggccggtacaagagcgtgctccaccgcgtggtcgcgcaggccgacggcaaccggatgtccatcgcctccttctacaacccggccagcgacgcggtgatcttcccggcgccggcgctggcggaggcggaggcggccggcggggcgtaccccaggttcgtgttcgaggactacatgaagctgtacgtgcgccacaagttcgaggacaaggagcccaggttcgaggccttcaagtccatggagagccagagcaccaagctcatcgccaccgcttagaagcaacccttgctctgctctccgtacgtggcctcggttaatggttgaggacgatggcacataggatgctccagagttcgtacgtacgtacgtgctagaccactggctactgtttggtgccgaataaacgagcctgtgctggcttgtgtgctacgcctagctaggatctgtagtaagtaggagtgtttgtcattttcgctgtgttgtgctgcttccgaccagcatgagagctgtattgttctgtgtctgttcttattcccaggggcatcgtatcggttgtctcttttaatatgtactacgtgctgcctccttgtgtgagagtactaccgcttccaaaaaaaaaaattaattaatcatattctccatttcctcctctctatccttcttcctctcctactcctcttccttccctctcctcctctccatcaattttctttcttcttctcttcttctcgggggcgggccgtttataaaaatctccctcggggggcccaaattttaatcggcccctgtttttttttaacaaaaggtggtccctcttttggggggcgctttttaatggttggcccgcggccgttgtttcttaccctcgcgtctgtggagaaatccccttcctgcggcattctttggccatagcacctttctttggggggggtacctatgtcagaaaactcccctcccgaactttatactgtccctgagaactataatattcttcgggcgtaagagagccaccccgcgacggcctccctcccccggctcgaa

SEQ ID NO: 917 - DNA, 1380 bp, Triticum aestivum
acactgactactcaaacacgcagcaagcgcttgcagagaagccataaagcaacctgagatcagttccaggcttccagcaccaggcgccgcagcacaagttcgagagctagaaatggcgccggcttcgtccttcccgatcatcgacatggggctgctggccggggaggagaggcccgtggcgatggacctgctgcatgacgcatgcgtgaactggggattcttccaggttctggaccacggcatctcaacggagctgatggacgaggtggagaagatgaccaaggagcactacaagagggtgcgcgagcagaggttcctcgagttcgccagcaagacgctggagggcggcggcagggcggcggagaacctggactgggagagcaccttcttcgtgcgccacctcccggaggccaacatcgccgagatacccgacctcgacgacgactacaggcgggtgatgaagcagttcgcggcggagctggagaggctggcggagcggctgctggacctgctctgcgagaacctcggcctggagaaggggtacctcacgcgggcgttccggggctccaagggcgtccccaccttcggcaccaaggtcagcagctacccgccgtgcccgcgcccggacctcgtcaagggcctccgcgcgcacaccgacgccggcggcatcatcctgctcttccaggacgactgcgtcggcgggctccagctcctcaaggacggcgagtgggtggacgtgccgcccacgcgccactccatcgtcgtcaacctgggcgaccagctggaggtgatcaccaacggcaggtacaagagcgtgctccaccgcgtggtcgcgcaggccgacggcaaccggatgtccatcgcctccttctacaacccggccagcgacgcggtcatcttcccggcgccggcgctggcggaggcggccggcggtgcgtaccccaggttcgtgttcgaggactacatgaagctgtacgtgcgccacaagttcgatgacaaggagcccaggttcgaggccttcaagtccatggagagccagagcaccaagctcatcgccaccgcttgacaacaacaaccacggtactccgttgctctgctctccgtacgtggcctcggttatggtcgaggacgatagcacataggatgcttgagagttcgtacgtctagtactgtttggtgccgaataaacgagcctgctggctgtgtgctacgcctagctaggatatgtagtaggagtgtttgtcattttcgctgtgttgtgctgcttccgaccagcatgagagctgtactgttctgtgcctgttcttattcccaggggcatcgtatcgattgtctcttttaatatttacgtgctgcctccttgtgtgagagtacacagct

SEQ ID NO: 918 - DNA, 1065 bp, Brachypodium distachyon
caagcacttgcagagagcagcagtagcgagacagtagcggcgatttggttgggttggtactgtgtagagtgccgagagctagaaatggcaccggcttcgtcgttcccgatcatcgacatggggctgctgggcggggaggagaggcccgcggccatggagctgctgcacgacgcatgcgagaactggggattcttccaggttctggaccacggcatctcgacggagctgctggacgaggtggagaagatgaccaaggcgcactacaagagggtgcgcgagcagaggttcctggagttcgcgagcaagacgctggagggcggcaaggctgacacggagaacctggactgggagagcaccttcttcgtgcgccacctccctgagcccaacatcggcgacataccggacctcgacgacgactacaggcgtgtgatgaagcagttcgcggcgagctggagaagctggcggagcgctcctggacctgctctgcgagaacctcggcctggagaaaggctacctcacgcgcgccttcgcgccgggctccaaggccggcgtcccgaccttcggcaccaaggtcagcagctacccgccgtgccctcgcccggacctcgtcaagggcctccgcgcccacaccgacgccggcggcatcatcctgctcttccaggacgaccaagtcggcggcctccagctgctcaaggacggcgcctgggtcgacgtgccgcccacgcgccactccatcgtcgtcaacctcggcgaccagctggaggtcatcaccagtgggaggtacaagagcgtgctccaccgcgtggtcgcgcagaccgacggcaaccgcatgtccatcgcgtccttctacaacccggccagcgacgccgtcatcttcccggcgccggcgctggtgaagaaggaagccggcgccgggacgtaccccaagttcgtgttcgaggactacatgaagctgtacgtgcgccacaagttcgaggacaaggagcccaggttcgaggccttcatgtccatggagaccgacacctccaagctcatcgccaccgcttgatttaccttgctctgctc

SEQ ID NO: 919 - DNA, 1318 bp, Sorghum bicolor
actcacacttcactccagcgtccagcgttcagcattagacacgcacaccataagcaagaaacagcgagcgagtagcatggcgcctgcattgtcattcccgatcatcgacatggggctgctcgccggggaggagaggccggcggcgatggagctgctgcgcgatgcgtgcgagaactggggcttcttcgagattctgaaccacggcatctcgacggagctgatggacgaggtggagaagctgaccaaggaccactacaagcgggtgcgcgagcagaggttcctcgacttcgccagcaagacgctcgcggacgccaaggcggcggagaacctggactgggagagcaccttcttcgtccgccacctcccggaatccaacctcgccgagataccggacctcgacgacggctaccggcgcgtgatgaggcggttcgccggcgagctggaggcgctggcggagcggctgctggacctcctctgcgagaacctcggcctcgaggggggctacctcgcgcgggcgttccgcgggcgcagcacgggcgccccgacgttcggcaccaaggtgagcagctacccgccgtgcccgcgcccggacctcgtgagcggcctgcgcgcgcacaccgacgccggcggcatcatcctgctgttccaggacgaccgcgtcggcgggctccagctgctcaagggcggcgagtgggtggacgtgccgccgctgcgccacgccatcgtcgtcaacctgggagaccagctggaggtggtcaccaacggcgcgtacaagagcgtgatgcaccgggtggtggcgcagcccgacggcaacaggatgtccatcgcctccttctacaacccgggcagcgacgccgtcatctttcccgcgccggcgctggtgaacaaggcccaggaccaggaggccgccgcggggaatggggatggggtcggggtgtaccccaggttcgtgttcgaggactacatgaagctgtacgtgcggcacaagttcgaggccaaggagccacggttcgaggccttcaggtccatggagacggacagctccaactgcatagccatcgcgtaaaaagtaccttgctctggtttactgttcgagatgtatctgctgcatgatcatctatgtatgcctggtctggtccctctctgctcttcttcgctcgctagtcagcctgctagctagttatatgtgtcgcgcactctgttctgtaatatgtcttactttacaaaactgttcgtgttctcctttcgaaattatgaactcatgccaaaatggacccatctatgcaaaaacagtacctagctagaattctcgtttcac

SEQ ID NO: 920 - DNA, 1209 bp, Sorghum bicolor
ccagcgttcagcattagacacgcacaccataagcaagaaacagcgagcgagtagcatggcgcctgcattgtcattcccgatcatcgacatggggctgctcgccggggaggagaggccggcggcgatggagctgctgcgcgatgcgtgcgagaactggggcttcttcgagattctgaaccacggcatctcgacggagctgatggacgaggtggagaagctgaccaaggaccactacaagcgggtgcgcgagcagaggttcctcgacttcgccagcaagacgctcgcggacgccaaggcggcggagaacctggactgggagagcaccttcttcgtccgccacctcccggaatccaacctcgccgagataccggacctcgacgacggctaccggcgcgtgatgaggcggttcgccggcgagctggaggcgctggcggagcggctgctggacctcctctgcgagaacctcggcctcgaggggggctacctcgcgcgggcgttccgcgggcgcagcacgggcgccccgacgttcggcaccaaggtgagcagctacccgccgtgcccgcgcccggacctcgtgagcggcctgcgcgcgcacaccgacgccggcggcatcatcctgctgttccaggacgaccgcgtcggcgggctccagctgctcaagggcggcgagtgggtggacgtgccgccgctgcgccacgccatcgtcgtcaacctgggagaccagctggaggtggtcaccaacggcgcgtacaagagcgtgatgcaccgggtggtggcgcagcccgacggcaacaggatgtccatcgcctccttctacaacccgggcagcgacgccgtcatctttcccgcgccggcgctggtgaacaaggcccaggaccaggaggccgccgcggggaatggggatggggtcggggtgtaccccaggttcgtgttcgaggactacatgaagctgtacgtgcggcacaagttcgaggccaaggagccacggttcgaggccttcaggtccatggagacggacagctccaactgcatagccatcgcgtaaaaagtaccttgctctggtttactgttcgagatgtatctgctgcatgatcatctatgtatgcctggtctggtccctctctgctcttcttcgctcgctagtcagcctgctagctagttatatgtgtcgcgcactctgttctgtaatatgtcttactttacaaaact

SEQ ID NO: 921 - DNA, 1401 bp, Sorghum bicolor
tccccaccaccgccacctcgtcacagccgcttcaacacaccacaccgcacgcgaaccgcaccggccgccgcgcgctacgaccaccaccagtccacggccatggccgccgcgcgctacgacgtggagaagggcgggaggaacggggaggggaagcagcgctactcgccgcaggcggagcacctgtacccgccgcagcgggatggggagagggagtgggtgccgtggttcgtgccgctcgtcgcggccgtcaacatcgtgctgttcgccgtggcgatgtacgtcaacaactgccccgcccacgcctctcgccgcggcggcggcggcgccggcgcctgcgtcgcccgcgggttcctccaccgcttctccttccagccgctcagcgagaacccgctcctcggcccctcgtcggccacgctgcagaagctgggggcacttgtatgggacaaagtcgtgcaggagcaccagggatggaggctcgtcacctgcatctggctgcacgccggtgttgcccaccttctagccaacatggtcagcctcgtgctcatcggactcaggctcgagcaacagtttggatacgtgagaattggcatcatctaccttgtttctggcgtcggaggcagcgtgctgtcatcgctcttcgtcaggaacaccatctccgtcggcgcttctggagctctgttcggactccttggcgccatgctgtcggagctcttcaccaactggaccatttactcaaacaaggccgcagccctggtaacgctgctgatcgtcatcgccatcaacctcgccatcggcatcctcccgcacgtcgacaacttcgcgcacatcggagggttcctcaccggcttcctcctggggttcgtcttcctgatgcgcccgcactacgggtggatgcagcgctacgtcctgccctccgacgtcaagtacaccagcaagaagtacctggcctatcagtgggctctgctggccgtggcttcggtcctcgctgtcgtcgggttcgccgttgggctggggatgcttttcagaggagtgaacgcgaatgatcactgtgggtggtgccactacctcagctgcgttccgacctcgagatggagctgtgggaagtgaagattggcgtgcggacacaacggactgaagccaggagaggagagagcccatggcccatgggtccttttcgggcaagcatttccatgaatagaaagatagctatacagctcggacagtcttactgtacataatgccatgactcccggggttcacatatgacatattaattattatgttttatttgattggtcgatgattcattctatttattcagtgagttaaaattgaaatgccttcaatctttcacctgtctgtcagctatatatttgcaaactagcttgcagttgtattgtt

SEQ ID NO: 922 - DNA, 1604 bp, Zea mays
cgccaagtgcggccgtttatatacttgcacgcctcccctcccctccagcctccccttgcacgacgtctccaccactacaccacacctcaagtccacaacaccaccagcctcgtctcagccgcttcagcataccacaccgcacgcaaacccaccgcgcgctacgaccaccaccgtcaccatggccgccgcgcgctacgacgtggagaagggcgggaggaataacggggatgggaagccttcgccgccgccgccgggccacctgtacccgcagcgcgacggggagagggagtgggtgccgtggttggtgccgctcgtcgtggccgtcaacatcgtgctcttcgccgtggcgatgtacgtcaacaactgcccggcccacgccgcctcgtctcgccgcggcggcgccggatcatgcgtcgcccgcgggttcctccaccgcttctcgttccagccgctcagcgagaacccgctcctcgggccctcgtcggccacgctgcagaagctgggagcgcttgtatgggacaaagttgtgcgggagcaccaggggtggaggctcgtcacctgcatctggctgcacgccggtgttgcccacctcctggccaacatgatcagcctcgtgctcatcgggctcagactggagcaacagtttggatacgtgagagttggcatcatctaccttgtctctggcgtcggaggcagcgtgctttcgtctctgttcatcaggaacaacatctctgtcggcgcttccggagctctgttcgggctccttggggccatgctgtcggagctcttcaccaactggaccatctatgcaaacaaggctgcagccctggtgaccctgctggtcgtcatcgccatcaacctcgccatcggcatcctcccgcacgtcgacaacttcgcgcacatcggagggttcctcaccggcttcctcctcgggttcgtcttactgatgcgcccgcactacggctggatgcagcgctacgccctgccctccgacgtcaagtacaccaccaagaagtacctggcctaccagtgggctctgctggccgtggcctcggtcctcgctgtcatcgggttcgccgtagggctggggatgcttttcagaggagtgaacgcgaatgatcactgcggctggtgccactacctcagctgtgttccgacctccagatggagctgtgggaagtgaagatcggcgtgctgacaaaatggacttgaagccaggatagagcccatggccgcccatgggaccttttcgagcaagcatttccatgaatagatagatatacagctcgcagtcttactgtacataatgtcaccaggatgtggtttatatatgacattatttatgctatctgattgatcgatggttcattctatttattcagcgagtgaaaattgaaatgccttcaatctttcgcttgccagctatatttgaaaactagatgcagttgtgttgttatcaactcccccgttctttttttatcgtcatttagttaaaaaataaactagtgagccacaaagaaggtagacctgtcaaccacaatcggccttccatgattactgtggttatttcataatataagttatgtgatgctggttttcatctc

SEQ ID NO: 923 - DNA, 1187 bp, Panicum virgatum
  misc_feature (176)..(176): n is a, c, g, or t
  misc_feature (298)..(298): n is a, c, g, or t
  misc_feature (578)..(578): n is a, c, g, or t
  misc_feature (588)..(588): n is a, c, g, or t
  misc_feature (760)..(760): n is a, c, g, or t
  misc_feature (969)..(969): n is a, c, g, or t
  misc_feature (1119)..(1119): n is a, c, g, or t
accacctccaccaccacgtcgcagccgtttctctgcagcaagccagcaacccaccgctaacccccgccgcttctctccagcaacccaccgcatcccggcccgcgcggcagcagcagcagccagcgtcgccccccgcgttacgaccgccatggccgccgcgcgctacgacgtggagnagggcgggaggggcggggaggggaagtacccgccgccgccggagcagatgtacccgcagcgggagggggagagggagtgggtgccctggttcgtgccggtcgtcgtggccgccaacatcgcnctcttcgccgtcgtcatgtacgtcaacaactgccccgcccacgccgcctcgactcgcggcggcggcgcctgcgtcgcgcgcgggttcctccaccgcttcgccttccagccgctcagcgagaacccgctcctcggcccatcgtcggcggcgctgcagaagctgggagcacttgtgtgggacaaagttgtgcacgagcaccagggttggaggctcctgacgtgcatctggctgcacgccggcgttgtccacctgctagccaatatgctcagcctcgtgctcntcggactcanactcgagcaacaatttggatatctgagaatcggtgtcatctacattgtttctggcgttggaggcagcgtgctttcatctctgttcatcaggaacaacatctctgttggcgcttctggagccctctttggactccttggagccatgctgtcggagctcttcaccaactggacnatctactcaaacaaggctgcagccctggtgaccctcttggtcgttatcgccatcaacctcgccatcggcatcctcccgcacgtcgacaactttgcgcacatcggaggattcctcactggtttcctcctgggattcatcttcctgatgcgcccgcattacggttggatgcagcgctatgtccggccctcggacatcaagtacaccaccangaagtacctgccctatcaatgggttctgttggccgtagcttcggtcctcgctgtcctcggattcgccgttgggatggggatgcttttcaagggagtgaacgcgaacgaccactgccagtggtgccactacctcagctgcgtcccgacatntagatggagctgtgggaagtgaagactagtgctcgagacaccttggactgaaaccaggagatggcgcc

SEQ ID NO: 924 - DNA, 1952 bp, Zea mays
tccctcgtccccaacccacgcactgcccaccggtctctctcacacaacacagggatataagcccagtccacgagatctcccgtagaccagtggcgagggaaggaacgaaacagagcccgatcctagcgacaggccagggaagatcgccatgatgatgatgggcgaaggcgtgagcgtgccgccgtggtcccaccacgtccccgtgagcggcgtcgacgtcggcgtcggcggcgacgagatgacgccgtacctgctggcggcgctgcggcagtacctgccgtgcaacgacgccggcgccgccgaggcggacgacgaggaggcggcggccatggccgcgggcgtggacggctacggctgcgacgagttccgcatgtacgagttcaaggtccggcggtgcgcccgcgcgcgcagccacgactggaccgagtgccccttcgcgcacccgggggagaaggcgcggcggcgcgacccgcgcaggtaccactactcgggcgccgcctgcccggacttccgcaagggcgggtgcaggcgcggcgacgcctgcgacttcgcgcacggcgtcttcgagtgctggctccacccggcgcgctaccgcacccagccctgcaaggacggcacggcctgccgccgccgcgtctgcttcttcgcgcacaccccggaccagctgcgggtgctcccgcccacgccgcagcagtctagcgccagccccaggggcgccggcgcgctgcccgagtcctacgacggctccccgctgcgtcgccaggcgttcgagacctacctcaccaagagcatcgtgtcctcgtcgccgaccagcacgctcctgtcgccgcccaagacgcccccgtccgagtcgccgccgctgtcgccggacggggccgccgccgccttccgccgcgggtcctggcccggcgccgggtcccccgtcaacgacgtcctggcctcgctccgccagctccgcctcggcacggccagctcgtccccgtccggcgggtggggcggctacccggcgtccgcggctgcctacgggtcgcccacagcgggcgggctctacagcctgccctccaccccgacagccctcgccaccgcctccggctacatgcccaacctggagccgcttgacgtcagcttcggcggcgacgaggagcccgtggagagggtggagtccgggcgggccctccgcgccaaggtgttcgagcggctcagcagggagggcgctgtttcctgctacccagctgccggaaccggtggccccgacgtcgggtgggtctccgacctcatcaactgaggcggcttcggcggcgggtcggtgctgcatagcagtggagaaaaggtggtggtaactggtaagccgtaacagagaaggatggcataaaaaaatgttcccctttggttccagataattccgctaattaccctgtacatagatatctatcgccctgtgaatattctcggctggttgggtggagggctgatgctagggggtggatttgttttggggttcttgaggtagcggaaaatttccaaggaaaagaaaatatgtaagcaagtgtagatgtcgtaggcggcggcggcggcggcggtttgtgccctcttgtgtgctgcgaagcatggcgagggccgacggtgacgacgaagactggccggatttccagctttggtgttcctgtgattccgcagcaagttcagtttgatgttgtttcaagttgttccgtcgtctgtgcactatgcatccggctagttggcgattgcaacctgcttgtggattactacccccattttgttgttgatgttgatgtaatctgtttattaagacccagcattcccctacagcttattttgttgtacttactatatatctttagtaggtgccgagatctaagttcacccgctattggaggtgaacttgccgtgtaatatttggatcaagtaaatggtttaatgtccgtcgccca

SEQ ID NO: 925 - DNA, 1905 bp, Zea mays
gtccccagcccgcgcactgcccccggtctctctctctcaacacaccgataagcccagtccaccggatctcccgtagtccagagactgagttgaaggaaggaagccatgatgatgatgggcgaaggcgtgagcatgccgccgtggtcccaccacgtccctgtgagcggcgtcgacgaaggcgacgagatgacgccgtacctgctcgcggcgctgcgccagtacctgccgtgcaacgacgccggcgccgaggccgaggaggatgaggcggcggcgcgccgccgccatggcggcgggcgtggacggctacggctgcgacgagttccgcatgtacgagttcaaggtccggcggtgcgcgcgcgcgcgcagccacgactggaccgagtgccccttcgcgcacccgggggagaaggcgcggcgccgcgacccgcgcaagtaccactactccggcgccgcctgcccggacttccgcaagggcgggtgcaagcgcggcgacggctgcgacatggcgcacggcgtcttcgagtgctggctccacccggcgcgctaccgcacccagccctgcaaggacggcacggcctgccgccgccgggtctgcttcttcgcgcacaccgcggaccagctgcgcgtgctcccgcccacgcctcagcagcagtccagccccaggggcgccgcctgctcttccccgctcgccgagtcctacgacggctccccgctccggcgccaggcgttcgagagctacctcaccaagagcatcatgtgctcgtcgccgaccagcaccctcctgtcgccgcccaagtcgcccccgtcggagtccccgccattgtcgcccgacttccgccgtgggtgctggccgggcgccgggtcccccgtcaacgacgtgctcgcctcgctccgccagctccgcctcagcagggccaactcgtccccgtcgggcggctggtgcggctaccctgcatccgcggtcgcgtacggatcgcctacggggggcgcgctctacggcctgtcctccaccccgagggccaccgccgcatcctgctacatggccaacctggaccctctcgacgtcagcttcggcggcgacgacgagcccgtggagagggtggagtccggccgcgccctccgcgcgaaggtgttcgagcggcttagcagggagggcgctgtttccggcgacgccggtggccccgacgtcggttgggtctccgacctcatcaactgagcgcggcggcggcagtggcaataacaatgggcacggagaaaggtgatggtgagccgtaacggagaaggatggtacggagtatccaaaaaaaaaatatttccctatatttaatttcgttcctcagttaattccgataatccccgtgtacatatctatcaccctgtgaatattctcagttggtaagagggaggatgctaggtggtggaagtggaaggaggggtggatttgttttggggttcttgagggtagtagaaaatatccaagaaaaatagaaaaaaaaagtgtacagcagatgcagtagcgcggtggcggtggttgtgtccctcttctgtgcatagggttagggtgttggtggcgaagcatggcgggggctgatgtgacgacgaaggcggccggatttccaccacggcttggtatttctgtgattccggaacatggtagtttgatgttgttttttttaagttagtggactagttggcgattgcaacctgcttgtgaattactctcccattttgttttgtaatctgttaagacatcagcattccctacagcatattttgtgtacctacgtcttagtagttgccgaaatctcaatcaaaatcacccgctattggaggtgaatttcccatgtaatcttctgctcatgtaaatggttttctttttaatgaatcgatgtttatcgccctaat

SEQ ID NO: 926 - DNA, 1914 bp, Cenchrus ciliaris
  misc_feature (636)..(636): n is a, c, g, or t
  misc_feature (903)..(903): n is a, c, g, or t
  misc_feature (1020)..(1020): n is a, c, g, or t
  misc_feature (1105)..(1105): n is a, c, g, or t
  misc_feature (1776)..(1776): n is a, c, g, or t
  misc_feature (1778)..(1778): n is a, c, g, or t
  misc_feature (1783)..(1785): n is a, c, g, or t
  misc_feature (1839)..(1839): n is a, c, g, or t
cactgtcctcgtctcccccctcccctccctcctcccgcggagataagcccagtccacgagatctctccatagaccacaaacacacaccctggtggagggaaagaagcagagcaccgatcctttgcgagagcagcagcagcagccatgatgatgatgggcgaaggcgtgagcgtcccgccgtggtcccaccaccacctacccgtgagcggcgtcgacgtcggcggcggcgccggcaacggcgacgagatgacgccgtacctgctcgccgcgctgcgccagtacctgccgtacaacgacgccggcggcgcggccgacgatgaggaggcggccgcggcggcggcgatggcggcgggcgtcgacggctacggcagcgacgacttccgcatgtacgagttcaaggtccgccggtgcacccgcgcccgcagccacgactggaccgagtgccccttcgcgcacccgggggagaaggcgcgccgccgggacccgcgcaagtaccactactccggcaccgcctgccccgacttccgcaaaggcgggtgcaagcgcggcgacgcctgcgagtacgcgcacggcgtcttcgagtgctggctccacccggcgcgctaccgcacccagccctgcaaggacggcaccgcntgccgccgccgggtctgcttcttcgcccacaccccggaccagctccgcgtcctcccgccgcagcagtccagcccgaggggtgcggtggccggggcggcggcggcggcctccccgctcaccgagtcctacgacggctccccgctccggcgccaggcgttcgagagctacctcaccaagagcatcatgtcgtcctcgccgaccagcaccctcatgtcgccgcccaagtcgcccccctcggactccccgccattgtcgcccgacggggcngccgcctaccgccgcggctcctggcccggcgtcgggtcaccggtgaacgaggttctcgcctcgctccgccagctccgcctcagcaaggccaactcgtccccgtcgggcgggtgggcnggctacccgtcctccaccgtcgcgtacgggtcgcccacggcggccgggctctacagcctgccctccaccccgacgaccatgggcngcggcttcatgaccaacctggagccgctggacgtctccttcggcggcggcgaggacgagcccgtgcggagggtcgagtccgggcgtgccctccgcgccaaggtgttcgagcgtctgagcagggaaggcgctgtctctgccgaaccagccactggtggattcggaggccccgacgtcgggtgggtctctgatctcatcaactgaggcggcatgtcctttgtggagttgcaaggcatgtcaatggctggaagaagttggtggtaagcagccgtaacagagaagcgtggcatccaaaaaaaaaagatcagttctcttttgttggttgggagtttcttctgctaattcccctgtacatacctatcgccttgtgaatattctcggttggtagagggagagaggatgcaaggtggtggaagaggtggatttgttttggggttcttgaggtagcagaaaatatccagaaaaatagtaagaaaaaaaatagtagaaatgtattaggtgatggtggtggcaaggcaagtcctttgttgtgcatagggtgtggcggaggcaaggcaagcatggcgggcagctgatggtgcatcaagacggacggaagatggccggatttccagcaggcacggcggcggccggccgtagctgcttcaatttctacgattccggagcatagcntnctagnnngatgtttgtttaaagttcatcgtttgtgcattatgcatcggctagttgatcganttcaaaccttgttgattattaccacccacattttgttgatgtaatccttgtttattaagaccttcattccctaca

SEQ ID NO: 927 - DNA, 1229 bp, Saccharum officinarum
cctaactccaccacccacaccatctctctctgcagccaggagctcacgcaccacaccacaccacagaccaggcaaggcatggcgacgcgggcggacgtggagaagggcggggtgaggaaggagcccggcaaggtgccgtcgccgctgtacccgcagcacgagggggagcgggagtgggtgccctggatcgtccccgtcttcttcgtcgccaacatcaccgtcttcgtcatcgccatgtacgtcaacaactgccccgcgcacacgacgccgcgcgacggcaagtgcgtcgcccggttcctcggccgcttctccttccagccgctgcgacagaacccgctcctcggaccatcctccgccacgctcaccaagatgggggcccttgtgtgggagaaggtggtgcaccaccaccagggctggcgcctcctctccagcatgtggctccacgccggcgtcctccacctggtcgccaacatgctctgcctcctcttcgtcggcatgcgcctcgaacagcagttcggatacgtgaggatcggtgcgatctacgtcctctccggcctaggcggcgccgtgctgtcgtcgctcttcatccggaaccacatctccgtgggcgcctcgggcgcgctcttcggcctgctgggcgccatgctctcggagctcctcaccaactggaccatctacaccaacaaggcggcggccgtggccacgctcctgttcgtcgctgccgtcaacctggtgctgggcatcctgccccacgtcaacaacttcgcgcacgtcggagggttcctcgcgggcttcctcctcggcttcgtcgtcctcatgcggccccacttcgggtggatggagcgctacagcctccccgccggcgcgccctgcaccgccaggaagtacctcgcctaccagtggatcctcctcgccgtcgccctgctcctcctcgtcgtcggattcgcggtcggcatggcgatggtcttccgcggcgccaacgccaaggacagctgccactggtgtcactacctcagctgcgtgcccaccgccagatggaactgcaccaactgatgatccagcagcagcagcacgagttgccacccttttttttcccttcgtatatcctacccagcttgtcatgcatacacatacatcacacacagatgtattccttccggccggggtactgttactgtagatagcttctttgatgggtttgtgaactgtagagtctcgttgagatctta

SEQ ID NO: 928 - DNA, 1288 bp, Saccharum officinarum
  misc_feature (1086)..(1086): n is a, c, g, or t
  misc_feature (1254)..(1254): n is a, c, g, or t
cctaactccaccacccacaccatctctctctgcagccaggagctcacgcaccacaccacagaccaggcaaggcatggcgacgcgggcggacgtggagaagggcggcggggtgaggaaggagcccggcaaggtgccgtcgccgctgtacccgcagcacgagggggagcgggagtgggtgccctggatcgtccccgtcttcttcgtcgccaacatcaccgtcttcgtcatcgccatgtacgtcaacaactgccccgcgcacacgacgccgcgcgacggcaagtgcgtcgctcggttcctcgaccgcttctccttccagccgctgcgacagaacccgctcctcggaccatcctccgctacgctcaccaagatgggggcccttgtgtgggagaaggtggtgcaccaccaccagggctggcgcctcctctccagcatgtggctccacgccggcgtcctccacctggtcgccaacatgctctgcctcctcttcgtcggcatgcgcctcgaacagcagttcggatacgtgaggatcggtgcgatctacgtcctctccggcctaggcggcgccgtgctgtcgtcgctcttcatccggaaccacatctccgtgggcgcctcgggcgcgctcttcggcctgctgggcgccatgctctcggagctcctcaccaactggaccatctacaccaacaaggcggcggccgtggccacgctcctgttcgtcgctgccgtcaacctggtgctgggcatcctgccccacgtcaacaacttcgcgcacgtcggagggttcctcgcgggcttcctcctcggcttcgtcgtcctcatgcggccccacttcgggtggatggagcgctacagcctccccgccggcgcgccctgcaccgccaggaagtacctcgcctaccagtggatcctcctcgccgtcgccctgctcctcctcgtcgtcggattcgcggtcggcatggcgatggtcttccgcggcgccaacgccaaggacagctgccactggtgtcactacctcagctgcgtgcccaccgccagatggaactgcaccaactgatgatccagcagcacagcagcacgagttgccacctnttttttttcccttcgtatatcctacccagcttgtcatgcatacacatacatacacacacagatgtattcctttcggccggggtactgttactagatagcttctttgatgggtttgtgaactgtagagtctcgttgagatcttatctcctgttcatttgattcattctnttacatgatgcaaggcatttatgggattttgaat

SEQ ID NO: 929 - DNA, 1396 bp, Panicum virgatum
tcctctcctcctcgctcgctcactccgatccaccacctctatctctctacctctccattgctctgcagcgctagctccgatccctccgctagcttgtagcttctcgatggatccatccaatcacgacacagcacggcagtctccaatggcgacgcgcggggacgtggagaagggcggcgtgaagaaggaggccggcaaggtgccgtcgccgctgtacccgcagcacgagggggagcgggagtgggtgccgtggatcgtgcccgtcttcttcgtcgccaacatcaccgtcttcgtcgtcaccatgtacgtcaacaactgccccgcccacaccaccgccagagacggcaagtgcatcggacgcttcctcggccgattcgccttccagccgctgcgccagaacccgctcctcggaccatcctccgccacgctcaccaagcttggggcccttgtgtggcagaaggtggtgcacgagcaccagggctggcgcctcctttccagcatgtggctgcacgccggtgtcgtgcacctggtggccaacatgatgagcctcctcttcatcggcatgcgcctcgagcagcagttcggatacgtgaggattggtgctgtgtacctcctctccggcctcggcggcagcgtcctgtcctccctcttcatccgcaaccacatctccgtgggcgcctccggcgccctgttcgggctcctgggcgccatgctctcggagctcctgaccaactggaccatctacaccaacaaggtggccgccgtgctgacgctgctgttcgtggtggccgtgaacctggtgctgggcatcctcccgcacgtcaacaacttcgcccacatcggcggcttcctcacgggcttcctgctggggttcgtggtgctcatgcgcccgcacttcggctggatggagcgctacggcatgcccgccggcagcgcctgcacctccaggaagtacctgctctaccagtggatcctcatggccatcgccctcctcctcctcgtcatcggattcgcggtgggcatggcgatgctcttccgtggctccaacgccaacgacagctgctcctggtgccactacctcagctgcgtgcccaccgccagatggacatgcaccaactgatctcatcatccatccacgaccatgagcataacacggacggcagagattcttttattttcctccaatttttcttcctacatccagcatgcgcacacacacacacatgttccttccgggcactgtagatagcgtaaagaaaaacgaaggcacgcactactcttttgatgggttgtcagtcagctgtagagttatcgttcagatcttatctcctgttccatttgattcattctttacataatgcaatgcaatgaattactattattgaggtttggaatc

SEQ ID NO: 930 - DNA, 1520 bp, Zea mays
cgcgtttattaattcccaccccgccgctgctcacgtatcgcccgccgtcctctcctctcctccccggccccttcactccaccaacgaaccccacgcaggcagcagcacgcgcaagccgcaaggcaaggcacaaacactaggggccgggcatggcgacgcgggcggacgtggagaagggcgggccggcgaggaaggagcccggcaaggtgccgtcgccgctgtacccgcagcacgagggggagcgggagtgggtgccctggctcgtccccgtcatcttcgtcgccagcatcaccgtcttcgtcgtcaccatgtacgccaacaactgccccgcgcgcgacaccaacaagtgcgtcgcccgcttcctcggccgcttctccttccagccgctgcgacagaacccgctcttcgggccctcctccgccacgctcaccaagatgggggccctggtgtgggagaaggtggtgcaccgccaccagggctggcgcctcctctccagcatgtggctccacgccggcgtcatccacctggtcgccaacatgctctgcctcctcttcatcggcatgcgcctcgaacagcagttcggatacgtgaggatcggcgcgatctacgtgctctccggcgtgggcggcgccgtgctgtcgtcgctggtcgtccggaaccgcgtcaccgtgggggcctccggggcgctcttgggcctgctgggcgccatgctctcggagctgctcaccaactggaccatctacaccaacaaggcggcggccgtggccacgctcctgtccgtggccgccgtcaacctggtgctcggcgtcctgccccacgtcgacaacctggcgcacctcggcggcttcctcgcgggcttcctactcggcttcgtcgtgctcatgcgcccccacttgggctggatggagcgctacggactccccgccggcgcgccctgcaccgccaggaagtacctcgcgtaccagtggaccctcctcgccgtcgccatcatcatcctcctagtcggattcgcggccggcatggcgatgctcttccgcggcgccaacgccaacgacagctgccactggtgtcactacctcagctgcgtgcccaccgccagatggaactgcaccaactgatgatccatgcatagcggcagcagcacgagttggagttgccacccattttcatcttccgatccgtatagtctcgttactgtagatagcttctttgtcattcattcagatctcaacacacacgtcggtctcctgttcatttgattcattcttttacataatgatgcaatgcaattattgagatttcgaatctcgtcttgcgtgtctagtcagcatgcgccgcctttttcgaacccgtgcaaatgcgccaacgcacgcacaagagcaaccaccacgtgccttcccttctttttcttgacaacacatgtgtacgttctcaactgcacatgttcccaagataccaactatcacaggttggttggtgaaagtactacgcacagcgcatcacgaaggcccccccccccc

SEQ ID NO: 931 - DNA, 2030 bp, Oryza sativa
gtacgccacacgaaacgaataatcttattagcacatgattaattacaaaatagatttatttgcttttttaaaactactttgatatagattttcttttttttaaaaaaaactcatcatttcacagtctgaaaattattctaccgtaaaacgagtaagttgaagtttagagttgaagaattgagcatgactttcaattctttaatttggaccaaattttaacatgcaaattcgttttgctaactagtgctagttgtgtctcgaaaactagcgctagttggtgagatctggaccattgatttgatctgccgattcaaacaacaaccgggcaggtcaaactactgtcacgagacagtagtaactgcgggcggcgcgcgcccgcaacaattcacacgacgaagcaacccgtcgtgcgcgccgcgagccgtgtcgcgcccgctcgtttatttattcccgcctctccccccgcgcatctcgccgtccaccgcctcactccatccaccgcaccaccaccactaccctgcacctcgatcaattgaacgcgagcaaggaaagagagagagcgagaaagagagcggcaatggcgacgtcgcacgcggacgtggagaagggggcgaggaggaaggaggtggggaaggtgccgtcgccgctgtacccgcagcacgagggggagagggagtgggtgccgtggatcgtcccgtcgttcctcgtcgccaacatcgtcgtcttcgtcctcaccatgtacgccaacaactgccccctccacaccccgcctcgcagcggcaagtgcatcgcccgcttcctcggccgcttctccttccagcctctccacgagaacccgctcctcggcccctcctccgccacgctacagaagatgggagcacttgtgtgggacaaggtcgtgcacgagcaccagggctatcgcctcatcacctccatctggctgcatgccggtgttctgcacctggtcgccaacatgctcagcctcatcttcatcggcctgcgccttgagcagcagttcggatacgtacgaattggagcgatctacctcctgtctggcctgggcggcagcgtcctgtcctctctgttcatcagaaaccacatctcggttggtgcttcaggtgctctctttggactcctcggagccatgctctcggagcttctcaccaactggaccatttacaccaacaaggtcgcggccgtgatcaccctcctgttcgtgatcgcggtgaacctggcgctcggcatcctcccacacgtgaataacttcgcgcacatcggcgggttcctgacgggtttcctgctcggattcgtgctgctgatgcggccgcatttcggctggatggagcgctacagcctcccctccggcagcccgtgcagctccaagaagtacctcgtctaccagtggatcctgcttgccatcgccactgccctcgtcattgtcggattcgcggttggtatgaccatgctcttccgcggggagaacgccaacgacagctgccactggtgtcactacctcagctgtgtaccaacctccagatggacctgctcgaactgagaaatacaaggaggccatgaacaaattttctctgtactttttttctttttgcgtaatcctgtatgatgctgcaaacacatattctgtttatctgtagatagattaaagaaggattcttgatcgatcgatctcatactgtaggcaggctcgtcggggtcttccactcttcctatctcttgtacaattgattcattctttgtattgcaattattgaggcttggaatctcttctgtccctgcatcacttcttccaaattaaaacatatctttgaacctgtatggacaagcatttagctacagctcgtctaccacaagctaccagttggcatgtatgtttacagtatggtctaaaattgtcagctttgatcaccacatgtgagagattccatcaccaagtggatggtaatccatgcatattcaatagtactcgtagctgtggagttaagaatagtatgcacgcgctatgcaggaccagg

SEQ ID NO: 932 - DNA, 1316 bp, Brachypodium distachyon
gtcttccttccttctcatcacactcccaaaagcctcctcctctccaaatcaaccaagcacgagaggaagaacagtgggtgaatcaatggcgtcgagggcggacgtggagaagggagggaagcagggagggaaggtggtgccggcgccgctgtacccgcagcacgaaggggagcgggagtggacgccgtggctcgtgccctccatcctcgtcgccaacatcgtcgtcttcgccatcaccatgtactacaacaactgccccgcccacaacgccaacacaggcacccgtggcggcagcaagcagcagcagcagtgcgtcgccggcttcctcggccgcttctccttccagccgctccgccagaacccgctcctcggcccttcctccgccacgctggagaagatgggcgccctggtgtgggacaaggtggtgcacagccaccagggctggcgcctcctctcctgcatgtggctccacgccggcatcctccacctcctcgccaacatgctcagcctcctcttcatcggcctccgcctcgagcagcagttcggctacgtgaggatcggggcgatctacctgctctcaggaatcggcggcagcgtgctgtcgtcgctgttcatcaggacatccatctccgtcggagcttccggcgccctgttcgggctcctgggggcgatgctgtcggagttgctgaccaactggaccatctacaccaacaaggtggcggccgtgatgacgctgctgttcgtgatcacggtcaacctcgtgctgggcatcctgccgcacgtcaacaacttcgcccacatcggagggttcctggccgggttcctgctcggcttcgtcgtgctcatgaggccgcattacgggtggatggagcgctacagcctcccggctggaaccccctgcacctcccggaagtacctgctttaccagtgggttctcatggccgtcgccctgcttcttggcgtcattgggttcgcggctggcttggcgatggtgttccgcggggtgaacgccaacagcagctgccactggtgccactacctcagctgcgtgcccacagccagatggacctgcgcaaactgagcaagagacaccaccggacattttgctgcttctttctttctctctttcccgtgtcgctcttcctatcgtattcgaaccccacatatttttcccgtttatatctgtagatatagattaaaggataaggctgtttgattggatgcatactgtagacagacaggacctcgctgggggggtcttatctcttgtcgatttgatttattctttgtaatgaaaactatcattgggggattgg

SEQ ID NO: 933 - DNA, 1264 bp, Saccharum officinarum
ctctcgcctctggtgcgcggagctctcttgaagcctcgagacccgtctcgccactgctgctcctcagctctgccgctgcgctagctgttgcattgcagtccgcgaggcttgagctgctagctcgctcttcaccacagtccccagacatggagttcgaagaccgctgccacaaggtccaggagcccaagttcgactgcctgctctttgacctcgacgataccctgtacccgctgagctccgggatcgcaggccatgtcaagaagaacattgaagattacatggttgagaagctgggtattgatgagagcaagatcgagaacctgggcaatctgctgtacaagaactacggcaccacgatggctggcctcagggcgatcggctacagcttcgattacgacgagtaccacgccttcgtccatggaaggctgccctacgacaacatcaagcctgaccctgttctcaagcacattctcaagaacctgcgcgtccgcaaactcatattcaccaacggcgatatggtccacgccgtgagagccctcgagaggctgggcctggaggactgcttcgaggggatcatctgcttcgagaccctgaacccgccgtgcccgccgcagggagaccaggagcccgagatcttcgacatcgccggccacttcgcccgctctggcaccgccgacgagctgcccaagaccccggtcctgtgcaagcccaacgtcgacgccatggaggaggcgctcaggatcgccaacgtcaacccccacaaggcgattttcttcgacgacagcgtacgcaacatccaggccgggaagcagatcggcctccacacagtgctggtgggcaaatcgcagcgggtgaaaggcgcggaccacgcgctggagagcatccacaacatcagggaggcgctgccggagctgtgggaggaggccgagaaggccaaggaggacgtgctctacgccgaacgcgtcgcgatggagacctcggtcaccgcgtaaaactcctgaatcctccggagccgaactttctcgacatccaggaccgcgacgatcacataccactccccgagccagggctggtgatctcacgctggaactgactgaatccagcaatggccgggccgagaacttccgacagcaggagggggtgcagcatgtaaagggggaacagcagatgagatcatgtttgggatggtccctatatatatatagttatatgtatcagccagacctttgcttgtaaattaccagtattagaagtaataagaaaa

SEQ ID NO: 934 - DNA, 1347 bp, Saccharum officinarum
ctctcgcctctggtgcgcggagctctcttgaagcctcgagacccgtctcgccactgctgctcctcagctctgccgctgcgctagctgttgcattgcagtccgcgaggcttgagctgctagctcgctcttcaccacagtccccagacatggagttcgaagaccgctgccacaaggtccaggagcccaagttcgactgcctgctctttgacctcgacgataccctgtacccgctgagctccgggatcgcaggccatgtcaagacgaacattgaagattacatggttgagaagctgggtattgatgagagcaagatcgagaacctgggcaatctgctgtacaagaactacggcaccacgatggctggcctcagggcgatcggctacagcttcgattacgacgagtaccacgccttcgtccatggaaggctgccctacgacaacatcaagcctgaccctgttctcaagcacattctcaagaacctgcgcgtccgcaaactcatattcaccaacggcgatatggtccacgccgtgagagccctcgagaggctgggcctggaggactgcttcgaggggatcatctgcttcgagaccctgaacccgccgtgcccgccgcagggagaccaggagcccgagatcttcgacatcgccggccacttcgcccgctctggcaccgccgacgagctgcccaagaccccggtcctgtgcaagcccaacgtcgacgccatggaggaggcgctcaggatcgccaacgtcaacccccacaaggcgattttcttcgacgacagcgtacgcaacatccaggccgggaagcagatcggcctccacacagtgctggtgggcaaatcgcagcgggtgaaaggcgcggaccacgcgctggagagcatccacaacatcagggaggcgctgccggagctgtgggaggaggccgagaaggccaaggaggacgtgctctacgccgaacgcgtcgcgatggagacctcggtcaccgcgtaaaactcctgaatcctccggagccgaactttctcgacatccaggaccgcgacgatcacataccactccccgagccagggctggtgatctcacgctggaactgactgaatccagcaatggccgggccgagaacttccgacagcaggagggggtgcagcatgtaaagggggaacagcagatgagatcatgtttgggatggtcccaatatctatatatatatagttatatgtatcagccagacctttgcttgtaaattaccagtattagaagtaataagaaaatggagtttacttgtgaaagaataaacattacatggattaacgggacaggtaatgccagggcagtggaagttcaaggt

SEQ ID NO: 935 - DNA, 1337 bp, Zea mays
ctccccctccgcctcctgctctctctcgcctctggttggcagagctctcttgaagcctcgagactcgtctcgccgctgctccctcagctctgccgctgcgtgcctccgttagctgttgcattgcagcgcagccccgcgagccttgagctgctagctcgcccttcaccacagtcctcagacatggagttcgaagaccgctgccacaaggtccaggagcccaagttcgactgcctgctcttcgacctcgacgacaccctgtatccgctgagcgccgggatcgcaggccatgtcaagaagaacattgaagattacatggttgagaagctgggtattgacgagaccaagatcgagaacctgggcaatctgctgtacaagaactacggcaccacgatggctggactcagggccatcggctacagcttcgattacgatgagtaccacgccttcgtccatggaaggctgccgtacgacaacatcaagcctgaccccattctcaagcacattctcaagaacctgcgcatccgcaaactcatattcaccaacggtgacatggtccacgccgtgagagccctcaagaggctgggcctggaggactgcttcgaggggatcatctgcttcgagaccctgaacccgccctgcccgccgcagggagaccaggagcccgagatcttcgacatcgccggccacttcgcccgctccggcaccgccgacgagctgcccaagacccccgtcctgtgcaagcctaacgtggacgccatggaggaggcgctcaggatcgccaacgtcaacccgcacaaggcgatcttcttcgacgacagcgtacgcaacatccaggccgggaagcagattggcctccacacggtgctggtgggcaaatcgcagcgggtgaaaggcgcggaccacgcgctggagagcatccacaacatcagggaagcgctgccggagctgtgggaggaggccgagaaggcggaggacgtgctctaccccgaacgcgttgcgatggagacctcggtcaccgcgtaaaacccctgaatgcctccggtgcaccgtcagccgaactttctcgacatctccaggaccgcatcaacgatcacatgtcactcgctccccgagccagggccggtgatgatctcgcgctggaactgaatccaccagcaatggccgggccgaggatcgatttccgacagcaggaagggtgcagcatgtaaagggggaacagatgagatcatgtttgtttgggttggtcccccgttgtatatgtagttatgtatcagccagtcctttgtttgtaaattaccagtatttagaagtaataagaaaatgggggtttacgtgta

SEQ ID NO: 936 - DNA, 1310 bp, Panicum virgatum
gcctctcgctccctctcgcctctggttcggagagctctcttgaagcctcgaggcctgcctcgcctgggctctgctcctccggctccgccgccgcgctagctgttgcattgcagcccgcgagccctgagctgacagctagctcgttattcgccacacttccgagacatggagttcgaagaccgctgccacaaggtccaggagcccaagttcgactgcctgcttttcgacctcgacgacactctgtacccgttgagttctgggatcgcaggccatgtcaagaagaacattgaagactacatggttgagaagctgggtattgatgagagcaagatcgagaaccttggcaacctgctgtacaagaactacggcaccacgatggccggcctcagggcgatcggctacagcttcgattacgatgagtaccacgccttcgtccatggaaggctaccctacgacaacatcaagcccgaccctgttctcaagcacattctcaagaacctgcgcatccgcaaactcatattcaccaacggcgataaggtccacgccgtgcgcgccctcaagaggctgggcctggaggactgcttcgaggggatcatctgcttcgagaccctgaacccgccgtgcccgccgcagggcgaccaggagcccgagatcttcgacatcgccggccacttcgcccggtccggcaccgccgacgagctccccaagacccccgtcctgtgcaagcccaacgtcgacgccatggaggaggcgctgaggatcgccaacgtcaacccacacaaggcgatcttcttcgacgacagcgtgcgcaacatcctggccgggaagcagatcggcctccacacggtgctggtgggcaagtcgcagcgtgtgaagggcgcggaccacgcgctggagagcatccacaacatcagggaggcgttgccggagctgtgggaggaggccgagaaggcggaggacgtgctctacgccgaccgcgtggccatcgagacctccgtcacggcgtaaaaaatcccccggcgcaccgtcatcagccgaagtttctcgacgtccagggccgcagcagcgatcacgcatcgcacgcccgggccaggactggggtggtctcccacggtgggaactgaattccagcgatggccgggccgggaatttccgacaacagcaggggtgcagcatgtaatggtggggaacagatgatgagctcgtgttgggctggtcctagtatatatacatatatatgtatcggccggaccttttgcttgtaaattactagtagaagaaataataagaaaaaacggagtttacttgta

SEQ ID NO: 937 - DNA, 1399 bp, Zea mays
ctccccctccgccttctgctctctctcgcctctggtgcgcagagctatagctctcttgaagcctcgagactcgtctcgccgctgctctgctccccagctctgccgctgcgtgcctgcgtcagctgtcgcattgcagccagcgagccttgagctgctagctctctcttccccacagttcccaggcatggagttcgaggatcgctgccacaaggtccaggagcccaagttcgactgcctgctcttcgacctcgacgacaccctgtacccgctgagctccgggatcgcggaccatgtcaagaagaacattgaagattacatggtcgagaagctgggtattgacgagagcaagatcgagaacctgggaaatctgctgtacaagaactacggcaccacgatggctggcctcagggcgatcggctacagcttcgattacgatgagtaccacgccttcgtccacggaaggctgccgtacgacaacatcaagcccgaccctgttctcaagcacattctcaagaacctgcccatccgcaaactcatattcaccaacggcgacaaggtccacgccgtgagagccctggagaggctgggcctggaggactgcttcgaggggatcatctgcttcgagaccctgaacccgccgtgcccgcctcagggagaccgggaggccgagatcttcgacatcgccggccacttcgcccgctccggcgccgccgccgagctgcccaagacccccgtcctgtgcaagcccaacgtcgacgccatggaggaggcgctcaggatcgccaacgtcaacccgcacaaggcgattttcttcgacgacagcgtacgcaacatccaggccgggaagcagatcggccttcacacagtgctggtgggcaagtcgcagcgggtgaaaggcgcggaccacgcgctggagagcatccacaacgtcagggaggcgctgccggggctgtgggaggaggccgagaaggcggaggacgtgctctacgccgagcgcgtcgccatggagacctcggtcaccgcgtaaacccctctctcgaatcctccggtgcaccgtcagcccaaccttctcgacatccaggaccgggacgatcgcataccactctctccccgagccagggctggtggtctcacgctggaactgaatccagccatggccgggccgagaatttccgacagcaagaaggggtgcagcatgtaaaggggggagcagatgatatcatgtttgggatgctcccagatatgtatagttatgtatcagccagttgtttgtaaattaccaataaatattagaagtaataagaaaaaatggagtttacttgtacgtttcttgtgctctgtcatctgaagtaataaaagcggttagcaagaatggaagagcaacacatttgcttctctg

SEQ ID NO: 938 - DNA, 1338 bp, Panicum virgatum
cctctcgctccctttcgcatctggttcggagagctctcttgaagcctcgagcctgcctctcgcctgtgctctgctctgctccgcgcctccggctccgccgccgcgctagctgttgcattgcagcccgcgagccctgagctgatagctagctcgttcgttcttcaccacacttccgagacatggagttcgaagaccactgccacaaggtccaggagcccaagttcgactgcctgctcttcgacctcgacgacactctgtacccgttgagttctgggatcgcaggccatgtcaagaagaacattgaagactacatggttgagaagctgggtattgatgagagcaagatcgagaaccttggcaacctgctgtacaagaactacggcaccacgatggccggcctcagggcgatcggctacagcttcgattacgatgagtaccacgccttcgtccacggaaggctaccctacgacaacatcaagcccgaccctgttctcaagcacattctcaagaacctgcgcatccgcaaactcatattcaccaacggcgacaggtccacgccgtgcgcgccctcaagaggctgggcctggaggactgcttcgaggggatcatctgcttcgagaccctgaacccgccgtgcccgccgcggggcgaccaggcgcccgagatcttcgacatcgccggccacttcgccctgtccggcactgccgacgagctccccaagactcccgtcctgtgcaagcccaacgtcgacgccatgggggaggcgctcaggatcgccaacgtcaacccccacaaggcgatcttcttcgacgacagcgtgcgcaacatccaggccgggaagcagatcggcctccacacggtgctggtgggcaagtcgcagcgtgtgaagggcgcggaccacgcgctggagagcatccacaacatcagggaggcgctgccggagctgtgggaggaggccgagaaggcggaggacgtgctctacgccgaccgcgtggccatcgagacctccgtcacggcgtaaaaaccccccggcgcgccgtcagctagccgaagtttctcgacgtccagggccgctgcagcagcgagatcacgcatcacacgcgcccgggccagggactggtggtctctcacggtgggaactgaattccagcgatggccgggccgggaatttccgacaacagcaggggtgcagcatgtaacgggggggaacagatgacgagctcgtgatgggctggttctaatatatatacatacatatattatgtatcggccagaccttttgcttgtaaattactactagtagaagaaataataagaagaacaacggagtttacttgt

SEQ ID NO: 939 - DNA, 1319 bp, Cenchrus ciliaris
  misc_feature (321)..(321): n is a, c, g, or t
cccactccctctagcatctggttcggagcgctctcttgaagcctcgagaccccgcttcgcctctgctctgctctgctctgctgctccggctctgccgccgcgctagctgttgcattgcagaccgcgagccttgagttgatatctagctctttcttcaccacagtcccgagaaatggagttcgaaaacggctgccacaaggtccaagagcccaagttcgactgcctgctcttcgacctcgacgacactctgtacccgctcagcgctgggatcgcaggccatgtcaagaagaacattgaagattacatggttgagaagctggntattgatgagagcaagatcgagaacctggggaatctgctgtacaagaactacggcaccacgatggccggcctcagggcgatcggctacagtttcgactacgacgagtaccacgccttcgtccatggcaggctgccatacgacaacatcaagcccgaccctgttctgaagcacattctcaagaacctgcgcatccgcaagctcatattcaccaacggcgacaaggtccacgccctgcgatctctcaagaggctgggccttgaggactgcttcgaggggatcatctgcttcgagaccctgaacccgccgtgcccgccgaagggagacgaggagcccgagatcttcgacatcgccggccacttcgcccggtccggcaccaccgacgagctccccaagacccccgtcctgtgcaagcccaacgtcgacgccatggaggaggcgctcaggatcgccaacgtcaacccccacaaggcgattttcttcgacgacagcgtgcgcaacatccaggccgggaaggagatcggcctccacacggtgctggtgggcaagtcgcagcgggtgaagggcgcggaccacgcgctggagagcatccacaacatcagggaggcgctgccggagctgtgggaggaggccgagaaggcggaggacgtgctctacgccgaccgcgtggcgatcgagacctccgtgacggcgtaaaaatgcccagactccttccggtgcaccgtcagcagaactttctcgacgtccggggccgcagcgatcacacatcacaaaccccgagccagggctggtgatctcacggttgggaactgaagtccagcgatggccgggccgggaatttccgacaacagggaggggtgcagcatgtaatggggggaacagatgagatcaccttgggatggtcctagtatatatacatacatatatgtatcggccagacctttgcttgtaaattaccagtagaagtaataataataagataaatggagtttacttgtta

SEQ ID NO: 940 - DNA, 1316 bp, Oryza sativa
tcccccctccgcctcgcactctctctcgctatagcctatagcgtctctcccgaaggctcgagacaccacacctctcttctctttggctcctctcctcgctgcattgcgatcccaagagctgtgagctttaggagcttgttcatcacgacctgaaaatcatggagttcgaagaccgctgccacaaggtccaggagcccaaattcgactgcctgctgtttgacctcgatgacactctgtacccactgagctcggggatcgcgtcccatgtcaagaagaacattggagattacatggttgagaagctgggtattgaggagagcaagattgagaaccttggcaatctgctgtacaagaactacggcacgacgatggccggactcagggcaataggctacagcttcgattacgatgagtaccacagttttgtccatggaagactgccctacgagaacatcaagccggaccctgtcctgaagcacattctcaagaacctgcgcatccgcaaactcatattcaccaacggcgacaaggaccacgccgtgagagccctcaagaggctggggctggaggactgcttcgaggggatcatctgcttcgagaccctcaacccgccgtgcccgtcgccgccgtgcgacggggaggccagcatcttcgacatcgccggacacttctccatgcccggcgccgccgccgacgagcttcccaggacacccgtcctctgcaagcccaacgtcgacgccatggaggaggccctcaggatcgccaacgtgaaccctcacaaggcgattttcttcgacgacagcgtgaggaacatccaggcggggaagaggatcgggctccacacggtgctggtgggcacgccgcagcgggtgaagggcgcggaccacgcgctggagagcatccacaacatcagggaggcgctgccggagctgtgggaggaggccgagaaggcggaggacgtgctcatctactccgaccgcgtcgccatcgagacatcggtgaccgcgtaggccacacctactgtctctcccgactccggcgaatcgctcagaacgagcaaccatccatccatccatgtccatccctggccgggcaggtgatcatcaggtgggaattcagaattggccgggacaacaatacgttccaagaaaaaaagaggagggtgttccgtggaagttcaggattcagaatgtaacagcaatgttggaacgggtcctgtagtatatatatgtatcggtcagatctttgcatgtaaattagtactcctagaagcaataataataataattaataaagagaatgggggttatttatca

SEQ ID NO: 941 - DNA, 1315 bp, Brachypodium distachyon
cgcactctctctgtatatctctctctctctctcgctgttgcctctcgagaaactcttgaagaaagatcgagacctctgtctttggctcctcggctttgccactgtgctgttgcattgcagttcgcgagcacccgagttacttcatcacagtctgaatcatggagtacgaagagcgctgcctcatggtccaggagcccaagttcgactgcctgctctttgacctcgacgacactctgtacccgatgagctcggggatttcatctcatgtcaagaccaacattgaagattacatggttgagaagctgggtattgaagagagcaagattgaaaacctagggaatctgctgtacaagaactacggcacaacgatggctggcctcagggcaattggctacaacttcgattacgatgagtaccacagttttgtccatggaagactgccgtacgacaacatcaagcccgaccctgttctcaagcacattctcaagaacatgcgcatccgcaagctcatattcaccaacggcgacatggtccatgccgtgagagccctcaagaggctgggcttggaggactgcttcgaggggatcatctgcttcgagaccctgaacccgccgtgcctgttgccgggcgaccaggccctggagatcttcgacatcgccggccatttcgccggctccggcagcaccgacgagctgcccaggacgcccgtcctgtgcaagcccaacgtcgacgccatggaggcggcactcaggatcgccaacgtcaacccttataaggcgattttcttcgacgacagcgtgcgcaacatccaggccgggaagcgaattggtctccacacagtgctggttggcacgtcgcaccgggtgaagggcgcagatcacgcgctggagagcatccacaacatcagggaggcgctgccagagctgtgggaggaggccgagaagacagaggacgtgctctactccgaccgcgtcgcgatcgagaccgcggtgaccgcgtaggctgatctcccggtgcgccgtcggtctgagatatgaccccaaaacacacgacccgatcaaattcgccatccccagatagccttcctgccggaactggtgatcttcacgtggaaattcagcattggccgggacaagaatttccaacaagaggagggggggagttaagcaagtcaggaaagcgaacgcagcattgtacatcaaactgggctggtcctaccgttctacttagtatctatatatgtaccgatcagatctttgcttgtaaatttcaactaggagcaataataataataaaaccgggttacctgtatctg

SEQ ID NO: 942 - DNA, 1001 bp, Brachypodium distachyon
cgcactctctctgtatatctctctctctctctcgctgttgcctctcgagaaactcttgaagaaagatcgagacctctgtctttggctcctcggctttgccactgtgctgttgcattgcagttcgcgagcacccgagttacttcatcacagtctgaatcatggagtacgaagagcgctgcctcatggtccaggagcccaagttcgactgcctgctctttgacctcgacgacactctgtacccgatgagctcggggatttcatctcatgtcaagaccaacattgaagattacatggttgagaagctgggtattgaagagagcaagattgaaaacctagggaatctgctgtacaagaactacggcacaacgatggctggcctcagggcaattggctacaacttcgattacgatgagtaccacagttttgtccatggaagactgccgtacgacaacatcaagcccgaccctgttctcaagcacattctcaagaacatgcgcatccgcaagctcatattcaccaacggcgacatggtccatgccgtgagagccctcaagaggctgggcttggaggactgcttcgaggggatcatctgcttcgagaccctgaacccgccgtgcctgttgccgggcgaccaggccctggagatcttcgacatcgccggccatttcgccggctccggcagcaccgacgagctgcccaggacgcccgtcctgtgcaagcccaacgtcgacgccatggaggcggcactcaggatcgccaacgtcaacccttataaggcgattttcttcgacgacagcgtgcgcaacatccaggccgggaagcgaattggtctccacacagtgctggttggcacgtcgcaccgggtgaagggcgcagatcacgcgctggagagcatccacaacatcagggaggcgctgccagagctgtgggaggaggccgagaagacagaggacgtgctctactccgaccgcgtcgcgatcgagaccgcggtgaccgcgtag

SEQ ID NO: 943 - DNA, 1319 bp, Hordeum vulgare
attcggcacgaggtctccctctctctctctctccatacgcttccgagcgcgctcttgaagcaagcaaggctccacacacctctgccttcgcatccgcgagctctgttgcattgccgcagaggaggaccgtcagtagttctttccaccagagtccggatcatggagttcgacgagcgctgcctcaaggtccaggaccccaagttcgactgcctgctcttcgacctcgacgacactctgtacccgctgagctccgggatctcatcacacgtcaagaccaacattgaagcctacatggttgagaagctgggtattgaggagagcaagatcgaaaaccttggcaacctgctgtataagaactatggcaccacgatggccggcctcagggcaattggctacaacttcgattacgacgagtaccacagctttgtccatggaaggctgccctacgacaacatcaagcccgaccccgttctcaagcatattctcaagaacatgcgcatccgcaagctcattttcaccaacggtgacatgatccatgccgtgagagccctcaagaggctgggcctggaggactgcttcgaggggatcatctgcttcgagaccctgaacccgccctgcctgctgccacagtgcgaccaggcgcccaagatcttcgacatcgccggccacttcgccgggttaggcagcgccgacgacctgcccaggacccccgtcctatgcaagcccaacgtcggcgccatggaagcggcgctcaggatcgccaacgtgaacccttacaaggcgattttcttcgacgacagcgtgcgcaacattcaggcaggcaagcgaattggcctccacacggtgctggttggcacgtcgcaccgggtgaagggcgcggatcacgcgctggagagcatccacaacatcagggaggcgctgccggagctgtgggaggaggccgagaagacggaggacgtcctctacgccgaccgcgtcgcgatcgagacatcggtgaccgcgtagacgccgccgccgccgctggctcccggtgcaccttcagtctgataccccaagcgcaacccgatccgacccggcgtccccgagcctgccggactactggtgatcatcacgtggaattcagcattggccgggaaaaaacagtatccagcacgaggaggggggagctcagaaaagtcaggaattaatgcggcatgcacaccatgccgggccggtcctaatatatgtatatgtatatggagtatgtatcgatcagtcagatctttgcttgtaaattactgctaggaggaatgaataataagcaaaaaaacgggggttac

SEQ ID NO: 944 - DNA, 1599 bp, Hordeum vulgare
cggacgaggctccctccctctctctctctctccatacgcttccgagcgcgctcttgaagcaagcaaggctccacacacctctgccttcgcatccgcgagctctgttgcattgccgcagaggaggaccgtcagtagttctttccaccagagtccggatcatggagttcgacgagcgctgcctcaaggtccaggaccccaagttcgactgcctgctcttcgacctcgacgacactctgtacccgctgagctccgggatctcatcacacgtcaagaccaacattgaagcctacatggttgagaagctgggtattgaggagagcaagatcgaaaaccttggcaacctgctgtataagaactatggcaccacgatggccggcctcagggcaattggctacaacttcgattacgacgagtaccacagctttgtccatggaaggctgccctacgacaacatcaagcccgaccccgttctcaagcatattctcaagaacatgcgcatccgcaagctcattttcaccaacggtgacatgatccatgccgtgagagccctcaagaggctgggcctggaggactgcttcgaggggatcatctgcttcgagaccctgaacccgccctgcctgctgccacagtgcgaccaggcgcccaagatcttcgacatcgccggccacttcgccgggttaggcagcgccgacgacctgcccaggacccccgtcctatgcaagcccaacgtcggcgccatggaagcggcgctcaggatcgccaacgtgaacccttacaaggcgattttcttcgacgacagcgtgcgcaacattcaggcaggcaagcgaattggcctccacacggtgctggttggcacgtcacaccgggtgaagggcgcggatcacgcgctggagagcatccacaacatcagggaggcgctgccggagctgtgggaggaggccgagaagacggaggacgtcctctacgccgaccgcgtcgcgatcgagacatcggtgaccgcgtagacgccgccgccgccgctggctcccggtgcaccttcagtctgataccccaagcgcaacccgatccgacccggcgtccccgagcctgccggactactggtgatcatcacgtggaattcagcattggccgggaaaaaacagtatccagcacgaggaggggggagctcagaaaagtcaggaattaatgcggcatgcacaccatgccgggccggtcctaatatatgtatatgtatatggagtatgtatcgatcagtcagatctttgcttgtaaattactgctaggaggaatgaataataagcaaaaaaacgggggttacttgtacgcgagttattcgtacttcacccgccgcattaaacaagggacttgggcccctaaaaaaaaaagtaaacagctcaaattagttaagtttatgatatgtgtttatttgttgcaatgtctaaggtgtttctattcatttctttggggggggggcccggtcccctatttctcctattgtggggtgtttttatacaatatctggccgcttgttaaaaatcgtgttgtgcgtgaaaaaccttggtgtctcctccaaaaaattggtcttgcaaactataccct

SEQ ID NO: 945 - DNA, 1357 bp, Avena sativa
tctcctcctcgctctctccctctctgtctgtccctgtagcccccccctctactgcatccagagcgctcttgaagccctccagctctgtcgttctgctcccccggccggctctgcatccgcgcacccgagttgcattgcagttcccgagcgccccgagtcgctagctcttcacctcacagtccgtatcattcatggagttcgaagagcgctgcctcatggtccaggagcccaagttcgactgcctcctcttcgacctcgacgacactctgtacccgatgagctcggggatctcgtcccatgtaaagacgaacattgaagcttacatggtcgagaagctgggtattgaagagagcaagattgagaacctcggcaatctgctgtacaagaactacggcacaacgatggccggcctcagggcaatcggctacaattttgattacgatgagtaccacagctttgtccatggaagactgccctatgacaacatcaagcccgaccctgttctcaagcacattctcaagaacatgcgcatccgcaaactcatattcaccaacggtgacatgatccatgccgtgaaagccctcaagaggctaggcctggaggactgcttcgaggggatcatctgcttcgagaccctgaacccaccgtgcctgccgccgtcatgcgatcaggcgcctccggagatcttcgacatcgccggacacttcgcccggtcgggaagcgtcgccgagcttcccaggacccccgtcctgtgcaagcccaacgttggcgccatggaggcggccctcaggatcgccaacgtcaacccctacaaggcgattttcttcgacgacagcgtgcgtaacattcaggccggcaagataatcggtctccacacagtgctggttggcacgtcgcaccgggtgaagggcgcggatcacgcgctggagagcatccacaacatcagagaggcgctgccggagctgtgggaggaggcggagaagacggaggacgtcctctacaccgatcgcgttgcgatcgagacctcggtgaccgcgtagatgccgctggctcctacggtgcacctcaacacaagccgattcaactcccagcctgccggactggcgatcttcatgtggaattcagcactggccgggacagcagtttccaacaagacggggggagagttcagaaattcagggaatgcagcatgcgcatcatgctttggccggtcctagtatatgtatatgtatcgatcagatctttgcttgtaaattactactactaggagtaaaatctataatgattaataaacaaaagagggttttcttgtatgcgaattattcgtgtttagctgaagcaataatgaaggacttgg

SEQ ID NO: 946 - DNA, 1347 bp, Triticum aestivum
  misc_feature (649)..(649): n is a, c, g, or t
tctctctctcctccatacgcctcgcctcttgagcgcgctcttgaaggaaggctccagacctctgccttctgctctccccggctctgcatccgcgagagctgttgcattgctgcagctcgcgagcgcccgggtccttagtagttctttcaccacagcccggatcatggagttcgacgagcgctgcctcaaggtccaggagcccaaatttgattgcctcctctttgacctcgacgacactctgtacccgctgagctcggggatctcatcacacgtcaagaccaacattgaagcttacatgattgagaagctgggtattgatgagagcaagatcgaaaaccttggcaacctgctgtacaagaactatggcaccacgatggcgggcctcagggcaattggctacaacttcgactacgatgagtaccacagctttgtccatggaagactgccctacgacaacatcaagccagaccccgttctgaagcagattctcaagaacatgcgcatccgcaagctcattttcaccaacggtgacatgatccatgccgtgagagccctcaagaggctgggcctggaggactgcttcgaggggatcatctgcttcgagaccctgaacccgccgtgcctgctgacgccgtgcgaccaggcgccngagatcttcgacatcgccggccacttcgccgggttaggcagcgccgacgacctgcccaggacccccgtcctatgcaagcccaacgtcggcgccatggaggcggccctcaggatcgccaacgtcaacccttacaaggcgattttcttcgacgacagcgtgcgcaacattcaggctggcaagcgaatcggcctccacacagtgctggttggcacgtcacagcgggtgaagggcgcggatcacgcgctggagagcatccacaacatccgggaggcgctgccggagctgtgggaggaggccgagaagacggaggacgtgctctactcggaccgcgtggcgatcgagacctcggtgaccgcgtagacgccgctggctctcggtgcaccttcagtctgataccccaagcgcaacccgattcgaccccagcctgccggacagatgatcttcacgtggaatgctcttcagcattggccgggaaaccagtacagtatccatcacgaggagaggagggggagttcagaaagtcaggaattaatgcagcatgcgcaccatgccgggccggtcctaatatatgtatatgtatgtgtcgatcagatctttgcttgtaaattactactactagtaaggaggaataataaagagaaaaacggggttacttgtacgcgacttattcgtatttagccggagcaataaatcaagga

SEQ ID NO: 947 - DNA, 1426 bp, Triticum aestivum
tttaaaaataatccagtattccaaacatagtctgaactagaaaaaaatgtacatgcggcgccccccactcccgctctccatctctctgtccccatacgcctcgcctcttgagcgcgctcttgaaggaaggctcgacacctctgccttctgctctcctcggctctgcatccgtgagagctgttgcattgctgcagctcgcgagcgcccgggtcgttagtagttctttcaccacagcccggatcatggagttcgacgagcgctgcctcaaggtccaggaccccaaatttgattgcctcctctttgacctggacgacactctgtacccgctgagctcggggatctcatcacacgtcaagactaacattgaagcttacatggttgagaagctgggtattgaggagagcaagatcgaaaaccttggcaacctgctgtacaagaactatggcaccacgatggcgggcctcagggcaattggctacaacttcgactacgatgagtaccacagctttgtccatggaagactgccctacgacaacatcaagcccgaccccgttctcaagcagattctcaagaacatgcgcatgcgcaagctcattttcaccaacggtgacatgatccatgccgtgagagccctcaagaggctgggcctggaggactgcttcgaggggatcatctgcttcgagaccctgaacccgccgtgcctgctgacgccgtgcgaccaggcgcccgagatcttcgacatcgccggccacttcgccgggttaggcagcgccgacgacctgcccaggacccccgtcctatgcaagcccaacgtgggcgccatggaggcggccctcaggatcgccaacgtcaacccttacaaggcgattttcttcgacgacagcgtgcgcaacattcaggcaggcaagcgaattggcctccacacggtgctggttggcacgtcgcagcgggtgaagggcgcggatcacgcgctggagagcatccacaacatcagggaggcgctgccggagctgtgggaggaggccgagaaggcggaggacgtcctctacgccgatcgcgtggcgatcgagacctcggtgaccgcgtaagacgccgctggctcccggtgcaccttcagtctgataccccaagcgcaacccgattcgacccgagcctgccggacaggtgatcttcacgtggaatgctcttcagcatttgccgggcaaacagtatccatcacgaggagaggagggggagttcagaaagtcaggaattaatgcagcatgcacaccatgccgggccggtcctaatatatgtacatgtatcgatcagatctttgcttgtaaattactactgctaggtggaatgaataataaaaaagaacggggttacttgtaagcgagttattcgtatttagccgaagcaataaatcaaggacttggccaaa

SEQ ID NO: 948 - DNA, 1351 bp, Leymus cinereus x Leymus triticoides
  misc_feature (20)..(20): n is a, c, g, or t
  misc_feature (28)..(28): n is a, c, g, or t
  misc_feature (50)..(50): n is a, c, g, or t
  misc_feature (58)..(58): n is a, c, g, or t
  misc_feature (67)..(67): n is a, c, g, or t
  misc_feature (388)..(388): n is a, c, g, or t
  misc_feature (397)..(397): n is a, c, g, or t
  misc_feature (518)..(518): n is a, c, g, or t
  misc_feature (539)..(539): n is a, c, g, or t
  misc_feature (1035)..(1035): n is a, c, g, or t
  misc_feature (1247)..(1247): n is a, c, g, or t
gctctccctctccgtttctntacacctngcctttggagcgctcttgaagnctcgaganctctctgtnttttgctcctcgcctttgcatccgcggcagctgttgcattgcagctcgcgagcgcccgagtcgttagtagtccgaatcatggagttcgacgagcgctgcctcaaggtccaggagcccaagttcgactgcctcctctttgacctcgacgacactctctacccactgagctcggggatctcatcacacgtcaagacgaacattgaaggttacatggttgaaaagctgggtatcgaagagagcaagatcgaaaaccttggcaatctgttgtataagaactatggcacaacgatggcaggcctcagggctattggctacaacttngattacgangagtaccacagctttgtccatggaagactgccctacgacaacatcaagcccgaccccgttctcaagcacattctcaagaacatgcgcatccgcaaactcatcttcaccaacggcgacatgntccatgccgtgagagccctcnagaggctgggcctggaggactgcttcgaggggatcatctgcttcgagaccctgaaccagccgtgcctgctgccgcagtgcgaccaggcgccgaagatcttcgacatcgccggccacttggccgggtcaggcagcgccgacgacctgcccaggacccccgtcctatgcaagcccaacgtcggcgccatggaggcggccctcaggatcgccaacgtcaacccttacaaggcgattttcttcgacgacagcgtgcgcaacattcaggcaggcaagcgaattggcctccacacggtgctggttggcacgtcgcaccgggtgaagggcgcagatcacgcgctggagagcatccacaacatcagggaggcgctgccggagctgtgggaggaggccgagaaggcggaggacgtcctctactccgatcgcgtcgcgatcgagacctcggtgaccgcgtagacgccgctggctcccggtgcaccttcagcctgataccccaagcncaacccgattcgacccggcatccccgagcctgccgtactggtgatcttcacgtggaattcagcattggccgggaaaacagtatccagcacgaggagggggagttcagaaagtcaggaatgcagcatgcacaccatgctgggccggtcctaatatatgtatatgtatgtatcgatcagatctttgcttgtaaattactgctactaggaggaangaataataaacaaaaacggggttacttgtacgcgagttatttcttatttagccgacgcaataaatcaaggacttgggcagacgatgaacatgtctcctcctcta

SEQ ID NO: 949 - DNA, 1345 bp, Triticum aestivum
tctccatacgcctcgcctttggagcgctcttgaaggaagcctcgagacctctgccttctgctctcctcggctctgcatccgcgagagctgttgcattgctgctgcagctcgcgagcgcccgggtcgttagtagttcttttcaccgcaccgcagtccggatcatggagttcgacgagcgctgcctcaaggtccaggaccccaaatttgactgcctcctcttcgacctcgacgacactctgtacccgctgagctcggggatctcatcacacgtcaagaccaacattgaagcttacatggttgagaagctgggtattgaggagatcaagatcgagaacctcggcaacctgctgtacaagaactatggcacgacgatggcgggcctcagggcaatcggctacaacttcgactacgatgagtaccacagctttgtccatggaagactgccctacgacaacatcaagcccgaccccgtcctcaagcagattctcaagaacatgcgcatgcgcaagctcattttcaccaacggtgacatgatccatgccgtgagggccctcaagaggctgggcctggaggactgcttcgaggggatcatctgcttcgagaccctgaacccgccgtgcctgctgacgccgtgcgaccaggcgccggagatcttcgacatcgccggccacttcgccgggttaggcagcgccgatgacctgcccaggacccccgtcctgtgcaagcccaacgtcggcgccatggaggcggccctcaggatcgccaacgtcaacccttacaaggcgattttcttcgacgacagcgtgcgcaacattcaggcgggcaagcgaatcggcctccacacggtgctggttggcacgtcgcagcgggtgaagggcgcggatcacgcgctggagagcatccacaacatccgggaggcgctgccggagctgtgggaggaggccgagaaggcggaggacgtcctctacgccgaccgcgtggcgatcgagacctcggtgaccgcgtagacgccgctggctcccggtgcaccttcagtctgacaccccaagcgcaacccgatccgacccgagcctgccggacgggtgatcttcacgtggaattcagcattggccgggaaaacagttacagtatccatcacgaggagaggagggggagttcagaaagtcaggaattaatgcagcatgcacaccatgccgggccggtcctagtatatgtatatgtatatgtgtcgatcagatctttgcttgtaaattactactagtaggaggtataataaagaaaaaccggggttacttgtacgcgagttattcgtatttagccgaagcaataaatcaaggacttggcc

SEQ ID NO: 950 - DNA, 1345 bp, Pseudoroegneria spicata
cctctctgtctccatacgcctcgcccttggagcgcgctcttgaaggctcgagctcgagacctctgcctttcgctcctcgccttcgcatccgcgagcgctgttgcattgctgcagctcgcgagcgcccgagtcgttagtagttctttcgccacagtccggatcatggagttcgacgagcgctgcctcaaggtccaggaccccaagttcgactgcctcctcttcgacctcgacgacactctgtacccactgagctcggggatctcatcacacgtcaagaccaacattgaagcttacatggttgagaagctgggtattgaggagagcaagatcgaaaaccttggcaacctgctgtataagaactatggcacgacgatggcgggcctcagggcaattggctacaacttcgattacgatgagtaccacagctttgtccatggaagactgccctacgacaacatcaagcccgaccccgttctcaagcagattctcaagaacatgcgcatccgcaagctcattttcaccaacggtgacatgatccatgccgtgagagccctcaagaggctgggcctggaggactgcttcgagggcatcatctgcttcgagaccctgaacccgccgtgcctgctgatgccgtgcgaccaggcgcctgagatcttcgacatcgccggccacttcgccgggttaggcagcgccgacgacctgcccaggacccccgtcctatgcaagcccaacgtcggcgccatggaggcggcgctcaggatcgccaacgtcaacccttacaaggcgattttcttcgacgacagcgtgcgcaacattcaggcaggcaagcgaattggtctccacacagtgctggttggcacgtcgcaccgggtgaagggcgcggatcacgcgctggagagcatccacaacatcagggaggcgctgccggagctgtgggaggaggccgagaagacggaggacgtcctctactccgaccgcgtcgcgatcgagacctcggtgaccgcgtagacgccgctggctcccggtgcaccttcagtctgatactccaagcacaacccgattcgacccggcatcccccggcctgccggacaggtgatcttcacgtggaattcagcattggccgggaaaacagtatccatcacgagaggaggggcagttcagaaagtcaggaatgcagcatgcacaccatgccgggccggtcctaatatatgtatatgtatgtatcgatcagatctttgcttgtaaattactactactaggaggaataataaacaaaaacggggttacttgtacgcgagttattcgtatttagccggagcaataaatgaaggacttggccagacga

SEQ ID NO: 951 - DNA, 1427 bp, Zea mays
ggccctatccagaagtccagaaccttccccaatcacccacacggccacacctggccccgcccaacttccatttatgcacaggcggactcgcggactcggggctcgtaccaacaggaaaaaaggcccagaggcagtgccgtgaccgattcgagacgcaagagaaggatcgagacgaggcggcggttttccggggcagcatcgtctcggccacgaagatgtcttactcaaggggctcaagtgaaaggtatggatctcgctcaccttactcgagaagcacaaggtaccgaagtcgctctaggagtgtcgactctagtgatgctgaaaaccctgggaacaacctgtatgtgactggtttgtcggctcgtgtaacggatcgagatctggagaagcacttctccactgagggtgaggtgattgatgcaagcgttgtgtatgatccttggacaagggaatcacgggggtttggttttgttaccatggctgctgttaaagatgcagatcgctgcatcaaatatctggaccgttctgtgttgcaaggtcgggtcataactgttgagaagattttgttgacagcaacagggtagatgttggtagctgctctgcaacaaactgatacaacctaacaccaaaccatgccaacctcagccaaagggcaaagagaagacgaggtagaaccccaacacctgggaagtatcttggcacaaaatcatcccgtggacggaggtactccacaagctactcacctgatcggaggggccgttacagttcccgctactcacctgatcggagggactgtcatggtagagaccggtcatactctccatatgacagaaggcgatcatactctccttacggcagggatgaatcatattccccttactatggccggcgatcatactcaccttactacagcagacggtatcgttcaaggtccccatactgctacagaagacgtaggtcaccttctgtttcgccatactaccgccggcacaggtacagatctgtctccaagtcatccagttcatctccaagggccagaggacggagctattcgtgcagtttatcaccacagagaagctactcgcgcagccattccccagaatccgagagatcaacaagctattctcctaagaaagggagtaaaagggaaccctcgcgtagcagatactctggcaagagtcgtcattcaagggaaagccactctcatagccgcagttcgtactccaggtctgtgtccagggagcgctcagcttgatctgcgaggtgtgtcgtcctaggtggttataagatatgcgctgtatttgcatctatcagaacttgtgtacttcgtatattacgaacttgagaactgtatggatgtgtgcattgtgccaaattatgttcattctgtactatctttctgatgctatcttgctattgttggtttg

SEQ ID NO: 952 - DNA, 1366 bp, Panicum virgatum
gcccaaggctttgccataaccgacgcgagagtcgactcgagacgcaagagaagggagggccgccggggcaggatcgtcgcggacacgaaagatgtcttactcaagaggatcaaggtatgaatctcgctcaccttacaggagaagcagctattcaaggtacagaagtcgctctaggagtgtggactcaagtgatgctgaaaaccctgggaacaacctgtatgtgactggtctgtcagctcgtgtaactgatcaagatcttgagaagcacttttctactgagggagaggtgattgatgcgagtgttgtgcaagatccttggacaaaggaatcacgagggtttggttttgttaccatggctactgttaaggaggcagatcgctgcatcaaatatttggaccgttctgttttggaaggtcgtgtcataactgttgaaaagattttgttgacagcaacagggtagatgttggtagctgctctgcaacaaactcatacaacctaacaccaaatcatgccacctcaaccaaagggttgtatggcaaaaagaaaacgaggtagaacgccaacacctgggaagtatcttggtacaaaatcatcacgtggacggaggtattccccaagctactcacctgttcggagggaccgttgcagttcacgatattcacctgatcgcgaacggtcttattctccttatagtagacgccgatcgtactcaccctatgacaggcgaagatcgcgctccccctacgacagacggagatcatactcaccctatgagcggcgccggtcatactcgccttactacagcagccggcaccgttcaaggtctccatatcgctacaggagacgtaggtcaccttcctatgaccgatccgcttcaccctacaggcgccggtatagatctgtctccaggtcacccagtgcttctccaagggccagaggccggagctattcccgcagtttatcatcacacagaagctactctcgaagctgctccccagtgtcagaaagatcagcgagctactctccaaagagagggcgtagtacaaaggaacactcacgcagcagatcttctggcaagaggcgtcgttcaagggaaagctattctcacagccgcagttcgtactctaggtctgtctctagggagcgctcagcttgagctgcaggcctgtgtcctagtcctccttgtccttggtaactgcctaactggtaagaataagacgcagcctgtattcatgcgatacatgtgggtattctgaagtctgaactttgagcagcgtgggatttgtttattttactgcattatgtttagtttgtatgagatcctgctacatttcagatatacagtatatgtttgatttcgttggcc

SEQ ID NO: 953 - DNA, 1553 bp, Pennisetum glaucum
gtctattcgtctatttaatcacgcacacggggtcactggaagaaagggcaagacagtgctgtaatcgacgcgagacgcaagcgagaggttcgccggggcaggatcgttgcggccacgaaagatgtcttactcaagaggatcaaggtatgaatctcgctcaccatacaggagaagcagctattcaagatacaggagtcgctctaggagcgtggactcgtgtgatgctgaaaaccctgggaacaacctgtatgtaactggtttgtcagctcgtgtaacggaccgggatctggagaagcacttttctactgagggagaggtgattgatgcaagtgttgtgcatgatccttggacaagggaatcgcgagggtttggttttgttaccatggctactgttaaggaggcagatcgctgcatcaaatatttagaccgttctgtgttggaaggtcgggtcataactgttgagaaggtaaaatcataagagtgcctacgagtgaaatttttatttaacttctcgatggagtgatatttatatctctgattagtcttttatgctgaacttttgagtgttcttctgttcgttgaagtttttgttggcagcaacagggcagatgttggtagatgctctgcaacaaactcataccacctaacaccaaatcatgccacctcaaccaaagggttgtatgccctacattgcattatattttgtatttaatgtattattcagattctcaataattgaccactcttgcttttaatgtcaaaaacaccttcttatagagtcccacgttatgcaggcaaagagacgacgaggtagaaccccaacacctgggaagtatcttggcacaaaatcatcacgtgggcggaggtccccaagctactcacctgttcggagggaccgttacagttcacgctactcacgtgatcgtgaacgatcttattctccttatagtagacgccgatcatactccccctatgatcgccgcaggtcacactcgccttactacagcagtcggtaccgttcaaggtctccataccgctacagaagacggaggtcaccttccgatgaccgttccgcttcaccatactacagcaggcgccgataccgatctgtctccaggtcacccagtgcttctccaagggccagaggccggagctattcccgcagtttatcaccacagggaagctattctcgaagctgttctccagtgtcagaaagatcaacgagctattctccaaagaaaggtcatagtagaagggaacgctcccggagcagatcttctggcaagaggcgccgatcaagggaaagctattctcacagccgcagctcttactccaggtctgtctcgagggagcgttcagcttgagcgtgtactacagtagcaagaagaataaggtgtcctgtattcgtgggaactgatgtatgttaactttgaaattgtgaacctgaaacagcgtgggatgtgtgcattgttttaaggttggtgtgtgcaatcttagtgtactgtttatgttatatggatattgtttatgttatatggatattgtttatgttt

SEQ ID NO: 954 - DNA, 1642 bp, Saccharum officinarum
aacgtccatttattcacaggcgcactcaggccaacagaaagaaaaggcccagacagtgccgtgaccgactcgagacgcaagagaaggatcgagacgaggcggcggcttcccgggggcaggatcgtcgcggccacgaaagacgatgtcttactcaagaggatcaagtgaaaggtatggatctcgctcaccttactcgagaagcagctattcaaggtacggaagtcgctctaggagtgtggactcaagtgatgctgaaaaccctgggaacaacctgtatgtgactggtttgtcagctcgtggaacggatcgagatctggagaagcacttttccaccgagggagaggtgattgatgcaagcattgtgcatgatccttggacaagggaatcacgggggtttggttttgttaccatggctactgttaaggaggcagatcgctgcatcaaatatctggacccttctgtgttggaaggtcggatcataactgttgagaaggtaaaatcatgagatcgggaacatctgaacttccttatttaactgtgctactgaatgatatttatatcgttgcttagtactctacactgaacattttagtgttcttctgtccattgaagattttgttgacagcaacagggtagatgttggtagctgctctgcaacaaactgatacaacctaacaccaaaccatgccacctcagccaaagggttgtatgccctacattgtatattattatttttcttaaatgtgtttattcagattgtagataattgctctcttgcttttggtatcaaagacactttcttatctggtcccctattacacaggcaaagagaagacgaggtagaaccccaacacctgggaagtatcttggcacaaaatcatcacgtggacggagatactccccaagctactcacctgttagaagggaccgttacagttcccgctactcgcctgatcggagggaccgttacaattcccgctactcacctgatcgtgacctgtcttattctccttatggtagaggccggtcatactctccatatgacagaaggcgatcatactctcctaacggcaggcatggatcatattccccctacgatcggcggcggtcacactcgccttactacagaagccggtatcgttcaaggtctccatactgctacagaagacggaggtcaccttctgtttcgccatactacagccggcgctggtatagatctgtctccaagtcacccagtgtttctccaagggccagagggcggagctattcctgcagtttatcaccacagagaagctactctcgcagccattccccagaatcggagagatcaacgagctactctcctaagaaagggagtagaagggaaccctcacgtagcagatgttctggcaagaggcgtcattcaagggaaagctactctcatagccgcagttcgtactccaggtctatgtctagggagcgctcggcttgatctgcgaggtgtatcgtcctaggtggtggttataagatatgccctgtatctgtatttgtcagaactgatgtattttcaaggtcattactctggtattgtgaacttgagaacagcatggatgtgtgcattgtactatattatgttcattttgtatgagacagtgatacattt

SEQ ID NO: 955 - DNA, 825 bp, Panicum virgatum
gcccaaggctttgccataaccgacgcgagagtcgactcgagacgcaagagaagagagggccgccggggcaggatcgttgcggacacgaaagatgtcttactcaagaggatcaaggtatgaatctcgctcaccttacaggagaagcagctattcaaggtacagaagtcgctctaggagtgtggactcaagtgatgctgaaaaccctgggaacaacctgtatgtgactggtctgtcagctcgtgtaactgatcaagatcttgagaagcacttttctactgagggagaggtgattgatgcgagcgttgtgcaagatccttggacaagggaatcacgagggtttggttttgttaccatggctactgttaaggaggcagatcgctgcatcaaatatctggaccgttctgttttggaaggtcgtgtcataactgttgaaaaggtaaattcagaatattgcttacttgtgaacttcaatatttaagttctctacagagtgatatttatatctctgattagtcttctaagctgaacttttgagtgttcttctgttcgttgaagattttgttgacagcaacagggtagatgttggtagctgctctgcaacaaactcatacaacctaacaccaaatcatgccacctcaaccaaagggttgtatgccctacattgtataatttttgttttaaatgttttattcagattctcaacaatcgatcactcttgcttttaatgtcaaaggcactttcttatccagtcccctattgcacaggcaaaagaaaacgaggtagaacgccaacacctgggaagtatcttggtacaaaatcatcacg

SEQ ID NO: 956 - DNA, 1215 bp, Panicum virgatum
ggagaagcagctattcaaggtacagaagtcgctctaggagtgtggactcaagtgatgctgaaaaccctgggaacaacctgtatgtaactggtctatcagctcgtgtaactgaccgagatctggagaagcacttttctactgagggagagctgattgatgcgagcgttgtgcaagatccttggacaagggaatcacgagggtttggttttgttaccatggctactgttaaggaggcagatcgctgcatcaaatatctggaccgttctgttttggaaggtcgtgtcataactgttgaaaagattttgttgacagcaacagggtagatgttggtagctgctctgcaacaaactcatacaacctaacaccaaatcatgccacctcaaccaaaggacccctatcgcacaggcaaaaagaagacgaggtagaacgccaacacctgggaagtatcttggtacaaaatcatcacgaggacggaggtattcgccaagctactcacctgttcggtgggaccgttacagttcaagatattcacctgattgtgaatggtcttattctccttatagtagacgccgatcgtactccccctatgacaggcgaaggtcgcgctccccctacgacagacggagatcatactccccctatgatcgccgctggtcatactcgccttactacagcagccggcaccgttcaaggtctccatatcgctacaggagacgtaggtcaccttcctatgaccgatccgcttcaccctacaggcgcagatatagatctgtctccaggtcacctagtgcttctccaagagccagaggccggagctattcccgcagtttatcatcacagagaagctactctcgaagctgctccccagtgtctgaaagatcagcgagctactctccaaagaaagggcgtagtagaaaggaacgctcacgcagcagatcttccggcaagaggcgtcgttcaagggaaagctattctcacagccgcagttcgtactctaggtctgtctctagggagcgctcagcttgagctgccggcctgtgtcctagtctccatgtccttggtaaagaataagacgcgacctgtattcatgggagctgatgtatgttaaacgtctatatgtgggtattctgaagtctgaactttgagcagcgtgggatttgtgtattctaatgtattctgtttactttgtatgagatcctgctacatttcagatat

SEQ ID NO: 957 - DNA, 704 bp, Avena sativa
gaagtcataactgacaaaggcagtctcgaagcgaaagacagagggaggcttcggcggtcaggatcgcagcggcgacgaaagatgtcgtactcgagaggaccaaggcaaagtagctattcaaggtataggagtcgttcacggagcgtggattcaagtgacgttgaaaaccctgggaacaatctatacgtgactggtttgtcatctcgtataacagatcgagatctggagaagcacttctctaccgagggagaggtgatcgacgcaagtattgtgcttgatccatggacgagagaatcacgaggatttggttttgttaccatggccacacttaaggaggcggagcgctgcatcaaatatctggaccattcagtgctggaaggtcgagtcattactgttgagaagcttttgttgacagcagcaggtagatgcccgcagctgctccccatcaaatgcaaaagacacacaacctaacaaagaaaccatgctacctcaaccaaagggcaaagagaagacgaggtcgaaacccaactcctggaaggtatcttggctctaaatcatcgcgtggacggaggaattccccaagcatgtcacctgttaggagagaccgttacagctcacgctactcgcctgagtgggagggttcttattctccctataacagagggcgatcgcactctcgacatgacaggaggcgatcatactct

SEQ ID NO: 958 - DNA, 1169 bp, Panicum virgatum
gcgcacaaggagcgccgggaaggaatgcccaagcccaaggcagtaccataaccgacgcgagagtcgagacgcgagagaagagaggggagcgagaaggcttcgccggggcaggatcgttgcggccacgaaagatgtcttactcaagaggatcgaggtatgaatctcgctcaccttacaggagaagcagctattcaaggtacagaagtcgctctaggagtgtggactcaagtgatgctgaaaaccctgggaacaacctgtatgtaactggtctatcagctcgtgtaactgaccgagatctggagaagcacttttctactgagggagagctgattgatgcgagcgttgtgcaagatccttggacaagggaatcacgagggtttggttttgttaccatggctactgttaaggaggcagatcgctgcatcaaatatctggaccgttctgttttggaaggtcgtgtcataactgttgaaaaggtaaattcagaatattgcttacgtgtgaacttcaatatttttaagttctctacagactgatatttatatctctgattagtcttctaagctgaacttttgagtgttcttctgttcgttgaagattttgttgacagcaacagggtagatgttggtagctgctctgcaacaaactcatacaacctaacaccaaatcatgccacctcaaccaaagggttgtatgccctacattttatatttttgtattaaatgttttattcagattctcaacaatcgatcactcttgcttttttaatgtcaaagacactttcttatccagacccctatcgcacaggcaaaaagaagacgaggtagaacgccaacacctgggaagtatcttggtacaaaatcatcacgaggacggaggtattcaccaagctactcacctgttcggagggaccgttacagttcacaatattcacctgatcgtgaacggtcttattctccttatagtagacgccgatcgtactccccctatgacaggcgaggcgaaggtcgcgctctccctacgacagacggagatcatactccccctatgatcgccgccggtcatactcgccttactacagcagccggcaccgttcaaggtctccatatcgctacaggagacgtaggtcacctttcctatgaccgatccgcttcaccctacaggcgcag

SEQ ID NO: 959 - DNA, 777 bp, Saccharum officinarum
  misc_feature (632)..(632): n is a, c, g, or t
cagtcactgtcgtccccaaaccacagcgcgacactgaggacagcaggtcagcagctgcgagtgcgagagcgtcagaccgtgtgaagcaggaggacgagaagccgatggcggttgtgagcggcagcggcggcgggaggctgaacccctgggcggagcccttcgtgccttccggggtgcggtaccgcggcctgcagacggcggaggcggcgccggagcaggaggtggaggacttctcccccgagtggtggcgcctggtgtccgcctccccggccttccgcgaccgctggctccgcgagtacggcgcgctcggcctgctcgacgccgaggaggacctggacgacgacgcggaggtcgacggcttcctccccgacgacttcttctcccctccggccccgcgccaagagagcgagcgggaggacgccgcgcccggggctggtaagaaggccagcggaggacttgaagtggcggcgtggggcattgacaagtggtggcgggcgcacgggggtccgccggaggccccgaggtacgcggagaaggcgccgcggagggtgaccgccggcgccagggtgagcccccgccccatccagcagccgcgctgaaggacccgttctatccgttcccgcgcacgcgtncattcaccgacggctggtcaatggcagatctgggcaccaggaaaaataaggcccccgaaaaaaaattctttttcaatcttgcaattggtttgggtcttcgcttgcccaagttctggatttgactttgctttggcttaaaatggaa

SEQ ID NO: 960 - DNA, 887 bp, Saccharum officinarum
atcgtccccaaaccacagcgcgacactgaggacagcaggtcagcagctgtgagtgcgagagcgtcagaccgtgtgaagcaggaggacgagaagccgatggcggtcgtgagcggcagcggcggcggcaggctgaacccctgggcggagcccttcgtgccttccggggtgcggtaccgcggcctgcagacggcggaggcggcgccggagcaggaggtggaggacttctgccccgagtggtggcgcctggtgtccgcctccccggccttccgcgaccgctggctccgcgagtacggcgcgctcggcctgctcgacaccgaggaggacctggacgacgacgcggaggtcgacgacttcttctcccctccggccccgcgccaagagagcgagcgggagaacgccgcgcccggggctggtaagaaggccagcggaggacttgaagtggcggcgtggggcatcgacaagtggtggcgggcgcacgggggtccgccggaggccccgaggtacgcggagaaggcgccgcggagggtgaccgccggcgccagggtgagcccccgccccatccagcagccgcgctgaaggacccgttctatccgttcccgcgcacgcgtccatccaccgacggctgctcagtgccagatcttggcacaggaaaaattaggcacccaaaaaaaaaatccttttccaatcttgcaatttgctttggtcttcgtcttgcgcagtttctggatctggactctgcttcggctagaaatggaataggaagatcctctgcgttgtctatgctcatccctgtaatgtaaatatgatgatgtaataacaataacatgcagtgagactttagctttcaaaaaaacaacgtacggcacaacagcccacgctcaacacaa

SEQ ID NO: 961 - DNA, 827 bp, Saccharum officinarum
tcgtccccaaaccacagcgcgacactgaggacagcaggtcagcagctgtgagtgcgagagcgtcagaccgtgtgaagcaggaggacgagaagccgatggcggtcgtgagcggcagcggcggcggcaggctgaacccctgggcggagcccttcgtgccttccggggtgcggtaccgcggcctgcagacggcggaggcggcgccggagcaggaggtggaggacttctgccccgagtggtggcgcctggtgtccgcctccccggccttccgcgaccgctggctccgcgagtacggcgcgctcggcctgctcgacaccgaggaggacctggacgacgacgcggaggtcgacgacttcttctcccctccggccccgcgccaagagagcgagcgggaggacgccgcgcccggggctggtaagaaggccagcggaggacttgaagtggcggcgtggggcatcgacaagtggtggcgggcgcacgggggtccgccggaggccccgaggtacgcggagaaggcgccgcggagggtgaccgccggcgccagggtgagcccccgccccatccagcagccgcgctgaaggacccgttctatccgttcccgcgcacgcgtccatccaccgacggctgctcagtgccagatcttggcacaggaaaaattaggcacccaaaaaaaaattccttttccaatcttgcaatttgctttggtcttcgtcttgcgcagtttctggatctggactctgcttcggctagagatggaataggaagatcctctgcgttgtctatgctcatccctgtaatgtaaatatgatgatgtaataacaataacatgc

SEQ ID NO: 962 - DNA, 698 bp, Saccharum officinarum
  misc_feature (109)..(110): n is a, c, g, or t
  misc_feature (116)..(116): n is a, c, g, or t
  misc_feature (128)..(128): n is a, c, g, or t
  misc_feature (133)..(133): n is a, c, g, or t
  misc_feature (192)..(193): n is a, c, g, or t
  misc_feature (216)..(216): n is a, c, g, or t
  misc_feature (490)..(490): n is a, c, g, or t
  misc_feature (537)..(537): n is a, c, g, or t
  misc_feature (545)..(546): n is a, c, g, or t
  misc_feature (585)..(585): n is a, c, g, or t
  misc_feature (591)..(592): n is a, c, g, or t
cgtacagtcactatcgtccccaaaccacagcgcgacactgaggacagcaggtcagcagctgcgagtgcgagagcgtcagaccgtgtgaagcaggaggacgagaagccgnnggcggntgtgagcggcancggcngcgggaggctgaacccctgggcggagcccttcgtgccttccggggtgcggtaccgcggnntgcagacggcggaggcggcgccngagcaggaggtggaggacttctgccccgagtggtggcgcctggtgtccgcctccccggccttccgcgaccgctggctccgcgagtacggcgcgctcggcctgctcgacgccgaggaggacctggacgacgacgcggaggtcgacggcttcctccccgacgacttctcccctccggccccgcgccaagagagcgagcgggaggacgccgcgcccggggctggtaagaaggccagcggaggacttgaagtggcggcgtggggcatcgacaagtggnggcgggcgcacgggggtccgccggaggccccgaggtacgcggagaangcgccgcnnagggtgaccgccggcgccagggtgagcccccgccccatncagcanncgcgctgaaggacccgttctatccgtttcccgcgcacgcgttcattcaccgacggttggttagtgccagatcttggcacaggaaaaattaggcacccaaaaaaaaa

SEQ ID NO: 963 - DNA, 895 bp, Zea mays
atcatcgtctccaatccagagagccgtaccaatccccatcgccccagaccacagcgcgacagtgagtacagcagcagcagctgagagcgtgagagcgtgcgaagcaggagggaggacaagaagaagccgatggcggttgtgagcggcagcggcgggaggctgaacccctgggcggagcccttcgtgccttccggggcgcggtaccgcggcctgcggaccgtggaggcgacgccggagcaggaggtggaggacttctcccccgagtggtggcgcctggtgtccgcctccccggccttccgcgaccgctggctgcgcgagtacggcgcgctcggcctactcgacgccgaggacgacctggacgacgacgtcgacagcttcctccccgacgacttcttctcgcctccggccccgcgctacgagagcgagcgggaggacgccgcgggcaggagggcgggccgagggcttgaggtggcggcgtggggcatcgacaggtggtggagggcgcacggtgggccgccggagaccccgaggtacgcggagaaggcgccgcggagggtggccgccgccgccagggtgagcccccgccccatccagcagccgcgctgaaggaccagatccgttcatccaccgacggcgacggctgctcagtcagtgtcacatcttggcacgggggaaaaataggcacgaaaaaaaaagagttccctttcttgaatcgatgcagtttgctttggtgttcgtctcgcgcagtttctggatctgggctccgcttcagctcgagatcgactgggatgggaagatcctctgctgcgttgtcttgtctgtgctcatccgtgtgtactgtgtaaatatgaagatgtaataacaaaaacacgcattttagctttcagtttcgggc

SEQ ID NO: 964 - DNA, 795 bp, Saccharum officinarum
  misc_feature (675)..(675): n is a, c, g, or t
agtcactatcgtccccaaaccacagcgcgacactgaggacagcaggtcagcatatgcgagtgtgagagcgtcagaccgtgtgtgtgaagcatgaggacgagaagacgatggcggttgtgagcggcagcggcggcgggaggctgaacccctgggcggagcccttcgtgccttccggggcgcggtaccgcggcctgcagacggcggaggcggcgccggagcaagaagtggaggacttctcccccgagtggtggcgcctggtgtccgcctccccggccttccgcgaccgctggctccgcgagtacggcgcgctcggactgctcgacgccgaggaggacctggacgacgacgcggaggtcgacggctttcttcccgacgacttcttctcccctccggacccgcgccaagagagcgagcgggacgacgccgcgcccggggctggtaagaaagccagcggaggacttgaaatggcggcgtggggcatcgacaagtggtggcgggcgcacggtggtccgccggaagccccgatgtactccgagaaagcgccgcggaaggtgaccggccgcgcccaggtgaagccccgccccaatcaagagccgcgctgaaggacccgttctatatccgtcccgggcacgcgtaccgtcaccgacggttgctcaatgccagatcttggcacangaaaaattagccccccgaaaaaaaattccttttccaattttgcaattggttttggctttcgcctgggcaaatttttggatctggactctgttttcggtggagatggaataggaagaacct

SEQ ID NO: 965 - DNA, 997 bp, Zea mays
gtgtgggcagaaggcgcagcacaggggcctgctacttggtggagaggaggacaaatctgcgaccttttcatcgagtagaagcatcggcgctgtggcggccctcctccttgcccattcctctctttcgattcttcgatgcccatcgtccccaatccagtgagctgtaccaatccccatcgccccagaccagaccaacagtgagtacagcagcagctaagagcgtcagcgtgagagcgtgcgaagcaggagggaggacaacaagaagccgatggcggttgtgagcggcagcggcgggaggctgaacccctgggcagagcccttcgtgccttccggggcgcggtaccgcggcctgcggaccgtggaggcgacgccggagcaggaggtggaggacttctcccccgagtggtggcgcctggtgtccgcctccccggccttccgcgaccgctggctccgcgagtacggcgcgctcggcctactcgacgccgaggacgacctggacgacgacgtcgacagcttactccccgacgacttcttctcgcctccggcccagcgccacgagagcgagcgggaggacgccgcgggcaggagggcgggccgagggcttgaggtggcggcgtggggcatcgacaggtggtggagggcgcacggtgggccgccggagaccacgaggtaagcggagaaggcgccgcggagggtggccgccgccgccagggtgagcccccgccccatccagcagccgcgctgaaggaccagatccgttcatccaccgacggctgctcagtcagtgtcacatcttggcacagggggaaaaataggcacgaaaaaaagttctctttcttgaatcgatgcagtttgctttggtgttcgtcttgcgcagtttttggatctgtgctcctcttcagctcgagatcctctgctgcgttgctcattcctgtactgtgtaaatatgaagatgtaataacaataacacgcagtgtgactttttagctttcagttt

SEQ ID NO: 966 - DNA, 1386 bp, Saccharum officinarum
  misc_feature (655)..(655): n is a, c, g, or t
  misc_feature (699)..(699): n is a, c, g, or t
  misc_feature (725)..(725): n is a, c, g, or t
  misc_feature (793)..(793): n is a, c, g, or t
  misc_feature (803)..(803): n is a, c, g, or t
  misc_feature (1103)..(1103): n is a, c, g, or t
  misc_feature (1346)..(1346): n is a, c, g, or t
  misc_feature (1358)..(1358): n is a, c, g, or t
  misc_feature (1360)..(1360): n is a, c, g, or t
  misc_feature (1369)..(1369): n is a, c, g, or t
  misc_feature (1371)..(1371): n is a, c, g, or t
  misc_feature (1377)..(1377): n is a, c, g, or t
aggcgctaggcgtgaacaccgagaagaagaagcaagccagccaacaaaccgactccctaatcgagtcattgtccagttgtcccctcccctctcgccggcgcttctcttgcctgctccgatggccgctgccgccgcctccacgaagacggcgaacatccccgcgacgatgcgggccgtgcagtacgacgcctgtggcgggggcgccgcgggactcaagcatgtggaagttccagtcccatcggccaaaaagaacgagcttctattgaagctggaagcagcaagcattaatccagtggactggaagatacagaaagggatgttgcggcctttcctgcctcgtaaattgccttttatcccagtgactgatgtggcaggagttgtggctgatgttggtccaggaatcaatggattccaagccggagatcaagttgttgctatgctgaactcatttaatggaggtggacttgcggaatatgctgtggcatcagaaaatctgaccgtcaagaggcctcccgaggtatctgctgctgaaggcgcagggctgcccattgctgctggtactgcgctccaggcgcttaggaccatcggtgccaagtttgacggtactggccagcccttaaacgttctgatcaccgcagcatcaggtggcgtcggnctctacgccgtgcagctcgcgaaactggctggtctccacatcantgctacctgtggcgcgcgtaacgtanagctggtgaagagcctgggcgcagatgaggtgcttgactacaagacgccagagggtgccagcctgcanagcccctcangtaagaagtacgatggtgtcgtccactgcactgtcgggatcagctggtcgacgttcgagcctgtgctagccaccacagggagggtgatagaccttaccccaaacttcactgccatcctcaatcagcgctgcataaggtgaccttcgccaagaagcggctggtgccgctgctcgtgtcgcccaacaaggcggacctagagttcctggtcgggctgctgaaggacggcaacctcaacacgctgattgactcgaggttcccactgagcgaggtgagcaaggcgtgggagaagagcatcgaggnccatgccaccggaaagatcattgtcgagatgggaggctgatctgggatgcctccattgccgacatagacttgcatggagaatatacttagcgtactagtgtctgagtgtggcgtcgtcctacaaattattcgcgactgtgagccagtttataggcttgtttttcttttgttttcccttatgaactttcttgtacagtttaggggtttatggatttgcatggtcgatcagcaaagtcgcattgnaattgcacaatntnggagtgcantntatgcntcaaaggtt

SEQ ID NO: 967 - DNA, 1444 bp, Zea mays
gaggccaacccagaaacatagaaggcgtgtacaccaagaagaagccggccaaccaaccgactcccccgaccctcctgatcgatcgagggccccttgttctagccagttgtccccttccctctcgccggcgttgctcctgcctgctccaatggccgccgcctccacgaagacggcgaacatccccgcgacgatgcgggccgtgcagtacgactcctgcggcgggggcgccgctggactcaagcatgtggaagttccggtcccttcggcgaaaaagaacgagcttctgctgaagctggaggcagcaagcatcaacccagtggactggaaggtgcagaaaggcatgctgaggcctttcctgcctcgtaaattaccttttatcccagtgactgatgtggcaggagtcgtggctgatgttggtccaggaatcaatgggttccaagccggagatcaagttgttgctatgctcaactcatttaacggaggtgggcttgcggagtatgctgtggcatcagaaaatctgaccgtcaagaggcctcctgaggtatctgctgccgaaggcgcagggctgcccatcgccgccggcactgccctccaggcgctcaggaccatcggcgccaagttcgacggtactggaaagcccatgaacgttctggtcaccgcggcatcaggtggcgtcggcctctacgccgtgcagctcgcgaaacgggctggtctccacgtcactgccacctgcggcgcgcgtaacgtagagctggtgaagagcctgggcgccgacgaggtgcttgactacaggacgccggagggtgccaccctgcagagcccctcgggcaagaagtacgatggcgtcgtccactgcactgtcgggaccagctggtcgacgttcgagcctgtgctggccgccacggggaaggtgatcgacatcaccccgaacttgactgccatcctcaaatcggcgctgcacagtgtgaccttcgccaggaagcggctcgtgccactgctcctgtcgcccaacaaggcggacctagagttcctggtcgggctgctgaaggacggcaaactcgagacgctgatcgactcgaggttcccgctgagcgaggtgagcaaggcgtgggagaagagcatcgagggccatgccactggaaagatcattgtcgagatgggagactgatctgggacgcgtccattgccgatagagacttgcagtagcatccactaggctgttggacactacagggttaaagtcaacatatacgaagtagtactagtatctgagtttggtcgtcgtacaaattgttcgtgagtggtgagccagtttataggcttgtttttcttttgttttcagctataaacttgaacttcttgtacagtttagggttttatggggttgcatgatagatccgcaaagttgcattgtaattacatatttgggacttgggagttgcta

SEQ ID NO: 968 - DNA, 1473 bp, Panicum virgatum
caccagcaaccccctcacaccagcaacaccagcaacccagccgtcgaaacccctcctcgcgtcgcgtagtagtatatattctcctcgacctcacacgcaacggaggcagaggaggagaaaacgagaagaccgtgcgggcgggcgtgcacgccgagaagccactgagcgaaccgaccaaccaaccgagaaccgtacccaccccctctcgccggcgctgctcttccctcccccgatggccgccgcgacgatgcgggccgtgcagtacgacgccttcggcgggggcgccgcggacctcaagcttgtggaagttcccgtccctgcggcaaggaagaatgagcttctgttgaagctggaggcggcaagcatcaatccgctggactggaagctacagaaagggatgctacgccctttcctgcctcgcaaactgccttttatcccagtgactgatgtggcaggagttgtgattgatgtcggtccaggagtcaatggattcctggctggagatcaagttgttgccatgctgaacatatcttatggaggtggacttgcggagtacgctgtggcatctgaaaatctgaccgtcaagaggcctcctgaggtgtccgctgctgaaggcgcagggctgcccattgctgctgtcactgcgctccaggctctgaggaccattggcgccaagttcgacggaactggcgagcctttaaatgtgctgatcactgcagcatccggtggtgtcgggctctatgctgtgcagcttgcgaagctggcaggtcttcacatcactgccacctgtggcgcgcgcaatgtggagctggtgaagagccttggcgcggacgaggtgctcgactacaggacgccggagggcgccagcctgcagagcccgtcagggaagaagtacaatggcgtcgtccactgcacagtcgggataagctggtcgacgttcgagcctgtgctcgccaacaccggtagggtgattgacatcaccccgaacttcacagccatcctcaagtcggcgctgcacaaggtgacgtttgccaggaagcggctggtgcccctgctcctgtctcccaacaaggctgacctggagttcctggtcgggctgctgaagggcggcaagatgaagacgctgatcgactcaaggttctctctgagcgaagccagcaaggcttgggagaagagcatcgagggccacgccacaggcaagatcatcgtcgagatggaaggctgatccgccattaacaaaagcagggagacgcaaggtagctggctatagacatacagcgttgacggacaagtagtagcagggtgtctgggtatggcttcgtcgtacagaagaatattggtgaggaactgaggatagatgtttataggattgtgctttttccttgttttcgattgtgaggttcttgagtaggttgggggtttgtggatttgcaccgttgatcagtaaagtggcatcgtagtatttcgtagaac

SEQ ID NO: 969 - DNA, 1087 bp, Saccharum officinarum
aggcgctaggcgtgaacaccgagaagaagaagcaagccagccaacaaaccgactccctaatcgagtcattgtccagttgtcccctcccctctcgccggcgcttctcttgcctgctccgatggccgctgccgccgcctccacgaagacggcgaacatccccgcgacgatgcgggccgtgcagtacgacgcctgtggcgggggcgccgcgggactcaagcatgtggaagttccagtcccatcggccaaaaagaacgagcttctattgaagctggaagcagcaagcattaatccagtggactggaagatacagaaagggatgttgcggcctttcctgcctcgtaaattgccttttatcccagtgactgatgtggcaggagttgtggctgatgttggtccaggaatcaatggattccaagccggagatcaagttgttgctatgctgaactcatttaatggaggtggacttgcggaatatgctgtggcatcagaaaatctgaccgtcaagaggcctcccgaggtatctgctgctgaaggcgcagggctgcccattgctgctggtactgcgctccaggcgcttaggaccatcggtgccaagtttgacggtactggccagcccttaaacgttctgatcaccgcagcatcaggtggcgtcggtctctacgccgtgcagctcgcgaaactggctggtctccacatcactgctacctgtggcgcgcgtaacgtaaagctggtgaagagcctgggcgcagatgaggtgcttgactacaagacgccagagggtgccagcctgcaaagcccctcaagtaagaagtacgatggtgtcgtccactgcactgtcgggatcagctggtcgacgttcgagcctgtgctagccaccacagggagggtgatagaccttaccccaaactttactgccattcctaaatcagcgctgattaaggtgacctttgccaagaatgcggttgtgcccctcgttttggtcgccaacaaggcggacctagaattcctcggtcggcctggtgaaggacggtacccttaacacccttgattgacttcgaggttcccactgaccaggtgagcacaggct

SEQ ID NO: 970 - DNA, 1026 bp, Sorghum bicolor
atggccgtcgccgccgaccccatgaagacggccagcatccccgcgacgatgcgggccgtgcagtacgacgcctggggcgggggtgccacgggactcaagcatgtggaagttccaatcccttcggcccaaaagaatgagcttctattgaagctggaagtagcaagcatcaatccagtggactggaagatacagaaagggctcttgcggccattcctgcctcgtaaatttccttttatccctgtgactgatgtggcaggagttgtggctgatgttgggccaggagtccagggattccaacccggagatcaagtcgttgctaagctgtactcacttaaaggaggtggacttgcggagtatgctgtggcatcagaaactctgaccgtcaagaggcctgccgaggtatttgctgctgaaggcgcagggctgcctgttgctgctggtactgcgctccaggcgcttaggaccatcggcgccaagttcgacggcactggcaagcccttaaacgttctgatcaccgcggcatcaggtggcgtcggtcactacgccgtgcagctcgcgaaaatggccggtctccacatcaccgccacctgtggcgcgcgtaacgtggagctgctgaagagcctgggcgcggatgaggtgcttgactacaagacgccagagggtgccagcctgcagagcccctcgggtaagaagtacgatgttgtcatccattgcgctgcccggatcagctggtcgacgttcgagcctgtgctggccaccaccgggagggtgatcgacatcaccccaaacttcagctccatcctcaaatgggcgctgcacatggtgaccttcgccaggaagaggctggtgccactgcacctgtcgcccaacaaggcggacctagagttcctggtcgggctgctgaaggacggcaagctcaagacactgattgactcgaggttcccactgagcgaggtgagcaaggcctggcagaagagcgtcgacggccatgccaccggaaagatcatcgtcgagatcggaggctga

SEQ ID NO: 971 - DNA, 1268 bp, Saccharum officinarum
ccccggttctctccaaactccatagcgctcgagacatcaccgcgctgccgtctcggcaatctcccctgttcctcctagcttcctcgtcttctcgagctctcccgcccgccatggccgcgaactcccccttcgactgcatcctcctagacctggacgacaccctgtacccgggcaacaccggcatcggcccggccctgaagcgcaacatcgacgagttcctccaggccaagctcggcgtgtcggccgacaaggccgccgccatgcgcgtcgagctcttccgcacgcacggcagctccctcgccgggctcatcgcgctcggctatgacgtgcacccggacgagtaccacagttacgtgcacggcaggctaccgtacgacaggatccccgccgacccgcagctggcgcggctgctgcagagcatcccgcagcgcaaagtgctgttcaccaactcggaccgcgcgcacatgaggcgggcgctggagcggctgggcgtggacgaggccatcttcgacgccgtcgtgtgcttcgagaccatgaacccgcacctcttcggcggcgaggacagggaggagcgcgtcgacggcggcgatcacccggtcgtgatcctcaaaccggcggtggacgccatcgtggcggggctgcgcgtcgccggcaccagcccacgccggacgctcttcctggacgacagcgagaggaacatcgccgcggggaaagcgctcggcctccgcaccgccctggttggcaagagggtgaggagcaaggaagcagactacgccctggagaacatcggcgcgctgcgacgggccatcccggagatctggggcgtcgtcgccggcggcagcgagagtgaacgctcggaccacagcatggacaagctgccgatgaggtccgacctggactccatcatccagcccacgtccatccaggcctaacaacctcatcccacccatcttcgttaataatcaatcaatcagaatcaggggatcgaagccactaataactcgatcaataaagctctaccgcttggttttgccaaaaaaaaaaagctccgtctctctctctctccacctaatcgatcatcatgtacattattctgatgtattctgattcctgatgtgcgtgcgtgcgtgcgtgtgtgtgaatatctgtctgtacgtagctgacaggcatgtacatacacatttctgatcagcaccggttgtcagtgcatgtaaagcagcataatttcaagtgcatgacgagtcatcatatgtattatgataagaata

SEQ ID NO: 972 - DNA, 1313 bp, Saccharum officinarum
ccaaactccatagcgctcgagacatcaccgcgctgccgtctcggcaatctcccctgttcctcctagcttcctcgtcttctcgagctctcccgcccgccatggccgcgaactcccccttcgactgcatcctcctagacctggacgacaccctgtacccgggcaacaccggcatcggcccggccctgaagcgcaacatcgacgagttcctccaggccaagctcggcgtgtcggccgacaaggccgccgccatgcgcgtcgagctcttccgcacgcacggcagctccctcgccgggctcatcgcgctcggctatgaagtgcacccggacgagtaccacagttacgtgcacggcaggctaccgtacgacaggatccccgccgacccgcagctggcgcggctgctgcagagcatcccgcagcgcaaagtgctgttcaccaactcggaccgcgcgcacatgaggcgggcgctggagcggctgggcgtggacgaggccatcttcgacgccgtcgtgtgcttcgagaccatgaacccgcacctcttcggcggcgaggccagggaggagcgcgtcgacggggcgatcacccggtcgtgatcctcaaaccggcggtggacgccatcgtggcggggctgcgcgtcgccggcaccagcccacgccggacgctcttcctggacgacagcgagaggaacatcgccgcggggaaagcgctcggcctccgcaccgccctggttggcaagagggtgaggagcaaggaagcagactacgccctggagaacatcagcgcgctgcgacgggccatcccggagatctggggcgtcgtcgccggcggcagcgagagtgaacgctcggaccacagcatggacaagctgccgatgaggtccgacctggactccatcatccagcccacgtccatccaggcctaataacctcatcccacccatcttcgttaataatcaatcaatcagaatcaggggatcgaagccactaataactcgatcaataaagctctaccgcttggttttgccaaaaaaaaaaagctccgtctctctctctctccacctaatcgatcatcatgtacattattctgatgtattctgattcctgatgtgcgtgcgtgcgtgcgtgtgtgtgaatatctgtctgtacgtagctgacaggcatgtacatacacatttctgatcagcaccggttgtcagtgcatgtaaagcagcataatttcaagtgcatgacgagtcatcatatgtattatgattagaataccaagtcctaatgttgtgatgaaaaaaaaaaaaacaaggcggccgctcttcaggatcc

SEQ ID NO: 973 - DNA, 1050 bp, Saccharum officinarum
  misc_feature (656)..(656): n is a, c, g, or t
  misc_feature (840)..(840): n is a, c, g, or t
cccggctctctccaaactccatagcgctcgagacatcaccgcgctgccgtctcggcaatctcccctgttcctcctagcttcctcgtcttctcgagctcgcccgcccgcccgcccgccatggccgcgaactcccccttcgactgcatcctcctagacctggacgacaccctgtacccgggcaacaccggcatcggcccggccctgaagcgcaacatcgacgagttcctccaggccaagctcggcgtgtcggccgacaaggccgccgccatgcgcgtcgagctcttccgcacgcacggcagctccctcgccgggctcatcgcgctcggctatgaagtgcacccggacgagtaccacagctacgtgcacggcaggctaccgtacgacaggatccccgccgacccgcagctggcgcggctgctgcagagcatcccgcagcgcaaagtgctgttcaccaactcggaccgcgcgcacatgaggcgggcgctggagcggctgggcgtggacgaggccatcttcgacgccgtcgtgtgcttcgagaccatgaacccgcacctcttcggcggcgaggccagggaggagcgcgtcgaccacccggtcgtgatcctcaaaccggcggtggacgccatcgtggcggggctgcgcgtcgccggcaccancccacgccggacgctcttcctggacgacagcgagaggaacatcgccgcggggaaagcgcttggcctccgcaccgccctggttggcaagagggtgaggagcaaggaagcagactacgccctggagaacatcagcgcgctgcgacgggccatcccggagatctggggcgtcgtcgccggcggcagngagagtgaacgctcggaccacagcatggacaagctgccgatgaggtccgacctggactccatcatccagcccacgtccatccaggcctaataacctcatcccacccatcttcgttaataatcaatcaatcagaatcaggggatcgatgccactaataactcgatcaataaagctctaccgcatgggtttgtcaaaaaaaaaaagctccgt

SEQ ID NO: 974 - DNA, 1167 bp, Panicum virgatum
gctcctcgccccggctccggacagagatcacaccgctccgatccatcgccgcctcggcctcggcatcttcccccgttccttgcaagcttgcccgcctcaagaagaagctctccagccatggccgcgaactcccccttcgactgcgtcctcctagacctggacgacacgctgtacccgggcaacaccggcctcggccccgccctgaagcgcaacatcgacgagttcctccaggccaagctcggcgtctcggccgagcgcgccgccgccatgcgcgtcgagctcttccgcacgcacggcagctccctcgccggcctcatcgcgctcggctacgacgtgcacccggacgagtaccacagctacgtgcacggccggctgccgtacgaccggatcgccgccgacccgcagctggcgcgactgctgcagagcattccgcagcgcaaagtgctgttcaccaactcggaccgcgcgcacatgaagcgggcgctggagcggctgggcgtcgacgaggccgtcttcgacgccgtggtgtgcttcgagaccatgaacccgcacctcttcggcgaggaggggcgccgcgccgccgccgccgggaccgcccccccggctgtggtcctcaagccggcggtggacgccatcgtggcggggctgcgcgccgccggcactaacccgcgccggacgctcttcctcgacgacagcgagaggaacatcgccgcggggaaagcgctcggcctccgcaccgccctggttggcaagagggtgaggagcaagggtgcggactacgccctggagagcatcggtgcgctccggcgggtcatcccggagatatggggcgccgccgctgccgccgccggcgacggcagcgagcgctcggaccacggcatagacaagatgcccatgaggtccgacctggactccatcatccagcccacgtccatccaggcctaactccatccgatcccttcacctgatcctgcacgatccacgccactaataaagctctccctccctccctctcacactcaattatcgtgtaaattatattctgattcctgatgcgtttgtgtgtgaatacctgtacctagctagctgacaggcatgtacatctctgatcagcatccgcttgtaaatcatgctgttgtttataattatgtaaagcaatcaagtgca

SEQ ID NO: 975 - DNA, 1566 bp, Zea mays
ggccaccgccgaccgcggcagcgtcgtggctggcttggcaggcagctccaggctccagcgaagccgatggcaaaaaaggcgggactcgcgcaagcaagcgtggacgcgtacgttgagcagagctcgcggcgcaaggaacacgaggccgcgctaaaaactgctcctactccgggttgtagcgtgcttcacgcacgcacgttgctggataggtttgccgcgcgcgcttgcttgccccgtggtccacgcggccggcggcacccgcgcctcgcccgacgctctatttaaaagccacgcctcggcccccttctccctccgatctctctctctctcgttctgctcacatcgacgcggttcggttccagtttcactcccactgccgtctcggcaacctcccctgttccacgcttcgtcctcgcctgccaggctgccatggccgcgacgtcccccttcgactgcgtcctcctagacctcgacgacaccctgtacccgggcgacaccggcatcggcgcggccctgaggcgcaacatcgacgagttcctccaggccaagctcggcgtgtcggccgacgaggccgccgccacgcgcgccgagctcttccgcgcgcacggcagctccctcgccgggctcatcgcgctcggctacgacgtgcacccggacgagtaccacagctacgtgcacggcaggctaccgtacgacaggatcgcgcgcgacccgcagctggcgcggctgctgcagagcatcccgcagcgcaaagtgctgttcaccaactcggaccgcgcgcacatggagcgggcgctggagcggctgggcgtggacgaggccgccttcgacgccgtcgtgtgcttcgagaccatgaacccgcacctgttcggcgacgacggtggcgaccggcgcccggccgtggtgctcaaaccggcggtggacgcaatcgtcgccgggctgcgcgccgctggctccaacccacgccggacgctgttcctggacgacagcgagaggaacatcgccgcggggaaagcgctcggcctccgcaccgccctggttggcaagagggcgaggagcaaggaagcggactacgcggtggagagcatcggcgcgctccggcgggccatcccggagatctggggcgaggccgctgaacgctcctccgacaagctgccggtgccggccgtgagcgtggtgaggtcgacgacgtccgacctggactccatcatcatccagcccacgtccatccacgcctaatatataacctcatcgtccctagctccccacccccaatcagaatcagcgggtgcgtgcgtgcgtgtgtgaatatctctctctctctctctctctctctctctctctctctgcctgcctgcctcacaggctgaaaggcgtgtacatttctgatcagcaccaccggtcgcccgtcggtgcgcgcgtgcatgtaaagcaggcaccaccagctgcagcccaagtgcgtgcatgagcatgacgagtcatgcaatgtgttgtacgtattttacatgatgataagaataacaaaccgtgtttagctgcagagacccgagcagcggttttaaccaa

SEQ ID NO: 976 - DNA, 1448 bp, Zea mays
gaccctcctcctctcaactgttctctcgccgccgttctagttccgctttgcttgaggtgcacgtggcggtggaagcttcccgggcggtggcggttgttggttcatgtcgatggcgcaggtgtgctgcgactcggccgtaacggcggcaccggtggccgggccggaggcggaggcgagggccagggcgcgcgccgagaggcgccgccgggccgcggaggccgggaggtggaagcacgcggcggctgctggcacggcagccgcagatgccacgaggaagcggagcctcgaggccggggagctgctcgtggcgcggaagcacggggccgcgtcggtggccggccgccggagggagatggaggacgccgtgtccgtgcgcgagtccttcgccgcggagggcgacgccgacggcggcgggaggcgcgacttctacggggtgttcgacggccacggctgctcgcacgtggccgaggcgtgccgggaccggatgcacgacctgctcgccgaggagctcgccgctgccgacggttccggctccgcggcgacctggaccgccgcgatggaacgcagcttcgcgcggatggacgccgaggcgatgtcggccggcgggagcgccgcctgccgctgcgacccgcacaagtgcgaccacgtgggctccaccgccgtggtggccgtcgtggaggagcgccgcgtcgtggtggccaactgcggcgacagccgcgcgctgctgtgccgcgggggcggcgcgccgccgctgccgctgtcgtcggaccacaagcccgaccgccccgacgagctggagcggatcgaggccgcgggcggccgcgtcatcttctgggagggcgcgcgcgtgctgggcgtcctcgccatgtcccgcgccatcggggacggctacctcaagccgtacgtctcgtccgtgcccgaggtcacggtcaccgaccgctccgacgccgacgagtgcctcatcctcgccagcgacggcctctgggacgtggttagcaacgaggccgcgtgcgaggtggcgcgcgcctgcctccgccgggggcgggccaggtggtgcgccgaggccgccgcgctgctcaccaagctggccctcgccaggcgcagctccgacaacgtctcggtggtcgtcgtcgatctccggaagagggatcgctagctagctctgtgccgttagtactaatacagtagtaggatggtgcacaaaaggatctcgcgggtgtgtgctaattgtttttctgtctttctcgtcaaaagttattttttgctgctctccctgaatcaaaaagttcagaggagcccttagattaattgttgtggtggaaccggaatttgatccggataccatttgggatgaatggaaccttgcatagatcagaattcagaggagttggtctcagaaggaattatatgattcacgcgttatgtacagtatcggttgttcggtggag

SEQ ID NO: 977 - DNA, 1592 bp, Zea mays
ggcgccgcgcgagcccgcgagacaggggctttaaaaggggcgcccggcaggcaccacgggaccctctctcaactctcgtttcgccggagtatttagcttgcttcagggagcacgtggcggtggaagcttccctaggggtggcggaggcggtggtggtgcttggttgatgtcgatggcgcaggtctgctgtgactcggccgtagcggcgacggcggcaccggtggttggtgcggaggcggaggccagggccagggcgcgcgccgagaggcggagccgggccggagagtctggggcgtggaagcacgcggtggccgctggcacggccgatgctacgaggaagcggagtctcggggcaggggagctgctggtggcgcggaagcacggggcggcgtcggtggccggccgcaggagggagatggaggatgccgtgtccgtgcgcgacgcgttctgcgcggagggcacggccgacggcgggaggcgcgacttctacggagtgttcgacggccacggctgctcgcacgtggccgaggcgtgccgggaccggatgcacgagctggtcgccgaggagctcgccgccaccgccgccgacagctcagtctccgcggcggcggcctggaccgtggcgatggaacgcagcttcgcgcggatggacgccgaggtgacgtcggccggcgggcgcgccgccgccgccagaagcagcacctgccgctgcgacgcgcacaggtgcgaccacgtgggctccacggccgtggtggccgtcgtggaggagcacagcgtcattgtggccaactgcggcgacagccgcgccgtgctctgccgtggggacggcgcgccgccgctgccgctgtcgtcggaccacaagcccgaccgccccgacgagctggagcgcatcgagtccgccggcgggcgcgtcatcttctgggagggcgcgcgcgttctgggcgtcctcgccatgtcccgcgccgtcggggacggatacctgaagccgtacgtgtcgtccgttcccgaggtgacggtgaccgaccggtccgacggcgacgagtgcctcatcctgggcagcgacgggctctgggacgtggtgagcaacgaggccgcgtgcgaggtggcgcgcgcctgcctccgcaggggccgggccaagtggtgtgccgaggccgccgcgttgctcaccaagctggccctcgcgaggagaagctccgacaacgtctcggtggtcgtcatcgatctccggaggaggaatcactagttctgtgcagttgtcagctagtactagtactccctccgaaggatggctggtcgcacaagggatttcgcgggggtgcctaattgggttttttttcttccattttcattcaaaaagttttttttttttttgctgtactctccctgaatcaaaaagttcagaggagcccttagattaattattgtggtagagccggaatttggtccggataccattcggagaggtggtcgcgtagaaaaaactcagaggagagacggtctcacaagaaaatcagtctgtgtattgtatcatctagacatctaatgaaatagcaaccgaaacaaacaccacctccggtgtctggatgttctcg

SEQ ID NO: 978 - DNA, 1426 bp, Panicum virgatum
gttgctgtgttcttccggtaagcttttgctgctggtgggggtagccgtggaagctcagaggtggtggggggtggtggtgcttgctggttgatgtcgatggcgcaggtgtgctgtgactcagcggcagccgcggcggcggcggtggttgggccggaggcggaggccagggcgagggcgcgcgccgagaggcggcgccgggcgggggaggccgggaggtggaagcacgcgccggcggcggccgggacggccacgatgaagcgacgcgtggaggccggggagctgctcgtggcgcggaagcacggggcggcctcggtggccgggctcaggagggagatggaggacgccgtgtccgtgcgcgaggccttcgccgccggtggcgccgggaggtgcgacttctacggggtgttcgacggccacagctgctcgcacgtcgccgaggcgtgccgggaccggatgcacgagctgctcgccgaggagctggccgacgaggacggcccggcggcgcggcgggagcccgcggcctggaccgccgcgatggagcggtgcttcgcgcggatggacgccgaggtcgcctccgccggcgggcgcgccgccgccagctgccggtgcgacgcgcacaagtgcgaccacgtgggctccaccgccgtggtggccgtggtggaggagcgccgggtggtggtggcccactgcggcgactcccgcgcggtgctctgccgcgggggcgacggcgcggcgccggtcgcgctgtcctcggaccacaagcccgaccgccccgacgagcaggagcggatcgaggccgcgggcgggcgggtcatcttctgggagggcgcgcgcgtgctgggcgtcctggccatgtcgcgcgccatcggggacgggtacctcaagccctacgtgtgctcggtgcccgaggtgacggtggccgacctcgccgacggcgacgagtgcctgatcctggcgagcgacgggctgtgggacgtggtcagcaacgaggccgcctgcgaggtggcgcgcgcctgcctccggaggggcagggagaagtggtgcgccgaggccgccgcgctgctcaccaagctggcgctcgcgaggcgcagcgccgacaacgtctccgtcgtggtcgtcgatctccggcggaagaaccactagctctccttcacctctcaaatcgggctggtggtagcactagtacagtgggatggatgatgcacaaaaggatctggctgggatggtagtagtagcggcttgctagctagcaagtagtaattctactgattgttttttcttcttccttttctgttgggaatgattttttgggctgtatttctccctgaatcaaaaagttcagaggagcgcatgcatagatgaatgaattattatggtgtaaccggaactcgatccggataccatgtggaatgaaaatgaacttgtc

SEQ ID NO: 979 - DNA, 1406 bp, Zea mays
ggcttggttccccgtgaccttgccagccgcgctagatacacactcttcatcacccggagtcccggacggacgcacacgcatcgcttgcttgtcgttctccactcctcttcccccgctgctcgcctctcgattccgcctcatcgcgtccgcgaactccatgtccactgcgaccgcgaccctggccgccgcgcgatccccggctgtcgcgcttctcagcctgcgccgccgcgcacccgcggctgcccccattcgcttccccggtctccgcgtcggctctggttgccgtcacatagctatggcttccgcggcgcactcccgcgcccccaccgacccgcttcccaagggtgctgatttatttttccgggcagtaatctcgaacatggaaaaggtttatttgagcaggaatcctacagccaaaaccattctggagcttgtacgatcttatgatggtgatcacatttgctatgatcactttgctttccggacatttggggtcaatggttatggtataaactcactttctgattttttcactgattttggttatttacctcgcgaagaactcagatttccagctaaaaagcttagggcactatggttttccccgcccactaatgatggctactctggaactggtacatatggacctttgccaaggatattcatttcagaacttcttgtggatgagttgactactcaaagccaggaaattatacataaatacattaaaacttctggcaatggaaataatcatgctgctattgcaagtacatctggggagctaacatgggagaagcccatttattcagatttccagattttgtctagggaaagtgaatatgctgcatggactcttgttaatggctatgcactaaatcatgccacaattgccacccatcgcctagaatcagatatcagaagtattaataagttcaacaaatttgtggaggacaatggcttcaagttaaattcagaaggagggattctgaaagtgagtcctgatggtctccttcaacaaagttcaacagtagctgactcatcattgtttacgtttgctgatggaataactgaatctattcctcgatcatacattgaatttgctgaacgtctcctgttaccacagttcaaagatttacaagatgaagaggtgaaagaataccacaggcgtgatggttttgaggtgggcaatgcggacaagatattcgaaagtacatcgaaggatcagctgacgcggagatctgcatgaacagtgaactctagatctgcatatgaccccgtgaactctctagatctgcaaacaacccagtgtgcctcttggaagtgtgttggtgactgtgaaatgattgtacctacttgggtgaaataaagcatgggagtcaataaaaagtaactgtttctttattcta

SEQ ID NO: 980 - DNA, 1365 bp, Saccharum officinarum
  misc_feature (349)..(349): n is a, c, g, or t
  misc_feature (394)..(394): n is a, c, g, or t
  misc_feature (407)..(407): n is a, c, g, or t
  misc_feature (410)..(410): n is a, c, g, or t
  misc_feature (420)..(420): n is a, c, g, or t
  misc_feature (422)..(422): n is a, c, g, or t
  misc_feature (432)..(432): n is a, c, g, or t
  misc_feature (442)..(442): n is a, c, g, or t
gaacggccgcacacggcacacgcattgcttgctgcttgcttgtcgtgctgagccgctccactcctcttcccccgctgctcgcctctcgattccgcctcatcgcgtccggcgatccccatgtccactgcgaccgtgaccctcgccgccgcgcgatccccggctgtcgcgcttctcagcctgcgccgccgcgcccccgcggctgctcccattcgcttccccggcctccgcgtcggctccggttgccgtcgcatcgctatggcttccgcggcgcatgcccgcgcccccgccgacccgcttcccaagggtgctgatttatttttccgggcagaatctcgaacatggaaaaggnttatttgagcaggaatcctacagccaaaaccattctggagcttgnacgatcttatganggngatcacattngntatgatcacnttgctttccngacatttggagtcaatggttatggtataaactcactttctcaatttttcactgattttggttatttacctcgcgaagaactcagatttccagctaaaaagcttagagcactatggttttccccgctcaccaatggtggctactctggaactggtacatatggacctttaccaaggatattcatttcagaacttcttgtggatgagttgactactcaaagccaggaaattatacataagtaccttaaaacttctgtcaatggaaataatcatgctgctcttgcaagtacttctggggagctgacatgggagaagcccatctattcagatttccagattttgtctagggaaagtgaatatgctgcatggactcttgttaatggctatgcattaaatcatgccacaattgccacccatcgcctagaatcagatatcagaaatattaataagttcaacaaatttgtggaggacaatagcttcaagttaaattcagaaggagggattctgaaagtgagtcctgatggtctccttcagcaaagttcaacagtagctgattcatcattgtttacgtttgctgatgggataactgaatctattcctcgatcatacattgaatttgctgaacgcctcctgctaccacagttcaaagatttgcaagatgaagaggtgaaagaataccacagacgtgatggttttgaggtgggcaatgcggacaagatattcgaaagtacatcaaaggatcagctgacacggacatctgcataaacagtgaactctagatctattgtgcaaatgacccaatgtgcctcttggaagtgtgttggaggcatgtattgtgaaatgattgtacctacttgagtgaaataaaacatgagaatcaataaaaagtaactgttttttttattctcaaaaactgtgctgatta

SEQ ID NO: 981 - DNA, 1359 bp, Panicum virgatum
ccacgcgtccgcggacgcgtgggctccgctgctcgccttatctcgtcggctccccgaacccccatgtccgccgggagcgcgatcctcgccgccgctcgctgcccgggggccgcgcttctccgcctgcgccgtggtgtccccgcggccgctcccctccgcatccccgctcttggcgccggacccgggtaccgtcgcattgccatggccgccgcggcggatagcggggctcccgcccccgccgacccgcttcccaagggtgctgattcctttttccgaacagttatatcaaatatggaaaaggtttatttgaacaggaatccaacagccaaaacaattttggagcttatccattcttatgatggtgaccacatttgttatgatcaccttgctttccggacatttggggttaatggttatggtataaattcacttgctgatttttttattgattttggttatctacctcgtgaagaactaagatttcccgccaaaaagcttagagcaatatggttttcgcctccaaccaatgatggctacactggaactggtgtatatggacctttgccaaggatatttatttcggaacttcttgtggatcagttgagtgcccaaagccaggaaattatacataagtacattaaaacttctggcaaaggaaacaaacatgctgttgttgcaagtatatctggggagctgacatgggagaagcccatttattcagatttccaggttttgtctagggaaagtgaatatgcagcatggactcttgttaatggctatgcactaaatcatgccacaattgccacacattgcctagagtcagatatcagaagtattaataggttcaacaaatttgtggaggacaatggtttcaagttaaattcagaaggagggattctgaaagtgagtcctgatggtctccttcagcaaagctcaacagtagctgattcatcattgtttacatttgctgatggaatcattgaatctgttcctcgatcctatattgaatttgctgaacgcctactgctaccgcagttcaaagatttgcaagatgaagaggtgaaagaacaccacaggcgcgacggttttgaggtaggcaacgcagacaagatatttgagagcacgtcgaaggatcagctgacccggagatctgcttaaacagtgaattcttgatgaactgttctgctaatgatccagtgtgcctcttggaagaagtgtgttggaggcatgcattgtataaatgattgtatccaccaggttaaagaaaaacatgagaatcaataaaaattaaatgttttctaatctacatccctcgtggtgtaggctacatccctgtaaatctaaagctactgttgtcgg

SEQ ID NO: 982 - DNA, 1188 bp, Saccharum officinarum
gcacgaggcttctcagcctgcgccgccgcgcccccgcggctgctcccattcgcttccccggcctccgcgtcggctccggttgccgtcgcatcgctatggcttccgcggcgcatgcccgcgcccccgccgacccgcttcccaagggtgctgatttatttttccgggcagtaatctcgaacatggaaaaggtttatttgagcaggaatcctacagccaaaaccattctggagcttgtacgatcttatgatggtgatcacatttgttatgatcaccttgctttccggacatttggagtcaatggttatggtataaactcactttctcaatttttcactgattttggttatttacctcgcgaagaactcagatttccagctaaaaagcttagagcactatggttttccccgctcaccaatggtggctactctggaactggtacatatggacctttaccaaggatattcatttcagaacttcttgtggatgagttgactactcaaagccaggaaattatacataagtaccttaaaacttctgtcaatggaaataatcatgctgctcttgcaagtacttctggggagctgacatgggagaagcccatctattcagatttccagattttgtctagggaaagtgaatatgctgcatggactcttgttaatggctatgcattaaatcatgccacaattgccacccatcgcctagaatcagatatcagaaatattaataagttcaacaaatttgtggaggacaatagcttcaagttaaattcagaaggagggattctgaaagtgagtcctgatggtctccttcagcaaagttcaacagtagctgattcatcattgtttacgtttgctgatgggataactgaatctattcctcgatcatacattgaatttgctgaacgcctcctgctaccacagttcaaagatttgcaagatgaagaggtgaaagaataccacagacgtgatggttttgaggtgggcaatgcggacaagatattcgaaagtacatcaaaggatcagctgacacggacatctgcataaacagtgaactctagatctattgtgcaaatgacccaatgtgcctcttggaagtgtgttggaggcatgtattgtgaaatgattgtacctacttgagtgaaataaaacatgagaatcaataaaaagtaactgttttttttattct

SEQ ID NO: 983 - DNA, 1452 bp, Oryza sativa
gtccactccactctctcctccccttcagctgatcagctcgccacgtcaccgtcaccgcctcgcctcgcttgcttgtcgtggtgcagcatccaacctagtagtagtggtagtaggctaggctatatccgcctcggccaccgccgggttcgcctccagtgctcgccgcctccgccgccgccggtgtccatggccgtggcccttgccggcgcgagatccccaggagcgggcgcgatcctcagcctccgccgcctcgcccccgccgccgcggcgcccgtacgtctgggcggaagcggaaccccaggcacccggcgccgccgcggcatcgccatggcggcagctgcgtccgccccgcccgcgcccgccgatgccctccccaagggtgctgattcatttttccggacagttatctcaaacatggagaaagtatatctgagcagaaatccaactgccaaaaccatcctggaacttgttcgttcttatgatggggaccacatttgctatgatcattttgctttcagaacatttggagttgatggttatggtataaaatcacttgctgaattttttactgactttggttatgtccctcgtgaagaactaaggtttccagcaaaaaagttaagagcactatggttttctcctcccaccaatgatggatacactggaactggtgtttatgggcctttgccaaggatattcatttcagaactacttgtggatgagttgagtcctcagagccaggacatcattcaaaaatacattagaacttctggtaaaggaaataaacatgcaactcttgcaagtacatcaggggagctgacatgggagaagcccatttattctgatttccaagttttatctagggaaagtgaatatgctgcatggactcttgttaatggctatgcactaaatcataccacaatttccactcatcgcttgatatcagatattagaagtatcaataagttcaacaaatttgtggaggacaatgggttcaagttaaattcagaaggagggattttgaaagtgagtcctgatggtctcctccagcaaagctcaactgtagctgattcagcgttgtttacttttgctgatggaatcactgaatccattccacgttcctatattgaatttgctgaacgcctggtactcccacagttcaaagatttgccaaatgatgaggtcaacgaacaccacaggcgcgatggttttgaggtagggaatgcggacaaaatatttgagagcacatcaaatgatcagcttacacggagatctgcataaacgttgaagtctcaactattctggaagcgagtcatgcctcttggaagcgtattgaaggagtgttctctgtgataactgtatctacctgggtaaattaaaacattagaatgaataaactgttcgatgtatatcgctctcttgaataaagaaattactagttatctctacagt

SEQ ID NO: 984 - DNA, 1957 bp, Zea mays
attaaagttctgcttcagtgcttccagtcttccaccacccacccccacaaagaagccgccccccgagttgacggccatggcgtcagcggcgaacaccatgccaggcaagtctgttgtcctcctctcgctcgtcacgcttctcgtcgtcctcatctccgccgcggagagctacgacggccggtatgccgtctcgcactcggccatggcgcgccgctcccgcctggggacccggcacgcgcatcaccgccggacaacggtgccgcaccggtacgtgctcgcggagaagagcagcgcgcccagcggcggcggccccaagaaccacagttcgccggcgaaggccaacgccagctcgccggcgccggcgcctccggccgccgagcagactggccggcaccaccgcagccacaagaaccgggtgcgcaactggatcatcggcttcgtggtggggtccctcgccggcgtcatctccgggatggtgctgtcggtgctgttcaggctggcgctcaactgcatccgcgggcggtaccggacgcggtccggcgtgatgatcttcaccccgaagctgatcaggcggccggagcacctcgcgttcctggagaaggaggacgggctggcgtcgctggccgtgatcgggcgcggcgggtgcggggaggtgtacaaggcgcagctgcccgtggagcgggagggggagcagccgcgcttcatcgccatcaagaaggtcaagaagcacggcggcgacgcgcccagcaacaacctgagcgatgaggagagccggcagctggacaagaggtcccggcagatccagtcggagatccggacggtggggtacatccggcaccgcaacctgctgtcgctggcggcgcacgtgccgcgcccggactgccactacctggtgtacgagtacatgaagaacggcagcctgcaccaggcgctgaaagccgagaacgccgaggccgaggacggcagcagcggcagcggcaccggcgccggcgggctgtcgtggcccgcgcggctccgcgtggcggtgggcgtggcggcgggtctggagtacctccacgtctcccaccagccgcagatcatccaccgcgacctcaagcccgccaacatcctgctggacgacgacctggaggcccgcatcgcggacttcgggctggccaaggcgatgccggactcgcacacgcacgtcaccgcgtccaacgtggccggcacgctgggctacatcgcgccggagtactaccagacggtcaagttcacggccaagtgcgacgtgtacagcttcggggtcatcctggcggtgctggccacggggaaggagccgtccgaccagttcttcacgcagacggaggaggtggtcggcctcgtcaagtggctgcgccgcgtcatggaggccggggagcacgcgcaggccatagaccccgccatcgccggcgccggctacgacgagcagatcctgctgctgctgcgcatcgccttgttctgcaccaaggacgaccccaaggagcggcccactgccaaggacgtccgctgcatgctgtcgcagatcaagacctagccagctaaatcaatcaccactagctataaactaattacgagctccttctgtgcttgtggagtcggccgcgcacgcgctcgaataggacgtgcatgatacatcatcgcatctcctgcctttccctttgcttgcgagatgcgcgagctttggcatggtctatggcttatcctgaaatatcagtatgattcatgtgttcctttgtacagtatctttgcttgaaagattcgaaccatcttcttgtacaagggtccaaatccaataatgctacctactacttggtacagctccctcctctgtgctaaaatattagattgttggtttttttctgttattacttctcagttctcactaaatattttttctttgtgtatactttttgctttgtgttcaaaaggcccttgtgtt

SEQ ID NO: 985 - DNA, 1256 bp, Solanum tuberosum
tcgccggaaaatcaagattccggtaacccacggtaatcattttatttatacatagaattctttctttcctgtcgccgggagataaaaaaaggtgatgataaatggcgaagggtcggaaacttgccactagtcgcagtgaaatgttattaggaaactaccccagctatagaaatggaactgcaacactgaacggttcctcagaactaggagaagatgatatctggtcaacggttgatgacatggatgatcacgattcaaggggcgagtggagtccacgcgccgccgatgagagtaataacggatacgtgaaccgtaagctgccggtccaacaatccgaccaccaccacagccgccgcgggcgccaggttgggggcctgtcattggcttttgatgattcaggtaaaacggcatctcctcggatcttgcaccagtttcgcggacaagacgtgccatccacacgtgtggcacacatggccacgtcagcacctgtgaatgtccctgattggtctaaaatatatcgagttaactcggttgagtcgttgcatgactcggatgatggtgttgatgatcatgactcggagatggttccaccgcatgaatacattgctaggagccggaacttgaacgctcgctcggtgttcgaaggtgtgggccgtacgttaaagggtcgggacttgagccgggttcgagatgctgtgtggagtcagaccgggttcgatggttgagttcatcaaatgaactagctatcgctttgttagaattaaagattttataactattttagctgtttggagaattaaagagacaattgatgataattatttattttgctagataaatttttggtcttgggcaattattcaggttgaatgaatacaaactcagtgagtcaaccagctcctatggagcctaagtttaatctttttcttttttctattaatatattttcacatattttatgagtaagtatgtacttttactatggtggattttagcaaaatgttcctttgtcattttcagttatcaataatggtgaaagtttgggtgcaaaaaatgtagtcccactaaatagtgtctagataaaactagtacattcagtagtcccacaaaattgttgcaatcgttgatggaactattcaactatcaacaattgtttcataattaccatctatcaaaaataattttttatccaataaatttgatgtaaattttgcatacattctattattctcatatgttatttataaggttgtatt

SEQ ID NO: 986 - DNA, 1322 bp, Solanum tuberosum
  misc_feature (825)..(825): n is a, c, g, or t
  misc_feature (870)..(870): n is a, c, g, or t
  misc_feature (905)..(905): n is a, c, g, or t
acaataataccattcacatccgttttatattatttttctaagaaaaaaaaaaaaacttatttgggtcgccggaaaatcaagattccggtaacccacggtaatcattttatttatacatagaattctttctttcctgtcgccgggagataaaaaaaggtgatgataaatggcgaagggtcggaaacttgccactagtcgcagtgaaatgttattaggaaactaccccagctatagaaatggaactgcaacactgaacggttcctcagaactaggagaagatgatatctggtcaacggttgatgacatggatgatcacgattcaaggggcgagtggagtccacgcgccgccgatgagagtaataacggatacgtgaaccgtaagctgccggtccaacaatccgaccaccaccacagccgccgcgggcgccaggttgggggcctgtcattggcttttgatgattcaggtaaaacggcatctcctcggatcttgcaccagtttcgcggacaagacgtgccatccacacgtgtggcacacatggccacgtcagcacctgtgaatgtccctgattggtctaaaatatatcgagttaactcggttgagtcgttgcatgactcggatgatggtgttgatgatcatgactcggagatggttccaccgcatgaatacattgctaggagccggaacttgaacgctcgctcggtgttcgaaggtgtgggccgtacgttaaagggtcgggacttgagccgggttcgagatgctgtgtggagtcagaccgggttcgatggttgagttcatcaaatgaactagctatcgctttgttaganttaaagattttataactattttagctgtttggagaattaaagagncaattgatgataattatttattttgctagataatntttttggtcttgggcaattattcaggttgaatgaatacaaactcagtgagtcaaccagctcctatggagcctaagtttaatctttttcttttttctattaatatattttcacatattttatgagtaagtatgtacttttactatggtggattttagcaaaatgttcctttgtcattttcagttatcaataatggtgaaagtttgggtgcaaaaaatgtagtcccactaaatagtgtctagataaaactagtacattcagtagtcccacaaaattgttgcaatcgttgatggaactattcaactatcaacaattgtttcataattaccatctatcaaaaataattttttatccaataaatttgatgtaaattttgcatacattctattattctcatatgttatttataaggttgtatt

SEQ ID NO: 987 - DNA, 1196 bp, Solanum melongena
tgtctccgtaaattatagcccctttttcccccaccatggagctataacattaaatcacaaaaagattttcttattttggtcaccggaaaatcaagattccggtaagaaataaaaacaaccattttgtttacacctagcaaattctttcctgtccccgggaaataagaaaaggtgatgataaatggcaaagggtcggaaactgaccactagtcgtagcgatatgttattaggaaactaccccagctatagaaatggaagtgtaacaatcaacggttcctcagaactaggagaagatgatgtctggtcaacggttgatgacatggtcaacggggatgatcatggttcaagaggcgagtggagcccacgcgccgccgctgagagtaatagcgggtacgtgaaccgcaagcagccatcggaccgccacggccgccaggtgggtgggttgtcattggcttttgatgattcaggtaaaacggcatctcctcggatcttgcaccagtttcggggacaagacgcgccgtccccacgtgtggcacacatggccacgtcggcacctgtgaatgtccctgattggtccaagatataccgagttaactcggtagagtcgttgcatgactcggacgacggcggcgtcgacgatcacgactcggagatggttccgccgcatgaatacatcgctcggagccggaactccaacgctcactcggtgttcgaaggcgtgggccggactctaaagggccgggacctgagccgggttcgagatgctgtgtggagtcagaccgggttcgatggttgagttcatcaaataaacttgctctatcttttttagattaaaacattttataactattttagctgtttggaggattaaagaagataattatttaattttgctagataaatttttggtcttggggaattcttcaggttgaatgaatacaaactcagtgagtcaacccgctcccattgagtcttaagtttaatcatttttgttttttcttatcacttttagttaatataatatttccctctattttatgatgattatgtacttttactatggtggattgtagcaaaatagtatgttgtcattttcagatgtcatgaataatggtgaaattttgtgtgcaaataatgtagtcccacagaagtctggataaaactattatacgccaaatagtcccacaaagttgctg

SEQ ID NO: 988 - DNA, 1017 bp, Solanum phureja
agccctctcttgtgtctactcatcatttcacaaaaaaatatttgcatttataatttgctcaatttgtttttctctactatggattcttcctccccttttgactctattatttttgatttggatgatactctgtattcgtctaagactggaattggacaatccttgaagaagaacattgacgattttctggtggagaaatgcggttttccggtgtcgaaagcatcggctttgcgtgttgagcttttcaaaacttacggcagttctcttgccggattacgagctataggctatgatgttgatgccgatgattatcacagctatgtgcacggaagattaccgtatgatttgattaaaccggatccccaattacgaagcatcttgcgtcgtattaatcaaaggaaaattatttttacgaattcggatcgaattcatgcgatgaaggctttggatcgtcttggaattacggattgttttgaacagatcatttgtttcgagacgatgaattttaacctctctaaggcaacaaggccggaagagattccggtgatattgaagccttcaatggaggcaatgaacatcgccattgaagctgctcaggtcgatccttatcgcacgctcttccttgatgataatgttaagaacatagctgctggaaaagctgtggggcttcaaacagttttggttggaagatcgaccaagacgaaagaagctgactatgcattagagatagtgactgatttggttcaagtagtaccagcaatatggttcaaggaagaagaaaaagatcaaaaaataacacgtacaagaagtgaaatggactttgttacaaccacagctgtgggtgcttaatctatgtcaagaaaaaaccaaaataacaagaatcttctaatccatgtacaagtgtacatattcttaaaataattgtctttaatgtatgtgaatgtacttgttatgtatatatataaatcatgaataaattaacaaaagaaaagccacgtgaaggtggttttttcgaga

SEQ ID NO: 989 - DNA, 941 bp, Solanum tuberosum
gcacaaaaaaatatttgcatttataatttgctcaatttgtttttctctactatggattcttcctccccttttgactctattattttcgatttggatgatactctgtattcgtctaagactggaattggacaatccttgaagaagaacattgactgattttctggtggagaaatgcggttttccggtgtccaaagcatcggctttgcgtgttgagcttttcaaaacttacggcagttctcttgccggattacgagctataggctatgatgttgatgccgatgattatcacagctatgtgcacggaagattaccgtatgatttgattaaaccggatccccaattacgaagcatcttgcgtcgtattaatcaaaggaaaattattttcacgaattcggatcgaattcatgcgatgaaggctttggatcgtcttggaattacggattgttttgaacagatcatttgtttcgagacgatgaattttaacctctctaaggcaacaaggccggaagagattccggtgatattgaagccttcaatggaggcaatgaacatcgccattgaagctgctcaggtcgatccttatcgcacgctcttccttgatgataatgttaagaacatagctgctggaaaagctgtggggcttcaaacagttttggttggaagatcgaccaagacgaaagaagctgactatgcattagagatagtgactgatttggttcaagtagtaccagcaatatggttcaaggaagaagaaaaagatcaaaaaataaacacgtacaaagaagtgaaatggacttttgttgggcaaccacaggctgtgaggtgccttaatctaatgtcaagaaaagaactaaaataacaagaatcttctaatctatgtaacaagtgtacatattcttaaaataattatctttaatgtatgtgaatgtacttgttatgta

SEQ ID NO: 990 - DNA, 1019 bp, Solanum melongena
tccctcttgcctgctcatcctttcacaaaacaggaaaaataaaaagaagaagataatatttcagccaacattttcataatttactatggattcttcctccccttttgattctattattttcgatttggatgatactctgtactcatctaagactggaatcggccaatccttgaagaagaacattgacgattttctggtggagaaatgcggttttccggtgtcaaaagcatcggctttgcgtgtagagcttttcaaaacttacggaagttctctcgccggtttacgagctataggttatgatgttgatcccgatgattatcacagttacgtgcacggaagattaccgtatgatttgattaaaccggatcctcagttacgaagcattttgcggagtattaatcaaaggaaaatcattttcacgaattcagatcgagttcatgcgatgaaggctttggatcgtcttggaattgcggattgttttgaacagatcatttgtttcgagacgatgaattttaacctctccaaggcaacaaggccagaagagattccggtgatattgaagccttcgatggaggcgatgaagatcgccattgaagttgctcaagtcgatccttgtcgcacgctcttccttgatgataatgttaagaatatagccgctgggaaagctgtgggacttggaaccgttttggttggaagatcaagcaagacgaaagaagctgactatgcattagagatggtgtctgatctggttcaagtagtaccatcaatatggttcaaggaagaagaagaaaaagatgaaaaaataacacgtacaagaagtgaaatggactttcttgcaaccacagctgtgggtgcttaattttatcttatagtctttggaccacagtacatatgtaacatatgcctaatgatctttaatgtatgtgaatgtaccttgtatgtatataactaatccatgaataaattaacaaaagaagagacacaagaaggtggtcttttcgagaactttcgtgttggtt

SEQ ID NO: 991 - DNA, 1210 bp, Capsicum annuum
gcacgaggcccattcttgtccttatctttttccacccctttcctaatcaccaccttaataactcctataaatacccattttccctccccatttcaaagccccctcttgtctgctcatcgtttcataaaacagaaaaaagaaatagtttgagctaaatatttgcatatttgcatttataatttgttcaattcgtccttctctcctatggattcttgctccccttttgactctattattttcgatttggatgatactctctactcttccaagactggaattggacaatcgttgaagcagaacattgacgattttcttgtggagaaatgtggttttccagtgtcgaaagcatcggcgttgcgtgttgagcttttcaaaacttacggcagctctctcgccggtttacgagctataggctatgatgttgatgcagatgattatcacagttatgtgcacggaagattaccgtatgatttgattaaaccggatgctcagttacgaagcattttgcgtagtattaatcaaaggaaaatcattttcacaaattcagatcgagttcatgcaatgaaggcattggatcgtctcggaattacggattgttttgaacaaattatttgttttgagacgatgaattttaacctctccaaggcaacgcggccagaagagattccggtgatattgaaaccttcaatagaggcaatgaatatcgccatcgaagctgctaaggttgatcctagacgcacgctcttccttgatgataatgttaagaacatagctgctgggaaagctgtggggcttcgaactgttttggtcggaagaacaaccaagacgaacgaagctgactatgcattagagatggtgactgatctagtccaagtagtaccagcaatatggtacaccaaagtagaagaagatcaaaaaattacacgtactagaagtgaaatggactttcttgcaaccacagctgtgggtgcataattactggtccttggaccatagtccacagtacatatgtacaagtgcacatttcaataaccttgtagtgatcatctttaatctatgtgaatgtactcgtatgtatatatatcatgaataaaataacaaaaaaaaagccacaagaaggtggtcttttcgagaactttcttgttggttcgagataagctcagctaattttaaatttgataaatagtttgaaatttattcctaaaaaaaa

SEQ ID NO: 992 - DNA, 1027 bp, Petunia hybrida
tttgatcatattagaatttgctctctttctctctttatttatatatttgatcaagtatagtatggatttctcgaagtcttcacgtgattcttcttcccctattgattctattatcttcgatttggatgatactctgtactcgtccgagactggaattgggcaagcattgaaaaagaacattgatgattatctggtggagaaatgtggttttcctgagtcgaaagcatcggctttgcgtgttgagcttttcaaaacttatggcagctcacttgccggtttacgagcgttaggctatgatattgatgctgatgattatcacagctatgtgcacggaagattgccatacgatttgattaaaccggacgcacaattacgaaacatcctacgtagtattaatcaaaggaaaatcatttttacgaattcagatagaattcatgcgataaaagcattagatcgcttaggaattagggattgttttgaacaaattgtatgttttgagacgatgaatcagaatctctcaaaggcgacgcggccagaggagattccggtgatattgaaaccttcaatggaggcaatgaatattggcattgaagctgctcaggttgatccttgtcgcacgctcttccttgatgataatgttaagaatatagctgctgggaaagctgtggggctccgtacagttttggttggaagagcaaccaaaaccaaagaagccgactatgcattagagatggtgactgaactggcccaagtagttccagcaatatggtttaacgaagaaaaagatcaaaaaataactcgcacaagaagcgaattggactcccttcttgcaaccacagctgtcggtgcttagtttatttcagatcctatggtctcttatctttagaccacagtacatatgtacatgtgtacatatccatggcaaatgtgaatgtagctacccctgtatgtatcacggaataaaaatgtttcaaagaacgtgtgtttccagaactttcttattactcaggactcatcaacatcatca

SEQ ID NO: 993 - DNA, 1087 bp, Nicotiana tabacum
ggccccttccgtgtactcatccttccacgtaacagaaagaattactttcagctaacatttgcgtagtttcattatatatatacagttttgttcaattcgtccttctccaatatggattcatattccaattcttctcgtgattcttcttccccttttgattctattgtctttgatttggatgatactctgtactcgcccaggactggaattggccaagcattgaagaagaacattgacgattttctggtggagaaatgtggttttccggagtcgaaagcatcggttttgcgtgttgagcttttcaaaacttacggcagctctctcgccggtttacgagcattaggctatgatattgatgctgatgattatcatagctatgtgcacggaagattgccgtatgaattgattaaaccggatgctcaattaagaagcatcttgtgtagtattaatcaaaggagaattattttcacgaattcggatcgaattcatgcgataaaggcactggatcgtctaggaattaaggattgttttgaacaaattatttgtttcgaaactatgaattgtaacctgtccagggcaacacggccaaatgagattcctgtgatattgaagccttcaatggaggccatgaatatcgccattgaagctgctcaggtcgatccctgtcgcacgctcttccttgatgataatgttcggaacatagctgctgggaaagctgtggggctccgaacagttttggttggaagagcaagcaaaaccaaagaagcggactatgcactggagatggtgactgatctgtttcaagtggttccagcaatatggttcaagcaagaagaagatcaaaagataagacgcacaggaagtgaattagattcacttcttgcagccactgctgtgggtgcttaatttatttcaaaaccccaaggtctagtctttggaccacactacatatgtacaagtgtacatatactgatatccccctccatctcaaccttgtaaacatctttaatgtatgtgaatatatgtattatgtatgtgtataatataaataacaaaagaagagccacaagaaaggtggtttgtccag

SEQ ID NO: 994 - DNA, 1507 bp, Solanum phureja
ttcgagagccttcgctaattagagagagaaagagacgcatttcgatactacgccataatctcttcacgatgtcgtattccaggaggtcaaggtatactcgttcaccttcatacgatcgatatagcaagtctgtctcgaggtccagatatgtttcaaggagtcggtcaaggagctgtgattcaagtgatgttgagaacccagggaacaatttgtatgtgactggtctctcaacccgcgttaaagagcgagatgttgagaagcatttttctgctgagggaaaggttgaagatgttcgtcttgtttttgacccatggacccgcgaatctcgtgggtttggtttcgtgacgatgtccagcgttgaggaggctgatcgctgcatcaagtctctgaatcgctcagtacttgaaggcagagttatcactgtggagaaggctaggaggagaagaggtagaacacctactccaggaaaatatttggggcttagaactgttcgcgttcgtcgtgaatcacgaaactatcctcatcattcaaggagtcgctctccttgttactcatctgaaagctacaggagcaggagcaggtcttactctccatattaccgacaagagcatagatcatactcttattacagaggacgccagagatctcactcatcatattacaatcgacaccactgctactcagaatcaccttattctccttactatagtcgtgtcaggtcttactctcgatctttatccccatatagtcggcgtgatcggtcctactctccagatgaccgttactacagaagaagccgttaccatgactattctcccgacaatcatcggcgtgatcgttcctattctccagatgaccgttactatagaagaagccgctaccgtgactactctcccgaaagccgtgatctttcggactctccagatgttcgtgacaacagaatgagccgctatcgcgattactctccgaacagttactattatcgaaggaaccgatatcgttccatttctcggagcatttcacctcgatatcggagaagctactcatgcagtgcatcacctaggtggtcaaagaggagctattcaagaagcgtttccaggagcagctgctctcgtagcagttactctcctaatccgaagaaaagctctaagaagagtcgcagtgttagtgcatcttccagatttgtttcaaggtctgttacacctaggtcttcgccttcatcatgaaaggactacactactaggaaggtctagtctgtcactctctgttgcaaagagtttaaagttgtactagattggtcactcaagtagaattactcaagataacaaatctgctttccagcttatgtgactggtggaaatgagatctagctgtactattgtgtttgtaatttaatgcagaggtaatacggtgtattgaccgaatatggaaacgacactagcatattaatgtgtacgaagccagtacagaaatctctcaatttcttcattgctttctagtggctttt

SEQ ID NO: 995 - DNA, 1452 bp, Solanum tuberosum
aaattagagagagaaagagacgcatttcgatactacgccataatctcttcacgatgtcgtattccaggaggtcaaggtatactcgttcaccttcatacgatcgatatagcaagtctgtctcgaggtccagatatgtttcaaggagtcggtcaaggagctgtgattcaagtgatgttgagaacccagggaacaatttgtatgtgactggtctctcaacccgcgttaaagagcgagatgttgagaagcatttttctgctgagggaaaggttgaagatgttcgtcttgtttttgacccatggacccgcgaatctcgtgggtttggtttcgtgacgatgtccagcgttgaggaggctgatcgctgcatcaagtctctgaatcgctcagtacttgaaggcagagttatcactgtggagaaggctaggaggagaagaggtagaacacctactccaggaaaatatttggggcttagaactgttcgcgttcgtcgtgaatcacgaaactatcctcatcattcaaggagtcgctctccttgttactcatctgaaagctacaggagcaggagcaggtcttactctccatattaccgacaagagcatagatcatactcttattacagaggacgccagagatctcactcatcatattacaatcgacaccactgctactcagaatcaccttattctccttactatagtcgtgtcaggtcttactctcgatctttatccccatatagtcggcgtgatcggtcctactctccagatgaccgttactacagaagaagccgttaccatgactattctcccgacaatcatcggcgtgatcgttcctattctccagatgaccgttactatagaagaagccgctaccgtgactactctcccgaaagccgtgatctttcggactctccagatgttcgtgacaacagaatgagccgctatcgcgattactctccgaacagttactattatcgaaggaaccgatatcgttccatttctcggagcatttcacctcgatatcggagaagctactcatgcagtgcatcacctaggtggtcaaagaggagctattcaagaagcgtttccaggagcagctgctctcgtagcagttactctcctaatccgaagaaaagctctaagaagagtcgcagtgttagtgcatcttccagatttgtttcaaggtctgttacacctaggtcttcgccttcatcatgaaaggactacactactaggaaggtctagtctgtcactctctgttgcaaagagtttaaagttgtactagattggtcactcaagcagaattactcaagataacaaatctgctttccagcttatgtgactggtggaaatgagatctagctgtactattgtgtttgtaatttaatgcagaggtaatacggtgtattgaccgaatatggaaacgacactagcatattaatgtgtacgaagccagtac

SEQ ID NO: 996 - DNA, 1498 bp, Solanum tuberosum
gattcgaaattagagagagaaagagacgcatttcgatactacgccataatctcttcacgatgtcgtattccaggaggtcaaggtatactcgttcaccttcatacgatcgatatagcaagtctgtctcgaggtccagatatgtttcaaggagtcggtcaaggagctgtgattcaagtgatgttgagaacccagggaacaatttgtatgtgactggtctctcaacccgcgttaaagagcgagatgttgagaagcatttttctgctgagggaaaggttgaagatgttcgtcttgtttttgacccatggacccgcgaatctcgtgggtttggtttcgtgacgatgtccagcgttgaggaggctgatcgctgcatcaagtctctgaatcgctcagtacttgaaggcagagttatcactgtggagaaggctaggaggagaagaggtagaacacctactccaggaaaatatttggggcttagaactgttcgcgttcgtcgtgaatcacgaaactatcctcatcattcaaggagtcgctctccttgttactcatctgaaagctacaggagcaggagcaggtcttactctccatattaccgacaagagcatagatcatactcttattacagaggacgccagagatctcactcatcatattacaatcgacaccactgctactcagaatcaccttattctccttactatagtcgtgtcaggtcttactctcgatctttatccccatatagtcggcgtgatcggtcctactctccagatgaccgttactacagaagaagccgttaccatgactattctcccgacaatcatcggcgtgatcgttcctattctccagatgaccgttactatagaagaagccgctaccgtgactactctcccgaaagccgtgatctttcggactctccagatgttcgtgacaacagaatgagccgctatcgcgattactctccgaacagttactattatcgaaggaaccgatatcgttccatttctcggagcatttcacctcgatatcggagaagctactcatgcagtgcatcacctaggtggtcaaagaggagctattcaagaagcgtttccaggagcagctgctctcgtagcagttactctcctaatccgaagaaaagctctaagaagagtcgcagtgttagtgcatcttccagatttgtttcaaggtctgttacacctaggtcttcgccttcatcatgaaaggactacactactaggaaggtctagtctgtcactctctgttgcaaagagtttaaagttgtactagattggtcactcaagcagaattactcaagataacaaatctgctttccagcttatgtgactggtggaaatgagatctagctgtactattgtgtttgtaatttaatgcagaggtaatacggtgtattgaccgaatatggaaacgacactagcatattaatgtgtacgaagccagtacagaaatctctcaatttcttcattgctttctagtggctttt

SEQ ID NO: 997 - DNA, 2089 bp, Solanum phureja
gctcgtttttcttacaatgcagccaaccatttttgattcatataaaccaccaatacacacttataaaaaaatccatcaaccaccacagcctggttgcctcattcacctctctcttccctccgtccggcctaccggaaaaacaagaatctcaatggcttcaaatttccacttttttctcttataccttgtgacccttttcctttttgctcaagcaagactgaatctttatccacaagatcatgctgcacttttgcttgttcaaaaagacttaggcatcattgctcttaacaacccctgtacgctcgcaggaatatcctgcgagcgtagaccgggtaacagaacacaagttctgagagttacccgtattgtattcagatccaatggattgaagggaactttgtcttctgctattggcaaactctctgagctcaaagagctttctctttccgacaatcaactatctgaacaaatcccaattcagattcttgattgtcggaaattagagattcttgaacttcaaagaaacagattttctggaaagattccgtatgaattgtcatctttaaaccgtttaagggtagttgacttttcatcgaatgagttttctgggaatcttgatttcttgaaatactttcctaatttggaaaaactgtctctggctgataatatgttcactggaaaaatacccttttcattgaaatctttcaggaatcttcgtttcctcaacatttcagggaatagtttccttgaaggtccagtacctgtcatgagtcaaattgagcatttatcagcagatttgaatcgaaacaatgccgttcccaaacgttacattcttgctgagaattcaacaaggtcaaatcagatatctgcaatggtgcctgctccagctccagcaccggtcaatcgtgttgtaccggtggtacataaacgtaacaagaagaaaaggaagttaagatcttggtttcttggtttcctagctggaacttttgctgggggtatatctgctgtgatcttttcgttgctattcaagctcgtaatgttcttcgtaagaaggggaaagaacgatagttcaagtttaacgatatttagtccgttgatcaagaaagcggaggacttggctttcttagagatggaagatggagtggcatcacttgaaatgattggaaaaggtggatgtggagaagtttatagagccgagttaccggggagtaatgggaagattatagctataaagaagattatacaatccccaatggatgctgcagagatcacggaggaagatactaaggcgttgaacaagaaaatgcgtcaagttaaatcagaaattcaaattgtaggtcaaatcagacaccggaatctgcttccattactggcgcatatgccaaggccagactgtcattacttggtgtatgaatatatgaaaaatgggagtttacaggatatcctgcagcaagtcacagaaggcacaagagaattagattggttgggacgacacagaattgcagcgggggtagctgctggtcttgagtatctccatataaaccatactcaacgcataattcacagagatctaaagccagcaaatatcctacttgatgatgacatggaagctcgaatagctgattttgggcttgcaaaggcagttccagatgctcatacacatattacgacttcaaatgttgcaggaactatgggatatattgcaccagaatattatcagacactgaagtttacagacaagtgtgatatatacagcttcggtgtggtgctagctgtgttggttatcggaaagggtccatcggatgaatatttccaacatacttctgagatgagtttagttaagtggctgagaaatgtaatgacttctgatgatcctaaaatagcaattgatcctaagctgagagggaatggatatgaggagcaaatgcttttggttctcaagatagcttgcttttgtactctcgacaatccaaaggagaggcctaacagtaaggatgttaggtgcatgttaactcagatcaagcattagctaagtcatacggggtatacgttggttatgtaactaagaatgtgttctgtatttcagttt

SEQ ID NO: 998 - DNA, 2162 bp, Nicotiana tabacum
  misc_feature (2115)..(2115): n is a, c, g, or t
  misc_feature (2143)..(2143): n is a, c, g, or t
caaaaaatatccaccactccccaggctagtgtctcatccacctcccgtctgccggaaaaacaagaacctcaatggccttcactgcttcacaaatccacttctttttcatctcccttttcgcccttttacttattgttcaagcaaaactaaatctttatccaccagatcatgctgcacttttgcttgtccaaaaagacttgggcatccaaggtcaacgcattgcactttgcaactctgtagcagtatcctgcgaaaggcgaaaggcaaacagaacacagttgttgagagtcacccgtattgacttcagatccaatggattgagtggaactttgtctcctgccattggcaaactttctgagctcaaagagctctctcttccaaacaaccgactctttgaccaaatcccagttcagattctcgactgccgtaaactggagatccttgaccttggaaacaatctgttttctgggaaagttacatctgaattatcatctctagtccgccttcgaattcttgatctttcttcaaatgagttgtctgggaatcttaacttcttgaagtattttcccaacttagaaaaactctccttagctgataacatgttcactggaaaaatacccccttctttgaaatctttcagaaatctgcgtttccttaatatttcaggaaacagttttcttgaaggtcctgtgcctgttatgagtcaagttgagcacttgtcagcagatttggatcggaacaacttcgttccaaaacgttacattcttgctgaaaattcgacaaggtcaaatcagatatcagcactggcacctaattccaattcaggaaatgccccagctccagcaccgagtcataatgttgctccagtccataaacgtaacaagaagaaaaggaaagtcagagcgtggtttcttggtttctttgctggttctttcgcaggggctatatctgcagtactcttatcagttctctttaagctggtaatgtttttcgtccgaaagggaaagactgatggaagtttaacaatatacagtccactgattaagaaagccgaggatttggccttcttagagaaagaagatggagtagcatcacttgaaatgattggaaaaggtggatgtggagaagtttatagagctgagttaccaggaagtaatgggaagattatagctataaagaagattttacaacccccaatggatgctgcagaactcgccgaggaagataccaaggctttgaacaagaaaatgcgacaggtaaaatcagaaattcaaattcttggtcaaatcagacacaggaatttgcttcccctactggcacatatgcctaggccggactgccattacttggtatatgaatatatgaaaaatgggagcttacaagatatcctccagcaagtcacagaagggacaagggaattagattggttgggacgacaccgaattgcagtagggatagctactggacttgagtatctccatataaaccacagtcaatgcataattcacagagatctaaagccagcaaatgtccttcttgacgatgatatggaagctcgaattgctgattttggacttgcaaaggcagttccagatgcccatacacatgttacgacttcaaatgttgcaggaactgtgggatatatagcaccagaataccatcagacactgaagtttacagataagtgtgatatatacagctttggtgtggtgttggcagtgctggttataggaaagcttccatcagatgaatttttccagcacacgcctgagatgagtttagtgaagtggctgagaaatgtaatgacttctgaggatccaaaaagggcaattgatccaaagctgataggaactggatttgaggagcaaatgcttttggttctcaagatagcttgcttttgtactctggaaaatccaaaggagaggcctaacagtaaggatgttaggtgtatgttaactcagatcaagcattaagtaagcacgtgatattgcaataatgaacaagttggtttatgtaactaagaatgtgttttgtactatctccaagatggagactttgcaagttaagtttttgttgtaattggtttatacaaagtaaatcaaatctctgtactgnagtcttaatggtattctttccacttttntgctgaagttactaaactc

SEQ ID NO: 999 - DNA, 667 bp, Solanum tuberosum
attaagcctcaaattcatacaatataatggggctgagggctattcccttttcaccttctcaaaattactatttgagtggttcagaatatttccccaaatgcagtattcttcgtagcagcagaatttgctcatcaaaactagtagcaatttcagcaaaggctaaaaaagaggatacacaagaagaagaaccaaaaaataagaggaaacaatctttgttttcaagtgtaactgaagctcttgatttttcccaagttagatcttcaaaggacgctgagcttcttgatgaagcaagagaaaaaacacaatccggagagagaatgtctagagaacagtatggagctctgagaaggaagattggtgggacatacaaagatttcttcaagtcctacgttgaggtggatggacaatatgtggaggagggatgggtagacaaaacgtgcaaggtttgcaagaaagatacgagtggagaagcaaggcaagttgacaaattgggaagatatgcgcacgtagcttgcctagaaaaatccaactctggaaatttcttcaccaagctcttctcaagatgaattttgtagtatatatcttaagggctaattagtagtacgtactatttcctcctcttatatatgaactcataagaatataacagccttggccattttgtgtt

SEQ ID NO: 1000 - DNA, 793 bp, Solanum phureja
acagcttcaaggtagtaattaattaagtctcaaattcatacaatataatggggctgagggctattcccttttcaccttctcaaaattactatttgagtggttcagaatatttccccaaatgcagtattcttcgtagcagcagaatttgctcatcaaaactagtagcaatttcagcaaaggctaaaaaagaggatacacaagaagaagaaccaaaaaataagaggaaacaatctttgttttcaagtgtaactgaagctcttgatttttcccaagttagatcttcaaaggacgctgagcttcttgatgaagcaagagaaaaaacacaatccggagagagaatgtctagagaacagtatggagctctgagaaggaagattggtgggacatacaaagatttcttcaagtcctacgttgaggtggatggacaatatgtggaggagggatgggtagacaaaacgtgcaaggtttgcaagaaagatacgagtggagaagcaaggcaagttgacaaattgggaagatatgcgcacgtagcttgcctagaaaaatcccactctggaaatttcttcaccaagctcttctcaagatgaattttgtagtatatatctcctcttatatatgaactcataagaatataacagccttggccattttgtgtttctctttttttcttgactcaatcatgaatgttatcaattggtcttagcctcttgaatagagttattcaaaagtatatcagtgtattcagaggcggagctatgattttttaactttatgaattctcattttagaatca

SEQ ID NO: 1001 - DNA, 689 bp, Solanum tuberosum
  misc_feature (29)..(29): n is a, c, g, or t
  misc_feature (550)..(550): n is a, c, g, or t
gacaacttcaaggtaagaattaattaagnctcaaattcatacaatataatggggctgagggctattcccttttcaccttctcaaaattactatttgagtggttcagaatatttccccaaatgcagtattcttcgtagcagcagaatttgctcatcaaaactagtagcaatttcagcaaaggctaaaaaagaggatacacaagaagaagaaccaaaaaataagaggaaacaatctttgttttcaagtgtaactgaagctcttgatttttcccaagttagatcttcaaaggacgctgagcttcttgatgaagcaagagaaaaaacacaatccggagagagaatgtctagagaacagtatggagctctgagaaggaagattggtgggacatacaaagatttcttcaagtcctacgttgaggtggatggacaatatgtggaggagggatgggtagacaaaacgtgcaaggtttgcaagaaagatacgagtggagaagcaaggcaagttgacaaattgggaagatatgcgcacgtagcttgcctagaaaaatccnactctggaaatttcttcaccaagctcttctcaagatgaattttgtagtatatatcttaagggctaattagtagtacgtactatttcctcctcttatatatgaactcataagaatataacagccttggccattttgtgtt

SEQ ID NO: 1002 - DNA, 982 bp, Capsicum annuum
ccacaagccacgtcatatgttaagaaccaccagttatttgatttcagtgactgccccaaaatttttattctaaaaattaactatggcacaaacaaatttcttcccatataatagagcaatttaaagctgcagcttgagcttagcactagtaattggaaagcaacttaatggggctcagggctattccattttcagcttctcaaaatggccttatgcctaattactatttgggtggttcagaatatttcgccaaatgctgtgttcttcctagcagcagaatgtcctcatcaaaactagtagtagtttcagcaaaggcaaagaaagagcatacacaagaagaagaagaacccaagaataagaagaagcaatctttgttttcaagtgtaactgacgctctcgatttttcccaggttagatccgcaaaggacgcggagcttcttgatgaagctcgacaaaaaacacaatctggggagagaatgtccaaagaacagtatggagctctaagacggaagattggtgggacatacaaagatttcttcaagtcctacgttgaggtggatgggcaatatgtggaggagggatggatagacaagacgtgcaaggtttgcaagaaagatacgagaggagaagcgaggcaagttgacaaattgggccgatatgcgcacgttgcttgcctagagaaatccaactccggaaatttcttcgccaagctcttctcaagatgaattatatgatcataagggtcaattagtactatttttttcgcactcgtggatacctcttagatatgaactcataaaactagaagaataaaacagtgccacgtccttttgtccaaatttccaatatcattacctttttttctttggccattgtgtatttctttctttcctttaagatgaaattaactgaatcatgaatgtcctcatcaattggtcttagcctcttgaatagagttactgaagtacccatgttttgattt

SEQ ID NO: 1003 - DNA, 2092 bp, Solanum phureja
ctatttttatcaattcctcaaaacgcaactttactatatttgaaaatacacatatttttctttcttttatcatacattcaaatcagggagatttttctgtttccaaagagacgcagcaacattcttctcccaattcacaaattacaaggtaagctcttgatctgtaaaagaggaaaagtttttttttatcttcctctttatcagtttctttgggtagcaattgattgatgggatctctaccggagccaattatggaagaaacttacagcaagccccctggaattagggtgatggagagggcaaagaagtctaacctctctttcaagacatatcaaggcattgtgttaattgtaacatttttagcttatacaagttaccatgctactagaaaaactacaagcattgtgaaaagtgctttggatccccagtctcctgatgttggtttaaagtttccgtggcaaaggcgtaataccacttatgaccaaaatcaaagttcaaaactttcttggatgcttaaagatggttgggtaccatttaacggagttgatggtacagcgatgcttggtgaacttgatgtgtctttcctttttgtatatgccatgggaatgtatttctccgggcacgttggtgataggatggatctgagaatatttttgacagtaggaatggtgggtactggtgtattcactgccctttttggagttggatattgggcaaatgtacacatcttttattactatctaattgtccaaatgatggctggattgttccaatccacaggatggccctcagtggttgcagtagtgggaaattggtttgggaaaaagaagagaggacttataatgggtatttggaatgctcacacctcgatcggtaatattacgggttctttggttgcttcattattgttgaagtatggatggggttggtcaatggttgttcctggtactcttatcgctgtcgttggcgtggtagtattccttttcttgccggttaatcctgaatctgtgggagctaataaagatgaagatgaagtgttttctcctagaaaagtaggtgatgaagtaacagagcctttcttgagatcagatagagaagaggaatcagccgtgggttttattgaagcatggaagattccaggggtggcaccgtttgcgttttgccttttcttcgcaaagttggtagcatacacatttttgtattggctgcctttctacattagccacacagctatagaaggaaggtatttatccaatgaggaagctggaaacttgtcgacattgtttgatgtcggaggggtagtaggtggaatcctagcaggttacatatctgaccgcttagatgccagagctataactgctgccagcttcatgtactgtgctatcccggttctctacttctatcggagctatggacacgtctccatgactataaacatcatcctcatgttgatcactggagtattcgtgaatggtccttatgcattgatcacaactgctgtttcggctgacctgggaacacatagctctttgaaaggcaattcacgagcgcttgcaactgtcactgctattattgacggaactggctcaattggagcggccattggaccacttctaactggttacatttcaactaatagctggagtggtgtatttacaatgctgatgggatcagcttttatagctggtttgtttctaaccaggcttgttgtagctgaagtgggtgaaaagattcaacaattagggccccaaggatcatcacctagatcaaggtcccctgaccttctagtgtgaaaataataattgtggtattcttttattgctttttgtgaatgcatttcgaagcctcgattctaatgttagcctaggatcatagagatatatagagttggagatgcatttcttgacaagaaatggaaggatttctagtatccttgtgtacagcgtgggagttagtttaaaagggggatcactcccaatatcatgaaatagcatttccacatgtacattcttgtgtgctagaaaaggatcaaatacatcattttagtttagaggaaacctgggttattgggcgttttgtacatcttcttttt

SEQ ID NO: 1004 - DNA, 783 bp, Solanum phureja
gaaactactaaacacttctctaggaagctataaataactagctaatccttatccatcaaccatcaaaaaattaaagcaattaaacacaagaacaaacacagaaaattctcaatagctcactgaaaatgtcactgatcccaagaatcttcggtgatcgacgaagcaccagcgtgttcgatccattttcaattgacgtatttgatccattcaaggaattaggcttcccagtttccaattcaggggagacctctgcatttgctaacactcgaatcgattggaaagaaactccagaagctcatgtgttcaaggctgatcttccagggcttaagaaggaggaagtgaaagtggagatcgaagaggatcgtgttcttcagatcagcggagagaggaacgtggagaaggaagacaagaacgatacttggcatcgggtggagcgaagcagcgggaaattcatgagaagattcagacttccggagaatgcaaagatggatcaagttaaggcttctatggagaacggagtgctcactgttactgttccaaaggaagaagtgaagaagcctgatgtcaagtccattgagatctctggttgaaatatgtgaatatattactacagtatcctatgatgtatgggcaaataaaaaataattcgaatccgtagtgtttgaagtagctctgtttctgtatcaaatggcgtggttgatgtacttcctgtaaaatttcatgttaaaaatgtaatagtagtgttgtaatatcttttttgttgttcaaaacttgcagttagtc

SEQ ID NO: 1005 - DNA, 673 bp, Solanum tuberosum
aaacacagaaaattctcaatagctcactgaaaatgtcactgatcccaagaatcttctgtgatcgacgaagcaccagcgtgttcgatccattttcaattgacgtatttgatccattcaaggaattaggcttcccagtttccaattcaggggagacctctgcatttgctaacactcgaatcgattggaaagaaactccagaagctcatgtgttcaaggctgatcttccagggcttaagaaggaggaagtgaaagtggagatcgaagaggatcgtgttcttcagatcagcggagagagaaacgtggagaaggaagacaagaacgatacttggcatcgggtggagcgaagcagcgggaaattcatgagaagattcagacttccggagaatgcaaagatggatcaagttaaggcttctatggagaacggagtgctcactgttactgttccaaaggaagaagtgaagaagcctgatgtcaagtccattgagatctctggttgaaatatgtgaatatattactacagtatcctatgatgtatgggcaaataaaaaataattcgaatccgtagtgtttgaagtagctctgtttctgtatcaaatggcgtggttgatgtacttcctgtaaaattccatgttaaaaatgtaatagtagtgttgtaatatcttttttgttgttc

SEQ ID NO: 1006 - DNA, 672 bp, Solanum tuberosum
gtaaacacaagaacaaacacagaaaattctcaatagctcactgaaaatgtcactgatcccaagaatcttctgtgatcgacgaagcaccagcgtgttcgatccattttcaattgacgtatttgatccattcaaggaattaggcttcccagtttccaattcaggggagacctctgcatttgctaacactcgaatcgattggaaagaaactccagaagctcatgtgttcaaggctgatcttccagggcttaagaaggaggaagtgaaagtggagatcgaagaggatcgtgttcttcagatcagcggagagagaaacgtggagaaggaagacaagaacgatacttggcatcgggtggagcgaagcagcgggaaattcatgagaagattcagacttccggagaatgcaaagatggatcaagttaaggcttctatggagaacggagtgctcactgttactgttccaaaggaagaagtgaagaagcctgatgtcaagtccattgagatctctggttgaaatatgtgaatatattactacagtatcctatgatgtatgggcaaataaaaaataattcgaatccgtagtgtttgaagtagctctgtttctgtatcaaatggcgtggttgatgtacttcctgtaaaattccatgttaaaaatgtaatagtagtgttgtaata

SEQ ID NO: 1007 - DNA, 732 bp, Solanum tuberosum
ctaaacacttctctaggaagctataaataaataactagctaatccttatccatcaaccatcaaaaaattaaagcaagtaaacacaagaacaattctcaatagctcactgaaaatgtcactgatcccaagaatcttcggtgatcgacgaagcaccagcgtgttcgatccattttcaattgacgtatttgatccattcaaggaattaggcttcccagtttccaattcaggggagacctctgcatttgctaacactcgaatcgattggaaagaaactccagaagctcatgtgttcaaggctgatcttccagggcttaagaaggaggaagtgaaagtggagatcgaagaggatcgtgttcttcagatcagcggagagaggaacgtggagaaggaagacaagaacgatacttggcatcgggtggagcgaagcagcgggaaattcatgagaagattcaaacttccggagaatgcaaagatggatcaagttaaggcgtctatggagaatggagtgcttaccgttactgttccgaaggaagaggtgaagaagtctgatgtcaagtccattgatatctctggttgaaatatgtgaatatattactatagtatcctatgatgtatgggcaaataaataaaaaatcgaatccgtagtgtttgaagttgctctgtttctgtatcaaataacgtggttgatgtacttcctgtaaaatttcatgttaaaaatgtaatagtagtgtt

SEQ ID NO: 1008 - DNA, 770 bp, Solanum tuberosum
ctaaacacttctctaggaagctataaataaataactagctaatccttatccatcaaccatcaaaaaattaaagcaagtaaacacaagaacaattctcaatagctcactgaaaatgtcactgatcccaagaatcttcggtgatcgacgaagcaccagcgtgttcgatccattttcaattgacgtatttgatccattcaaggaattaggcttcccagtttccaattcaggggagacctctgcatttgctaacactcgaatcgattggaaagaaactccagaagctcatgtgttcaaggctgatcttccagggcttaagaaggaggaagtgaaagtggagatcgaagaggatcgtgttcttcagatcagcggagagaggaacgtggagaaggaagacaagaacgatacttggcatcgggtggagcgaagcagcgggaaattcatgagaagattcaaacttccggagaatgcaaagatggatcaagttaaggcgtctatggagaatggagtgcttaccgttactgttccgaaggaagaggtgaagaagtctgatgtcaagtccattgatatctctggttgaaatatgtgaatatattactatagtatcctatgatgtatgggcaaataaataaaaaatcgaatccgtagtgtttgaagttgctctgtttctgtatcaaataacgtggttgatgtacttcctgtaaaatttcatgttaaaaatgtaatagtagtgttgtaatatctcttttgttgttcaaaacttgcagttagtc

SEQ ID NO: 1009 - DNA, 666 bp, Solanum tuberosum
caagaaaattctccaatagctcactgaaatgtcactgatcccaagaatcttctgtgatcgacgaagcaccagcgtgttcgatccattttcaattgacgtatttgatccattcaaggaattaggcttcccagtttccaattcaggggagacctctgcatttgctaacactcgaatcgattggaaagaaactccagaagctcatgtgttcaaggctgatcttccagggcttaagaaggaggaagtgaaagtggagatcgaagaggatcgtgttcttcagatcagcggagagagaaacgtggagaaggaagacaagaacgatacttggcatcgggtggagcgaagcagcgggaaattcatgagaagattcagacttccggagaatgcaaagatggatcaagttaaggcttctatggagttcggagagctcactgttactgttccaaaggaagaagtgaagaagcctgatgtcaagtccattgagatctctgtttgaaatatgtgaatatattactacagtatcctatgatgtatgggcaaataaaaaataattcgaatccgtagtgtttgaagtagctctgtttctgtatcaaatggcgtggtttgatgtacttcctgtaaaattccatgattccaaatggtaatagtagtgtttgtaatatctttttt

SEQ ID NO: 1010 - DNA, 690 bp, Solanum lycopersicum
gctcctcttccatcaaccatcaaaaattgaaaagtaagcaaacacagaaatttctcaaaaagctaaccaaaaatgtctctgatcccaagaatcttcggcgaccgacgaagcagtagcatgttcgatccattttcaattgacgtatttgatcaatttaggggattaggctttccaggtaccaattcaggggagacctctgcatttgctaacactcgaatcgattggaaggaaactccagaagctcatgtgttcaaggctgatcttccagggcttaagaaggaggaagtgaaagtggagatcgaagaagatagggttcttcagatcagcggagagaggaacgtggagaaagaagataagaacgacacttggcatcgtgtggaacgcagcagtggaaaattcatgaggagatttagacttccagagaacgcaaagatggatcaagtcaaggcttctatggagaatggagtgctgactgtcactgttccaaaggaagaagtgaagaagcctgatgtcaagtctattgaaatctctggttaaaacttcatttgcttgttaagtggtagtatatgatgtatgagcaaataatcagttggatattttaagttgctgtgtctttgtattcaagtgttttgagttgtctctgtttctgatgttcaagatatgaaatactaacccttttcagtctgttcc

SEQ ID NO: 1011 - DNA, 703 bp, Solanum melongena
ataagaagcaaacacagaacattcccaataaactcactttaaaatgtcactaatcccaagaatcttaggcgatcgacgaagcagcagcgtcttcgatccattctccatcgacgtatttgatcctttcaaggaattaggcttcccggttctcagttcaggagagacctcggcatttgctaacacccgaattgactggagggaaactccggaggctcatgtgttcaaggccgatcttccagggcttaagaaggaggaagtgaaggtggagatcgaagaagataagagttcttcagattagcggagagaggaacgtggagaaggaagataagaatgatacgtggcatcgcatggaacgaagcagcggcaaattcatgagaagattcagacttccggagaatgcgaagatggatcaagttaaggcgtctatggagaacggagtgctcactgttactattccaaaggaacaagtgaagaagcctgatgtcaagtctattgagatctctggttagacactttagataaaggaaaaatcatatgaaaatttgttactactagtatatgatggatgtgcaaataaaaaagaaatcaaatctgtaatgtttgaagctgctctgtctttctagactctttttcttttttcttgcctgatgtacttcctttgaaattccatgttcaaaatgtaaaagtattgtattatcctttc

SEQ ID NO: 1012 - DNA, 652 bp, Solanum tuberosum
ttctcaaaaagctcactgaaaatgtctctgatcccaagaagaatcggcgatcgacgtagcagcagcatgtttgatccattctcaattgacgtgtttgatccatttagggaattaggcttcccaggtaccaattcaggggagacctctgcatttgctaacactcgaatagattggaaggaaaccccagaagctcatgtgttcaaggctgatcttccagggcttaagaaggaggaagtgaaggtggagatcgaagaagatagggttcttcaaatcagcggagagaggaacgtggagaaagaagataagaatgatacttggcatcgtgtggaacgcagcagcgggaaattcatgagaagattcagacttccggagaacgcaaagatggatcaagttaaggcttctatggagaatggagtgcttactgtcactgttccaaaggaacaagtgaagaagcctgatgtcaagtctattgaaatctctggttaaaaatacatttgtcaattaagtagtagtatatgatgtatgaacaaataaacaatggattatgtctgttgaagatttgaagttgctctgtttttctatttaagtcttgagtctgctctgtttctgcttaatggagtagttgtacttttccaaattccatgttgaatat

SEQ ID NO: 1013 - DNA, 640 bp, Solanum phureja
gaaaaccaagccaacacagaaatttctcaaaaagctcactgaaaatgtctctgatcccaagaatcttcggcgatcgacgtagcagtagcatgtttgatccattctcaattgacgtgtttgatccatttagggaattaggcttcccaggtaccaattcaggggagacttctgcatttgctaacactcgaatagattggaaggaaactccagaaggtcatgtgttcaaggctgatcttccagggcttaagaaggaggaagtgaaggtggagatcgaagaagatagggttcttcaaattagcggagagaggaacgtggagaaagaagataagaatgatacttggcatcgtgtggaacgcagcagcgggaagttcatgagaagattcagacttccggagaacgcaaagatggatcaagttaaggcttctatggagaatgaagtgcttactgtcactgttccaaaggaacaagtgaagaagcctgatgtcaagtctattgaaatctctggttagaaattcatttgtgaactaagtggtagtatatatatatgatgtatgaccaaataaacaactgaatccgttgtatctgttggagatttgaagttgctgtgctctctgtattcaagtgcaataggaaataaaat

SEQ ID NO: 1014 - DNA, 474 bp, Solanum phureja
ctcactgaaaatgtcactgatcccaagaatcttcggcgatcgaagaagcagcagcatgtttgatccattctcaatggacgtgttcgattcgttcaaggaactaggcttcccagtttccaattcaggagagacctctgcatttgcgaacactcgagtcgactggaaggaaactccagaagctcatgtgttcaaggccgatcttccagggcttaaaaaggaggaagtgaaagtggagatcgaagaagatagggttcttcaaattagcggagagaggaatgtggagaaagaagataagaatgataagtggcatcgcgtggaacgcagcagtgggaaattcatgagaagatttagacttccggagaatgcgaagatggatcaagttaaggcttcgatggagaatgaagtgcttactgtcactgttccaaaggaacaagtgaagaagcctgatgtcaagtccattgagatctctggtta

SEQ ID NO: 1015 - DNA, 798 bp, Solanum tuberosum
  misc_feature (13)..(13): n is a, c, g, or t
  misc_feature (25)..(25): n is a, c, g, or t
  misc_feature (95)..(95): n is a, c, g, or t
  misc_feature (98)..(98): n is a, c, g, or t
gagaactatgganaaagtgctaaanactcctataatgaagctataaataaccaccatctcctcttccatcaaccatcaaatttgaaagcaagcangcnaaaaaaaaaacagaaagttctcaaaaaactcactgaaaatgtctctgatcccaagaatctttggcgatcgacgaagcagtagcatgttcgatccattctcaattgacgtgtttgatccattcagggaattaggcttcccaggtaccaattcaggggagacctctgcatttgctaacactcgaatagactggaaggaaactccagaagctcatgtgttcaaggctgatcttccagggcttaagaaggaggaagtaaaagtggaagtcgaagaagatagggttcttcaaatcagcggagagaggaacgtggagaaagaagataagaatgataagtggcatcgcgtggagcgaagcagcggcaaattcatgaggagatttagacttccggagaatgcaaagatggatcaagttaaggcttctatggagaatggagtgcttactgtaactgttccaaaggaagaggtgaagaaacctgaggtgaagtccattgacatctctggttaaacccttcagctggggaacaaaaacctgtagtattaagtaaagtgtgtactgttgaagattttgagtttttattttattttctgcctgtgtcttatgctgagtcgttttcctagtttgttatgacctgtttgatgtatttccctcgagtactctatatgtgaaaatatgtattactaataatagtatttctggtgcca

SEQ ID NO: 1016 - DNA, 834 bp, Nicotiana tabacum
cggatagaagtatcgagaaagcactaaacactcctctacgacagtttaaatatctacccaggtcctcttccttgaaccaacgaacttgaaagctgaaagcaaattaagaaaattctcaaaaagctcactgaaaatgtcactgattccaagagtgttcggcgatcgacgaagcagtgtctttgatccattctcaattgacgtgtttgattcgttcagggaattgggctttccaggttccaattcaggggagacttctgcattcgcgaacactcgagtcgattggaaggaaactccggaggctcatgtgttcaaggccgatctccctgggcttaagaaggaggaagtgaaagtggagatcgaggatgatagggttcttcagattagcggagagaggaacgtagagaaagaagacaagaatgatacttggcaccgtgtggaacgcagcagtggcaaattcatgaggaggttcagacttccggagaatgcgaaaatggatcaagttaaggcggcgatggagaatggagtgctcactgttactgttccgaaagaagaggtgaagaagcctgatgtcaaatccattgatatcagtggttagatagtcgctttggctgaaatatgtaagtacgctatgatatgtgagcaagtatatgtagaagttgctgtgtttttgtatctggtctgtagtcgagtctgtttttcgcttaaaggtgtgtttgatgtaattttgttgaaattctatgtggtaaaggcaatagtgttgttatagaatcaaagtattgtattatccttcaattctgttcgatctcccatattttccttcttcttcgtcttctc

SEQ ID NO: 1017 - DNA, 808 bp, Solanum lycopersicum
cgggctgcagggaaatgtctctgtggatagtagaagtatggagaaactgctaaacactcctccaatgaagctataaataactaccgcctcctcttcaatcaaccatcaaaatcgaaagcaagcaagcaaaaaaacgtagaaaattctcaaaaaagttcactgaaaatgtctctgatcccaagaattttcggcgatcgacgaagcagcagcatgttcgatccattttcaattgacgtatttgatccattcagggaattaggcttcccaggtaccaattcaggggagagctctgcatttgccaacacacgaatagactggaaggaaactccagaagctcatgtgttcaaggctgatcttccagggcttaagaaggaggaagtcaaagtggaagtcgaggaggatagggttcttcagatcagcggagagaggaacgtggagaaggaagataagaatgacaagtggcatcgcgtggagcgaagcagcgggaaattcatgaggagatttagacttccggagaatgcaaagatggatcaagttaaggcttcaatggagaacggagtgcttactgttactgttccaaaagaagaggtgaagaagcctgaggtcaagtccattgagatttctggttaaaaatacatttgtgaattaagttgatgtgtatggtcaaataaataactgagttgttgtgtctgttgaaggtttgaagttgctctgtttttctatcgaaagtcttgagtcggctttgtttctcgcctaatggcgtgttgtacttttccaagtttcacgtttaatatgaaaaatttgtctt

SEQ ID NO: 1018 - DNA, 817 bp, Solanum phureja
aatgtctcagtggatagtagaactatggagaaagtgctaaacagctcctataatgaagctataaataactaccacctcctcttccatcaatcatcaaaattgaaagcaagcaagtaaaaaagttctcaaaaaactcactgaaaatgtctctgatcccaagaatctttggcgatcgacgaagcagtagcatgttcgatccattctcaattgacgtgtttgattcattcagggaattaggcttcccaggtaccaattcaggggagacctctgcatttgctaacacgcgaatagactggaaggaaactccagaggctcatgtgttcaaggccgatcttccagggcttaagaaggaggaagtaaaagtggaagtcgaagaagatagggttcttcaaatcagcggagagaggaacgtggagaaagaagataagaatgataagtggcatcgcgtggagcgaagcagcgggaaattcatgaggagatttagacttccggagaatgcaaagatggatcaagttaaggcttctatggagaatggagtgcttactgtaactgttccaaaggaagaggtgaagaaacctgaggtcaagtccattgacatctctggttaaacgctttggctgggattaaacttgtagtattaagtaaagtgtgtactgttgaagattttcagtttttttattttctgcctgtgtcttatgctgagtcgttttcctagtttgttatgacctgtgtgatgtatttcccttgagtactctatatgtgaaaatatgtattactagtagtatttctggtgccattctgcaatctgttcaattat

SEQ ID NO: 1019 - DNA, 787 bp, Solanum tuberosum
ctaaacagctcctataatgaagctataaataactaccacctcctcttccatcaatcatcaaaattgaaagcaagcaagtaaaaaagttctcaaaaaactcactgaaaatgtctctgatcccaagaatctttggcgatcgacgaagcagtagcatgttcgatccattctcaattgacgtgtttgattcattcagggaattaggcttcccaggtaccaattcaggggagacttctgcatttgctaacacgcgaatagactggaaggaaactccagaggctcatgtgttcaaggccgatcttccagggcttaagaaggaggaagtaaaagtggaagtcgaagaagatagggttcttcaaatcagcggagagaggaacgtggagaaagaagataagaatgataagtggcatcgcgtggagcgaagcagcgggaaattcatgaggagatttagacttccggagaatgcaaagatggatcaagttaaggcttctatggagaatggagtgcttactgtaactgttccaaaggaagaggtgaagaaacctgaggtcaagtccattgacatctctggttaaacgctttggctgggattaaacttgtagtattaagtaaagtgtgtactgttgaagattttcagtttttttattttctgcctgtgtcttatgctgagtcgttttcctagtttgttatgacctgtgtgatgtatttcccttgagtactctatatgtgaaaatatgtattactagtagtatttctggtgccattaaccactctggtcaattataaaaaa

SEQ ID NO: 1020 - DNA, 744 bp, Nicotiana tabacum
acgaacttgaaagctgaaagcaaattaagaaaattctcaaaaagctcactgaaaatgtcactgattccaagaatgttcggcgatcgacgaagcagtgtctttgatccattctcaattgacgtgtttgattcgttcagggaattgggctttccaggttccaattcaggggagacttctgctttcgcgaacactcgagtcgattggaaggaaactccggaggctcatgtgttcaaggccgatctccctgggcttaagaaggaggaagtgaaagtggagatcgaggatgatagggttcttcagattagcggagataggaacgtagagaaagaagacaagaatgatacttggcaccgtgtggaacgcagcagcggcaaattcatgaggaggttcagacttccggagaatgcgaaaatggatcaagttaaggcggcgatggagaatggagtgctcactgttactgttccgaaagaagaggtgaagaagcctgatgtcaagtccattgagatcactggttagatagacgctttagctgaaatatgtaagtacgctatgatatgtgagcaagtatatgtgaaatcgaatagaagtcttttgtgaatatttgaagtttctctgtttttgtatcttgtctgtagtcgagtctgttaaaggcgtgtttgatgtgaattttttgaaattatatatggaaaaggcagtagtgttgttatagaatcaaagtgttctattatccttcaattctgttcg

SEQ ID NO: 1021 - DNA, 2410 bp, Solanum tuberosum
agctcctataatgaagctataaataactaccacctcctcttccatcaatcatcaaaattgaaagcaagcaagtaaaaaagttctcaaaaaactcactgaaaatgtctctgatcccaagaatctttggcgatcgacgaagcagtagcatgttcgatccattctcaattgacgtgtttgattcattcagggaattaggcttcccaggtaccaattcaggggagacttctgcatttgctaacacgcgaatagactggaaggaaactccagaggctcatgtgttcaaggccgatcttccagggcttaagaaggaggaagtaaaagtggaagtcgaagaagatagggttcttcaaatcagcggagagaggaacgtggagaaagaagataagaatgataagtggcatcgcgtggagcgaagcagcgggaaattcatgaggagatttagacttccggagaatgcaaagatggatcaagttaaggcttctatggagaatggagtgcttactgtaactgttccaaaggaagaggtgaagaaacctgaggtcaagtccattgacatctctggttaaacgctttggctgggaaaaacctgtagtattaagtaaagtgtgtactgttgaagattttcagtttttattttattttctgcctgtgtcttatgctgagtcgttttcctagtttgttatgacctgtttgatgtatttccctcgagtactctatatgtgaaaatatgtattactagtagtatttctggtgccattttttagcaacattttttccttttactaaacaggcagcaatctagtactaaactatgtaacaaaactgttttcacctaacctttatccactcccaagcagacaaccaacttatacacgagcaaaagaatttcaaataaaaatataagatgactggctatgttggccagacccgccaaccaggtctcttctgaagcatccaagctgggggacacttgcatcaacttaagagacccaaagtcactagaaggtcatgacttctctgtgtatcccccctaaaaaaaattccacagtccaccctgggacgataaaatgagagttcaattaaaccaccaagcaccctcatcaacttgacgatcggccaaagtattaaagagatatcaatcaatctctccttcctctggatcattcgatacgtcagggatgctctgtggttcagcttcttcttcctcctcttcatcttcatcttcatcttcttccttcatatataatccaagttgctccaatggattactagttgccttaaatttgaaactcccaagaacattctcagaatgaccaggactagtctcctcaatgaagctctctagctgttcatctggagcagctctgaacaattccagatcttccataaattgactgttctcattgatttcaacagtcttctccatcttctggagtgcctgacgggcagcttctctttcaagttcacgtttccttttggcttctgcagcagcttctgcctcagctcttttacgagcctcttcggcagccttagcttcagcttgcaaccgagctttctcttctcgccttcgcctttcaaactcctctctctcaagctttagcttttctgggtcccgcacttcacccttttcaatgctcttttcctgagcttttagtatgatatccgcaaagcgacctcttaacaaagctgcacggtaaagcttctcaggagagacttgcctctcaggttcagcactttcctcctctcgatgatcatcgggctcagcaaaattggagttctgctgagaagtcagcactgtttggccagccaacggatctgtagtttctggaaggtcaagctcatcttcctgctccaatctcgccccagaagccgctgttgccttctgaacagttaaggcaactgaatctttatcagcatccgattcaccaccagatgagcttccagaatctgtaccactagatgaagagccagaatcactactcgaactacttgaactactgcatttattgctcctgcgagctctatccttctctatctccacaggagggaagcttgaaacaggtggatcgttcccaccgatatccacttcctcatctgccggatcatttcctttgcatggctgcatggatgaattactgaatccagactcattgtgaagctccatctcacagggttcacctttagcctgatttttctgtttctccagtagataatcatccaaaagcttccgtagctcgtacaagatatcatcatgaagaacatcaagatcaatctcgatctcatcttcactgacttgacttccgttggagcttttttctttcaagaaatcaattatattttcaggtaattcagtcagtaaatcttcaagctcggcagtgagtttatgttttacaacatcactcatgactcc

SEQ ID NO: 1022 - DNA, 746 bp, Solanum phureja
ttcaaagaagaagattgtgagaacaacagtttaaaagcttaattgaaaatgtcactaattcctagaattttcggtgatcgacgaagcagcagtaagtttgatccattctcaatggacatgtttgattccttcaaggaattaggctttccaggttcaaattcaggggagatctctgcatttgccaacactcgagttgattggaaggaaactccagaagctcatgtgttcaaggccgatcttccagggcttaagaaggaggaagtgaaagtggagatcgtagaagatagggttcttcagattagcggagagaggaacgtggagaaagaagataagaatgataagtggcatcgcgtggagcgaagcagcgggaaattcatgaggagatttagacttccggagaatgcaaagatggatcaagttaaggcttctatggagaatggagtgcttactgttactgttccaaaggaacaagtgaagaagcctgatgtcaagtctattgaaatctctggttaaaaatacatttgtcaattaagtagtagtatatgatgtatgaacaaataaacaatggattatgtctgttgaagatttgaagttgctctgtttttctatttaagtcttgagtctgctctgtttctgcttaatggagtagttgtacttttccaaattccatgttgaatatgaaatactagtctttttattaaattgttatttcatatttacgtaacttcaaaaaataattatttagc

SEQ ID NO: 1023 - DNA, 801 bp, Solanum lycopersicum
taaataactaccacctcctcttcaatcaaccatcaaaatcgaaagcaagcaagcaaaaaaacgtagaaaattctcaaaaagttcactgaaaatgtctctgatcccaagaattttcggcgatcgacgaagcagcagcatgttcgatccattttcaattgacgtatttgatccattcagggaattaggcttcccaagtaccaattcaggggagagctctgcatttgccaacacacgaatagactggaaggaaactccagaagctcatgtgttcaaggttgatcttccagggcttaagaaggaggaagtcaaagtggaagtcgaggaggatagggttcttcagatcagcggagagaggaacgtggagaaggaagataagaatgataagtggcatcgcatggagcgaagcagcgggaaattcatgaggagatttagacttccggagaatgcaaagatggatcaagttaaggcgtctatggagaatggagtgcttactgttactgttccaaaggaagaggtgaagaagcctgaggtcaagtccattgagatctctggttaaatgctctggttgggaacaaacctgtagtattaagtcaagtgtgtactgtcgaagattttgagtttacttattttctgtctgtgtcttgtgcgctgagtcgttttactagttggttgttatctgtttgatgtattttccttgagaactcttatgtgtgaaagaatgtattactactaataatagtatttctggtgcccgggatcttttgacgggtcggatcttaataacatcaaaactggctggca

SEQ ID NO: 1024 - DNA, 750 bp, Capsicum annuum
cgaaactataaatacccaccagctcctctttcgtaaacgatgatcggaattgaatcaagcaatcagggaaccaagcaaacaaagaaaattcaagctcactgaaaatgtcgctaatcccaagaatcttcggcgatcgacgaagcagcagcatgttcgatccattctcaatcgacatgtttgatccattcagggaattgggcttcccaggttccaattcaagggaggcctctgcatttgccaacacacgaatcgactggaaggaaacacccgaggcgcatgttttcaaggccgatcttccagggcttaagaaggaggaagtgaaagtagagatcgaagagcatagggtacttcagattagcggagagaggaatgaggagaaagaagataagagtgatacttggcatcgtatggaacgaagcagcggaaaattcatgagaagattcagacttccggagaatgcaaagatggatcaagttaaggcttcgatggagaacggagtgctgactgttactgtcccgaaggaagaggtgaagaagcctgatgtcaaatccattgagatctctggttagacgctttggctgaaagctactctaagatatagtaaagtacttgaggtgtgtgctgttcaaaatttggtgttctctgttttgtctgtcttatgctgagtcctcttccttctcctgcttgatgtatttccgttttgaactctgtatgtgaaaaggaatgtaataaatttctggttttagtctt

SEQ ID NO: 1025 - DNA, 691 bp, Capsicum annuum
agcaaatacaaataattctcaaaagctcactgaaaatgtcactgattccaaggatcttcggcgatcgacgaagcaacagcatgttcgatcccttcgcaatggacgtgtttgatccattcagggaattaggcttcccaggttccagttcaagggagacctctgcatttgccaacactcgaatcgactggagggaaactcctgaggcacatgtgttcaaggctgatcttccagggctcaagaaggaagaagtgaaagtggagatcgaagaggatcgtgttcttcagattagtggagagaggaacgtggagaaagaagataagaatgatacttggcaccgaatggaacgcagtagtggcaaattcatgagaagatttagacttcctgagaacgcaaagatggatcaagttaaggcatctatggataatggagtacttactgtcaccgtcccgaaggaagaagtgaagaagcctgatgtcaaatccattgagatctctggttagacatgttggttgaaagtttctatatgtagatattaaggtgtgtattgtggaaaagtatggagcttttggtgtgtgtcttgtgctaagtcctccctttttggctatcatctgtttgatgtatttaccttgagaactctgtatgtgaaaaatgttgtagtactaaataatatatttcatttctggcctcgtgc

SEQ ID NO: 1026 - DNA, 804 bp, Solanum lycopersicum
atggagaaactgctaaacactcctctaatgaagctataaataactaccacctcctcttcaatcaaccatcaaaatcgaaagcaagcaagcaaaaaaacgtagaaaattctcaaaaagttcactgaaaatgtctctgatcccaagaattttcggcgatcgacgaagcagcagcatgttcgatccattttcaattgacgtatttgatccattcagggaattaggcttcccaagtaccaattcaggggagagctctgcatttgccaacacacgaatagactggaaggaaactccagaagctcatgtgttcaaggttgatcttccagggcttaagaaggaggaagtcaaagtggaagtcgaggaggatagggttcttcagatcagcggagagaggaacgtggagaaggaagataagaatgataagtggcatcgcatggagcgaagcagcgggaaattcatgaggagatttagacttccggagaatgcaaagatggatcaagttaaggcgtctatggagaatggagtgcttactgttactgttccaaaggaagaggtgaagaagcctgaggtcaagtccattgagatctctggttaaatgctctggttgggaacaaacctgtagtattaagtcaagtgtgtactgtcgaagattttgagtttacttattttctgtctgtgtcttgtgcgctgagtcgttttactagttggttgttatctgtttgatgtattttccttgagaactcttatgtgtgaaagaatgtattactactaataatagtatttctggtgccattctgcaatctgttc

SEQ ID NO: 1027 - DNA, 717 bp, Solanum melongena
atcaaaagcagaattcgcagaaaagtacatacaataaattctcataaaattcactgaaaatgtcgctaatcccaagaatgtttggcgatcgacgaagcagcagcatgttcgatccattctctattgacgtattcgatccattcagagaattaggcttcccgagttccaattcacgggagacctctcaattcgccaacacccgaatcgactggaaggaaactccggaggctcatgtgttcaaggctgatcttccagggcttaagaaggaggaagtgaaggtggaaatcgaagacgatagggttcttcagattagcggtgagaggaacgtggagaaagaggacaaaaatgatacttggcaccgcatggaacgcagcagcgggaaattcatgagaagattcagacttccggagaatgcaaagatggatcaagttaaggcttctatggagaatggagtgctcactgttatggttcccaaggaagaggtgaagaagtctgatatcaagtccattgagatctctggttagacgttttggctggattaagtatatatggtgtgtatggtcaaagttttggagttcctgtttttctttttcttgcctgtatggtatgctggatcgtctttctagttggctattacctgtttgatgtattttccttgagaactctatatgtaaaaagatgttctactaataataaataatagtatgtctgttgccg

SEQ ID NO: 1028 - DNA, 694 bp, Solanum tuberosum
gtgagaacaacagtttaaaagcttaatttgaaaatgtcactaattcctagaattttcggtgatcgacgaatcagcagcaagttcgatccattctcaatggatgttttttattccttcaaggaattaggctttccagtatcaaattcaggggagatctctgcatttgccaacactcgagtcgattggaaggaaactccagaagctcatgtgtttaaggctgatcttccagggattaagaaggaggaagtgaaagtggagatcgaagaagatagggttcttcaaattagcggagagaggaacgtggagaaagaagataataatgataagtggcatcgtgtggagcgaagcagcgggaaattcatgaggagatttagacttccggagaatgcaaagatggatcaagttaaggcttctatggagaatggagtgcttactgttactgttccaaaggaacaagtgaagaagcctgatgtcaagtctattgaaatctctggttaaaaatacatttgtcaattaagtagtagtatatgatgtatgaacaaataaacaatggattatgtctgttgaagatttgaagttgctctgtttttctatttaagttcttgagtctgctctgtttctgcttaatggagtagttgtacttttccaaattccatgttgaatatgaaatactagtctttttatttaaaaagga

SEQ ID NO: 1029 - DNA, 492 bp, Solanum phureja
aaaattcttaacaaataaaaaaaagtctgattccaagaatctttggcgatcgacgaagcagcagcacgtttgatccattctcaatggacgtgttcaattcgttcaaggaattaggcttcccaatttccaattcaggagagacctctgcatttgccaacactcgagtcgactggaaggaaactccagaggctcatgtgttcaaggctgatcttccagggcttaaaaaggaggaagtgaaagtggagatcgaagaagatagggttcttcaaattagcggagagaggaatttggagaaagaagataagaatgataagtggcatcgtgtagaacgcagcagtgggaaattcatgaaaagatttagacttccggagaatgcgaagatggatcaagttaaggcttctatggagaatagagtgcttactgttattgttccaaaggaagaggtaaaaaagcctgatgtcaagtccattgagatctctgggtaaaaataaa

SEQ ID NO: 1030 - DNA, 624 bp, Solanum tuberosum
agaattttcggtgatcgacgaagcagcagcaagttcgatccattctcaatggatgtttttttttccttcaaggaattaggctttccagtttccaattcaggggagatctctgcatttgccaacactcgagtcgattggaaggaaactccagaagctcatgtgttcaaggccgatcttccagggcttaagaaggaggaagtgaaagtggagatcgaagaagatagggttcttcaaattagcggagagaggaatgtggagaaagaagataagaatgataagtggcatcgtgtggaacgcagcagtgggaaattcatgagaagatttagacttccggagaatgcgaagatggatcaagttaaggcttcgatggagaatggagtgcttactgttactgttccaaaggaacaagtgaagaagcctgatgtcaagtccattgagatctctggttaaaagtccatttgtgaattaagtagtagtatatgatatatgggcaaataaagaactgattccgttgtgtctgttgaagatttgaagttactctgtttttctattgaagtgttgagtcggctctgtttctagcctaatggcgtaattgtactttctttgaaattccatgtttaatat

SEQ ID NO: 1031 - DNA, 663 bp, Solanum tuberosum
agaattttcggtgatcgacgaagcagcagcaagttcgatccattctcaatggacgtgtctgattccttcaaggaattaggctttccagtatcaaattcaggggagatctctgcatttgcgaacactcgagtcgattggaaggaaactccagaagctcatgtgtttaaggccgatcttccagggcttaagaaggaggaagtgaaagtggagatcgaagaagatagggttcttcaaattagcggagagaggaacgtggagaaagaagataagaatgataagtggcatcgcgtggagcgaagcagcggtaaattcatgagaagatttagacttccggagaatgcaaagatggatcaagttaaggcttctatggagaatggagtgcttactgttactgttccaaaggaacaagtgaagaaacctgatgtcaagtccattgagatctctggttagacgctttggttaaaaatatacatttgtgaattaaatattagtatatgatgtatgggcaaataaacaatggatcatgtctgttgaagatgtgaagttgctctgtttttctatttaagtcttgagtcggctctgtttctgcttaatggcgtagttgtacttttccaaattccatgttgaatatcagaatatgaaatactagtctttttattgaat

SEQ ID NO: 1032 - DNA, 832 bp, Capsicum annuum
gcacgaggcgagaaagtacttgacactcctctaacgccttataattacccatcagtttcagttcctcttctacgaaccatcaaaaaactgaaatcaaacaaaagccccaagcaatacataaaattcattctctaaagctcactcgaaaatgtcgctgatcccaagaatcttcggcgatcgacgaagcagcagcatgatggatccattctcaatggacctgttcgatccgttcagggaattaggcttgccaggtttcaattcaggggagacctctacattcgccaacgcacgagtcgactggaaggaaactccagaagctcatgtgttcaaggccgatcttccagggcttaagaaggaagaagtgaaagtggagatcgaagaggatagggtacttcagattagcggagaaaggaatgtggagaaggaagataagaatgatacttggcatcgtgtggagcgcagtagcggaaaattcatgagaaggtttagacttccggagaatgcaaagatggaacaagttaaggcttcgatggagaatggagtgcttactgttactgttcccaaggcagaagtgaagaagcctgatgtcaaatccattgagatctctggctaaacgctttggctaaatattcgaagtactctgtgttgtatgggcaaataagaagttgaactcgttgtgtttgaagttgctctgtttttgtatcaaaagtctctgagtcgtgtctgtttatcgcttaatggctaaaattccatgttgaaaatataatactattagtagttttgtattttcctttaattctgttcaaacttccatgtgtgttctttcttcttg

SEQ ID NO: 1033 - DNA, 642 bp, Solanum phureja
ggcgatcgaagaagcagcagcatgtttgatccattctcaatggacgtgttcgattcgttcaaggaactaggcttcccagtttccaattcaggagagacctctgcatttgcgaacactcgagtcgactggaaggaaactccagaagctcatgtgttcaaggccgatcttccagggcttaaaaaggaggaagtgaaagtggagatcgaagaagatagggttcttcaaattagcggagagaggaatgtggagaaagaagataagaatgataagtggcatcgcgtggaacgcagcagtgggaaattcatgagaagatttagacttccggagaatgcgaagatggatcaagttaaggcttcgatggagaatgaagtgcttactgtcactgttccaaaggaacaagtgaagaagcctgatgtcaagtccattgagatctctggttaaaagtccatttgtgaattaagtagtagtatatgatatatgggcaaataaagaactgattccgttgtgtctgttgaagatttgaagttactctgtttttctattgaagtgttgagtcggctctgtttctagcctaatggcgtaattgtactttctttgaaattccatgttgaatatgaaatattagtcctttgattctgttcc

SEQ ID NO: 1034 - DNA, 712 bp, Glycine max
atcatcaaacaacaaaaagactttctctttacaaattttgtaactttcaagactcagctaataaacatcaaaagatgtctctgattccaagtatttttggtggccgaaggagcaacgtgttcgatcctttctcccttgacgtgtgggaccctttcaaggattttcattttcccacttctctttctgctgaaaattctgcatctgtgaacactcgtgtggattggaaagaaaccccagaagcacacgtgttcaaggctgatattccagggctgaagaaggaggaagtgaaggtggaaattgaagatgatagggttcttcagataagcggagagaggaaccttgagaaggaagataagaacgacacgtggcatcgcctggagcgtagcagtggcaagttcatgaggaggttcaggttgccggagaatgctaaagtggagcaagtgaaggcttctatggaaaatggggttcttactgtcactgttcccaaggaagaggttaagaagcctgatgttaaggccattgaaatctctggttaaacttgttgtcgctgaaaatcctgagctttaaaatttgctttgttgtagtgtattaattctctcggtcttgtgttccaatgatgattttgagaaagatcatggaattgcgaattgtacctgcttaagtggtaactgtgtggttgtgtaattcgtgtgaataaacacatgctttcaga

SEQ ID NO: 1035 - DNA, 735 bp, Medicago truncatula
gggctattcattagatttacaccgaacatctatagcattaagcactcagttagttctcagtttacaaagttctttacttcttcaaaatgtcgttgattccaagtttctttggtggccgaaggagcaacgttttcgatccattctcccttgacgtttgggaccccttcaaggattttcctttaaccaattctgcactttctgcttcttcattccctcaggagaattctgcttttgtgagcaccaggattgattggaaggagaccccagaagcacatgtgttcaaggctgatcttcctggactgaagaaggaggaagtgaaggttgaaattgaaggtgatagggttcttcagataagcggagagaggaatgttgagaaagaagataagaacgatcaatggcatcgtgtggagcgcagcagcggaaagttcatgaggagattcaggttgcccgaaaatgcgaaaatggatcaagtgaaagctgcaatggagaatggtgttctcactgttactgttccaaaagaagaagttaagaaacctgatgttaagtccatcgaaatctctggttgaacacatattcaagctctattactctgtttttaggttgagaatattgtgaagtgtgttgtgtgtgcgttctgttttatgtaaaagtaaattctgtgaattatattttgtaaggaataaattatgtaagaatggtttaattatctattgtctcacatcgttttttatgtct

SEQ ID NO: 1036 - DNA, 942 bp, Glycine max
aaacgaaacgaagaaaagagttacaaagttacctgtatacgatctcattttgatctcccaagtttcaaatctcgcgaataaatatatcaaaagatgtctctgattccaagtattttcggtggcagaaggagcaacgtgttcgatcctttctccctcgacgtgtgggatcccttcaaggattttcattttcccacttctctttctgctgaaaattctgcatttgtgaacactcgtgtggattggaaagaaaccccagaagcacacgtgttcgaggctgatattccagggctgaagaaggaggaagtgaaggtgcagattgaagatgatagggttcttcagataagcggagagaggaaccttgagaaggaagacaagaacgacacgtggcatcgcgtggagcgtagcagcggcaacttcatgaggaggttcaggttgccggagaatgctaaagtggagcaagtgaaggcttctatggaaaatggtgttctcacagttaccgttcccaaagaagaggttaagaagcctgatgttaaggccattgaaatctctggttaaacttgttgttgctgaaaatcgtgagctttgctttgtgtaataactaataagtattctctgtcatgtgttcctgtggtgaattttgagaattgaaagattttacattgtgaaatgtaactgcttaagtggtaattgtgtgcttgtgtaattcatgtgaataaagtccagccttcagaaaatactataattttgctatatcacaagtgtctgatatgtgatgtagacaaaaaaatagatcgtgtaatgtgaattgtaattggcctatagtgtgcatttgttatagccgagagactttctctctatgttcataaactccacctcccagtaagtgtataatattccatcttaataatgaaaataaatagacgatttagtgtgttcccatgc

SEQ ID NO: 1037 - DNA, 769 bp, Carica papaya
atcgaagcacatcctttcagcgatataggcagcatatcagagcaatctcaaaatcaaatctttcaagtttctgtaaagcaaaacaaaaccagttcttcaacatgtctctgattccgagcttctttggaaaccgaggaagcagtgtgttcgatcccttctcgctcgacgtttgggacccattcaaggattttcctttcccttcctcgtcaatttctcgggaaaattccgcccttgttaacacgcgtgtggactggaaggagacaccggaggcgcacgtcttcaaggcggatcttcccggtctgaaaaaggaggaggtgaaagtggaggtagaggatgacagggtgctgcagataagcggggagagacacgtggagaaggaggacaagaacgacacatggcaccgcgtggagcgcagcagcgggaagttctcgaggaggttcagattgccagagaacgtgaagatggaccaggtgaaggcttcaatggagaacggggtacttactgttacggtgcccaaagcagaggtgaagaagcccgacgttaaggccattgagatctctggttgagaatctggaattcatggttctacaggtgtttcgttcatgtttcttagcgtatagtttatgaatcaataagtgggtacaagatatgattgtgcatgccaagtgtttgatgaaatgtgggtgttcgcattttgtaatgttgttgtaaagttgatattctgatcatgaataaaataatcatcgaagcataaagaattttttattta

SEQ ID NO: 1038 - DNA, 589 bp, Arachis hypogaea
aggaaaagatgtccctgattccaagtttcttcggtggccgaaggagcaacgtcttcgatcctttttccctcgacgtttgggaccccttcaaagacttccaattcccgagctctcttacttcttccgacaattctgcgttcgtcaacactcgtgtggactggaaggagactcccgaagctcatgtcttcaaggctgatcttcctggtctgaagaaggaggaagtgaaggttgagatcgaagataacagtgtccttcagatcagcggagagaggaacgttgagaaggaggacaagaacgacacctggcaccgtgtggagcgcagcagcggcaagttcatgcggaggtttaggctccctgagaacgccaagatggatcaggtgaaggcatccatggagaatggtgttctcactgtcactgttcccaaggcagaagttaagaaacctgatgttaagcccattcagatcactggttaaacaagatacttttttccttgtttttgctcctctcgttttcaaacctgtgtttgcgttttgttgtgaattgtaattgcgtaatgcctatgtcatgttcatgtccctgagaaatataa

SEQ ID NO: 1039 - DNA, 1094 bp, Medicago truncatula
ctctagagtgttctcgggctatatagagaatccccgaatatttccaaaattagtaatttctggaaattacacgatgattcttccatctagtttatatacccgtcgcctgcgaagcaggttattcacactaagcattgagagtaattagcaattacattccattctattctcaatttacagagttctaaaatcttcatcaaaatgtcgctgattccaagtttctttggtggccgaaggagcaacgttttcgatccattctcccttgatgtttgggatccctttaaggatttttcatttcccaattctgcactttctgcttcttcatttcctcaggagaattctgcttttgtgagcaccaggattgattggaaggagaccccagaagcacacgtgtttaaagctgatcttcctggactgaagaaggaagaagtgaaggttgaaattgaagatgacagagttcttcagattagtggagagaggaacgttgagaaagaagacaagaacaaccaatggcatcgcgtggagcgtagcagtggaaagtttatgaggaggttcagattgcccgaaaatgccaagatggatcaggtgaaagctgcaatggagaatggtgttctcactgtaactgttccaaaagaagaagttaagaaacctgatgttaagtctattgagatctctggttgaactttctaagaatgagttctgtcattatgttgctttaaatattcgtgtactcagagtttggctttaatgcttaccttgtgtgatgtgtgagttgttatcatatcatatgtgaaatgttgatgcataaataaataattagttcttgttcttcaaacagttgcgattcacttgtatttcccttggaaaattaatttgagatgttgtttgcattcccagtatggaacataagagagagaaaaacaagcaagcaatgaatttatgtcatgccaaatctggtttgtaagagaacttcaatggaggtatctaaatgaaattcgtagaataatgaactgttgcttgtacgttgtattgtagtattttaatctcctgccccagttttccttgtatcctatcctcaaataagtttgagtgca

SEQ ID NO: 1040 - DNA, 988 bp, Medicago truncatula
aggccattatggccggggacactaagcattgagagtaattagcaattacattccattctattctcaatttacagagttctaaaatcttcatcaaaatgtcgctgattccaagtttctttggtggccgaaggagcaacgttttcgatccattctcccttgatgtttgggatccctttaaggatttttcatttcccaattctgcactttctgcttcttcatttcctcaggagaattctgcttttgtgagcaccaggattgattggaaggagaccccagaagcacacgtgtttaaagctgatcttcctggactgaagaaggaagaagtgaaggttgaaattgaagatgacagagttcttcagattagtggagagaggaacgttgagaaagaagacaagaacaaccaatggcatcgcgtggagcgtagcagtggaaagtttatgaggaggttcagattgcccgaaaatgccaagatggatcaggtgaaagctgcaatggagaatggtgttctcactgtaactgttccaaaagaagaagttaagaaacctgatgttaagtctattgagatctctggttgaactttctaagaatgagttctgtcattatgttgctttaaatattcgtgtactcagagtttggctttaatgcttaccttgtgtgatgtgtgagttgttatcatatcatatgtgaaatgttgatgcataaataaataattagttcttgttcttcaaacagttgcgattcacttgtatttcccttggaaaattaatttgagatgttgtttgcattcccagtatggaacataagagagagaaaaacaagcaagcaatgaatttatgtcatgccaaatctggtttgtaagagaacttcaatggaggtatctaaatgaaattcgtagaataatgaactgttgcttgtacgttgtattgtagtattttaatctcctgccccagttttccttgtatcctatcctcaaataagtttgagtgca

SEQ ID NO: 1041 - DNA, 899 bp, Medicago truncatula
atgcctaattttactacatgttttgtggaggaagtcatgatctagagacttctagttgactgtggaagaaactctacaatgtttcttattttccagaaagttcgttaattatagaatatttctggaacgtactagattactcatccacttcttttaaatactcggcgaatccctcttgctttactagaaaacacatttttcattcattttcagaattctcaattcacatcaaacacaacacagcagaacaatgtcgctgattccaagtttctttggtggccgaaggagcaacacttttgatccattctcccttgacgtttgggacccattcaaggattttcctttcaccaattcttcactttctgcttcttcattccctcaggagaattctgcttttgtgagcaccaggattgattggaaggagaccccagaagctcatgtgttcaaggctgatcttcctggactgaagaaggaggaagtgaaggttgaaattgaagatgatagggttcttcagataagcggtgagaggaactttgaaaaagaagataagaatgatcaatggcatcgtgtggagcgtagcagtggaaaattcatgaggaggtttagattaccagagaatgcgaaaatggatcaagtgaaagctgcaatggagaatggtgttctcactgttactgttccaaaagaagaagttaagaaacctgatgttaagtccatcgaaatctctggttgaacacatattcaagctctattactctgtttttaggttgagaatattgtgaagtgtgttgtgtgtgcgttctgttttatgtaaaagtaaattctgtgaattatattttgtaaggaataaattatgtaagaatggtttaattatctattgtctcacatcgttttttatgtct

SEQ ID NO: 1042 - DNA, 641 bp, Nicotiana tabacum
cagcgtctttgatccattctcaatcgacctatgggatcccttcagggaattgggctttccaggatccaattcacgggagacttctgcattcgctcacacacgagtcgattggaaggaaactccggaggctcatgtgttcaaggccgatctccctgggcttaagaaggaggaagtgaaagtcgagatcgaagacgatagggttcttcaaatcagcggagagaggaatgtggagaaagaagataagaatgatacttggcaccgtgtggaacgcagcagcggcaaattcatgagaagattcaggctccccgagaatgcgaaaatggatcaagttaaggcggcgatggagaatggagtgcttactgttactgttccgaaagaagaggtgaagaagccagatgtcaaatccattgatatcactggttagatagacgatgaaatatgtaagaacgctatgatatgtgagcaagtatatatgaaatcgaatagaagttgctctgtttttgtatcttgtctgtaatcgagtctgtttttcgctttaaggcgtgtttgatttaattttgttgaaattctatggggaaaaggcaatagtgttgtaatagaatcaaagtattctattatccttcaattctgttcgatctccc

SEQ ID NO: 1043 - DNA, 879 bp, Gossypium hirsutum
gcaaagcagcagaaactctaagacagctctcttacctcttctagttttcctactataatcttatttttcattccattcccgaatatgtctcttattccaagcttctttggcaaccgtcgcagcagcgcctttgatccattctctcttgatgtttgggatcctttcaaggacttccctttctcttctccttcatcaccctccacgggctcttcggaaacttcggcttttgtcaatacccgaatcgattggaaggaaaccccagaatctcacgtgttcaaggctgatgttccggggcttaagaaagaagaagtgaaagttgaggttgaaaatgacagggtgcttcagataagcggggagaggaatgtagagaaggaagacaagaaggacacatggcatcgggtggaacgcagtagtggcaagttcatgaggaggttcagactgccggagaatgccaagatggatcagataaaggcttccatggaaaatggagtgcttactgttactattcccaaacttgaagtcaaaaagcccgatgtgaagtccattgaaatttccggataaagatgtttgtaacttgtgagtgaatgcctgtttcctttgctttgagatagtgtcttgtgcctattgtcaagtgtgtgggataaaaaaaagctatgggtactatgactttatgttgttgatgaagtttgtgtttttatgttgttaataaatgagtttatcctcctgcttttgttgtctactttctgcagatggttgaatgaacttgaaacactaatggtttaacattacttatttagcacgacaataataacaccttggggtgaaaattccatcttttggttcaacttaatcgccattcttcatctaggataaacccct

SEQ ID NO: 1044 - DNA, 904 bp, Theobroma cacao
cgggaagcagtggtatcaacccagagtacgcggggagacaagcaaagcatagaaattctacgacagctccctcaattttccttgttatcaaagtttcctgtttaatatcgttttccattcctgaaaatgtctctgattccaagcttctttggcagccgccgcagcaacatcttcgatcctttctctcttgatgtttgggatcctttcaaggacttccctttcccttcttcactcaccacacataccccagaaacctcggcttttgttaacacccggatggactggaaggaaaccccagaagctcacgtcttcaaggctgatgttccagggctcaagaaagaagaagtgaaagtggaggttgaggatgacagggtgctgcagataagtggagagaggaacatagagaaggaagacaagaacgatacttggcatcgcgtggagcgtagcagtggcaagttcatgaggaggttcagattgcctgagaatgccaagatggatcagatcaacgcttccatggaaaatggggtgcttactgtgactgttccaaaacaggaggtgaaaaagcctgacgttaaggctattgagatttcaggctagaaaattgaagatgagttgtgaaggcatctctctcctgcgacagattatcaaaataacaactttaatagaaaaaaaaaagtttgtgagctatgaagtgggtgcctctttctctgtcagatgagagttttgtttgtgtgtgataaattattaagtactatgttcttgtatgaagtttacccttcttccttgtttttgaaattgtgaaatttgcttggagcaagtacaatttgtcagataatgaatgtacaattgaatgtgacaacgtacttaaatgaaatatacatagcaccctggtctagaattggaa

SEQ ID NO: 1045 - DNA, 833 bp, Gossypium hirsutum
gtaaaatcaaactgttgtttttattggattagttcgaaaattcttgagaatactagaatccccatatatccctataaaaactgcatttcaggggtccaaattacccagacaagcaaagcagagaaactttaagacagctctcttagcttttccgtttttcgtatcacttataatcttatttttcattccatccccgagtatgtctctgattccaagcttctttggcaatcgtcgcagcagcatctttgatccattctctcttgacgtttgggatcctttcaaggacttccctttctcttctccttcttcatcactctccacgcgctcttctgaaacctcggcttttgtcaatacccgaatcgactggaaggaaactccagaagctcacgtgttcaaggctgatgttccaggacttaagaaagaagaagtgaaagtggaggttgaagatgacagggtgcttcagataagcggggagaggaatgtagagaaggaagacaagaatgacacatggcatcgggtggaacgcaatagtggcaagttcatgaggaggttcagactgccggagaatgcgaagatggatcagatcaaggcttccatggaaaacggagtgcttactgttactattcccaaacttgaagtcaagaagcccgatgtgaagtccattgaagtttccggctaaagatgtttgtaacttgtgagtgcctttgtcctttactttgagattcggagttctgtgcctattgtcaattgagtgtctgtgtgataaacaaagctatgggtactatgactttatgttgttgatgaagtttgtgttgttaatgtaaaaaataatt

SEQ ID NO: 1046 - DNA, 706 bp, Gossypium hirsutum
agaaactctaagacagctctcttagctcttcaacttttcgtactacttataatcttatttttcattccattcccgagtatgtctctgattccaagcttctttggcagccgtcgcagcagcatctttgatccattctctcttgacgtttgggatcctttcaaggatttccctttctcttctccttcttcatcactctccacgcgctcttctgaaacctcggcttttgtcaacacccgaatcgactggaaggaaaccccagaagctcacgtgttcaaggctgatgttccaggacttaagaaagaagaagtgaaagtggaggttgaagatgacagagtgcttcagataagcggggagaggaatgtagagaaggaagacaagaacgacacatggcatcgggtggaacgaagtagtggcaagttcatgaggagattcagactgccggagaatgccaagatggatcagatcaaggcgtccatggaaaatggggtgcttactgttactattcccaaacttgaagtcaaaaagcccgatgtgaagtccgttgaaatttccagctaaagatttttgtaagttgtgagtgcctatctcctttactttgagattgagagttctgtgcctatcgtcaattgtgtgtgataaacaaagccatgggtactatgactttatgttgttgatgaggtttgtggtgttaatgtaaaaaatagtt

SEQ ID NO: 1047 - DNA, 661 bp, Carica papaya
gcaaaacaaacaaaaagcagagatttcttaaccatgtcgatcattccaagcatctttggcagccgacgaagcaacgtcttcgaccccttctcgctcgacgtttgggatccattcaaggatttccccttctcttcctcgtcaatgtcgcgggataattctgcattcgttaacacacgggtggactggaaggagaccccagaggcgcacgtcttcaaggcggatctccctgggatgaagaaagaggaggtgaaagtggagatagaggacgacagggttttgcagatcagcggcgagaggcacgtggagaaggaggacaagaatgatacttggcaccgcgtggagcgcagcagcgggaagttttcgaggaggttcaggctgccagagaacgtgaagatggaccaagtgatggcgtcgatggagaatggggtgctgaccgtgactgtgccgaaagcggaggtgaagaaacctgatgttaaggccattgaaatctctggttgagagcttggaagccatggctgtcagaaatccttggcgttgtgttatagtatgtgaactatttgataaaatgccgatgtaatctgactgtatctgagtttgtaattgtaatggataatgtacattcgacattataataaaataataatataaataaaataatttt

SEQ ID NO: 1048 - DNA, 771 bp, Arachis hypogaea
gcaagacaacaaagtatttcgtaatcaatcacacacacatcattttctactcgatcacacaaaaagaaaagaagagaatgtcgctgattccaagtttcttcggtggccgaaggagcaacgtcttcgatcctttctccctcgacgtttgggaccccttcaaagacttccaattcccgagctctcttacttcttcagagaattctgcgttcgtcaacactcgtgtggactggaaggagactcccgaagctcatgtgttcaaggctgatcttcctggtctcaagaaggaggaagtgaaggttgagatcgaagataacagtgtccttcagatcagcggagagaggaacgttgagaaggaggacaagaacgacacctggcaccgtgtggagcgcagcagcggcaagttcatgcggaggttcaggctccccgagaacgccaagatggatgaggtgaaggcagccatggagaatggtgttctcactgtcactgttcccaaagcagaagttaagaaacccgatgttaaacccattcagatcactggttaaacaagatactttttctcttgtttttgctcctctcgttttcaaacctgtgtttgcgttttgttgtgaattgtaattgagcaatgcctatgtcatgttcatgtccctgagaaatataaatcatgtagtagtggtaagtaagaaagcaagattattgtgatatgagatgtaatcaagtatgtagtgcatgtgaataataataatttccttcttttatcagttgagggatttg

SEQ ID NO: 1049 - DNA, 803 bp, Glycine max
agatatattgttggctgttttgaacattcacccaatttgcagagttccaagttatatacatacactgcataattaagagaaaatgtcgctgattccaagtttctttggtggccgaaggagcaacgttttcgatccattctcccttgatgtttgggatccctttaaggatttttcatttcccaattctgcactttctgctgaaaattcagcctttgtgagcacacgagtggattggaaggagacaccagaagcacacgtgttcaaggctgatattccagggctgaagaaggaggaagtgaagctggagattcaagatgacagagttcttcagataagcggagagaggaatgttgaaaaagaagacaagaatgatacgtggcatcgcgtggagcgaagcagtggtaagttcatgaggaggtttagattgccggagaatgctaaagtggatcaagttaaggcttccatggaaaatggggttctcactgtaactgttcctaaggaagagattaagaagcctgatgttaaggccattgacatctctggttaacctatgctactctgttccttagttgaaaatccttgtattatgttttcttctgagggtcatacgagcccaagacagttgtcacgtattattatgctggttttgtttagaggccttatgttaatacggccatagaaatctttggttaaactgtgttaatatgttacttgctttgtaattgcaaaatatatcaagtgatagactagtagctaatgtacatagtgagaagaaataataattttaaatattcctaatcttc

SEQ ID NO: 1050 - DNA, 747 bp, Jatropha curcas
attccatcatcgaaaaactagaaacacgacgaagctactctcgctacgatcgaccaaatctaaggctttcagatcgaaaaatggcattgattccaagctttttcggtaactcacgaagcaacatcttcgatcctttctctgctctcgacgtttgggatccattcagagacttttctttcccttcatcttcttccctcgtctctcgtgaaaattctgcttttattaacactcgcattgactggagagagacaccagaggctcatatattcaaggctgatctccctgggctcaaaaaagaggaagtgaaagtagaaattgaagatgacagagtgcttcaaatcagcggggagagaaatgtggagaaggaagacaagaacgacacgtggcatcgcgtggagcgtagcagtggcaagttcatgaggaggttcaggctgccggagaatgcaaagatggatcaagtaaaggcttcaatggaaaacggagtacttactgtcactgttcctaaagaggaagtcaagaaacctgatgttaaggctattgagatctctggttaagtttcagcttataatgatgttatctcaatatatatatatatatatatatatatatatatatatatatatatatatataatgatatgtgtgtgagaaagtatgtactgaaagaatgtttattattactgtttcattttaataatgtaaaatataataattcctgattacaaaaaaaagaattcgaattcctgca

SEQ ID NO: 1051 - DNA, 745 bp, Carica papaya
cagcattataaatagcagacaagagctctctctaaaccaaatcttcttcttctttcaagtttcggtaaagcgaacaacccagttttccaaccatgtctctgattccaagcttctttggaaaccgaggaagcagtatattcgaccccttctcgctcgacgtttgggatccattcaaggattttcctttcccttcctcgtcaatttctcgggaaaattccgcctttgttaacacgcgtgtggactggaaggagacaccggaggcgcacgtcttcagggcagatcttcccggtctgaaaaaggaggaggtgaaagtggagttagaggatgacagggtgctgcagatcagcggggagagacacgtggagaaggaggacaagaacgacacttggcaccgggttgagcgcagcagcggtaagttctcgaggaggttcagattgccagagaacgtgaagatggaccaggtgaaggcttcaatggagaacggggtacttactgttacggtgcccaaagcagaggcgaagaagcctgacgttaaggccattgagatctctggttgagaatctggaattcatggttgacaggtgtttgttcatgtttcttaatgtatagggcatattaatcaataagtgggggtatgacatatgattgtgcatgccaattgttcgatgaaatgtgggtctttggatttttgtaatgttgttgtaaagttgatattttgataataaataaaataatcatcttttct

SEQ ID NO: 1052 - DNA, 804 bp, Arachis hypogaea
gatcaagaaagcatacagaagcagtttctcagatagcaaacaaagccacacaacacaacaatcactatttttcggagtagcaagaatatcatctaatagaggaaaagatgtcgctgattccaagtttcttcggtggccgaaggagcaacgtcttcgatcctttctccctcgacgtttgggacccctttaaagacttccaattcccgagctctcttacttcttccgacaattctgcgttcgtcaacactcgtgtggactggaaggagactcccgaagcacatgtgttcaaggctgatcttcctggtctgaagaaggaggaagtgaaggttgagatcgaagataacagtgtccttcagatcagcggcgagaggaacgttgagaaggaggacaagaacgacacctggcaccgtgtggagcgcagcagcggcaagttcatgcggaggttcaggctccccgagaacgccaagatggatgaggtgaaggcagccatggagaatggtgttctcactgtcactgttcccaaagcagaagttaagaaacccgatgttaagcctattcagatcactggttagacgtgcgtgagaatgaagcaatcctgcatccaataagctgttgagtcttgtttgttttcctcttgtagtaatgcgtctgtaatctccgcttaattctgttatattttgcttgaaaatggtgtgtcctgtacatgtgtgatatctgcaaaagaaggactatcttgcaatttagtttatatggtttgaaattgaacaaggtaaataaaaatcacaggcctattagttttacgtg

SEQ ID NO: 1053 - DNA, 752 bp, Arachis hypogaea
gatcatcgagcacaagcatttacaacgacagttacacctacattctctgcttgcaagaacttaatcatcaaacaaagagaagatgtcgctgattccaagtttctttggtggcagaaggagcgaccctttctccctcgacgtttgggaccccttcagggacttccaattcccgagctctcttgcttcttcagagaattctgcattcgtgaacactcgtgtggattggaaggagactcccgaagcacatgtgttcaaggctgatcttcctggtctgaagaaggaggaagtgaaggttgagatcgaagataacagtgtccttcagatcagcggcgagaggaacgttgagaaggaggacaagaacgacacctggcaccgtgtggagcgcagcagcggcaagttcatgcggaggttcaggcttcctgagaatgccaagatggatcaggtgaaggcatccatggagaatggtgttcttactgtcactgttcccaaggcggaagttaagaaacctgatgttaagcccattcaaattactggttaagcaaaagtatgcagtatacagtgatctagtaatctcttgttcttgaatgttgtagtgtgctttctgcgtgtcatgtgaataaatgggaaattgaacggtgaggttcttgtattgtattttctgcgtgttttcgtaaataccgaagcaattggtcttgtaacgtttttatattatacatagtttaataagagccaatacaacttatattttgggt

SEQ ID NO: 1054 - DNA, 870 bp, Glycine max
ctggaacatacaagatcatcctttcacttcctttaaatacctcgcgtatccccttcgtcctcatcaaacgaagaaaaaagttacctgtttgcgatctcattacaatctccccagtttctaatctcagctaagaaaaaccaaaagatgtctctgattccaggtttcttcggtgcccgaaggagcaacgtcttcgatccattctcactcgacatttgggatcccttcaaggattttcatgttcccacttcttctgtttctgctgaaaattctgcattcgtgagcactcgtgtggattggaaggaaaccccagaggcacacgtgttcaaggctgatattccagggctgaagaaagaggaagtcaaggttcagattgaagatgatagggttcttcagattagcggagagaggaacgttgagaaggaagacaagaacgacacgtggcatcgcgtggagcgtagcagtggtaagttcgtgagaaggttcagattgccggagaatgcaaaagtgaatgaagtgaaggcttctatggaaaatggggttctcactgtcactgttcctaaggaagaggttaagaagcctgatgtcaaggccattgaaatctctggttgatccatgttatggttgaaaatcgtgagcttatcctttgttgttgtaataagtgtcttctgtcttgtgtgcctttgagaaaaatcttccatgcatgcattgtggattgtaattgctccagtgattgataactgtgtggctgtgtaattcatgtgaataaagtcctaccttcagagttcagaatatataatttcggtgtatctagtgtctgatatgtgccaaatagattgtgtaatgtgaattgtatttggccaattgcatttg

SEQ ID NO: 1055 - DNA, 702 bp, Solanum lycopersicum
atcaaaatcgaaagcaagcaagcaaaaaaacgtagaaaattctcaaaaaagttcactgaaaatgtctctgatcccaagaattttcggcgatcgacgaagcagcagcatgttcgatccattttcaattgacgtatttgatccattcagggaattaggcttcccaggtaccaattcaggggagagctctgcatttgccaacacacgaatagactggaaggaaactccagaagctcatgtgttcaaggctgatcttccagggcttaagaaggaggaagtcaaagtggaagtcgaggaggatagggttcttcagatcagcggagagaggaacgtggagaaggaagataagaatgacaagtggcatcgcgtggagcgaagcagcgggaaattcatgaggagatttagacttccggagaatgcaaagatggatcaagttaaggcttcaatggagaacggagtgcttactgttatgttccgaaggaggaggtgaagaagcctgatgtcaagtccattgagatctctggttaaaatatgtgaatttattgtatccttgtatgggcaaataaaaaataatcgtatctgtagtgtttgaagtcgttctgtttctgtattaaagtcttcgaatcggctctgtttctcacctaatggcgtagttgatgtacttgctgtaaaatttcatgttgaaagatgtaatagtagtgttgt

SEQ ID NO: 1056 - DNA, 850 bp, Glycine max
attttaaataccccatgtgtcctttgaagacacatcacagaaagaagtgaaggcatcgttagcagttttgtagattcaacctcaatttgcagagttacgttctaatatatttacacaagactgataagagaaaatgtctctgattccaagtttcttcggtggccgaaggagcagtgttttcgaccctttctccctcgatgtgtgggaccccttcaaggattttccatttcccagttctctttctgctgaaaattcagcgtttgtgagcacacgagtggattggaaggagacaccagaagcacacgtgttcaaggctgatattccagggctgaagaaggaggaagtgaagctggagattcaagatggcagagttcttcagataagcggagagaggaatgttgaaaaagaagacaagaatgatacgtggcatcgcgtggagcgaagcagtggcaagttggtgaggaggtttagattgccggagaatgctaaagtggaccaagtgaaggcttccatggaaaatggggttctcactgtaactgttcctaaggaagagattaagaagcctgatgttaaggccatagacatctctggttaatctatgttgctctgttccttcgttgaaatgtgtttatgttttcttattctgaggatcatttgtgtgagtcgtgtgaaaaatatttcaggttttatgttggctaagaggcctaatgtttgggccctagaaatctctggttaaactgtgtaaagatctgttacttggtttaaagtttgtgtgttttgttcacttccaaggaatttatgtgtgcaagaaagatgtaattgaaaaatttagcaatagactaatggtttt

SEQ ID NO: 1057 - DNA, 825 bp, Euphorbia esula
  misc_feature (9)..(9): n is a, c, g, or t
  misc_feature (654)..(654): n is a, c, g, or t
  misc_feature (656)..(656): n is a, c, g, or t
  misc_feature (658)..(658): n is a, c, g, or t
  misc_feature (660)..(660): n is a, c, g, or t
  misc_feature (663)..(664): n is a, c, g, or t
  misc_feature (666)..(666): n is a, c, g, or t
  misc_feature (668)..(668): n is a, c, g, or t
  misc_feature (670)..(670): n is a, c, g, or t
  misc_feature (737)..(737): n is a, c, g, or t
caaaacgcnaattgtaatcaaactcagaaatcagaattcacaaataattactcagtttctcttcaaattaagaattagatggcgttgaatccattctttggaaaccggagaagcaacatcttcgatcctttttctctagacatttgggatccattcaaggatttcccgtttcctgcgtcttcatcttcatcctcactcatctctcctgagaattcagctttcgtagggacccgaatcgactggaaggagacaccagaagcgcacgtgttcaaggctgatcttccagggcttaagaaagaagaagtgaaagtggagattgaggatgacagggttcttcagatcagtggagaaaggaatgtggagaaagaagataagaatgacacgtggcatcgtgttgagcgtagcagcggcaagttcatgaggaggttcaggctcccggagaatgcaaagatggatcaagttaaggctgctatggagaatggagttcttactgttactgttcctaaagaagaagtcaagaaacctgatgtgaaatctattgaaatctctggttaattcagttggttaagtgtcctatcttagatgattagggtaaataaatgtaatgagtaaataaattgtgtttgttgagctcatatttatgtgtttgttttntntntnttnngntnanatttatgtgtttgtttgattgaatataagtatgatataatgtgatgtactagcttgttttgttctanaatttcttccttttcactaattttgctttctgtcaatccaattcgcaattttcaattttttttttataaaacaaatttcaatttgttc

SEQ ID NO: 1058 - DNA, 724 bp, Euphorbia esula
gatctaagaaattagaaaccaaactgcgatctaaaacccttgattaattaaccacaattcaattcaattgctctctgtttttccttgaaatctacatggcgttgaatccattctttggcaacagaagaagcaacatcttcgatcctttctctctcgacatttgggatccattcaaagacttcccgtttccatcgtcttcatcttcatccccactcatctctcctgaaaattcggcttttgtgggtactcgaatcgactggaaagaaacaccagaagcgcacgtgttcaaggcggatcttccagggcttaagaaggaagaagtgaaggtggagattgaggatgacagggttcttcagataagcggagaaaggaatgtggagaaggaagataagaatgacacgtggcaccgtgttgagcgcagcagcggcaagtttatgaggaggttcaggctgccggagaatgcaaagatggatcaagttaaggctgctatggagaatggagttctcactgttactgttcctaaagaagaggtcaagaaacctgacgtcaagtccattgaaatctctggttaactcactatctctagggttaatttaagaggaatatgtggactttactgagtattattaatctgtgttgttgaggttttgggtgtgtgtttgattgaacatgagtctgatatgatataatgtaatctactagctatctttttgaatataacaag

SEQ ID NO: 1059 - DNA, 963 bp, Medicago truncatula
ggacactaagcattgagagtaattagcaattacattccattctcaatttacacagttctaaaattttcatcaaaatgtcgttgattccaagtttctttggtggccgaaggagcaacacttttgatccattctctcttgacgtttgggatcccttcaaggattttccattctccaattcttcactttctgcttcattccctcgtgagaattctgcatttgcaagcacacaagtggattggaaggagaccccagaagcacatgtgttcgaggctgatcttcctggactgaagaaggaagaagtgaaggttgaaattgaaggtgatagggttcttcagataagcggagagaggaatgttgagaaagaagataagaacgatcaatggcatcgtgtggagcgtagcagtgggaaattcatgaggaggttcagattgcctgagaatgcgaaaatggaccaagtgaaagctgcaatggagaatggtgttctcactgttactgttccaaaagaagagatcaagaagcctgatgttaagtccattgaaatctctggttgaacttataatgagttctgtctgttattatgttgcttaaaaattattcgcgtccttcagagtgttggttgtaatgcttaccttttgtgtgtgatgtgggtgtgagtgagttatcatgtcatatgtgaaatgttgctgaataaataaattattaattctccaatttttccttcaagttcactggagtattgattcttttgcaatccttcataatttcccttgtgtatttcatttggcatattaagactcatttgttatcttgcctaacttccattcctagacaacgtggtcatcacactgagctctatgatctcagatgcttggagcagtaaatcatgaataatgctaggattctgattgatcttatttttgaggatgatacatgatggatgatgaataatgctaggagtttggg

SEQ ID NO: 1060 - DNA, 935 bp, Medicago truncatula
attacattccattctcaatttacacagttctaaaattttcatcaaaatgtcgttgattccaagtttctttggtggccgaaggagcaacacttttgatccattctctcttgacgtttgggatcccttcaaggattttccattctccaattcttcactttctgcttcattccctcgtgagaattctgcatttgcaagcacacaagtggattggaaggagaccccagaagcacatgtgttcgaggctgatcttcctggactgaagaaggaagaagtgaaggttgaaattgaaggtgatagggttcttcagataagcggagagaggaatgttgagaaagaagataagaacgatcaatggcatcgtgtggagcgtagcagtgggaaattcatgaggaggttcagattgcctgagaatgcgaaaatggaccaagtgaaagctgcaatggagaatggtgttctcactgttactgttccaaaagaagagatcaagaagcctgatgttaagtccattgaaatctctggttgaacttataatgagttctgtctgttattatgttgcttaaaaattattcgcgtccttcagagtgttggttgtaatgcttaccttttgtgtgtgatgtgggtgtgagtgagttatcatgtcatatgtgaaatgttgctgaataaataaattattaattctccaatttttccttcaagttcactggagtattgattcttttgcaatccttcataatttcccttgtgtatttcatttggcatattaagactcatttgttatcttgcctaacttccattcctagacaacgtggtcatcacactgagctctatgatctcagatgcttggagcagtaaatcatgaataatgctaggattctgattgatcttatttttgaggatgatacatgatggatgatgaataatgctaggagtttggg

SEQ ID NO: 1061 - DNA, 745 bp, Manihot esculenta
agagaaggcaagcgattcgcggcacacaatcaaacccaagcaatatctattgctaaacccatttccaacaaatacaaaatggcattggttccaagtttcttcggtaacacacgaagcagcatctttgatcctttcaactctttcgagctgtgggatccattcaaagacttccaatttccttcttcctcttcaatcatctctggtgagaattctgcttttgttaacgctcgcatagactggaaagagactccagaagctcatgtgttcaaggctgatcttccggggcttaaaaaggaggaagtgaaagtggagattgaagatgacagagtgcttcaaatcagcggagagaggaatgtggagaaggaagacaagaatgatacttggcatcgtgtggagcgcagcagcggcaaattcttgaggaggttcagactgcctgagaatgccaagatggatcaagttaaggcttccatggagaatggggttctcacagtgactgttcctaaggaggaggtgaagagacctgatgtcaaggcaattgaaatctctggttgattaatttctttcttctgaatggaatggatgtaactacaatggatgatacaatgtatgctggtttaatgatctaataatactactgcatacttcataattgttcaatatattttattttctgcaaaatcttcaactgcaataagttttaaatcctttgtacaattgattatcgcttaaaattgacagtattacc

SEQ ID NO: 1062 - DNA, 780 bp, Gossypium hirsutum
gagacaagcaaagcatacaaaaaccaagacgagtctctcaatctcccaaaatatcataatccaattttcctgttaatcccagttttctattgtgaaaatggctatgattccaagcttttatggcagccgccgcagcaatgtctttgatcctttctctcttgatgtatgggatcctttcaaggacttccccctttcttcttcactcacctcacaaaccccggaaacctcagcgtttgtgaatacccgaattgactggaaagaaaccccagaagcgcacgtgttcaaggctgatgttccggggcttaagaaagaagaggtcaaagtggaggttgaagatgacagggtgcttcagataagcggagagaggaacatggagaaggaagacaagaatgacacatggcatcgcgtggaacgtagcagtgggaagtttatgaggaggttcaggttgcctgagaatgctaagatggatcagatcaaggcttccatggaaaatggtgtgcttactgtcactgttcccaaactggaagtgaaaaagcccgatgtcaaggctattgacatttctggctaaacgattgaactttggtttctaaaccgtgtcttttaacactgccagatcagagttcagttcccactatgcgcgatctatactatatgtgtgtttacgtatgtatgtataaaagttttaaataacgttgtgatttgtaatggtcttcgttttgtagtttggtcttttatgtatctgtaatcaaaataaatatctcaattttatacatctgtttg

SEQ ID NO: 1063 - DNA, 805 bp, Gossypium hirsutum
caaaattgagacaagcaaagcatacaaaaatcaagacgagtttctcaatctcccaaaatatcataatccaagtttcctgttaatcccagttttctatcctgaaaatggctatgattccaagcttttttggcaaccgccgcagcaatgtctttgatcctttctctcttgatgtatgggatcctttcaaggacttccccctttcttcttcactcacctcacaaaccccggaaacctcagcgtttgtgaatatccgaattgactggaaagaaaccccagaagcgcacgtgttcaaggctgatgttccggggcttaagaaagaagaggtgaaagtggaggttgaagatgacagagtgcttcagataagcggagagaggaacattgagaaggaagacaagaatgacacatggcatcgcgtggaacgcagcagtgggaagtttatgaggaggttcaggttgcctgagaatgccaagatggatcagatcaaggcttccatggaaaatggtgtgcttactgtcactgttcccaaactggaagtgaaaaagcccgatgtcaaggctattgacatttctggctaaacgattgaacttgggtttctaaaccgtgtctttcaacactggcagatcagagttcagttcccactatgcgcgatccataatatatgtgtgtttacgtatgtatgtataaaacttttaaataacgttgtgatttgtaatggtcttaattttgtagtttggtcttttatgtatctgtaataatataaatatctcaattttatatatctgtttgcgaagttctgttttttctt

SEQ ID NO: 1064 - DNA, 1220 bp, Cichorium intybus
ttcaagaagcttatttgacgaattgttgattttgtcaaactcgaatggcttagattcagatcgctgtaatcgggttggtatttatctgtctcttttcactgagtttggtgttgtaacacattgaaaacatccctttctaaccctgtaaccggttgtaaaggttacaagggtctaattaacaggtcaaatatgacgttattccattaaaaagcaagaaaaaaactttaggaaccttttaaaccagaagttgatacttcgttgggctacagtgtaattttgtctatctaaaataagaagcatcgagaagctccggtcataagacggaaggatggggaaacttcttcaggtttccatgcatgaaaacaacgatcaaccatctagaaagttctggggcatgcccctgatcatagatataaatgccaaccccatctgcaagtgccaaacaataacagaaacaatcgtatcagcaaaaaccccaatcaatcaagctaagcgagttcttcttacaacagtgtcggattatatcacaggaaacgttagaacatgtcgattattccaagtttcttcggtgggcgacgaagcagcatcttcgatccattttcactcgacatctgggacccgttcaaggatttcccgatttcatcttcgtctgacgtttcaagggaaacctccgcattggtaaacacccgtgtggattggaaggaaaccccagaagcccatgtgttcaaggcagatcttccagggatcaagaaagaagaagtcaaggtggaggtagaagacgacaggatcctacaaatcagtggcgagaggaatgtcgagaaagaagataaaaacgatacatggcatcgtgtcgaacgcagcagtgggaagttcactaggaggttcaggttaccggagaatgctaagatggatcaggtgaaagcagccatggaaaacggagttctaacaattactgtgcccaaggaagaagtgaagaagcctgatgtcaagtccattgagatctctggatagaaaaatccatcggtctacaaagttctacataattatgggtgtatattgttgagtctagtcggctatgtttgctgtaagtgtcaataattctggtgtaatgtcctttggcgtttggttcgtccaccatatgtttgatgaaatgcgtagcggaactggtatatcgtttttgtaatttccacaaagaataaattccctgttacgttttaatt

SEQ ID NO: 1065 - DNA, 462 bp, Solanum tuberosum
atcaaaattgaaaaccaagcaagcagacacagaaatttctcaaaaagctcactgaaaatgtctctgatcccaagaagaatcttcggcgatcgacgtagcagtagcatgtttgatccattctcaattgacgtgtttgatccaatttagggaattaggcttccaaggtaccaattcaggggagacttctgcatttgctaacactcgaatagattggaaggaaactccagaagctcatgtgttcaaggctgatcttccagggcttaagaaggaggaagtgaaggtggagatcgaagaagatagggttcttcaaattagcggagagaggaatgtggagaaagaagataagaattatacttggcatcgtgtggaacgcagcagcgggaaattcatgagaagattcagacttccggagaacgcaaagatggatcaagttaaggcttctatggaaaatggagtgcttac

SEQ ID NO: 1066 - DNA, 753 bp, Gossypium hirsutum
  misc_feature (687)..(687): n is a, c, g, or t
cccttaagcagtgtaacaacgcgagtacgggggagacaagcaaaccttaagatcaacaagcattcaaacacaagcttacccactgtttttcaagaatgtcattgattccaagcttcttcggcaacaggcgcagcaacaacgtgttcgacccattctctctcgacgtttgggacgcactcaaggacttccccgtctcaacacggtcaccagaaacctccgccttcgtcgacgctcggattgactggagggaaacgccggaagctcacgtgttcaaagccgatgtgccggggcttaagaaagaagaagtgaaagtagaggtagaagatgatagggtgttacagataagtggagaaaggaacgtggagaaagaagataagaacgatacgtggcaccgccttgaacggagcagcggcaagtttatgaggaggttcaggttgctggaaaatgttaagatggatcaagttaaggcttcaatggaaaatggggtgcttactgtgactgttccgaaaatggaagttaaaaagcctgatgtcaaggctattgatatttctggttaaaatatgtttattgtgtgtatgtgtggagtttctgaacttaaaacaataaaatttactatcttattataattgttagtttagccctttctctgtttatattatgagtttttattaaataaaatttatattntttatatttttatttaaacataggatcgaaagtttcaatatatgttattataaataaataaaaacc

SEQ ID NO: 1067 - DNA, 766 bp, Carica papaya
catttctcttctccatcgaagcgtatcctttcggcgttataagcagcagatctaagcaatctctaaaccaaattctcttcttctttccaagttcctgtaaagcgaaaaaaaacccagttttccaaccatgtctctgattccgagcttctttggaaaccgaggaagcagtgtattcgaccccttctcgctcgacgtttgggatccgttcaaggattttcctttcccttcctcgtcaatttctcgggaaacttccgccctcgttaacacgcgtgtggactggaaggagacaccggaggcgcacgtcttcaaggcggatcttcccggtctgaaaaaggaggaggtgaaagttgaagtagaggatgacagggtgctgcaaatcagcggggagagacacacagaaaaggaggacaagaacgatacatggcaccgcgtggagcgcagcagcgggaagttctcgaggaggttcagattgccagagaacgtgaaaatggaccaggtgaaagcttcagtagagaacggtgtactgactgttacggtgcccaaagcagaggtgaagaagcctgaagttaaggccattgaggtctctggctgagaatctggaattcatgtatgacaaggtgcttgttcgtgtatagggtaagaatcaataagtgggtatgagatatgattgtgcatgccaagtgtttgatgaaatgtgggtgttcgcattttgtaatgtcgttgtaaagttgatgttctgatataataaaataatcatcttttttaa

SEQ ID NO: 1068 - DNA, 808 bp, Arachis hypogaea
gctccacagcgtttaaataccttatgtatcttcattcttctccatcaggcaagcaagacagtattttctaatcaatcacacacagcattttctactcaaatcacagaaaaagaaaagaagagaatgtcgctgattccaagtttcttcggtggccgaaggagcaacgtcttcgatcctttctccctcgacgtttgggacccctttaaagacttccaattcccgagctctcttacttcttccgacaattctgcgttcgtcaacactcgtgtggactggagggagactcccgaagcacatgtgttcaaggctgatcttcctggtctgaagaaggaggaagtgaaggttgagatcgaagataacagtgtccttcagatcagcggcgagaggaacgttgagaaggaggacaagaacgacacctggcaccgtgtggagcgcagcagcggcaagttcatgcggaggttcaggctccccgagaacgccaagatggatgaggtgaaggcagccatggagaatggtgttctcactgtcactgttcccaaagcagaagttaagaaacccgatgttaagcccattcagatcactggttaaacaagatactttttccttgttttcgctcctagagttttcaaacctatgtttttgtgaattgtaattgcgtaatgcctatgtcatgttcatgtccctgagaaatataaatcatgtagtagtggtaagtaagaaagcaagattattgtgatatgagatgtaatcaagtatgtagtgcatgtgaataataataatttccttcttttatcggttgagggatttg

SEQ ID NO: 1069 - DNA, 808 bp, Glycine max
acacaaagaagcgaagtcatagttagaagttttaaacattcaacctcaatttgcagagttctaatattacattgcagagaaaatgtctttgattccaagtttctttggtggcagaaggagcaatgttttggatcctttctccctcgatgtgtgggacccttttaaggattttccttttcccacttctctttctgctgaaaattcagcgtttgtgagcacacgagtggattggaaggagacaccagaagcacacgtgttcaaggctgatattccagggctgaagaaggaggaagtgaagctggagattcaagatgacagaattcttcagataagtggagagaggaacgttgagaaggaagacaagaacgacacgtggcaccgcgtggagcgaagcagtggtaagttcatgaggagtttcagattgccagataatgctaaagtggatcaagttaaggcttccatggaaaatggggttctcactgtaactgttccaaaggaagagattaagaagcctgatgttaaggccatagaaatttctggttaaactatgttgctcagtttcttcgttattgaaaagtcgtgtgtttatgttttcttattctgaggatcatttgtatgagtcgtgtaaaaaatatgtcagctattatgttggttaagacttaagaagcctgattatgttagggcaatacaatgatacaaatctctggttaaactgtgttatctgttacttggttgaaagattgtgtgtttggttttcttcgacgagttatatgtgtaagaaagtaatagaataacagttttatataaa

SEQ ID NO: 1070 - DNA, 709 bp, Manihot esculenta
atcatagaaaacaagcaaagcaattcagagcaacctatcaagccaattaatctctgttacataacccattccagcactacaaaatggcgatgattccaagcttcttcggtaaccgacgaagcagcatcttcgatccattcaattctttcgacctgtgggatccattcaaagacttcccattcccttcttcctcttcaatcgtctctcatgaaaataccgcttttgttaacactcgtatagattggaaagagacgccagaagctcatatcttcaaggctgatcttcctgggcttaaaaaggaggaagtgaaagtggaggttgaagatgacagagtgctccaaatcagcggagagaggaatgtggagaaggaagagaagaatgatacttggcatcgtgtggagcgcagcagtggcaaattcttgaggaggttcaggctgccggagaatgcgaagatggatcaggttaaggcctcaatggagaatggggttctcacagtgacggttcctaaggaggaggtgaagaagcctgatgtcaaagccattgaaatctctggttgattaacggcatgctatggatatatatatatatatatatatatgtgtggcaagatatgtagaaataatggtgtttgtgtgcctttgggattctctgagcagtttgtgatgtataactatattaaaagattatcaacatataatagtattgatcc

SEQ ID NO: 1071 - DNA, 674 bp, Manihot esculenta
  misc_feature (150)..(150): n is a, c, g, or t
  misc_feature (657)..(657): n is a, c, g, or t
ggcacgaggttacggccggggagagaaggcagcgattcgcggcacacaatcaaacccaagcaatatctattgctaagcccattccaacaaatacaaaatggcattggttccaagtttcttcggtaacacacgaagcagcatctttgatcntttcaactctttcgagctgtgggatccattcaaagacttccaatttccttcttcctcttcaatcatctctggtgagaattctgcttttgttaacgctcgcatagactggaaagagactccagaagctcatgtgttcaaggctgatcttccggggcttaaaaaggaggaagtgaaagtggagattgaagatgacagagtgcttcaaatcagcggagagaggaatgtggagaaggaagacaagaatgatacttggcatcgtgtggagcgcagcagcggcaaattcttgaggaggttcagactgcctgagaatgccaagatggatcaagttaaggcttccatggagaatggggttctcacagtgactgttcctaaggaggaggtgaagagacctgatgtcaaggcaattgaaatctctggttgattaatttctttcttctgaatggaatggatgtaactacaatggatgatacaatgtatgctggtttaatgatctaataatactactgnatacttcataattgttc

SEQ ID NO: 1072 - DNA, 791 bp, Manihot esculenta
  misc_feature (98)..(98): n is a, c, g, or t
ggtgatgaaagcgcaataggattacgcgagaaatcaccagatatatctcctgcttactataactaagaccttccttctctcccgttaaccaaggaaancaagcaattcagagcaacctatcaagccaattaatctctgttacataacccattccagcactacaaaatggcgatgattccaagcttcttcggtaaccgacgaagcagcatcttcgatccattcaattctttcgacctgtgggatccattcaaagacttcccattcccttcttcctcttcaatcgtctctcatgaaaataccgcttttgttaacactcgtatagattggaaagagacgccagaagctcatatcttcaaggctgatcttcctgggcttaaaaaggaggaagtgaaagtggaggttgaagatgacagagtgctccaaatcagcggagagaggaatgtggagaaggaagagaagaatgatacttggcatcgtgtggagcgcagcagtggcaaattcttgaggaggttcaggctgccggagaatgcgaagatggatcaggttaaggcctcaatggagaatggggttctcacagtgacggttcctaaggaggaggtgaagaagcctgatgtcaaagccattgaaatctctggttgattaacggcatgctatggatatatatatatatatatatatatgtgtggcaagatatgtagaaataatggtgtttgtgtgcctttgggattctctgagcagtttgtgatgtataactatattaaaagattatcaacatataatagtattgatcc

SEQ ID NO: 1073 - DNA, 744 bp, Populus trichocarpa
gtaacatcatcaagtcaaaaacaatcaaagcagaatctaatttagcagctctatatactgtgatatactgccaccatctttgtgccgttcaaaatgtcgatgatcccaagtttctttggcaaccgaaggagcagcatcttcgatcctttctctcttgacgtttgggaccctttaaaggatttcccttttccttccccttccttccctcgcgatgaaaactctgcttttgttaacactcgcatcgactggaaggaaaccccagaagcccatgtcttcaaggccgatcttcctggcctcagaaaagaggaagtgaaggtccagattgaagatgatagggttctccaaatcagcggagagaggaatgtcgagaaggaagacaagaacgatacttggcatcgcgtggagaggagcagtggcaaattctcgaggaggtttaggctgcctgaaaataccaagatgaatcaggtcaaggcttctatggaaaatggggttctcacggtgaccgtgcccaaggaagaagcagtcaagaaacctgaagtcaagagcattgaaatctctggttgagatttgatgtctctattttggtgtcgatgcattattattaggataaaagagtagtactacgtttgctatctgccttgaaaaacatgttatgtttatgttcctgttgtgtaggtcgaggtgtgtggtgatgggttacttgtgctgtgctgataaataactgaaattaacttgtattttctg

SEQ ID NO: 1074 - DNA, 800 bp, Theobroma cacao
cggggagcgggaagaattcagcgtcagattctggcaaagcaatcagcaaatcaaacactatcaatttcacttaattcagtgtttcgttgatcattgttttgtagtggaggagtaatggcgatgatcccgagtttcttcggcaacagaagcagcagcgtcttcgatcctttttctcttgacgtttgggatcctttcaaggacttccctttcccttcttcactcaccagacatgcccctgaaacctctgctgttgccaacacccgaattgactggaaggaaaccccagaagctcacgtcttcaaggctgatctcccagggcttaagaaagaagaagtgaaagtggagattgaggatgacagggtgcttcaaatcagcggagagaggaaaatagaaaaggaagacaagaacgatacctggcatcgcgtggagcggagtagtggcatgttctcgaggaggtttaggttgccggagaatgtgaagatggatcaagttaaggcttccatggaaaatggggttcttactgttactgttcctaaggtggaagtgaaaaaacctgatgtcaaagccattgacatatccggttaaaaacttgaagatgctaaagctgcttttatgatactctacctgcttgtcttccagtttgataggtcttcatgtgtttgcatgtcttgtataggttaagaacacatgaaatcagatttctgctagtgtgcttgtgtttcggattgatatgatagttaaattttggtttgcaatactaaattttcgttctttaatgtaaaatattggtattactgtaa

SEQ ID NO: 1075 - DNA, 786 bp, Gossypium hirsutum
agcatcagcaagattatctgaaacactcagcaatcaaaaactttcagtttccattttctttttcagtttttcgttgatcattgtttcggttgggtaagcgaaatggctatgatcccgagtttatttggtaaccgaaggagcagcgtcttcgatcctttcgctcttgatgtatgggatcctttcaaggacttccctttcccttcttcactgacgacaggttccccagaaacctcggcttttgtcaatgcccgcatggactggaaggaaacccctgaagctcacgtctttaaggctgatcttccagggcttaagaaagaagaagttaaagtggaggttgaagatgacagggtgcttcaaatcagtggggagaggaaaatagaaaaggaagacaagaacgacacctggcaccgtgtggagcggagtagtgggaagttttcgaggaggtttaggttgccggagaatgtgaagatggatcaagtcaaggcttcaatggaaaatggagttcttacggttaccgttcctaaggtggaagtgaagaaacctgacgtcaaagccattgagatatctggttaaaagagcttcaatggttttgttcttgacatactaaagctattataaggtactctgtgtcttcatgttcggcgtgtgttttatgttttccatgtcttgtttagatgaataaacaagatcccttgtttgtggatgacaggttgaagttattatcaaattacagtttgtaatgttatcaagtttctatcaataaatgtaaattgttctttcatttct

SEQ ID NO: 1076 - DNA, 755 bp, Lactuca sativa
acagaatcagtaaaaatcccaataaatcaaactaagcgagttcttcttacacagtctcagataaacgtcagaagatgtcgatcattccaagtttcttcggtggccgacgaagcagcatcttcgatccattctcactcgacatctgggaccctttcaaagatttccccatctcatcttcgtctgatcatgtttccagtgaaacctccgcgttggtgaacactcgtgtggactggaaggaaaccccagaagcccatgtgtttaaggctgatcttcctgggatcaagaaagaagaggtgaaggtggaggtggaagacgacaggatcctacagatcagtggcgagagaaatgtcgagaaagaagataagaacgatacgtggcatcgtgtcgaacgcagcagtgggaaattcaccagaaggttcaggttgccggagaatgctaagatggatcaggtgaaagcagccatggaaaacggagtgctcacgattactgtgcccaaagaagaagtgaagaagcccgatgtgaagtcgattgagatttctggttaaaagtattccaccagtctacaatgttcgacagaatcaagggtgtatattgtagagtctagtcgggtatgtttgctgtgggtgtcgataattctggtgtaatgttctttttcttttgcgttttgttcgtgcactatgtgtttgatgaaatgcgtagcaggactggtgtatcgtttttgtaatttcgataaagaataaaatgtttgttacctt

SEQ ID NO: 1077 - DNA, 741 bp, Lactuca sativa
acagaatcagtaaaaatcccaataaatcaaactaagcgagttcttcttacacagtctcagataaacgtcagaagatgtcgatcattccaagtttcttcggtggccgacgaagcagcatcttcgatccattctcactcgacatctgggaccctttcaaagatttccccatctcatcttcgtctgatcatgtttccagtgaaacctccgcgttggtgaacactcgtgtggactggaaggaaaccccagaagcccatgtgtttaaggctgatcttcctgggatcaagaaagaagaggtgaaggtggaggtggaagacgacaggatcctacagatcagtggcgagagaaatgtcgagaaagaagataagaacgatacgtggcatcgtgtcgaacgcagcagtgggaaattcaccagaaggttcaggttgccggagaatgctaagatggatcaggtgaaagcagccatggaaaacggagtgctcacgattactgtgcccaaagaagaagtgaagaagcccgatgtgaagtcgattgagatttctggttaaaagtattccaccagtctacaatgttcgacagaatcaagggtgtatattgtagagtctagtcgggtatgtttgctgtgggtgtcgataattctggtgtaatgttctttttcttttgcgttttgttcgtgcactatgtgtttgatgaaatgcgtagcaggactggtgtatcgtttttgtaatttcgataaagaataaa

SEQ ID NO: 1078 - DNA, 953 bp, Populus trichocarpa
ccgtaacatcatcaagtcaaaaacaatcaaagcagaatctaatttagcagctctatatactgtgatatactaccaccatctttgtgctgttcaaaatgtcgatgatcccaagtttctttggcaaccgaaggagcagcatcttcgatcctttctctcttgacgtttgggaccctttaaaggatttcccttttccttccccttccttccctcgcgatgaaaactctgcttttgttaacactcgcatcgactggaaggaaaccccagaagcccatgtcttcaaggccgatcttcctggcctcagaaaagaggaagtgaaggtccagattgaagatgatagggttctccaaatcagcggagagaggaatgtcgagaaggaagacaagaacgatacttggcatcgcgtggagaggagcagtggcaaattctcgaggaggtttaggctgcctgaaaataccaagatgaatcaggtcaaggcttctatggaaaatggggttctcacggtgaccgtgcccaaggaagaagcagtcaagaaacctgaagtcaagagcattgaaatctctggttgagatttgatgtctctattttggtgtcgatgcattattattaggataaaagagtagtactacgtttgctatctgccttgaaaaacatgttatgtttatgttcctgttgtgtaggtcgaggtgtgtggtgatgggttacttgtgctgtgctgataaataactgaaattaacttgtattttctgtgacattagttacgtggctgtgctggtgatgtttgatctgtacaatgttttatacattactaactgagatgcttgattcccatgagaaatgcttagatacacaagcagggcatcgacaatataaaaggtttagatttctatggcgctgcattattattattattaaaaatgtttaataataagagaaaaacagtcctccgtgattag

SEQ ID NO: 1079 - DNA, 743 bp, Populus trichocarpa
gtaacatcatcaagtcaaaaacaatcaaagcagaatctaatttagcagctctatatactgtgctatactgccaccatatttctgccgttcaaaatgtcgatgatcccaagtttctttggcaaccgcaggagcagcatcttcgatcctttctctcttgatgtttgggaccctttaaaggatttcccttttccttccccttccttccctcgcgatgaaaactctgcttttgttaacactcgcatcgactggaaggaaaccccagaagcccatgtcttcaaggccgatcttcctggcctcagaaaagaggaggtgaaggtccagattgaagatgatagagttctccaaatcagcggagagaggaatgtcgagaaggaagacaagaacgatacttggcatcgcgtggagaggagcagtggcaaattctcgaggaggttcaggctgcctgaaaataccaagatgaatcaggtcaaggcttccatggaaaatggggttctcacggtgaccgtgcccaaggaagaagcagtcaagaaacctgaagtcaagagcattgaaatctctggttgagatttgatgtctctattttggtgtcgacgcattattattaggataaaagagtagtactacgtttgctatctgccttgaaaaaatgttatgtttatgttcctgttgtgtaggtcgaggtgtgtggtgatgggttacttgtgctgtactgataaataactgaaattaacttgtattttctg

SEQ ID NO: 1080 - DNA, 902 bp, Taraxacum officinale
cggggggagagcttctcgtgtccggtgtccccatctctgaaaatgatgatcgactaccacgagccatctagaaagctccagatcatgttctaatcatgtgtataaataccaaaccgctaacaagctcaaaagcaaaatcagcgaaaacagaatcagcaagaacctcaagtctccaaccaatcaaactaagcgaattcttattaaaaactgtagaagatgtcgatcattccaagtttctttggtggccgacgcagcagcatcttggatccattctcactcgacgtctgggaccctttcaaagatttctctgttccatctccctctgatgtctcaagagaaacctccgcattggtaaacacccgtgtggattggaaggaaaccccagaagcccatgtgttcaaggccgatcttcctgggatcaagaaagaagaagtcaaggtggaggtagaagacgacagaatcctacaaatcagtggtgagagaaatgtggaaaaagaggataaaaacgatacatggcatcgcgtcgaacgcagcagcgggaagttcaccaggaggttcaggttgccggagaatgcgaagatggatcaggtgaaagctgccatggaaaacggagtgctcacaattactgtgcccaaggaagaagtgaagaagcccgatgtcaagtccattgatatctctggttaggaaaattcatcagtctgcaaaattgagttcaacatgattaaggatgtatactgttgagtcttgttcgctttctttgttgtgtgtgtcaagtattgtgctgtaatatccttgtgcgtttggttcatcccccatgtgttcgatgaaatgcatagctggagtggtatatcgtgtttgtaaaatgaaagaaataatcaaaatgtctgttaccttctaaaaaa

SEQ ID NO: 1081 - DNA, 757 bp, Glycine max
atcatcaaacaagagaagagttacagaatttcctgtttacgatcttattgcaattttgcaactttcaaagcttattagctaaagtaacatcaaaagatgtcattgattccaagtattttcggtggcccaaggagcaacgtgttcgatccattctcactcgatatgtgggatcccttcaaggattttcatgttcccacttcttctgtttctgctgaaaattctgcatttgtgaacacacgtgtggattggaaggagacccaagaggcacacgtgctcaaggctgatattccagggctgaagaaagaggaagtgaaggttcagattgaagatgatagggttcttcagattagcggagagaggaacgttgagaaggaagacaagaacgacacgtggcatcgcgtggagcgtagcagtggaaagttcatgagaaggttcagattgccagagaatgcaaaagtggagcaagtaaaggcttgtatggaaaatggggttctcactgttactattccaaaggaagaggttaagaagtctgatgttaagcctatagaaatctctggttaaacttggtttcactgaaaatcgtgagagcttttaaatttgctttgttgtaataagtgtcctttgtcttgtgttccaatggtgattttgagaaagatcatacaattgtgccttgtgttgttgtgcaagtgtaattgaagtgaataaaaattaacacctgctttcagaaaattttgctgtgtgtcattgtcatcgaata

SEQ ID NO: 1082 - DNA, 581 bp, Gossypium hirsutum
ttaagatcaacaagcattcaaacacaagcttacccacagtttttcaaaaatgtctttgattccaagcttcttcggcaacagacgcagcaacaacgtgttcgacccattctctctcgacctctgggacccactcaaggacttccccgtctcaacacggtcaccggaaacctctgccttcgtcgacgctcggattgactggagggaaacgccggaagctcacgtgttcaaagccgatgtgccggggcttaagaaagaagaagtgaaagtacaggtagaagatgatagggtgttacagataagtggagaaaggaacgtggagaaagaagataagaacgatacgtggcaccgccttgaacggagcagcggcaagtttatgaggaggttcaggttgccggaaaatgttaagatgggtcaagttaaggcttcaatggaaaatggggtgctgaccgtgactgttccgaaaatggaagttaaaaagcctgatgtcaaggctattgacatttctggttaaaatatgtttattgtgtgtatgtgtggagtttctgaacttaaaacaataaaatttactatcttattattat

SEQ ID NO: 1083 - DNA, 1307 bp, Solanum phureja
tggttctagaaaccgctgaaagcttcttcaaatcataataatcgaaattcaaatgaacacaaaaaaatttcaagtcttcccaaacaaaattgataaatcattcttctgagcattttctctctctctctctgtgaaggaggaggcaaaaaatggcagcgtacaggtggaagagtttcaacgatgatggagatcgtccagagaaacctcgtcgctatggcgttacagaaatgaagggtcccaactattcccttttctcgagaggccttcttgaggatgtttttgagtctatgggtcagtttgttgatgggctaaaactatgtgatggatcccatactgtgatgccaaagaattacatcaaagaagtgactgacatggcacataaacacaatgtttatgttaactctggtgattgggcagatcaaatgcttcgccgaggtccttcttctcttaaagaatatattgaggaatgtaagcaattggggtttgattcaattgagcttgatgttgcatcacttggtctacctgaggagaccctcttgagatatgtgaggctgattaagagcagtgggctcagagctaagcctcagttctctgttaagtttaacaagtctgatatagccttcgccggtgacagagcttttggggcttacgtgattccggcacctcaaacctctgagatggttgaagatgtggatcttttggtcagaagggcagagagatgcttagaagctggggcagacatgataatgatcaatgctgatgatttatgtaggcaggctggtttactaagatcagatattgttgcgaagattgtgggtcgtcttggacttgagaaaactatgtttgaggcatcaaatcctaaaatctctgagtggtttgtcaaacgttatggtccaaaggttaatcttatcgtggaccactcacaagtaatggatctggaatgcctcagaggacgtaacctgggtcaaaatcactcatctgtacttggcaggtcatattttctgctctgatcttgcggtgtccatagagaaaaatgtgctcattgtagcaaacaacttatctctgtaaaatgctttgctggtcatgttcagatcatgtttaaacttttaaatgaaaaaaaaggagagtgtttcatatatgtactcatgtactgtaaggatttcagtctttttagagacttgttttcttgcttgaagttcagctgcttggtaagatgttcttttatgttctagtgcctaaatggccgaaagttcaccaaatctttgaaagattgaggatctgcgcttttgtagattatattgtgtacc

SEQ ID NO: 1084 - DNA, 1108 bp, Solanum tuberosum
gcttcttcaaatcataataatcggaaattcaaatgaacacaaaaattttcaagtcttcccaaacaaattgataaatcattcttctgagcaattgcatccctctcccttctctctgtgtgtttgtgtgaaggaggaggcaaaaaatggcagcgtacaggtggaagagtttcaacgatgacggagatcgtcctgagaaacctcgtcgctatggcgttacagaaatgaagggtcccaactattcccttttctcgagaggccttcttgaggatgtttttgagtctatgggtcagtttgttgatgggctaaaactatgtgatggatcccatactgtgatgccaaagaattacatcaaagaagtgactgacatggcacataaacacaatgtttatgttaactctggtgattgggcagatcaaatgcttcgccgaggtccttcttctcttaaagaatatattgaggaatgtaagcaattggggtttgattcaattgagcttgatgttgcatcacttggtctacctgaggagaccctcttgagatatgtgaggctgattaagagcagtggactcagagctaagcctcagttctctgttaagtttaacaagtctgatatagccttcgccggtgacagagcttttggggcttacgtgattccggcacctcaaacctctgagatggttgaagatgtggatcttttggtcagaagggcagagagatgcttagaagctggggcagacatgataatgatcaatgctgatgatttatgtaggcaggctggtttactaagatcagatattgttgcgaagattgtgggtcgtcttggacttgagaaaactatgtttgaggcatcaaatcctaaaatctctgagtggtttgtcaaacgttatggtccaaaggttaatcttattgtggaccactcacaagtaatggatctggaatgcctcagaggacgtaacctgggtcaaaatcactcatctgtacttggaaggtcatattttctgctctgatcttgtggtgtccatggagaaaaatgtgatcattgtagcaaacaacttatctctgtaaaatgctttgctggtcatgttcagatcatgtttaaacttttaaatga

SEQ ID NO: 1085 - DNA, 1200 bp, Solanum tuberosum
accgctgaaagcttcttcaaatcataataatcgaaattcaaatgaacacaaaaattttcaagtcttcccaaacaaattgataatcattcttctgagcatttgcatccctctcccttctctgtgtgtgtgtgtgtgtgaaggaggaggcaaaaaatggcagcgtacaggtggaagagtttcaacgatgacggagatcgtcctgagaaacctcgtcgctatggcgttacagaaatgaagggtcccaactattcccttttctcgagaggccttcttgaggatgtttttgagtctatgggtcagtttgttgatgggctaaaactatgtgatggatcccatactgtgatgccaaagaattacatcaaagaagtaactgacatggcacataaacacaatgtttatgttaactctggtgattgggcagatcaaatgcttcgccgaggtccttcttctcttaaagaatatattgaggaatgtaagcaattggggtttgattcaattgagcttgatgttgcatcacttggtctacctgaggagaccctcttgagatatgtgaggctgattaagagcagtggactcagagctaagcctcagttctctgttaagtttaacaagtctgatatagccttcgccggtgacagagcttttggggcttacgtgattccggcacctcaaacctctgagatggttgaagatgtggatcttttggtcagaagggcagagagatgcttagaagctggggcagacatgataatgatcaatgctgatgatttatgtaggcaggctggtttactaagatcagatattgttgcgaagattgtgggtcgtcttggacttgagaaaactatgtttgaggcatcaaatcctaaaatctctgagtggtttgtcaaacgttatggtccaaaggttaatcttattgtggaccactcacaagtaatggatctggaatgcctcagaggacgtaacctgggtcaaaatcactcatctgtacttggcagatcatattttctgctctgatcttgtggtgtccatggagaaaaatgtgctcattgtagcaaacaacttatctctgtaaaatgctttgctggttatgttcagatcatgtttaaacttttaaatgaaaaaaaaaggagagtatttcatatatgtactcatgtactgtaaggatttcagtctttttagagacttgttttcttgcttgaa

SEQ ID NO: 1086 - DNA, 1185 bp, Solanum tuberosum
accgctgaaagcttcttcaaatcataataatcgaaattcaagtgaacacacaaattttcaagtcttcccaaacaaattgataatcattcttctgagcatttgcatccctctcccttctctgtgtgtgtgtgtgtgtgaaggaggaggcaaaaaatggcagcgtacaggtggaagagtttcaacgatgacggagatcgtcctgagaaacctcgtcgctatggcgttacagaaatgaagggtcccaactattcccttttctcgagaggccttcttgaggatgtttttgagtctatgggtcagtttgttgatgggctaaaactatgtgatggatcccatactgtgatgcctaagaattacatcaaagaagtaactgacatggcacataaacacaatgtttatgttaactctggtgattgggcagatcaaatgcttcgccgaggtccttcttctcttaaagaatatattgaggaatgtaagcaattggggtttgattcaattgagcttgatgttgcatcacttggtctacctgaggagaccctcttgagatatgtgaggctgattaagagcagtgggctcagagctaagcctcagttctctgttaagtttaacaagtctgatattgccttcgccggtgacagagcttttggggcttacgtgattccggcacctcaaacctctgagatggttgaagatgtggatcttttggtcagaagggcagagagatgcttagaagctggggcagacatgataatgatcaatgctgatgatttatgtaggcaggctggtttactaagatcagatattgttgcgaagattgtgggtcgtcttggacttgagaaaactatgtttgaggcatcaaatcctaaaatctctgagtggtttgtcaaacgttatggtccaaaggttaatcttatcgtggaccactcacaagtaatggatctggaatgcctcagaggacgtaacctgggtcaaaatcactcatctgtacttggcagatcatagagaaaaatgtgctcattgtagcaaacaacttatctctgtaaaatgctttgctggttatgttcagatcatgtttaaacttttaaatgaaaaaaaaaggagagtatttcatatatgtactcatgtactgtaaggatttcagtctttttagagacttgttttcttgcttgaagttcagctgcttgt

SEQ ID NO: 1087 - DNA, 1140 bp, Solanum melongena
catcgaaattcaatgaatacagaaattttcaagtcttcccaaacaaattgatcaatcgttcttctgagcatttacctctttctccctgctgccttctctttgtgcgtgtgtgaagaaggaggcaaaatatggcagcatacagatggaagagtttcaatgatgatggagatcgtccagagaaacctcgtagctatggcgttacagaaatgaagggtcctcactattcccttttctccagaggccttattgaggatgttttcgagtctatgagtcagtttgttgatggattaaaattatgtgatggatctcatacttccgtgccaaagacttacatcaaagaagtgactgacatggcacataaacacaatgtttatgttagctctggtgattgggcaggccaaatgcttcgccaaggtccttctgctcttaaagaatatattgaggaatgtaagcaattggggtttgatacaattgagcttgatgttgcatcacttggtctacctgaggagaccctcctgagatatgtgaggctgattaagagtagtggactcagagctaagcctcagttctctgttaagtttaacaagtctgatatagccttctctggcgacagagcttttggagcttacgtgattccggcccctcaaacctctgagatggttgaagatgtggatcttttggtcagaagggcagagagatgcttagaagctggggcagacatgataatgatcaatgctgatgatttatgtaggcaggctgatttgctgagatcagatatggttgcaaagattgtgggtcgtcttggacttgagaaaactatgtttgaggcatccaatcctaaaatcttggagtggtttgtcaaacgctatggcccaaaggttaatctttttgtggatcactcacaagtgatggatctggaatgcctcagaggacgcaacctgggtcaaaatcactcatctgtacttggcaggtcatatttttatgtttaaactttttaaatgaaagaaaaagaagtatttcatgtatgtactgtgatgatttgagtcttctcagagacttattttttcttgaggttcagctgcttgtaaagattctattttatgttctagtgcctaaatggctgaaagtacacaaaatctt

SEQ ID NO: 1088 - DNA, 1092 bp, Nicotiana tabacum
  misc_feature (534)..(534): n is a, c, g, or t
ggaaaaagatggcagcatacaggtggaagagtttcaacgacgaggaagaagatcgtccggagaaacctcgtcgctatggcgttactgaaatgaggggtccccattattccctgttctctcgaggcgtccttgaggatgttttcgagtctgtgggtcagtttgttgacgggctgaagttctgtggtggatctcatactctgatgccaaagacttacatcaaagaagtgactgacatggcacataaacacaatgtttatgttagctctggtgattgggcagaccaaatgcttcgccaagatccttctgcgattaaagaatacattgaggaatgtaagcgattggggttcgatacaattgagcttgatgttgcatcccttggtctacctgaggagaccctcttgagatatgtgcggttgatcaagagcggtgggctcagagccaagcctcagttctctgttaagtttaacaagtctgatatagccttcacgggtgacagagcttttggggcttacgtgattcctgcacctcaaaccnctgagatggttgaagatgtggaccttttggtcagaagggcagagagatgcttagaagctggggcagacatgataatgatcaacgctgatgatttatgcaggcaggctgattcgctacggtcagacatggttgcaaagattgtgggtcgtcttggacttgagaaaactatgtttgaggcatcaagtcctaaaatctctgagtggtttatcaaacgttatggtccaaaggttaatcttttcgtggatcactcacaagtgatggatctggaatgcctcagaggacgcaacctgggtcaaaaccactcatccctacttggcaggtcatattttctgctctgatcttgtcgcatccatagagaaaaacgcgcatattgtggcacccattaacgtaatgcgttggtggtcatctgttgaggtcatgtataaatgaaaaaagaatgtatttcatgtatgtactgtaatgattttggagactcttctctttgcatgaagttcagctgcttgtaaagatactcttttatgttctaatgcctaatggactgaaagttaacaaatcttg

SEQ ID NO: 1089 - DNA, 1213 bp, Solanum phureja
caccataaagataccattctatcaactgtcaactactgccacagagatacatgaacattccagttccaatccacacacatagatatatcccaaatcaagaaatttcacaaataagatgtttgatgcaggggaattttctccaagttcttcaacagctgctctgtctgcagagtgtttcagtagtagcagctgcttcagcagtctgtcatcctcaaagaagaagaagattaacaataacaacgcgaggaggttcagcgatgaacagataaaatcattagaaacgatgttcgaaacagagaccaaacttgaaccaagaaagaagctgcaactagccagagaactcggattacaacctcgacaagtagcaatttggtttcaaaacaagagagctcgatggaaatcgaagcaactcgaaagggattacagtatacttaaatcaaattatgacaatcttgcttcccagtacgaatctttaaagaaagaaaaacaatccttgcttattcagttgcaaaaactgaatgatgtgatgcagaaagaaagggggaagtactgttgcaagcaagaaatcgagttagacaacagatgtgctgcaattaagaaaaatgaaatggaagggatgccaagcttgtcttttgacttatcatctcagcatggaacaaatggtgttatttcagatgatgacattgacagcagtataaaagctgattatctcgggttagatgacgatgcagtacatcatctactgaaaattgttgaagcaggggatagttctttaacttcccctgaaaattggggcagtctaaacgacgatggtatcttaaaccatcagcctaatagttctagttatgatcactggtgggatttctggtcttgaatcagaattgtcgacaacatatacacataaatgatcagatgccaaattgctcgcgactcttgtacatttgatcgagcatgctgggcatcctttgttttcactttcataagagttgagtttacctcagccttacagtgcctttgtctacttgacaaactgtaatcttgtatactagtactagtccatggtgattttagtttgtatgccttgaaatatgctacttgtaatacgtagtaattatcagatcagaatagctgagaagtataatttccagcagctcgtaatcagagatatagtttaaaagaaagtaaccacacagaatagaagctattggagggt

SEQ ID NO: 1090 - DNA, 1228 bp, Solanum tuberosum
gcaccataaagataccattctatcaactgtcaactactgccacagagatacatgaacattccagttccaatccacacacatagatatatcccaaatcaagaaatttcacaaataagatgtttgatgcaggggaattttctccaagttcttcaacagctgctctgtctgcagagtgtttcagtagtagcagctgcttcagcagtctatcatcctcaaagaagaagaagattaacaataacaacgcgaagaggttcagcgatgaacagataaaatcattagaaacgatgttcgaaacagagaccaaacttgaaccaagaaagaagctgcaactagccagagaactcggattacaacctcgacaagtagcaatttggtttcaaaacaagagagctcgatggaaatcgaagcaactcgaaagggattacagtatacttaaatcaaattatgacaatcttgcttcccagtacgaatctttaaagaaagaaaaacaatccttgcttattcagttgcaaaaactgaatgatgtgatgcagaaagaaagggggaagtactgttgcaagcaagaaatcgaggtagacaacagatgtgctgcaattaagaaaaatgaaatggaagggatgccaagcttgtcttttgacttatcatctcagcatggaacaaatggtgttatttcagatgatgacattgacagcagtataaaagctgattatctcgggttagatgacgatgcagtacatcatctactgaaaattgttgaagcaggggatagttctttaacttcccctgaaaattggggcagtctaaacgacgatggtatcttaaaccatcagcctaatagttctagttatgatcactggtgggatttctggtcttgaatcagaattgtcgacaaaatatacacatctaaaacgttggctttagaaatgatcagatgccaaattgctcgcgactcttgtacatttgatcgagcatgctgggcatcctttgttttcactttcataagagttgagtttacctcagccttacagtgcctttgtctacttgacaaactgtaatcttgtatactagtactagtccatggtgattttagtttgtatgccttgaaatatgctacttgtaatacgtagtaattatcagatcagaatagctgagaagtataatttccagcagctcgtaatcagagatatagtttaaaagaaagtaaccacacagaatagaagctattgga

SEQ ID NO: 1091 - DNA, 1233 bp, Solanum tuberosum
gcaccataaagataccattctatcaactgtcaactactgccacagagatacatgaacattccagttccaatccacacacatagatatatcccaaatcaagaaatttcacaaataagatgtttgatgcaggggaattttctccaagttcttcaacagctgctctgtctgcagagtgtttcagtagtagcagctgcttcagcagtctatcatcctcaaagaagaagaagattaacaataacaacgcgaagaggttcagcgatgaacagataaaatcattagaaacgatgttcgaaacagagaccaaacttgaaccaagaaagaagctgcaactagccagagaactcggattacaacctcgacaagtagcaatttggtttcaaaacaagagagctcgatggaaatcgaagcaactcgaaagggattacagtatacttaaatcaaattatgacaatcttgcttcccagtacgaatctttaaagaaagaaaaacaatccttgcttattcagttgcaaaaactgaatgatgtgatgcagaaagaaagggagaagtactgttgcaagcaagaaatcgaggtagacaacagatgtgctgcaattaagaaaaatgaaatggaagggatgccaagcttgtcttttgacttatcatctcagcatggaacaaatggtgttatttcagatgatgacattgacagcagtataaaagctgattatctcgggttagatgacgatgcagtacatcatctactgaaaattgttgaagcaggggatagttctttaacttcccctgaaaattggggcagtctaaacgacgatggtatcttaaaccatcagcctaatagttctagttatgatcactggtgggatttctggtcttgaatcagaattgtcgacaaaatatacacatctaaaacgttggctttagaaatgatcagatgccaaattgctcgcgactcttgtacatttgatccagcatgctgggcatcctttgttttcactttcataagagttgagtttacctcagccttacagtgcctttgtctacttgacaaactgtaatcttgtatactagtactagtccatggtgattttagtttgtatgcctttaaatatgctactagtaatacgtagtaattatcagatcagaatagctgagaagtataatttccagcagctcgtaatcagagatatagtttaaaagaaagtaaccacacagaatagaagctattggagggta

SEQ ID NO: 1092 - DNA, 1377 bp, Solanum tuberosum
gtttacaccagcgaggtctctttttccatctgtgcagtggtcatgacgagacgaaaacgacgccacgccccttatacaacggacgattctcgccgccgttttccaccacccgaagcccaaccccaaccccgtatacacccgtcagacttaattgatgatcgggaagcggctcagcaacgcgagattgaaaaactgctccaggaaaaccgcagtctagcgggcgcgcacgtctctcttaaccaggagctctccgccgtccagcacgagctccgtcttctctcttccacagccgcaaccgtcaagaccgaaagggatgctgaggtccgtgaggtttacgacgaggcacggaagaaggagtctgatgttcgtatactcgatgagcttagagtagagttggctcgggttaggagcgatattcagaacctagttgacgaccgtaaagagctcactgccaaattgcagaacatggagaaagatctcgtcaaggttggttccgagttacagcagtttcccgtaatcaaggctgaaattgagtccatgcataaggaagttcaacgaggaagagctgctatcgactatgaaaaaaagatgcacaccagcaaccttgaatatagtcaagcaatggagaaacataagattactctggcttctgaaattgagaaactacatgccgagcttgcaaatgcagagaagagggcaagggcagcagcagctgcagcggctccaagtaatttaaaccgccagatttctgcagcaactccaaattttacatattctgccaattatggaaatcctgaaacaggttatagagagaatctgtaccctgcgccttatgctgtacatcaggttcaggtcagtgctgatgcaaaaacccaatatgttggtggagccatgccttatgtacatcactagttggtggtttgaaagtgaaaaactcgtgccggatgacaagcagatgtaaatgtgtcaaacttagggatcttttatttcatgagagaagtggtttctggaggaagcacagatgaaatgatttttcttggtggtgatgagactgacatttgtcttgagtgtagtctcagaattcagataattaatgactgttgtggttatttgtgcatatgtctatttagtggattgaagttagtttgagccatgattggatcctgaatttaaaaatgtggggttttcaaaattaattaagttgaagctgcaagtgacagtcagttttgaagatgggaatataggggaataggggaagtggaattgaaatccccatgtatcattggcagaggagaaggagaagcgttttatattcttatttttatagaagatttttttgcctattgtggactaggtgagtagtaacactaattgtgg

SEQ ID NO: 1093 - DNA, 1406 bp, Solanum tuberosum
aaaaaacaaaaggaaattctctctcttgtgtttacaccagcgaggtctctttttccatctgtgcagtggtcatgacgagacgaaaacgacgccacgccccttatacaacggacgattctcgccgccgttttccaccacccgaagcccaaccccaaccccgtatacacccgtcagacttaattgatgatcgggaagcggctcagcaacgcgagattgaaaaactgctccaggaaaaccgcagtctagcgggcgcgcacgtctctcttaaccaggagctctccgccgtccagcacgagctccgtcttctctcttccacagccgcaaccgtcaagaccgaaagggatgctgaggtccgtgaggtttacgacgaggcacggaagaaggagtctgatgttcgtatactcgatgagcttagagtagagttggctcgggttaggagcgatattcagaacctagttgacgaccgtaaagagctcactgccaaattgcagaacatggagaaagatctcgtcaaggttggttccgagttacagcagtttcccgtaatcaaggctgaaattgagtccatgcataaggaagttcaacgaggaagagctgctatcgactatgaaaaaaagatgcacaccagcaaccttgaatatagtcaagcaatggagaaacataagattactctggcttctgaaattgagaaactacatgccgagcttgcaaatgcagagaagagggcaagggcagcagcagctgcagcggctccaagtaatttaaaccgccagatttctgcagcaactccaaattttacatattctgccaattatggaaatcctgaaacaggttatagagagaatctgtaccctgcgccttatgctgtacatcaggttcaggtcagtgctgatgcaaaaacccaatatgttggtggagccatgccttatgtacatcactagttggtggtttgaaagtgaaaaactcgtgccggatgacaagcagatgtaaatgtgtcaaacttagggatcttttatttcatgagagaagtggtttctggaggaagcacagatgaaatgatttttcttggtggtgatgagactgacatttgtcttgagtgtagtctcagaattcagataattaatgactgttgtggttatttgtgcatatgtctatttagtggattgaagttagtttgagccatgattggatcctgaatttaaaaatgtggggttttcaaaattaattaagttgaagctgcaagtgacagtcagttttgaagatgggaatataggggaataggggaagtggaattgaaatccccatgtatcattggcagaggagaaggagaagcgttttatattcttatttttatagaagatttttttgcctattgtggactaggtgagtagtaacactaattgtgg

SEQ ID NO: 1094 - DNA, 897 bp, Solanum phureja
aaaaaacaaaaggaaattctctctcttggtttacaccagcgaggtctctttttccatctgtgcagtggtcatgacgagacgaaaacgacgccacgccccttatacaacggacgattctcgccgccgttttccaccacccgaagcccaaccccaaccccgtatacacccgtcagacttaattgatgatcgggaagcggctcagcaacgcgagattgaaaaactgctccaggaaaaccgcagtctagcgggcgcgcacgtctctcttaaccaggagctctccgccgtccagcacgagctccgtcttctctcttccacagccgcaaccgtcaagaccgaaagggatgctgaggtccgtgaggtttacgacgaggcacggaagaaggagtctgatgttcgtatactcgatgagcttagagtagagttggctcgggttaggagcgatattcagaacctagttgacgaccgtaaagagctcactgccaaattgcagaacatggagaaagatctcgtcaaggttggttccgagttacagcagtttcccgtaatcaaggctgaaattgagtccatgcataaggaagttcaacgaggaagagctgctatcgactatgaaaaaaagatgcacaccagcaaccttgaatatagtcaagcaatggagaaacataagattactctggcttctgaaattgagaaactacatgccgagcttgcaaatgcagagaagagggcaagggcagcagcagctgcagcggctccaagtaatttaaaccgccagatttctgcagcaactccaaattttacatattctgccaattatggaaatcctgaaacaggatatagagagaatctgtaccctgcgccttatgctgtacatcaggtttgtaattacatctctcttac

SEQ ID NO: 1095 - DNA, 1316 bp, Solanum phureja
agctgtatttttttgtctttgtgttcttctctttataataaatacccatatcacaaattttaattttcatctttcagtatttgagatttttttctaatttttactgaaaacccatcatgggttcttcgttttctgtgttgattcctcagttttcgtctactgttactaagcaaaatcattcaagtcttggtgatttgccggaaagttgtgtagcttcagttcttgtatacatggacccgcctcagatctgtaaattgtctatgcttaatagggcttttagaggcgcttcttctgctgattttgtgtgggaatccaagttgccgatgaattacagctctattattcaaagggtctttgctggtcgaaattttccggctaatttgtgtaaaagagatatttatgctatgctttgtcgacctaattcttttgatggtggctcaaagaaagtttggttagataagagaactggaagagtttgtatgtctatatcttcaagtggcttggcaataacgggcatcgatgataggagatattggagtcggattgaaactgatgaatctagattcaagtccgttgcatatctccaacagatctggtggtttgaagttgatggagaggtcgatttcccattccccgttgggtcctatagcatattcttcagactacaagtaggacgtgcctctcggagatttggacgccgagtctgcaactccgagcatgttcacgggtgggataagaaaccagtgcggtttcagctctcgacatcagacggtcaacaagctacaacccaatgttacttgaacgaacctggaatatggaagtaccaccatgtaggtgactttgttgccacgggttcagtagaacccatgaaagttaaatattcgttgacacagatcgattgtacacatactaaaggtggactatgtgtagattctgtactgatatgtccagtagagtttacagagaggttgaagcagagtttttgatttgctgattacctgtttctgagggctcgtttggtaggaggggtcagggataactaatcccgagattaattttaggatgagtttattccatatttggttaggataaaattgcgggataataatcgtggaataacttgttcctaaccaaacgagccccaagagtagttgtagttctagtgctatccatagtttttccgagtggttagtattaagagataatcatatattagactgaggcaatttgtgtaaatgtatactatggggctgtttatccattcattgtgctgagttattagcatctattacattaaaaatacatttctttttgca

SEQ ID NO: 1096 - DNA, 1250 bp, Solanum tuberosum
ctctttataataaatacccatatcacaaattttaattttcatctttcagtatttgagatttttttctaatttttactgaaaacccatcatgggttcttcgttttctgtgttgattcctcagttttcgtctactgttactaagcaaaatcattcaagtcttggtgatttgccggaaagttgtgtagcttcagttcttgtatacatggacccgcctcagatctgtaaattgtctatgcttaatagggcttttagaggcgcttcttctgctgattttgtgtgggaatccaagttgccgatgaattacagctctattattcaaagggtctttgctggtcgaaattttccggctaatttgtgtaaaagagatatttatgctatgctttgtcgacctaattcttttgatggtggctcaaagaaagtttggttagataagagaactggaagagtttgtatgtctatatcttcaagtggcttggcaataacgggcatcgatgataggagatattggagtcggattgaaactgatgaatctagattcaagtccgttgcatatctccaacagatctggtggtttgaagttgatggagaggtcgatttcccattccccgttgggtcctatagcatattcttcagactacaagtaggacgtgcctctcggagatttggacgccgagtctgcaactccgagcatgttcacgggtgggataagaaaccagtgcgatttcagctctcgacatcagacggtcaacaagctacaacccaatgttacttgaacgaacctggaatatggaagtaccaccatgtaggtgactttgttgccacgggttcagtagaacccatgaaagttaaatattcgttgacacagatcgattgtacacatactaaaggtggactatgtgtagattctgtactgatatgtccagtagagtttacagagaggttgaagcagagtttttgatttgctgattacctgtttctgagggctcgtttgataggaggggtaagggataactaatcccgagattaattttaggatgagtctattccatatttggttaggataaaatcgcgggataacaatcgtggaataacttgttcctaaccaaacgagccccaagaatagttgtagttctagtgctatccatagcttttccgagtggttagtattaacagataatcatatattagactgaggcaatttgtgtaaatgtgaacaatggggctgtttatccattcattgtactgagtta

SEQ ID NO: 1097 - DNA, 1292 bp, Solanum tuberosum
  misc_feature (34)..(34): n is a, c, g, or t
  misc_feature (44)..(44): n is a, c, g, or t
  misc_feature (478)..(478): n is a, c, g, or t
ctctttataataaatacccatatcacaaattttnattttcatcnttcagtatttgagatttttttctaatttttactgaaaacccatcatgggttcttcgttttctgtgttgattcctcagttttcgtctactgttactaagcaaaatcattcaagtcttggtgatttgccggaaagttgtgtagcttcagttcttgtatacatggacccgcctcagatctgtaaattgtctatgcttaatagggcttttagaggcgcttcttctgctgattttgtgtgggaatccaagttgccgatgaattacagctctattattcaaagggtctttgctggtcgaaattttccggctaatttgtgtaaaagagatatttatgctatgctttgtcgacctaattcttttgatggtggctcaaagaaagtttggttagataagagaactggaagagtttgtatgtctatatcttcaagtggcttggcnataacgggcatcgatgataggagatattggagtcggattgaaactgatgaatctagattcaagtccgttgcatatctccaacagatctggtggtttgaagttgatggagaggtcgatttcccattccccgttgggtcctatagtatgttcttcagactacaagtaggacgtgcctctcggagatttggacgccgagtctgcaactccgagcatgttcacgggtgggataagaaaccagtgcggtttcagctctcgacatcagacggtcaacaagctacaacccaatgttacttgaacgaacctggaatatggaagtaccaccatgtaggtgactttgttgccacgggttcagtagaacccatgaaagttaaatattcgttgacacagatcgattgtacacatactaaaggtggactatgtgtagattctgtactgatatgtccagtagagtttacagagaggttgaagcagagtttttgatttgctgattacctgtttctgagggctcgtttgataggaggggtaagggataactaatcccgagattaattttaggatgagtctattccatatttggttaggataaaatcgcgggataacaatcgtggaataacttgttcctaaccaaacgagccccaagaatagttgtagttctagtgctatccatagcttttccgagtggttagtattaacagataatcatatattagactgaggcaatttgtgtaaatgtgaacaatggggctgtttatccattcattgtactgagttattagcatctattacattaaatacatttctttttgcaaaaaaa

SEQ ID NO: 1098 - DNA, 1172 bp, Solanum melongena
taccttcttctcaatacccattatcacaagttctcaatttcatcttttctctattgaaatttttacaacaaatccttaaacccatcatgggttcttctttttctttcttgattcctcagttttcttctgctgttactcagcaaaagcccagtcttggtgatttgccggagagctgtgtagcttcagttcttgtatatatggacccccctcagatctgtaaattgtctgtactaaatagagcttttaggggtgcttcttctgctgattttgtgtgggaatccaagttgccgatgaattatagctctattattcaaagggtttttgatggtagaaattttccggctaatctgtgtaaaagagatatttatgctaagctttgtcgacctaattcttttgatggtggcacaaagagagtttggttggataagagaactggaagggtttgtatgtcaatatcttcaagcggcttggcgataacgggcatcgatgataggagatattggagtcggattgaaacagatgaatcaagattcaagtccgttgcatatctccaacaaatctggtggtttgaagttgatggggaggttgatttcccattccctgccgggtcctatagcatattctacagactacaagtaggacgttcctctcggagatttggacgccgagtctgcaactctgagcatgttcatgggtgggataggaaaccagtgcggtttcagctctcgacttcagacagccaagaagccacaacccagtgttacttgaacgaacctggaatatggaagtaccaccatgtaggtgactttgttgccacaggttcgtttgaaccgatgaaagttaaatattcgatgactcagatcgattgtacacatactaaaggtggactatgtgtagattctgtactgatatgtccggtagagtttacagagaggttgaagcagagtttttgatttgcttgattacccgtctcttgagattagtttacactagtgctatccatagttttttgagtggttagtatcgagggataatcatatatttgacttgaggcaaattgtgtaaaatttgaacaatgggactttttgtactcagttgttagcatctgttgttgcattagatacctatttctttgcactaccaattcttgtaagtgttatcggggtctttcg

SEQ ID NO: 1099 - DNA, 3885 bp, Solanum tuberosum
gatttatctgtatacattattcagcatttgcaggtcggagaatctgatcggagcaagttgtgaccgacgatcggagttgaaagttcgttattcaaagtgttctgcgttagcttccttttatattcacttttgtttttgctccgtaattccgtttttcgctcttctcatttctattgaatttacttatataggtatgtagactgtatgaattttgcgctattatatagtttcctgcaagtatgattagacctataatgacgcctatctactgatctctgtgtttcaacttattcttcattttcgcgtactgcttaatttattgtttgttgcatttcatcctcttttgcggagtctatgaaatgtttgtgttggtgaatttataggctttgtttgcttagatcgattataacggatttgcgttagtttgtatgaggagagatacttttagtggagcttgtagaatttgtgttgtgttgattgtgctctcgtctaggttccattttttgtgtaatctataagaattgtgattgttgtgctatggaaaaaagaaagagaaagagactctgttgagattatgtttctgtgccatgagatcatgaatgattggtttgcgtgctgttgtgttacgaatggttgccttgctaatatctatgttgaattagatgggttatgtagcgtatgtgtcttggtggaatgctgcttcatatcactgagctttcgtgctttgtggttatattaaccctatccacaattttttattaatagagtgtaaataatcctcagtttcggggcatttacggtcgttgattgattgcatgaggccttcgcttttgattgattgagtggcagcaaaatatatccgtaggaacgattgataactaatttggcattctttggtcttaggatagttgatgaaattatctagttttactcttagccttgaaaaattatagttaaaaatatataagtgcccgcaggtttaagaaatggggtaccttgaacttgtgtgtgggtgatttagctatattgatgttttgtgacagtatgtaaattgcagttatcaaataaaattccagtgagaagttgatgatgaatttaaagaaaaaaataataataaagatcttgaataaacaaatacttttcttttttcctgccctatcccttttcgcttatgaagatggagactataaacacaagcatttataagcatgtatttggtcaatctgaagttgaaaagctggtgttccaatcaaatggaagtagtagtcgtgatagcgcccttctcattggacatctatgtcaatcttctgttcagtttgttcatcactctgtttccttttgtctattttgcgttcaacttctgatgctggtatcccattgaggctattggtattagcagttctcacttttccttaagtaggctgacttaggattgggagtttcgattgctttccaagttttctggtatgttttatcttccaaccaatctaattttgggctcctgaaagagatcatttggtatatgtggttgtagctgttcttgactgatggtaatgaaagattgtaaattttacctactttcgcatgggaggtagacactggactgtggaaaaataagttatcgtggcacatgatgctttttgtgttgcaacttcagtttttgtgaattttagtaaaatgctaggcatatgcgatgatgaagtttttcattaacaaagataagcctcaggatgaaaaggtgaacaagaaaagaaaggaaacaagaaagatgaccaccggagactggagagtatggatcagttggatgttgtaacccaacagataagattttcctttctgacaatgaaataatccaactaacagattgtaggaatttataaaattcttcttcagggtaagattcccttgttgaagtgacatggtgcagaatctcagacagaggtagggttgtctgtgatggacaacaaataaatcatctctgcagtctcgcacttttcccagtatttttctgtcaggacgggtttgattgttgtccattgcttttaccttaggttggacttcccttcatcagtatctctttaaatggagttctccaagaatgaaatcatcgtgcaatcattattatctactgctggacgctttggagctcctcaatgcttcacgatagttctagtttgggttccttttgaacctacttgtggattcttgtagatcaacttgttttgatgaattctcatggtggagtttgctgattggagctgtcaagctttgttggaatttgttgttgctggtttcaattggtgttcatgtgcgacaacacaacattgtctgaggtgttttgcccatttggagggccaagtagtcatgcctttgtaggtttaggattttttcccttgactgtttcctgaatgcagggcttctagttgttaaattgatccataaggcaaaatgggagacatagtgattgaacattcagggacgccacattatgaggccttaaacttacaaaatgttacaacatctgagaatgatgctgatctggttcagagtttctgtggggactacttgcctgaggatattacacatgaagaaaaatccacttgtactgaagccctcgacagaggatacttggaatatggatgtccccactatcgccgtagatgtcgcattatagccccatgctgcaatgagatgtttgactgcaggcattgtcataatgaatataagaacaatatcaacgttgaccagaaacttcgacatgagattcctcgtcacaaggtggaaagggtgatatgctcactttgtgatacagagcaagaggttcggcaagtttgcatcaattgcggtgtgtgcatggggagatatttctgtgaaacgtgtaagctatttgatgatgatacatccaaaagacagtatcactgcaatggttgtggaatatgcaggattggtgggatggagaacttcttccactgtcccaaatgcagatgttgttattcagttctattgaggaacagccacccctgtgtagagggggcaatgcatcatgactgtcctgtttgttttgagtatctctttgaatcgataaatgatgtaacagtcatgccttgtggccacactattcataagaactgcttgaaggagatgcaggaacactaccaatatgcttgtcctctctgctctaagtcggtatgtgatatgtcaaaggtctgggagaaatttgacatggagattgctgcaacaccaatgcccgaaccttatcaagacaagaaggtttggatcctttgtaacgattgtggaatcacctcagaagtgcaatttcactttgtggcccagaaatgtccatgttgcaaatcttacaacacccgccaaacaagaggcagataaaaggaccaaatatcaatagccagcctgggtttcaagtgaaaatgatcccacaccctatgtggctagggtggtacctctgagcgggaatgactgggctttacaaaagctaagcttatagaagaaatgatggaaggaaggggtactaatatgatcctgcttgtagcacttgtggggttatcctgttttcgcgtttcttcagtttatttatcttcaatgttccttggtagtatgtgtgttttatatgccagtgtaatgtaattttgaagacactgattatttgttcagtgctagcacaaatattgttggtatgcgtgattcaatcctgtatagcacagagcaagttgaactgttgcatgtcaggtggctgagacttgatgtgttgtgtgatattgtatcttccagttaattactcatgtgaagttaaatttgtattattacttcgtatttaaagagtactatagttctttaaaaaaaatgaaggtgcctaattaaattttagga

SEQ ID NO: 1100 - DNA, 3808 bp, Solanum tuberosum
cattattcagcatttgcaggtcggagaatctgatcggagcaagttgtgaccgacgatcggagttgaaagttcgttattcaaagtgttctgcgttagcttccttttatattcacttttgtttttgctccgtaattccgtttttcgctcttctcatttctattgaatttacttatataggtatgtagactgtatgaattttgcgctattatatagtttcctgcaagtatgattagacctataatgacgcctatctactgatctctgtgtttcaacttattcttcattttcgcgtactgcttaatttattgtttgttgcatttcatcctcttttgcggagtctatgaaatgtttgtgttggtgaatttataggctttgtttgcttagatcgattataacggatttgcgttagtttgtatgaggagagatacttttagtggagcttgtagaatttgtgttgtgttgattgtgctctcgtctaggttccattttttgtgtaatctataagaattgtgattgttgtgctatggaaaaaagaaagagaaagagactctgttgagattatgtttctgtgccatgagatcatgaatgattggtttgcgtgctgttgtgttacgaatggttgccttgctaatatctatgttgaattagatggttatgtagcgtatgtgtcttggtggaatgctgttcatatcactgagctttcgtgcttgtgggtatattaaccctatcacaattcttataatagagtgtaaataatcctcagtttcggggcatttacggtcgttgattgattgcatgaggccttcgcttttgattgattgagtggcagcaaaatatatccgtaggaacgattgataactaatttggcattctttggtcttaggatagttgatgaaattatctagttttactcttagccttgaaaaattatagttaaaaatatataagcgcccgcaggtttaagaaatggggtaccttgaacttgtgtgtgggtgatttagctatatcgatgttttgtgacagtataaattgcagctatcaaataaaattccagtgagaagttgacgacgaatttaaagaaaaaaaaataataaagatcttgaataaacaaatacttttcttttttcctgccctatcccttttcgcttatgaagatggagactataaacacaagcatttataagcatgtatttggtcaatctgaagttgaaaagctggtgttccaatcaaatggaagtagcagtcgtgatagcgcccttctcattggacacctatgtcaatcttctgttcagtttgttcatcactctgtttccttttgccaatttgcgttcaacttctgatgctggtatccattgaggctattggtattagcagttctcacttttccttaagtaggctgacttaggattgggagtttcgattgctttccaagttttctggtatgttttatcttccaaccaatctaattttgggctcctgaaagagatcatctggtatatgtggttgtagctgttcttgactgatggtaatgaaagattgtaaattttacctactttcgcatgggaggtagacactggactgtggaaaaataagttatcgtggcacatgatgctttttgtttgcaacttcagtttttgtgaattttagtaaaatgctaggcatatgcgatgatgaggtttttcattaacaaagatgggcctcagggtgaaaaggtgaacaaaaaaagaaagatgaccaccggagactggagagtatggatcagttggatgttgtaacccaacagataagattttcctttctgacaatgaaataatccaactaacagacagtaggaatttataaaattcttcttcagggtaagattcccttgttgaagtgacatggtgcagaatctcagacagaggtagggttgtctgtgatggacaacaaataaatcatctctgcagtctcgcacttttcccagtatttttctgtcaggacgggtttgattgttgtccattgcttttaccttaggttggacttcccttcatcagtatctctttaaatggagttctccaagaatgaaatcatcgtgcaatcattattatctactgctggacgctttggagctcctcaatgcttcacgatagttctagtttgggttccttttgaacctacttgtggattcttgtagatcaacttgttttgatgaattctcatggtggagtttgctgattggagctgtcaagctttgttggaatttgttgttgctggtttcaattggtgttcatgtgcgacaacacaacattgtctgaggtgttttgcccatttggagggccaagtagtcatgcctttgtaggtttaggattttttcccttgactgtttcctgaatgcagggcttctagttgttaaattgatccataaggcaaaatgggagacatagtgattgaacattcagggacgccacattatgaggccttaaacttacaaaatgttacaacatctgagaatgatgctgatctggttcagagtttctgtggggactacttgcctgaggatattacacatgaagaaaaatccacttgtactgaagccctcgacagaggatacttggaatatggatgtccccactatcgccgtagatgtcgcattatagccccatgctgcaatgagatgtttgactgcaggcattgtcataatgaatataagaacaatatcaacgttgaccagaaacttcgacatgagattcctcgtcacaaggtggaaagggtgatatgctcactttgtgatacagagcaagaggttcggcaagtttgcatcaattgcggtgtgtgcatggggagatatttctgtgaaacgtgtaagctatttgatgatgatacatccaaaagacagtatcactgcaatggttgtggaatatgcaggattggtgggatggagaacttcttccactgtcccaaatgcagatgttgttattcagttctattgaggaacagccacccctgtgtagagggggcaatgcatcatgactgtcctgtttgttttgagtatctctttgaatcgataaatgatgtaacagtcatgccttgtggccacactattcataagaactgcttgaaggagatgcaggaacactaccaatatgcttgtcctctctgctctaagtcggtatgtgatatgtcaaaggtctgggagaaatttgacatggagattgctgcaacaccaatgcccgaaccttatcaagacaagaaggtttggatcctttgtaacgattgtggaatcacctcagaagtgcaatttcactttgtggcccagaaatgtccatgttgcaaatcttacaacacccgccaaacaagaggcagataaaaggaccaaatatcaatagccagcctgggtttcaagtgaaaatgatcccacaccctatgtggctagggtggtacctctgagcgggaatgactgggctttacaaaagctaagcttatagaagaaatgatggaaggaaggggtactaatatgatcctgcttgtagcacttgtggggttatcctgttttcgcgtttcttcagtttatttatcttcaatgttccttggtagtatgtgtgttttatatgccagtgtaatgtaattttgaagacactgattatttgttcagtgctagcacaaatattgttggtatgcgtgattcaatcctgtatagcacagagcaagttgaactgttgcatgtcaggtggctgagacttgatgtgttgtgtgatattgtatcttccagttaattactcatgtgaagttaaatttgtattattacttcgtatttaaagagtactatagt

SEQ ID NO: 1101 - DNA, 1471 bp, Solanum tuberosum
catgcctttgtaggtttaggattttttcccttgactgtttcctgaatgcagggcttctagttgttaaattcatccataaggctaaatgggagacatagtgattgaccattcagggacaccacattatgaagccttaaacttacaaaatgttacaacatctgagaatgatgctgatctggttcagagtttctctgggggctacttgcctgaggatagtacacatgaagaaaaatccacttgtactgaagccctcgacagaggatacttggaatatggatgttcccactatcgccgtagatgtcgcattatagccccttgctgcaatgagatgtttgactgcaggcattgtcataatgaatataagaacaatatcaatgtagaccagaaacttcgacatgagattcctcgtcacaaggtggaaagggttatatgctcactttgtgatacagagcaagaggttcagcaagtttgcatcaattgtggtgtgtgcatggggagatatttctgtgaaacgtgtaagctatttgatgatgatatatccaaaagacagtatcactgcaatggttgtggaatatgcaggattggtgggatggagaacttcttccactgtcccaaatgcagatgttgttattcagttctattgaggaacagccacccctgtgtagagggagcaatgcatcatgactgtcctgtttgttttgagtatctctttgagtcgataaatgatgtaacagtcatgccttgtggacacactattcataagaactgcttgaaggagatgcaggaacactaccagtatgcttgtcctctctgctctaagtcggtatgtgatatgtcgaaggtgtgggagaaatttgacatggagattgctgcaacaccaatgcccgaaccttatcaagacaagcaagtttggatcctttgtaatgattgtggaatcacctcagaagtgcaatttcactttgtggctcagaaatgtccatgttgcaaatcttacaacacccgccaaataagaggcagatagagggaccaagtagcaatagtcagtctggctttcaagtgaaaatgatcccacaccctatgtggctagggtggtacctctgagtggtaatgattgggctttacaaagctaaaattgtagaagaaatgatggaaggaaggggttctaatatgatcctgcttgtagcacttctggggttatcgtgttttcgcatttcttcagtttatttatcttcaatgttccttggtagtagtatgtgtgttttatatgccagtgtaatttcgaagacactgattatttgttcagtgttagcacaaatattgttggtgtgttattcaatcctttagagaacagcgcgagtagaactgtggtggctgagagatttgatgtgttgtgtgatatgtatcttccagttaattactctatgtgaagttaaatttgtattattacttcatatttaaagaatactatagt

SEQ ID NO: 1102 - DNA, 2021 bp, Solanum tuberosum
gataagatttcctttctgacaatgaaataatccaactaacagacagtaggaatttataaaattcttcttcagggtaagattcccttgttgaagtgagacatggtgcagaatctcagacagaggtagggttgtctgtgatggacaacaaataaatcatctctgcagtttcgcactttcccagtatttttctgtcaggacggggttgattgttgtccattgcttttaccttaggttggacttcccttcatcagtatctctttaaatggagttctccaagaatgaagtcatcatgcaatcattattatctactgctggacgctttggagctcctcaatgcttcacgatagttctagtttgggttccttttgaacctacttgtggattcttgtagatcaacttgttttgatgaattctcatggtggagtttgctgattggagctgtcaagctttgttggaatttgttgttgctggtttcaattggtgttcatgtgcgacaacacaacattgtctgaggtgttttgcccatttggagggccaaatagtcatgcctttgtaggtttaggattttttcccttgactgtttcctgaatgcagggcttctagttgttaaattcatccataaggctaaatgggagacatagtgattgaccattcagggacaccacattatgaggccttaaacttacaaaatgttacaacatctgagaatgatgctgatctggttcagagtttctctgggggctacttgcctgaggatagtacacatgaagaaaaatccacttgtactgaagccctcgacagaggatacttggaatatgggatgttcccactatcgccgtaagatgtcgcattatagccccttgctgcaatgagatgtttgactgcaggcattgtcataatgaatataagaacaatatcaatgtagaccagaaacttcgacatgagattcctcgtcacaaggtggaaagggttatatgctcactttgtgatacagagcaagaggttcagcaagtttgcatcaattgtggtgtgtgcatggggagatatttctgtgaaacgtgtaagctatttgatgatgatatatccaaaagacagtatcactgcaatggttgtggaatatgcaggattggtgggatggagaacttcttccactgtcccaaatgcagatgttgttattcagttctattgaggaacagccacccctgtgtagagggagcaatgcatcatgactgtcctgtttgttttgagtatctctttgagtcgataaatgatgtaacagtcatgccttgtggacacactattcataagaactgcttgaaggagatgcaggaacactaccagtatgcttgtcctctctgctctaagtcggtatgtgatatgtcgaaggtgtgggagaaatttgacatggagattgctgcaacaccaatgcccgaaccttatcaagacaagcaagtttggatcctttgtaatgattgtggaatcacctcagaagtgcaatttcactttgtggctcagaaatgtccatgttgcaaatcttacaacacccgccaaataagaggcagatagagggaccaagtagcaatagtcagtctggctttcaagtgaaaatgatcccacaccctatgtggctagggtggtacctctgagtggtaatgattgggctttacaaagctaaaattgtagaagaaatgatggaaggaaggggttctaatatgatcctgcttgtagcacttctggggttatcgtgttttcgcatttcttcagtttatttatcttcaatgttccttggtagtagtatgtgtgttttatatgccagtgtaatttcgaagacactgattatttgttcagtgttagcacaaatattgttggtgtgttattcaatcctttagagaacagcgcgagtagaactgtggtggctgagagatttgatgtgttgtgtgatatgtatcttccagttaattactctatgtgaagttaaatttgtattattacttcatatttaaagaatactatagttcttt

SEQ ID NO: 1103 - DNA, 1568 bp, Solanum phureja
aaaaatccttcattttctctgtgcgtgcatttatctgtatacattattcagcatttgcaggtcggagaatctgatcggagcaagttgtgaccgacgatcggagttgaaaggcttctagttgttaaattgatccataaggctaaatgggagacatagtgattgaacattcagggacgacacattatgaggccttaaacttacaaaatgttacaacatctgagaatgatgctgatctggttcagagtttctgtggggactacttgcctgaggatattacacatgaagaaaaatccacttgtactgaagccctcgacagaggatacttggaatatggatgtccccactatcgccgtagatgtcgcattatagccccatgctgcaatgagatgtttgactgcaggcattgtcataatgaatataagaacaatatcaacgttgaccagaaacttcgacatgagattcctcgtcacaaggtggaaagggttatatgctcactttgtgataaagagcaagaggttcggcaagtttgcatcaattgcggtgtgtgcatggggagatatttctgtgaaacgtgtaagctatttgatgatgatacatccaaaagacagtatcactgcaatggttgtggaatatgcaggattggtgggatggagaacttcttccactgtcccaaatgcagatgttgttattcagttctattgaggaacagccacccctgtgtagagggggcaatgcatcatgactgtcctgtttgttttgagtatctctttgagtcgataaatgatgtaacagtcatgccttgtggccacactattcataagaactgcttgaaggagatgcaggaacactaccaatatgcttgtcctctctgctctaagtcggtatgtgatatgtcaaaggtctgggagaaatttgacatggagattgctgcaacaccaatgcccgaaccttatcaagacaagaaggtttggatcctttgtaacgattgtggaatcacctcagaagtgcaatttcactttgtggcccagaaatgtccatgttgcaaatcttacaacacccgccaaacaagaggcagataaaaggaccaaatatcaatagccagtctggctttcaagtgaaaatgatcccacaccctatgtggctagggtggtacctctgagcgggaatgactgggctttacaaaagctaagcttatagaagaaatgatggaaggaaggggtactatatgatcctgcttgtagcacttctggggttatcgtgttttcgcgtttcttcagtttatttatcttcaatgttcagtatgtgtgttttatatgccagtgtaatgtaattttgaagacactgattatttgttcagtgctagcacaaatattgttggtatgcgtgattcaatcctgtatagcacagagcaagtagaactgtcgcatgtcaggtggctgagacttgatgtgttgtgtgatattgtatcttccagttaattactcatgtgaagttaaatttgtattattatttcgtatttaaagagtactatagttctttaaaaaaaatgaaggtgcctaattaaattt

SEQ ID NO: 1104 - DNA, 1388 bp, Solanum melongena
tagtgattgaacatccaggggtgccacattatgaggccttgaacctacaaaatattacagcatcggagaatgatgctgatctggttcagagtttctgtggggactgcttgcctgagcatggtacatgtgaagaaaaatcctcttgtaatgaagcccttgacagaggatacttggaatatggctgttcccactatcaacgtagatgtcgcataagagccccgtgctgcaatgagatatttgactgcaggcattgtcataatgaagctaagaacaatatcaacattgaccctagacttcgacatgagatttctcgtcacaaggtggaaagggttatatgctcactttgtgatactgagcaagaggttcggcaagtttgcatcaactgtggtgtgtgcatggggagatatttctgtggaacgtgtaagctatttgatgatgatgtatccaaaagacagtatcactgcaatggttgtggaatatgcaggattggcggaatggagaacttcttccactgtcccaaatgcagatgttgttactcagttctgttgagggacagccacccctgtatagagggggcaatgcatcatgattgtcctgtttgttttgagtatctctttgagtcgataaatgatgtaacagtcatgccctgtggacacactatccataagaactgcttgaaggagatgcaggaacactaccaatatgcttgtcctctctgctctaagtcggtatgtgatatgtcaaaggtgtgggagaaatttgacatggagattgctgcaacaccgatgcccgaaccttatcaagacaagaaggtttggatcctttgtaatgattgtggaattacctcagaagtgcaatttcactttttagcccagaaatgtccatgttgcaaatcttacaacacccgccaaaccagaggcagatagagggaccaaaatcagtctggcgttcatgtgaaaatgatcccacactcaaggtggcagtaaattctgagtgggacgtgattgggctttacaaagctaagcttgcagaagaaatgatggaaggaaggggttctcctgcttgtagcacttatggggttatcggtctttttgattttcttcattttatatattttcaattttcaatttcaatgtttcctcggtagtagtatcaagtatgtgtggtttataaaccggtgtagttttgtagacgctgattatatatgttgagtgttggcacagatattgtttgcatgtgtgatgtctgtagcttgctgcttcaatcctttgtagcaaacagcgagtaaatatgtggcaagtcaggtggctatgcgtgatgtgataatgtaaactacagatgatgatttaatgcattaattcggattgcccggctttaagttagtaagg

SEQ ID NO: 1105 - DNA, 1967 bp, Petunia hybrida
gcagaaggtagaataagaaaaagaaaaggaaaagatgagccatagagtatggacaagttggatgttgttgcacaactgataacattttcctttctgtcaatgaggcttccaagtaacacgccgttaggatctaaaagattctttgtcagggtaagtttctcttgttgaagacgatgtgatgcagaatctcagacagaggtagggttgtcctcaatggacaacaaaataattcgtctctgcagtctccttgcactttcccaatatttttctctgtcaggacgggtttgatgctttgtccattgcttttaccttaggttggactacccttcgtcggtatctctttaaatggaggacttctctaagaatgaagtgatcatgcagtcattattatctactgctggacgctttggagctacgcaatacttcatgatagttttagtttgggttcctaatcgacctacttgtggattcttgttgatcaacttgttttgatgaattctcgtggtgcagcttgctgattggagctgttcaaccttacgtggaatttatagttgctggtttcaattggtgttctatagtattcaagaaagcaccattgtctgggtgttttgcccatttggaggggcaactagacatgtctttgtaggtgtaggatttttccttaactgtttcctgattgcaggacttgtattagctaaattaagtcatcaggctcaatgggagacgtagtgattgaacacccagggactccacgttctgagacaataaacctacacaacttaatatcgaagaatcatgctgatgtgctcgagaatttccatgggggatacttccctgaggatgaaacacgtgaagaaaaatcaactggtactgaagcccttgacagaggatacttagattatggctgttctcactatcggcgtagatgtcgcattagagccccttgctgcaatgagatatttgactgcagacactgtcataatgaagctaagaacaatatcaacattgaccagaaacttcgacatgagattcctcgtcacaaggtggaaagggttatatgctcactctgtgatactgagcaagaggttcggcaagtttgcgtcaattgcggagtctgcatgggaagatatttctgtgaaacctgtaagctattcgatgatgatatatccaagagacagtaccactgcaatggttgtggcatttgcaggattgggggcaaggagaacttcttccattgtcccaagtgcagatgttgctattcagttctgttgaagaatagccacccctgtgtagagggggcaatgcatcacgactgtcctgtttgttttgagtatctctttgaatcggtaaacgatgtaacagtcatgccatgtggacacactattcacaagaactgcttgaaggagatgcaggaacactaccaatatgcttgtcctctatgctctaagtcggtatgtgatatgtcaaaggtgtgggagacatttgacgtggagattgctgcaacgcctatgcccgaatcttatcaagacaagaaggtatggatactttgtaatgattgtggaaccacctctgaagtgcaacttcattttgtggcccagaaatgcccatgctgcaaatcttacaacactcgccaaacaagaggcagatagagggaccattaacaatagtctgggtgttattgtgaaaatgatccctgcccaatgtgattgacagtgccatattctgagtgggaagtgattgggcttttcaaagctaagcttgcagaggaaatgatggaactaggggttctgctacgatcctgcgtttagcactccggcgctttgttttcgcttttttatttttatgtttatcccaatgttgtagtatgtgtggcattcagtaaatcctagaagctcattgcatgaagaacccgatgtaactctttgaggcagtagtaactgttcagtattacagcaagtattgttggc

SEQ ID NO: 1106 - DNA, 1389 bp, Nicotiana tabacum
  misc_feature (77)..(77): n is a, c, g, or t
  misc_feature (117)..(117): n is a, c, g, or t
  misc_feature (651)..(651): n is a, c, g, or t
acccctcatgcggccgctggcaagtagacatgcttgtaggttttaggactttttccttaactatttcctggatgcanggcttgtagtagttaagttcatacataaggctcaatgggnggcatagtgattgaacattcagggactccatgttctgagacaataaacatgcacaacgtaatatttatgagtgatgctgacgtggttcagaatttccatgagggctacttgcctgaggatggaacacgtgaagaaaaatcctattctacagaagcccttgacagaggatacttggaatatggctgttctcactatcggcgtagatgtcgcattagagccccttgctgcaatgaaatattcgtctgcaggcattgtcataacgaagctaagaacaatatcaacattgaccagaaacttcgacatgagattcctcgtcacaaggtggaaagggttatatgctcgctttgtgatactgagcaagaggttcggcaagtttgcatcagttgtggcgtgtgcatggggaagtatttctgtgaaacctgtaagctatttgatgatgatatatccaagagacagtatcactgcaatggttgtggcatttgcaggattggtgggatggagaacttcttccactgttccaaatgcagatgttgntattcagttttgttgaagaaaagccacccttgtgtagagggagcaatgcatcatgactgtcctgtttgttttgagtatctgtttgagtcggtaaacgatgtaacagtcatgccctgtggacacactattcaccagaactgtttgaaggagatgcaggaacactaccaatatgcttgtcctctatgctctaagtcggtatgtaatatgtcaaaggtgtgggagaaatttgacatggagattgccgcagcaccaatgcctgaatcttatcaagacaagaaggtttggattctttgtaatgattgtggaattacctcagaagtgcaatttcattttgtggcccagaaatgtccatgttgcaaatcttataacacccgccaaacaagaggcagataggaggaccaaatatcaatagtctggctgtgatgtgaaaatgattgccgcccaatgtggttagaatgctatattctgagtgggaagtgattgggcttttcaaagctggctcttgcagaagaaacgaaggaaagagggggttccaacatgatcctgcttgtagcgcttctggggttctcgtacttttgcatttcctcaaaaaatttctgttgttccttgtggtaggtgtggcatccactacaattctaaattcctgcgtgaagtatccagtgtatatcagaagacactgactaattgttcagtgttaccaactagtgttggcagcatatgtttacctttagctttatt

SEQ ID NO: 1107 - DNA, 619 bp, Solanum phureja
tacgccaaaaaccctacaatttttctctgcttcttcttcaacaacaatggcgcccatgggtggaaaacgctttgctttaaccggatcaagcagcagcagcaagaacgacggcgttttagctaggatttctcaatcctccattgttacaaaggggaaacaagcagcttgtggtgcgacttatgtggggaaaaaacttgcgaagagtactggaaaagctgcgtggcttgttgctacaacgtttttggttctgggtttaccgttaattattgttatggatcgtgaacagcagctgaatgatcttgatcttcaacaagctagtcttcttggtgcttcccctgctacaacccagaattgattttgttagatgggtttgagaaatttgtagaatggatgtttgggaagctgcagttcattagttaaaaaaagaagatcttgatcttccatagaaattatttttcgttatgttttgtgtttttttttagtgttttgatgatgggtttcgagattggattgatgaaatttgtagaatgtgttggttgctttattagatgtttgggaagctgcagtgtttattagtgaaaaaatttgatcttgatcttcaatagaattgatttcactt

SEQ ID NO: 1108 - DNA, 592 bp, Capsicum annuum
gcacgaggcaagcctaaacctaaaaccctacaactttcctctttcttcctcaacaatggctgcttcaacaagtggaaaaagattttctttaagcaaaaacgacggcgtattagccaagatttctaattcaactattgttacaaagggaaaacaagcagcttgtggagcaacatatgtagggaagaaacttgcaaagagtactggaaaagctgcttggcatgttgctactacttttttggtacttgggttgcctttgattatagttatggatagggaacaacagcttaatgatcttgatcttcaacaagctagtcttcttggtgttgttcctcctgcttcagctgttgctcctcagaagtgaatcttgattttgaattttttgttatgtttttgaaccccgttttgttagttatgaacacccttttgtgttttggtgatgaatttgagttatattgattttatctagtgaaaagtatgattaaatgttcttatttatgaacacccttttgtgtattatttagtgttttggtgatggatttgctgttaattattgttatggatagggaataacagcttaatgttctagatcttc

SEQ ID NO: 1109 - DNA, 829 bp, Solanum phureja
agcttgtgatgaagaaaattgaggatccaacatcccgtcaacagttctattcaaagcgcaaggataccattcttaagaagtcaaatgagttggctgttttatgtgacgttgatgttggtcttctaatgttttctccagcgggtgaagtgaccagctattctagcaaagaaagtcttgaggatgtcatgctccttgctatgaacaaggctggcgaactgaacaagcgatctcctgaaaatccaaatgaacagcctttgacggagattctcacacaatcaaaacatgaaggcaaaatggtggaaaagatagcgatagccatgaggagaagcttaataagcttaaagaaaggctaagtgaagcacaacagaaaataaggtattacgaaccacaagtggagaatatcaactctgtccaagaagctgatgcatatgagaagttcattaggagtgctatggaactaattcaactatcaaaagcaaaactcttgggtggccaggaatttctccagagaaatgaaaatgttgcggtgtcttctgtcaacgcagaggatatggctgctgcaggaaccagtatgggacggatgtattgaggaaacaggccggatcgcggcggggaagtagctgtgggtgtccaacagctgcaacaggaattatgttatactagtttataggttaagaacttggtagaataaataacttccccctatcaggcaagcaaaagtatgaataatgttgcatttgtctattgtgaatgcaacttttagagttcttgtatggcatcaaaacataggtattgtgttttgaattagaaaacaatttggtttggtttc

SEQ ID NO: 1110 - DNA, 1354 bp, Solanum tuberosum
gctatatattcatttcaaatacaatcttgaggctttgccggttttgctccaatttcaaggtgttgttccttccccaattcacatagaattgaaattggtgaatttgatatggctggtaagattatgcatgctgttcaatacgactcttatggcggtggagccgctggcttgaagcatgtggaagttcctgtgcctactccgaagaaggatgagatcttgctaaaactggaggctacaagcattaatcctgttgactggaaaattcagaagggcatgcttcgtccgcttcttcctaccaagtttccttttattcctactaccgacgtgggaggagaggttgtagaggtaggatctaatgtaaaaagtttcaaggctggtgacaaggttgtggctatgctcaataccctgaatggaggtggattggctgaatatgcggtggctaatgagagtttgactgttccaagacccgccgaagtatcagctgcagaaggtgcaggtcttgttattgcaggtcttacagctcttcaggcccttgtcaatcctgctgaggttaagctcgatggaactggaccccggaagaacattctagttacggctgcttcgggtggtgtcggtcactatgctgttcaattggcaaaacttggtaacactcatgttactgccacctgtggagcgcgcaacattgattttgtgaagagcttaggagcagatgaggttcttgattacaagaccccagagggagcagctcttaagagtccgtcaggccaaaaatatgatgcagtgattcactgcacaacaggcatcccttggtctacgtttgagcctaatttaagttcgagtggaaaggtcatcgatataactcctggagttagtgccatgtggacctttgcagtaaagaaattaaccttctcaaagaagcagttggtgccactgcttttaattcccaagaaggagaacctggaattgattgttgggcttgtgaaggaagggaaacttaaaacagtgatcgactcgaaatttcctctgagcaatgctgaagatgcttggagcaggagtattgatggacatgcgaccggaaagattgttgtggagccatagagtagtggtctaaaagatttgtgaggcgtgtgtgcagtttgtcatctggcttgtaacaactatcatttgccttgtatgcttgtgcagtttgtcatctgccttttccctttcataatgctgttcgattttgttgtctttgcattttgacaattattcattttctagactgatgactagtggaaaaccaaaacagttgaattgaaaattgacattttcttagtgatgagtggatttttaatcattactcataacaaaa

SEQ ID NO: 1111 - DNA, 1448 bp, Solanum phureja
taaaactagtgttcaaatgttgtcttttacgagaacattcgtagaaaggcggccgcgtgtcgcccaaaatctatgctactgccgtctaccgatttcacatcgatatattcatttcaaatacaatcaagaggctttgccggttttgctccaatttcaaggtgttgttccttccccaattcacatagaattgaaattggtgaatttgatatggctgggaagattatgcatgctgttcaatacgactcctatggcggtggagccgctttgaagcatgtggaagttcctgtgcctactccgaagaaggatgagatcttgctaaaactggaggctacaagcataaatcctgttgactggaaaattcagaagggcatgcttcgtccgcttcttcctaccaagtttccttttattcctactaccgacgtgggaggagaggttgtagaggtaggatctaatgtaaaaagtctcaaggctggtgacaaggttgtggctatgctcaataccctgaatggaggtggattggctgaatatgcggtggctaatgagagtttgactgttccaagacccgccgaagtatcagctgcagaaggtgcaggtcttgttattgcaggtcttacagctcttcaggcccttgtcaatcctgctgaggttaagctcgatggaactggaccccggaagaacattctagttacggctgcctcgggtggtgtcggtcactatgctgttcaattggcaaaacttggtaacactcatgttactgccacctgtggagcgcgcaacattgattttgtgaagagcttaggagcagatgaggttcttgattacaagaccccagagggagcagctcttaagagtccgtcaggccaaaaatatgatgcagtgattcactgcacaacaggcatcccttggtctacctttgagcctaatttaagttcgagtggaaaggtcatcgatataactcctggagttagtgccatgtggacctttgcagtaaagaaattaaccttctcaaaaaaacagttggtgccactgcttttaattcccaagaaggagaacctggaattgattgttgggcttgtgagggaagggaaacttaaaacagtgatcgactcgaaatttcctctgagcaatgctgaagatgcttggagcaggagtattgatggacatgcgaccggaaagattgttgtggagccatagagtagtggtctaaaagatttgtgaggcgtgtgtgcagtttgtcatctggcttgtaacaactatcatttgccttgtatgcttgtgcagtttgtcatctgccttttccctttcataatgctgttcgattttgttgtctttgcattttgacaattattcattttctagactgatgactagtggaaaaccaaaacagttgaattgaaaattgacattttcttagtgatgagtggatttttaatcattactcataacaa

SEQ ID NO: 1112 - DNA, 1298 bp, Nicotiana tabacum
gcataggagtagtatataacaatactacattgcctcggtggtttcgctccttccccgaattaagagaaaggcgtgaatttgatatggctgggaaggtgatgcatgctatccaatacaactcttatggtggcggtgccgctggcttaaagcatgttgaagtccctgtgcctactccgaagaaggatgaggtcttgctaaaactggaggctacaagcttaaatcctgttgactggaaaattcagaagggcgtgcttcgtcctcttctgcctcccaagtttccttttattcctactactgacgtgggaggagaggttgtagaggtaggatctagtgtaaaagatttcaaggtcggcgacaaggttgtggctatgcttaataccctgaatggaggtggattggctgaatacgcggtggctaaggagagtttgactgttccaagaccagctgaagtatcagctgctgaaggtgcaggtcttcctgttgcaggagttacagctcttcaggcccttgtcaatcctgctgaggtcaagctcgatggaactggaccccggaagaacatcttagttacagctgcctctggtggtgtaggtcattatgctgtgcaactggcaaaacttggtaacacccatgttactgctacctgtggagcccgtaactttgattttgtgaagagcttaggagcagatgaggttcttgattacaagaccccagagggagcagctcttaagagtccatcaggccaaatatatgatgcagtaattcactgtactacaggcattccttggtctacctttgagcctaatttaagtgcgaaagggaaggtcatcgacctgactcctggacctagcgccatgtggacctatgcagtaaagaaactaaccttctcaaagaagcagttggtgccattgcttttaattcccaagaaggagaacctggacttggttgttagtcttgtgaaggaagggaaacttaaaacagtgatagactccaaacatcccctgagcaaggctgaagatgcttggagcaggagcattgatggacatgcaacaggaaagattattgtggagccatagagtagtctttcaaatgatgttaatgttatataggtgtgtgataaaaggtttgggaggcatgtttattatgacaggtaaatctatccagcgataacaattttcatttgccttgcatggatgcgcagtgtgtcaactggttttccacctgtatggtgtgtgataaatctttatttctctgggagttgtttcatgacatgtattttactgaggttgtctccctgctcc

SEQ ID NO: 1113 - DNA, 1195 bp, Solanum tuberosum
ccaacttcaaagagaattgaaattggtgaatctgatatggctgggaagattatgcaggctgttcaatacgactcttatggcggtggagctgctgccttgaagcatgtggaagttcctgtgcctactccgaagaaggatgaagtcttggtaaaagtggaggctacaagcataaatcctcttgactgtaaaattcagaagggcatgtttcgtccacttcttcctcccaagtttccttttattcctgctaccgacgtggcgggagaggttgttgaggtaggatctaatgtaaaaagtttcaaggctggtgacaaggttgtggctatgctcagtaccaagagtggaggtggcttggctgaatatgcggtacctaaggagagtttgactgtttcaagacccgctgaagtatcagctgcagaaggtgcaggtcttcttattgcaggtcttacagctcttcaggcccttgtaaatcctgctgaggttaagctcgatggaactggaccccggaagaacattctagttacggctgcctcgggtggtgtcggtcactatgctgttcaattggcaaaacttggtaacgcccatgttactgccacctgtggagcccgcaactttgattttgtgaagagcttaggagcagatgagattcttgattacaagactccagagggagcagctcttaagagtccatcaggccaaaagtatgatgcagtgattaactgcacaacaggcatcccttggtctacgtttgagcctaatttaagttcgagtggaaaggtcattgatctaactcctggagctagctccatgtggacctttgcagtaaagaaattaaccttctcaaagaagcagttggtgccatttcttttaaatgccaagaaggaaaacctggaattgcttgttaggcttgtgaaggaagggaaactcaaaacagtgatcgactccaaatttcctctgagcaaggctgaagatgcttggagcaggagtattgatggacatgcgacgggaaagatttttgtggagccatagagtagtggtctaccatattatgttattatacatacatgtgtaataaaagatttgtgaggcttgtgcattatgaccagttaaatttattcagctgtaacaacttttatttgccttgtatgcatatgcagtcaactgttttttttttttcataatgctgtttgatttagtt

SEQ ID NO: 1114 - DNA, 1368 bp, Solanum phureja
aaataccctttgatagcggcaattcacttgtatatattctaaaattccagtactatgtagcagccacgcccattttactccaacttcaaagagaattgaaattggtgaatctgatatggctgggaagattatgcaggctgttcaatacgactcttatggcggtggagctgctgccttgaagcatgtggaagttcctgtgcctactccgaagaaggatgaagtcttggtaaaagtggaggctacaagcataaatcctcttgactgtaaaattcagaagggcatgtttcgtccacttcttcctcccaagtttccttttattcctgctactgacgtggcgggagaggttgttgaggtaggatctaatgtaaaaagtttcaaggctggtgacaaggttgtggctatgctcagtaccaagagtggaggtggattggctgaatatgcggtacctaaggagagtttgactgtttcaagacccgctgaagtatcagctgcagaaggtgcaggtcttcttattgcaggtcttacagctcttcaggcccttgtcaatcctgctgaggttaagctcgatggaactggaccccggaagaacattctagttacggctgcctcgggtggtgtcggtcactatgctgttcaattggcaaaacttggtaacgcccatgttactgccacctgtggagcccgcaactttgattttgtgaagagcttaggagcagatgagattcttgattacaagactccagagggagcagctcttaagagtccatcaggccaaaaatatgatgcagtgattaactgcacaacaggcatcccttggtctacctttgagcctaatttaagttcaagtggaaaggtcatcgatctaactcctggagctagctccatgtggacctttgcagtaaagaaattaaccttctcaaagaagcagttggtgccatttcttgtaaatgccaagaaggaaaacctggaattgcttgttaggcttgtgaaggaagggaaactcaaaacagtgatcgactccaaatttcctctgagcaaggctgaagatgcttggagcaggagtatcgatggacatgcgacgggaaagatttttgtggagccatagagtagtggtcttccatattatgttattatacatatatgtgtaataaaagatttgggaggcttgttcattatgaccagttaaatctattcagctgtaacaacttttgtttgccttgtatgcatatgcagtttgtcaactcgtttttttctttcataatgatgtttgatttaatttgtcctagttttctttgcattttgataatcattcattttctggattgggttctagactaatgataaatggaaaagcaaacagttaaattg

SEQ ID NO: 1115 - DNA, 1751 bp, Capsicum annuum
gcacgaggatacgagaagccactggttagaagaaatatttacctaagttttgtcaactttggcgtcctctttagaagcttctttcagtcaactttgggatattttgaaccattttcgtgtaaaaacactaagaagtttgactaaaaattattaattttatctcagatgcttagcccgtgtaagtttccataagtttttttctatatatattccaatctccgataggtccaatacccagttttgctacaacttggaggtcttgttcgtccctgatccagagagattttaggaagttgctgaatttgagatggctgggaaggttatgcacgctgttcaatacaactcttatggccgcggagccgctggtttgaagcatgtggaagttcctgtgcctactccgaagacagatgaggtcctgctaaaactggaggctgcaagcataaatcctattgactggaaaattcagaatggcatgcttcgtccacttcttcctcccaagtttccttttattccaactaccgacgtgggaggagaggttgtagaggtaggatctaatgtaaaaagtttcaaggccggcgacaaggttgtggctatgctcggtacccggaatggaggtggattggctgaatatgcggtggctaaggagagtatgaccgttacaagacccaccgaagtatcagctgcagaaggtgcaggtcttcttgttgcaggtcttacagctcttcaggcccttgtcaatcctgctggggtcaagctcgatggaactggacctcggaagaacattctagttacggctgcctccggtggtgttggtcactatgctgttcaattggcaaaacttggtaacacccatgttactgctacctgtggagcccgcaactttgattttgtgaagagcttaggagcagatgaggttcttgattacaagaccccagagggagcagcacttaagagtccatcaggccaaaaatatgatgcagtggttcactgcacaacagggatcccttggtctacctttgagcctaatttaagtgcgagtgcaaaggtcatcgatctaactcctggagctggcgccatgtggacctttgctgtaaagaaattaactttttcaaagaagcagttggtacctttcctttatactcccaataaggagaacctggaattgcttgttaggcttgtgaaggaagggaaacttaaaacagtgatcgactccaaacatcctctcagcaaggctgaagatgcttggagcaggagtattgatggacatgcgacaggaaagatctttgtggagccataggctggtggtctcccaaatgactttatgttatatgggtgtgtggaataaaaggtttgtgaggcttgtatgttgtgatcagttaaatctattcagctgtaacgactttcagttgtcttgtacttgtcttgtacgcatgggctttatcaattttttttctttcacagtgccgttcgatttagttgtccgaattttccttgtaatcacaaggatttcaaaacttcgggaggaccaaacgggcggggtgggggagggccagggggatgaggataccaggaatcacagagctatatagacaaaatattctaatatatagaagcgtgaagggaagcaggaggcggtggtgttgcttgcgtctttcgtgattttattgtattatccctcattaattattatatgttatttatatattaaaaaattaataatatttaacaaaaatataaatagatatttatga

SEQ ID NO: 1116 - DNA, 1289 bp, Solanum tuberosum
ccaacttcaaagagaattgaaattggtgaatctgatatgactgggaagattatgcaggctgttcaatacgactcttatggcggtggagctgctgctttgaagcatgtggaagttcctgtgcctactccgaagaaggatgaagtcttggtaaaagtggaggctacaagcataaatcctcttgactgtaaaattcagaagggcatgtttcgtccacttcttcctcccaagtttccttttattcctgctaccgacgtggcgggagaggttgttgaggtaggatctaatgtaaaaagtttcaaggctggtgacaaggttgtggctatgcttagtaccaagagtggaggtggcttggctgaatatgcggtacctaaggagagtttgactgtttcaagacccgctgaagtatcagctgctgaaggtgcaggtcttcttattgcaggtcttacagctcttcaggcccttgtaaatcctgctgaggttaagcttgatggaactggaccccggaagaacattctagttacggctgcctcgggtggtgtcggtcactatgctgttcaattggcaaaacttggtaatgcccatgttactgccacctgtggagcccgcaactttgattttgtgaagagcttaggagcagatgagattcttgattacaagactccagagggagcagctcttaagagtccatcaggccaaaagtatgatgcagtgattaactgcacaacaggcatcccttggtctacgtttgagcctaatttaagttcgagtggaaaggtcatcgatctaactcctggagctagctccatgtggacctttgcagtaaagaaattaaccttctcaaagaagcagttggtgccatttctaataaatgccaagaaggaaaacctggaattgcttgttaggcttgtgaaggaagggaaactcaaaacagtgatcgactccaaatttcctctgagcaaggctgaagatgcttggagcaggagtatcgatggacatgcgacgggaaagatttttgtggagccatagagtagtggtctaccatattatgttattatacatacatgtgtaataaaagatttgtgaggcttgtgcattatgaccagttaaatttattcagctgtaacaacttttatttgccttgtatgcatatgcagtttgtcaactgttctttttctttcataatgctgtttgatttagtttgtcctagttttctttgcactttgacaatctttcattttctggattgggttttagactgatgataaatggaaaaacagatagttaaattg

SEQ ID NO: 1117 - DNA, 1305 bp, Solanum tuberosum
gatcgcccattttgctccaacttcaaagagaattgaaattggtgaatctgatatgactgggaagattatgcaggctgttcaatacgactcttatggcggtggagctgctgccttgaagcatgtggaagttcctgtgcctactccgaagaaggatgaagtcttggtaaaagtggaggctacaagcataaatcctcttgactgtaaaattcagaagggcatgtttcgtccacttcttcctcccaagtttccttttattcctgctaccgacgtggcgggagaggttgttgaggtaggatctaatgtaaaaagtttcaaggctggtgacaaggttgtggctatgctcagtaccaagagtggaggtggcttggctgaatatgcggtacctaaggagagtttgactgtttcaagacccgctgaagtatcagctgctgaaggtgcaggtcttcttattgcaggtcttacagctcttcaggcccttgtaaatcctgctgaggttaagctcgatggaactggaccccggaagaacattctagttacggctgcctcgggtggtgtcggtcactatgctgttcaattggcaaaacttggtaacgcccatgttactgccacctgtggagcccgcaactttgattttgtgaagagcttaggagcagatgagattcttgattacaagactccagagggagcagctcttaagagtccatcaggccaaaagtatgatgcagtgattaactgcacaacaggcatcccttggtctacgtttgagcctaatttaagttcgagtggaaaggtcatcgatctaactcctggagctagctccatgtggacctttgcagtaaagaaattaaccttctcaaagaagcagttggtgccatttcttataaatgccaagaaggaaaacctggaattgcttgttaggcttgtgaaggaagggaaactcaaaacagtgatcgactccaaatttcctctgagcaaggctgaagatgcttggagcaggagtattgatggacatgcgacgggaaagatttttgtggagccatagagtagtggtctaccatattatgttattatacatacatgtgtaataaaagatttgtgaggcttgtgcattatgaccagttaaatttattcagctgtaacaacttttatttgccttgtatgcatatgcagtttgtcaactgttctttttctttcataatgctgtttgatttagtttgtcctagttttctttgcactttgacaatctttcattttctggattgggttttagactgatgataaatggaaaaacagatagttaaattg

SEQ ID NO: 1118 - DNA, 1243 bp, Solanum lycopersicum
caaattgcagtactacatagaaccgtagtccattttgctccaacttcaaagagaattgaaattgggaaatctgatatgtctgggaagattatgcatgctgttcaataccactcttatggcggtggagctgctgccttgaagcatgtggaagttcctgtccctactccaaataaggatgaagtcttggtaaaaatggaggctacaagcataaatcctcttgactcgaaaattcagaagggcatgcttcgtccatttcttccttccaagtttccttttattcctactaccgacgtggcgggagaggttgttgaggtaggatctaatgtaaaaagtttcaaggctggtgacaaggttgtggctatgctcagtaccaagagtggaggtggattggctgaatatgcggtacctaaggagagtttgactgtttcaagacccgctgaagtatcagctgcagaaggtgcaggtcttgttattgcaggtcttacagctcttcaggccctcgtcaatcctgctgaggttaagcttgatggaactggaccccggaagaacattctagttacggctgcttcgggtggtgtaggtcactatgctgttcaattggcaaaacttggtaacgcccatgttactgccacctgtggagcccgcaacattgattttgtgaagagcttaggagcagatgagattcttgattacaagactccagagggagctactcttaagagtccatcaggccaaaaatatgatgcagtgattaactgcacaacaggcatcccttggtctacctttgagcctaatttaagttcaagtggaaaggtgatcgatctaactcctggagctagctccatgttgacctttgcagtaaagaaattaaccttctcaaagaagcagttggtgccgtttcttgtaaatgccaataaggaaaacctggaattgcttgttaagcttgtgaaggaagggaagctcaaaacagtgattgactccaaatttcctctgagcaaggctgaagatgcttggagcaggagtatcgacggacatgcgacaggaaagattttggtggagccataaagtagtgatctaccatattatgttattatacatacgtgtgttataaaagatttgtgaggcttgtgcattatgaccagttaaatctattcagctgcaacaacttttatttgtcttgtatgcatatgcagcttgtcaactgttttttatttttattttcataatgctgttcgattaagtt

SEQ ID NO: 1119 - DNA, 1395 bp, Solanum lycopersicum
aaaaccgcagacaaaggaaaattaccctttgacagcggcaattcacctatatatatattctacaaattgcagtactacatagaaccgtagtccattttgctccaacttcaaagagaattgaaattgggaaatctgatatgtctgggaagattatgcatgctgttcaataccactcttatggcggtggagctgctgccttgaagcatgtggaagttcctgtccctactccgaataaggatgaagtcttggtaaaagtggaggctacaagcataaatcctcttgactcgaaaattcagaagggcatgcttcgtccatttcttccttccaagtttccttttattcctactaccgacgtggcgggagaggttgttgaggtaggatctaatgtaaaaagtttcaaggctggtgacaaggttgtggctatgctcagtaccaagagtggaggtggattggctgaatatgcggtacctaaggatagtttgactgtttcaagacccgctgaagtatcagctgcagaaggtgcaggtcttgttatcgcaggtcttacagctcttcaggccctcgtcaatcctgctgaggttaagcttgatggaactggaccccggaagaacattctagttacggctgcttcgggtggtgtaggtcactatgctgttcaattggcaaaacttggtaacgcccatgttactgccacctgtggagcccgcaacattgattttgtgaagagcttaggagcagatgagattcttgattacaagactccagagggagctactcttaagagtccatcaggccaaaaatatgatgcagtgattaactgcacaacaggcatcccttggtctacctttgagcctaatttaagttcaagtggaaaggtgatcgatctaactcctggagctagctccatgttgacctttgcagtaaagaaattaaccttctcaaagaagcagttggtgccgtttcttgtaaatgccaataaggaaaacctggaattgcttgttaagcttgtgaaggaagggaagctcaaaacagtgattgactccaaatttcctctgagcaaggctgaagatgcttggagcaggagtatcgacggacatgcgacaggaaagattttggtggagccataaagtagtgatctaccatattatgttattatacatacgtgtgttataaaagatttgtgaggcttgtgcattatgaccagttaaatctattcagctgcaacaacttttatttgtcttgtatgcatatgcagcttgtcaactgttttttatttttattttcataatgctgttcgattaagtttgtcctagttctctttgcattttggcaatcattaattttctggattgggttcaagactgatgctaaatggtaaagcaaacagttaaattg

SEQ ID NO: 1120 - DNA, 1384 bp, Solanum melongena
tatgtgatcatagcagcttttatgagtatttgactatttacctactacttttgattttaaggagaaaagtcttgaaaaggcggccaaaatttgatcatccccgggtttgctcaaaacttgaacgtcttgctgaatttgatatggctgggaagattatgcatgctgttcaatacgactcttatggccgcggagccgctggattgaagcatgtggaagttcctgtgcctactccaaagatggatgaggtcttgataaaagtggaggctacaagcataaatcctattgactggaaaattcagaagggcatgcttcgtccacttcttcctcccaagtttccttttattcctactaccgacgtggccggagaggttgtagaggtaggatctaatgtaagaagtttcaaggttggtgacaaggttgtggcgatgctcaataccaagagtggaggtggattggctgaatatgcggtacctaaggagaatttgactgtttcaagacccactgaagtatcagcagcagaaggtgcaggtcttcttattgcaggtcttacagctcatcaggcccttgtcgatcatgctggggttaagcttgatggaactggaccccggaagaacattttagttacagctgcctcaggtggtgtcggtcactatgctgttcaattggcaaaacttggtaatgcccatgttactgccacctgtggagcccgcaacattgattttgtgaagagtttaggagcagatgaggttcttgattacaagaccccagagggagcagctcttaagagtccatcaggccaaaaatatgatgcagtggttcactgcacaacaggcatcccttggtctacttttgagcctaatttaagttcgagcgggaaggtcatcgatctaactcctggagctggcgccatgttgacctttgcaataaagaaattaaccttctcaaagaagcagttggtgccactgcttgtaaatgccaagaaggagaacctggaattgcttgttaggcttgtgaaggaaggaaaacttagaacagtgatcgactccaaatttcctcttagcaaggctgaagatggttggagcaagagtattgatggccatgcaacgggaaagatttttgtggagccatagagtagtggtcttcccagtgttcatctattactatgtatgtacgtgtggaataaaagatttgtgaggcttgtgcattatgaccagaccagtgttatctattcagctgtaacagcttttagttaaatctttacttgcgcactttgtcaactggcttttgccttttataggatttagttttctttgcattttcacaattattcattttatcgactgggttccaggctgatgataattggaaaagcaaacagtaattg

SEQ ID NO: 1121 - DNA, 1124 bp, Solanum lycopersicum
ggagaaaagtcgtggataggcggccgcgtgtgccccaatagatacactctaatgctaccgccgattcaccaatcttatccatcagcctcgccgattttgctccaatttgagagagaattgaaattggtgaatctgatatggctatgcatgctgttcaatacgactcttatggcagcggctccgctggattgaagcatgtggaagttcctgtgcctactccgaagaaggatgaagtcttgataaaagtggaggctacaagcataaatccttttgactggaaaattcagaagggcatgcttcgtccacttcttcctaccaagtttccttttattccttctatcgacgtgggaggagaggttgtagaggtaggatctaatgtaaaaagattcaaggctggtgacaaggttgtggctatgctcaatgccctgaatggaggtggattggctgaatatgcggtggctaatgagagtttgactgttccaagactcgctgaagtatcagctgcagaaggtgcaggtcttattgttgcaggtcttacagctcttcaggcccttgtcaatcattctgaggttaagctcaatggaactggaccccggaagaacattctagttacggctgcctcaggtggtgtcggtcactatgctgttcaattggcaaaacttggtaacactcatgttactgccacctgcggagtgcgcaacattgatcttgtgaagagcttaggagcagatgaggttcttgattacaataccccagagggagcagctcttaagagtccgtcaggccaaaaatatgatgcagtgattcactgcacaacaggcatcccttggtctacctttgagcctaatttaagttcaagtggaaaggttatagatataactcctggagttagcgccatgtggacctttgcggtgaagaaattgaccttctcaaagaaacagctggtgccactgcttctgattccgaagaaggaaaatctggaattgattgttgggcttgtgaaggaagggaaactgaaaacagtaatcgactcaaatttcctctgagcaaggctgaagatgcttggagcaagagtattgatggacatgccaccggaaagattattgtggagccatagagcagtg

SEQ ID NO: 1122 - DNA, 1355 bp, Solanum tuberosum
gctatatattcatttcaaatacaatcttgaggctttgccggttttgctccaatttcaaggtgttgttccttccccaattcacatagaattgaaattggtgaatttgatatggctggtaagattatgcatgctgttcaatacgactcttatggcggtggagccgctggcttgaagcatgtggaagttcctgtgcctactccgaagaaggatgagatcttgctaaaactggaggctacaagcattaatcctgttgactggaaaattcagaagggcatgcttcgtccgcttcttcctaccaagtttccttttattcctactaccgacgtgggaggagaggttgtagaggtaggatctaatgtaaaaagtttcaaggctggtgacaaggttgtggctatgctcaataccctgaatggaggtggattggctgaatatgcggtggctaatgagagtttgactgttccaagacccgccgaagtatcagctgcagaaggtgcaggtcttgttattgcaggtcttacagctcttcaggcccttgtcaatcctgctgaggttaagctcgatggaactggaccccggaagaacattctagttacggctgcttcgggtggtgtcggtcactatgctgttcaattggcaaaacttggtaacactcatgttactgccacctgtggagcgcgcaacattgattttgtgaagagcttaggagcagatgaggttcttgattacaagaccccagagggagcagctcttaagagtccgtcaggccaaaaatatgatgcagtgattcactgcacaacaggcatcccttggtctacctttgagcctaatttaagttcgagtggaaaggtcatcgatataactcctggagttagtgccatgtggacctttgcagtaaagaaattaaccttctcaaaaaaagcagttggtgccactgcttttaattcccaagaaggagaacctggaattgattgttgggcttgtgaaggaagggaaacttaaaacagtgatcgactcgaaatttcctctgagcaatgctgaagatgcttggagcaggagtattgatggacatgcgaccggaaagattgttgtggagccatagagtagtggtctaaaagatttgtgaggcgtgtgtgcagtttgtcatctggcttgtaacaactatcatttgccttgtatgcttgtgcagtttgtcatctgccttttccctttcataatgctgttcgattttgttgtctttgcattttgacaattattcattttttagactgatgactagtggaaaaccaaaacagttgaattgaaaattgacattttcttagtgatgagtggatttttaatcattactcataacaaaa

SEQ ID NO: 1123 - DNA, 1332 bp, Citrus sinensis
ggggggccacccaaagggaagcgagtacactgtcactgcgttacatacatattataatcgtatgcagagtggtctctttgattctatcgatagcacactcgaaatcccagaaacggcatcgtgtattagctgtgaaaatggcaggaaagcctcttatgcacgcggttcagtataattcttatggtggaggagctgctgatttgaagcatgttgaactgccggttcctaccccaagcaaagatgaggttttgcttaaacttgaagcaactgctctaaatccggttgactggaaaatccagaagggccagttacgcccttttttgcctcgcaagtttccttgcatacctgcaactgatgtagcaggagaggtcgtaggggtaggatcagaagttaaaattttcaaagctggtgacaaagttgtagcttttcttaactacctcgtaactaatggaggtggactagctgagtttgctgtggctaaggagagctcgacagttactaggccaccagaggtttcagcagctgaaggttctggcttacctgttgctggtctcactgctcaccaggcccttactcaatctgcaggtgtcaagcttgatggaagtgggcaacagaaaaacattctagtaactgctgcctcagggggtgtaggtcactatgctgttcagttggcgaagcttggaaacacgcacgtgactgcctcttgtggggctcgcaacattgaatttgtcaagagtttaggggctgatgaggttcttgattacaagacacctgacggggcagctctaaagagtccatctggtcgaaaatacgatgcagtgatccactgtgcaacagggattccctggtctacttttgagcctaatctgggcacaaatgggaaggtgatagatatcactcctggccctagtgcgatgctgacttttgctttgaagaaacttaccttctccaaaaagcagctggtaccactgctgctgattcccaagcgtgagaacctagattttctagttaagttggtgaaggaaggaaagcttaagacagtaatcaactcaaagcatcccctgagcaaggcagaagatgcttgggctgagagtattgatggccatgctacagggaagatcattgtggagccataacttcatatgatttggtttattgttgaagttttatgtcactgaagaatttgtctgtaggacaaagcttatggcaaatgtgctgtttcatcgtgtaatttctttcaaccagatgctgtgattagatcgtttgtgtgtattagacgatatgttgtccaagtgatatgtggatttgggtaaattatttgactcaaaaaaa

SEQ ID NO: 1124 - DNA, 1351 bp, Ipomoea nil
ggggatgcgcttgtcgagtaacacaaaccatacaaaggatcggcgacacgcacaaggctattacataaaatccacttttgcccacaatttcgtcactattcttgctctgcgaaccactcgactttgtgcatctgggaatggcaggaaagcttatgcgcgctttgcagtatgacgggtatggaggcggcgctgctggtttgaagcacattgaagttcctgtgcccactcctaataaaaatgaagtcttgctaaagctagaagcaacaagcataaacccggttgattggaaaattcaaaaagggatgatccgtcctcttcttcctggcaaatttccttacatccccgctactgatgtagcgggagaagtagtggaggttggggctggtgtcaagaatttcaaggtcggtgacaaagttgtggctatgctcagtcatcttactggaggtggatttgcggagtatgctgtagctaaggagagcttaactgccataaggccaccggaggtatcgcctgccgaagctgcaggccttcctgtcgcaggcctaacagctctccaggccctcgttggagctgctggggtgaagctcgacgggagtgggccccagaagaacatactcgtgacagccgcctctggtggtgtgggtcactatgcggttcaactagcaaagctcgggaacgcacacgttaccgctacctgtggggcccgcaacctcgggttcgtgaagagcttaggggcagacgaggttattgactacaagaccccagacggggcagctctcaagagcccttcgttgcaaacatacgacgcggtgatccactgcgccacgggcattccctggtctactttcgagccaaacctgagcaagaaaggcaaggtgatcgacctcacccccggggctagcgccatgtggacgttcgcggtgaagaaactcacgatgtcgaagaagcaattggtgccattgcttctaatccccaagagtgagaacctggagtatcttgttgggttggtgaaggaggggaagctgaagagtgtgattgactctaaacatcctctaagcaaggcagaagaagcttgggctatgagcattgatgggcatgccacagggaaaatcattgtgcagccttaaaaggcttacttacaattgaattcaaagtgttattagcggcgagggaaacccgaaacctgcagtcactatctgaagatgtgcgggcattgggtttctgctacatgttttggctacccgagggtctgcacggggtatagctacatgttttaataatgattggccgaatataaactctaacaacgtgtgcaaatacttgtaagaattgtcgtgaatttaacaaaaga

SEQ ID NO: 1125 - DNA, 1290 bp, Arabidopsis lyrata
tcacaaccattttttatatttgatataccgcttttaccccttaagcctctccgcgtaaaaccgagaacaaatatcttaagcaccgttgttttcgattcagagatcatcgtcgtcgtcgtcgttcaaaaccttcatcaatggccggaaaactcatgcacgctcttcagtacgactcgtacggtggtggcgccgccgctttaaagcatgttcaagttccggttccaacaccgaagagtaatgaggtttgcctgaaattagaagctactagtttaaaccctgttgattggaaaattcagaaaggaatgattcggccttttctgccccgaaagttcccctgcattcctgctactgatgttgctggagaagtcgttgaggttggatcaggagtcaagaatttcaaggctggtgacaaagttgtagcggttcttagccatctaggtggaggtggacttgctgagttcgctgttgcaagcgagaagctgactgtcaaaagacctcaagaagtgggagcagctgaagcagccgctttacctgtggcgggtctaaccgctctccaagctcttactaatcctgcggggttgaagttggatggtacaggcaagaaggcgaacatcctggtcacagcagcatctggtggggttggtcactatgcagtccagctggcaaaacttgcgaatgctcatgtaaccgctacatgtggtgcccggaatatagactttgtcaaatcgttgggagcggatgaggttctcgactacaagactccggagggagctaccctcaagagtccgtcaggtaagaaatatgacgctgtggtccattgtgcaaacgggattccattttcaacatttgaaccaaatctgtcggaaaacgggaaggtgatagatatcacaccggggcctagtgccatgtggacttatgcggttaagaaagtaaccatgtcaaagaagcaattggtgccgctcttgttgatcccaaaagctgagaatttggagtttatggtcaatctattgaaagaaggaaaagtgaagactgtgattgactcgaagcaccctctgagcaaagcggaagatgcttgggccaaaagtatcgatggtcatgctactgggaagatcattgtcgagccataagagcgttttttgccatctttgactgtctgtgataatagacgttaaaaagtttgttttccgtttacacattgctttatgttgttttctttaatatacccgagtatgtcgaaatttgtatgacaagaaaatttggtatagataatacttgttaggtatttttgtt

SEQ ID NO: 1126 - DNA, 1223 bp, Mimulus guttatus
gattctatatatatatatattttttgtttttggtatctctgcaatctcggaaattagaggatttcgtgaattgggtatggcgggcaggcttatgcatgcggttcagtacgaaggttacggcggtggtgctgcaggtttgaagcatgttgaagttccggttcctacacctagtaagggtgaagtgttgttgaaattggaagccgcgagcataaatcctattgattggaagattcagaaaggaatgcttcgccctcttcttccgcgcaagttgccttgtataccaactactgacgtggctggagaggtagtagaaatcggatctggagtcaaaaacttcaaacctggtgataaagttgttgctatgctgagtgctcttacaggtggcggtttctccgaatacggagtggccaatgaaaacctaactgttcctaggccacccgaagtatcagccgccgaaggcgcaagccttccagtcgcagcgctcaccgcccacatggcactaacccaatccattggtctcaagctcgacaaaagcgggccccacaaaaacatcctcgtcacagcagcttcgggtggggtcggtcactacgccgtccagctggcgaagctcggaaacgcccacgtaactgccacctgtggggcccgcaacattgactttgtgaaaagcctcggggcggacgaggttcttgactataatacccccgaaggagccgcccttacgagtccgtcgggaaagaaatacgacggtgtggttcactgtgcaccggctattccttggtcggttttcgagccgaatttggggtcgagtgggaaggtggttgatatcacgccgggccccagtgccatgtggacttttgcggtgaagaaactgacgttttcgaagaagcgtttggtgcctttgcttctgatcccgaagggggagaatttgcagtatgttgttgatttggtgaaggaaggtaagttgaagagtgtggttgattctaaatttcctttgagtaaagctgaagaggcttgggctaagagtatcgatggacatgctaccggtaagattatcgtggagccgtaagtgatttttttttaataaaataaatattcgaaaggatgtaatatgtggctgatttggttcttgatgttgtattttgtttgttgattggccgtttatggttttgcgtgtgtttgtcttaacttttatataatagcaatattttgatttgcttgatggt

SEQ ID NO: 1127 - DNA, 1351 bp, Ipomoea nil
  misc_feature (787)..(787): n is a, c, g, or t
ggggatgcgcttgtcgagtaacacaaaccatacaaaggatcggcgacacgcacaaggctattacataaaatccacttttgcccacaatttcgtcactattcttgctctgcgaaccactcgactttgtgcatctgggaatggcaggaaagcttatgcgcgctttgcagtatgacgggtatggaggcggcgctgctggtttgaagcacattgaagttcctgtgcccactcctaataaaaatgaagtcttgctaaagctagaagcaacaagcataaacccggttgattggaaaattcaaaaagggatgatccgtcctcttcttcctggcaaatttccttacatccccgctactgatgtagcgggagaagtagtggaggttggggctggtgtcaagaatttcaaggtcggtgacaaagttgtggctatgctcagtcatcttactggaggtggatttgcggagtatgctgtagctaaggagagcttaactgccataaggccaccggaggtatcgcctgccgaagctgcaggccttcctgtcgcaggcctaacagctctccaggccctcgttggagctgctggggtgaagctcgacgggagtgggccccagaagaacatactcgtgacagccgcctctggtggtgtgggtcactatgcggttcaactagcaaagctcgggaacgcacacgttaccgctacctgtggggcccgcaacctcgggttcgtgaagagcttaggggcagacgaggttattgactacaagaccccagacggggcagctctcaagagccnttcgttgcaaacatacgacgcggtgatccactgcgccacgggcattccctggtctactttcgagccaaacctgagcaagaaaggcaaggtgatcgacctcacccccggggctagcgccatgtggacgttcgcggtgaagaaactcacgatgtcgaagaagcaattggtgccattgcttctaatccccaagagtgagaacctggagtatcttgttgggttggtgaaggaggggaagctgaagagtgtgattgactctaaacatcctctaagcaaggcagaagaagcttgggctatgagcattgatgggcatgccacagggaaaatcattgtgcagccttaaaaggcttacttacaattgaattcaaagtgttattagcggcgagggaaacccgaaacctgcagtcactatctgaagatgtgcgggcattgggtttctgctacatgttttggctacccgagggtctgcacggggtatagctacatgttttaataatgattggccgaatataaactctaacaacgtgtgcaaatacttgtaagaattgtcgtgaatttaacaaaaga

SEQ ID NO: 1128 - DNA, 1264 bp, Brassica napus
ggtaaaggttccagatcctcccttcaactttatttatctctgcaagaagaaaactatactgttcgatttagagatccccttcgtttaacaatggccgaaaaactcatgcacgctcttcaatacgagtcttacggcggtggcgccgccgctttgaagcatgttcaagttccggttccatcgcctaaggccaacgaggttttgctgaaattagaagctactagtctaaaccctgttgattggaaaattcaaaaaggaatgattaggccttttctgcctcgcaagttcccctgcattcctgctacggatgttgctggtgaggtcttagaggttggatcaggagtcaagaacttcaaggctggtgacaaagttgtatcagttctcagccatcttaccggaggaggacttgctgaatatgctgttgcaagcgagaaactgacagtcaaaaggcctcaagaggtaggaccagctgaagcagccgctttacctgtggccggcctaaccgctctccaggctctaactaatccggcaggattgaagctggatggtacaggcaagcaggcgaacatcctggtcacggcagcatctggtggtgtcggccactatgcagtccagctagcaaagctagggaacgctcatgtaaccgccacatgtggggctcggaacatagacttcgttaaatcattaggagcggacgaggttcttgactacaagactccagagggagctgctctcaagagtccctctggtaagaaatatgactctgtgattcactgcgcaaatgggataccgttttcgacattcgaaccgaatttgtctgaaaatggaaaggttatagacatcacgccggggcctagcgcaatgtggactttcgccgttaagaaaataaccatgtctaagaagcaattggttccgcttttgttgatcccgaaagctgagaatttggaatttatggtcaacttagtgaaagaagggaaagtcaagactgtgattgactcgaagcatcctctgagcaaagcagaggatgcttgggctaaaagtatcgacggtcatgctactgggaagatcattatcgagccatgaatagcattttgcttgtgccgcgctgtctatgtttctataagcttatagtttgattctcgttttctcattgttttcttttgttttgtgtaatatataatacccaactactaactagatacccgcattttgcgcggggtgagagttaaaaaataataatttatgtgaacatgttagttgacatgtt

SEQ ID NO: 1129 - DNA, 1143 bp, Brassica napus
ggtaaaggttccagatcctcccttcaactttatttatctctgcaagaagaaaactatactgttcgatttagagatccccttcgtttaacaatggccgaaaaactcatgcacgctcttcaatacgagtcttacggcggtggcgccgccgctttgaagcatgttcaagttccggttccatcgcctaaggccaacgaggttttgctgaaattagaagctactagtctaaaccctgttgattggaaaattcaaaaaggaatgattaggccttttctgcctcgcaagttcccctgcattcctgctacggatgttgctggtgaggtcttagaggttggatcaggagtcaagaacttcaaggctggtgacaaagttgtatcagttctcagccatcttaccggaggaggacttgctgaatatgctgttgcaagcgagaaactgacagtcaaaaggcctcaagaggtaggaccagctgaagcagccgctttacctgtggccggcctaaccgctctccaggctctaactaatccggcaggattgaagctggatggtacaggcaagcaggcgaacatcctggtcacggcagcatctggtggtgtcggccactatgcagtccagctagcaaagctagggaacgctcatgtaaccgccacatgtggggctcggaacatagacttcgttaaatcattaggagcggacgaggttcttgactacaagactccagagggagctgctctcaagagtccctctggtaagaaatatgactctgtgattcactgcgcaaatgggataccgttttcgacattcgaaccgaatttgtctgaaaatggaaaggttatagacatcacgccggggcctagcgcaatgtggactttcgcggttaagaaaataaccatgtctaagaagcaattggttccgcttttgttgatcccgaaagctgagaatttggaatttatggtcaacttagtgaaagaagggaaagtcaagactgtgattgactcgaagcatcctctgagcaaagcagaggatgcttgggctaaaagtatcgacggtcatgctactgggaagatcattatcgagccatgaatagcattttgcttgtgccgcgctgtctatgtttctataagcttatagtttgattctcgtttt

SEQ ID NO: 1130 - DNA, 1445 bp, Coffea canephora
cggccgggggacctctaccaatactcgtcctttcccattttctccctttctttctatccctccctctcccgcgatactctccgtaaatctaaacactgaattttgcagagttaggatttgggataatatggctgggaaagttatgcaagcggttcagttcgatggctacggcggtggagctgctgctttgaagcatgttgaacttcctgtccccaccccgaccaaaggtgaggtcctcctcaaattggaagcaacaagtttaaatccagttgattggaaaatacagaaaggcgtgctccgacctatcatgccccgcaagtttccttatgttcctgcaactgatgttgcaggagaggttgtggaagttggacctgaagtaaagaatttgaaagctggtgacaaagttgtggcatttcttaatcctttgtatggtggtggattggctgagtttgctgttgccaaggagagcttgactgttcaaaggccacctgaagtatctgccgccgaaggtgcatcccttcctgttgctgctcttacagcccatcaggcccttacccaaccagctggggttaatcttgatggtagtgggccgcaaaagaacattcttgttacggctgcctctggtggggttggtcattatgccgttcaactggcaaaactcggaaacacacatgtcacagccacctgtggagctcggaacatcgactttgtgaagagcttgggggcagatgaggttattgattacaagactccagagggagccgctcttaagagtccatctggaaaaatgtatgatgcggtgattcattgtgcatcaggcatcccctggtcgacttttgagccaaatctgagtgccagggggaaagttattgatctcactccaggcccaagcgccctctggacctttgctgtaaagaaattgaccctagctaagaagcaattggtgcctttattggcggtacccaaaagcgagaacctggattttcttgttaacttggttaaagaagggaaactgaagtcagtaattgactcgaagcatcctctgagcagggctgaagatgcttgggcgaagagtatggacgggcatgctactgggaagatcgtagtggagccctaaacgacgaacatcgagttcatttggctgtgttgatataattagaaggggaagtctgcgcatgaagcatgtgaacaagtttagttctactttttttttccttaaatgtaagtgggaggactcgaaccgggacttctcacttacgctcccttctttgaactacccaacccatctctcctctcccccaaagcatgtgaagaagttgcacgtgtatgtgctttgtgcttgaaaaagagtagtgtaaatgatgtgtcaattgtgaagcttctaacttttttcgtttgaatcagttagtgttaccatgttcattgttgggcccaaaaaaaaaaaa

SEQ ID NO: 1131 - DNA, 1255 bp, Raphanus sativus
  misc_feature (210)..(210): n is a, c, g, or t
  misc_feature (267)..(267): n is a, c, g, or t
gggtttgtaaaggttccagatcctcccttcaactttatctctaaaactatatttgttcgattcagagatcgccgtcgtttaacaatggctggaaaactcatgcacgctcttcaatacgagtcttacggcggtggtgtcgccgctttgaagcatgttcaagttccggttccatcgccaaaggacaacgaggttttgctgaaactagaagcnactagtataaaccctgttgattggaaaattcaaaaaggaatgattcggccttttctncctcgcaagttcccctgcattcctgctactgatgttgctggtgaggtcatggaggttggatcaggagtcaagaatttcaaggctggtgacaaagttgtatcagttctcagccatcttaccggaggcggatttgctgaatacgctgttgcgagcgagaaacttacagtcaaaaggcctcaagaagtaggaccagctgaagcagccgctttacctgtggcgggcctaaccgctctccaggctctaactaatccggctggattgaagctggatggtacaggcaagcaggcgaacatcctggtcacagcagcatccggtggtgtcggccactatgcagtccagctagcaaagctaggtaacgctcatgtaacggccacatgtggggctcggaacatagacttcgtcaaatcattaggagcggacgaggttcttgactacaagactccagagggagctgcgctcaagagtccgtctggtaagaaatacgacgctgtggttcactgcgcaaatgggataccattttcgacattcgaaccgaatctgtctgaaaacggaaaggtgatagacatcacgccggggcctaaggcgatgtggactttcgcggttaagaaaataaccatgtctaagaagcaattgattccgcttttgttgatcccgaaagctgagaatttggaatttatggtcaacttagtgaaagaagggaaagtcaagactgtgattgactcgaagtatcctctgagcaaagcagaggatgcttgggctaaaagtatcgacggtcatgctactgggaagatcattgtcgagccatgaatagcattttgcttgtgatctacatttctgtaatcttatagtttgattctcgttttctcattactttcgtttcttttgtttaatacaatacccaaactatgtcactagtaataaaaacaaaacataaacatgaatgcagtagtgagttcttgttctcccacgtttgagatggtttcatcag

SEQ ID NO: 1132 - DNA, 780 bp, Solanum phureja
gagcaattattacttcatgaataggagccacattccagcatttggtagctgggactgtaacaatgatttcccaattcctttcactcagtgctttgaatctgctagacaagctgggttgctcagatacagctactctgatgaccgtgatttgtatgtcgccggagatctataccagaatgatatcctcactccagccatgatcgtcgtccctcgtcgtaagagaaaatcaagtattactaatgaaggtgttggaaaagcaaggaaggaggggtgggtggtgtgcaattgtgaatatgatgaagagaaaaaagacacaagcactgttccaccatctccacctccacctaaaagagcacccaaagcagtagatgaagatctctacaagatttcccctcaattgctccactccaagcctacaaggaaaggtgttaggggattcttttcgagctgcttgctgccaacttgtgcttcttgatcctcaaataagagaagattgacaacatatataggactagtagtgtcgtattaatagttggtttgtgtctatattagaacttattaatttagtgtttggagtattttcttgggtttttagcagtaaattggctttataaacagagattttggccagcccaagaaaaacaaatatccatcattagcttatgatggtgaaaattaagagaattctttctctactctattgctagtatgttcccctttggaagtatttgtgtgtcaacttctctactagctaatgcacttctgttttgcttctttaaa

SEQ ID NO: 1133 - DNA, 2180 bp, Brachypodium distachyon
atggcgacctcgccggcggcgggcgcagcgatcctcggcacgctgaacgacttcacgtcgcagaagaattgggacaagttcttcgccatccgcggcgtcggcgacagcttcgagtggtacgctgagtggccgcaaatccaggccccgctcctgtcgctccttctcgaggaggagggggcggatatcctggtacctggatgtgggagctcggcgctctcggagcagctctacgacctagggttccgccgcatcaccaacgtcgacttctcccgcgttatcgtggccgacatgctccgtcgacacgcccgcgtgcgccccgagatgcggtggcgcgtcatggacatgactaacatgcagtttccagatgagtcatttgatttcatacttgataagggaggattggatgctcttatggagccagaggttggcatggaactggggatgaagtatctaaatgaggccaagagggttttgaaatctggtgggaagtttgtgtgctttactctagcagaatcccatgttttagccctacttttttctgagttcaggtttggatgggatatgagtattcaagctatagctggcgagccctcgaataagtctgccttccagaccttcatggtggtcatggcaaaagggaagatgggtgttgtacacacaataaaatcactactggatcagtctgcaaaatattgtaacatggcacaggcaaaggttgtaattcatgctctgcaaaatgagaatagaatccgggagtcacacacttctggtggtgatatacttttctcactgcaagatcttcagctaggagctattggagatctgaatgttattgtcccaggacggaggaggcacttaattctcggtgaacagggaagttcactgtattgctacaaggctgttttgctggattcgaagaatcaaacaggagcatttgtataccattgcggagtttttattgtgcctaaggcccgagctcaggaatggttatttgcttcagaggaagggcagtggcatgttgttgaaagtgcaaaagctgctcgtctaatcatggtatttttggatagaagacacatggattctgacattgatgttattaagaaggatttatctcctcttgttaaggatctagaacctgaatatcctgaagaggcagaccctataccgttcatgatggctagcgatggtgtcaagcaaagagatattctgcatgaggtaacatcagaaataactggtcctatggttgtggaagatgttgtttatgaaagtgttgatggagaccaaagttgcatgtctgaaaaaatgttccggcgacttgtctttaaaagaagttctggcttggtgcaatctgaagcattgttaatcagagaatcccccagtgatgagacagataataagaacaaaaaatcatctacagcatcaaaaaagaaaaggagccacaaaaaaggtctcactggatccaagagcagtctgaggatcgatcacagctatcttggtagctcttatcacagtagtatcatatgcgggctttctttaattgcatctgctctgagtaatgctgcttcatctggagaaaaagtcagcaccaccattgtaggtcttggtgcagggtgtttaccaatgtttcttcgtggatgtctcccttatttagatattgaggttgttgagttggaccccataatagaagaggtagcaaagaaatattttggcttttcaatggatgagcaattgaaggtgcatttgggggatggaatcagattcatagaagaaaaggccattctgtaccaaatggcaaagacagcaatgcagttagaattcttattgttgatgttgattcatctgacctaagttctgggttgtcttgcccaccagcaaactttgtggaagatcatttccttacgtcagcaaaaaagttcctttcagctgggggcctatttgtcatcaatttagtcgttcggtcatctacagtcagggaaatggtcgtttcacgactgaaagcggtctttgagcacctgtactcacttcaactggaagaagacgtgaatgaagttctgtttgcgtcctcgagtgaaagatatttggagatcgatcacctggatggggctgcaaccaaactgaaggctatgctgaaattccctgtggacttagaatcggatatacagaatttgcagaagctgcag

SEQ ID NO: 1134 - DNA, 2489 bp, Brachypodium distachyon
gaggacgtcccaaacccaaccccaaaccactgttctgacatccattttctaaaccctgctaggttagggtttgacacctcaacctgccatcccatggcgacctcgccggcggcgggcgcagcgatcctcggcacgctgaacgacttcacgtcgcagaagaattgggacaagttcttcgccatccgcggcgtcggcgacagcttcgagtggtacgctgagtggccgcaaatccaggccccgctcctgtcgctccttctcgaggaggagggggcggatatcctggtacctggatgtgggagctcggcgctctcggagcagctctacgacctagggttccgccgcatcaccaacgtcgacttctcccgcgttatcgtggccgacatgctccgtcgacacgcccgcgtgcgccccgagatgcggtggcgcgtcatggacatgactaacatgcagtttccagatgagtcatttgatttcatacttgataagggaggattggatgctcttatggagccagaggttggcatggaactggggatgaagtatctaaatgaggccaagagggttttgaaatctggtgggaagtttgtgtgctttactctagcagaatcccatgttttagccctacttttttctgagttcaggtttggatgggatatgagtattcaagctatagctggcgagccctcgaataagtctgccttccagaccttcatggtggtcatggcaaaagggaagatgggtgttgtacacacaataaaatcactactggatcagtctgcaaaatattgtaacatggcacaggcaaaggttgtaattcatgctctgcaaaatgagaatagaatccgggagtcacacacttctggtggtgatatacttttctcactgcaagatcttcagctaggagctattggagatctgaatgttattgtcccaggacggaggaggcacttaattctcggtgaacagggaagttcactgtattgctacaaggctgttttgctggattcgaagaatcaaacaggagcatttgtataccattgcggagtttttattgtgcctaaggcccgagctcaggaatggttatttgcttcagaggaagggcagtggcatgttgttgaaagtgcaaaagctgctcgtctaatcatggtatttttggatagaagacacatggattctgacattgatgttattaagaaggatttatctcctcttgttaaggatctagaacctgaatatcctgaagaggcagaccctataccgttcatgatggctagcgatggtgtcaagcaaagagatattctgcatgaggtaacatcagaaataactggtcctatggttgtggaagatgttgtttatgaaagtgttgatggagaccaaagttgcatgtctgaaaaaatgttccggcgacttgtctttaaaagaagttctggcttggtgcaatctgaagcattgttaatcagagaatcccccagtgatgagacagataataagaacaaaaaatcatctacagcatcaaaaaagaaaaggagccacaaaaaaggtctcactggatccaagagcagtctgaggatcgatcacagctatcttggtagctcttatcacagtagtatcatatgcgggctttctttaattgcatctgctctgagtaatgctgcttcatctggagaaaaagtcagcaccaccattgtaggtcttggtgcagggtgtttaccaatgtttcttcgtggatgtctcccttatttagatattgaggttgttgagttggaccccataatagaagaggtagcaaagaaatattttggcttttcaatggatgagcaattgaaggtgcatttgggggatggaatcagattcatagaagaaaaggctgttccagaccatagtgctctaacccattctgtaccaaatggcaaagacagcaatgcagttagaattcttattgttgatgttgattcatctgacctaagttctgggttgtcttgcccaccagcaaactttgtggaagatcatttccttacgtcagcaaaaaagttcctttcagctgggggcctatttgtcatcaatttagtcgttcggtcatctacagtcagggaaatggtcgtttcacgactgaaagcggtctttgagcacctgtactcacttcaactggaagaagacgtgaatgaagttctgtttgcgtcctcgagtgaaagatatttggagatcgatcacctggatggggctgcaaccaaactgaaggctatgctgaaattccctgtggacttagaatcggatatacagaatttgcagaagctgcagtagcgtaggcgtgtgttgttgaaagcaccatccatttgtactaggcatagtcggtaaacgggtgttgtttttatttgcaacaaaaggtaggactaaaaaggaggtatagatccattttttacgttgtattttgttgccaaaattggtaatagtaaagcaatgtgcaatctgcgggaacgtacttcttactg

SEQ ID NO: 1135 - DNA, 2193 bp, Hordeum vulgare
ggctgcagggacgagctcggcgcgctctggcacgacggatccgacgacctcagcttcggcggtggcggtggcggcggcggctactcccactcgccctcgccgctcaagtggcgcgacatccaccaccaccaccacagcccggtctcggtcttccaggggccctcgtcctcgccggcttcccggagcccgtcgtcggcctcctggctcaccggccgcgagcgcgaccgcctcttctccggcttcgtgcgcaacgcgctcggctcctgcatcgactacgtcccggccaccagcccgcggcccgaggtcggcggcggcgagctcgcgttcgagctcgacgagaacctcgcgggggcgagccccgcctgcgagccctacgcccaggagctcctcgccggtgctcaggctcgccaccgcatcttccacgaggaactcgtggtgaaggctttcttcgaggccgagaaggctcaccatggccagacgagggcgagcggcgatccattcttgcaacattgcgtggagacggccgtgctgctggcaaagatcggagcgagcgccacggtcgtctctgctgggcttctgcacgacaccattgatgattcgttcgtggattacgatcacatcttccacatgttcggtgctggcgtggctgatctcgtggaaggggtttcgaagctgagccacttgagcaagcttgctcgtgataacaacacggcaagcagaactgctgaagcagatcgcttgcatacaatgctccttgcaatggccgatgcacgggctgttctaataaagctagcagatcgtgtgcataacatgaggaccttagaagccttgcctttggtcaaacaacaaagatttgcgaaggagaccatggagatctttgtgcctttggccaatcgattggggattgctagctggaaagaccagctggaaaatctttgcttcaagcacttgaacccggaagagcacaaggagctgtcatcaaaattcgcagaaacctttgatgaggcactaatcacatctgctgtggatacactggatgaaggtctgagggaagcaggcatctcatatcacaatctttctggaaggaacaaaaacctttacagtgtttactccaagatgcagaagaagaatttgacaatggatgaagtccatgatatccatggcctgcgccttgtggttgacaaggaggaagattgctaccgagcactcgatgttgtccataaactctggccccaagttgatggaagattcaaggactacatatcgcggccaaaattaaatgggtaccgttcgttgcacactgttgtcatgagcgacggtgatcacacattcgaagtccagatccgcacaaaggagatgcatctacaggccgagtatgggttcgctgcgcactggaggtacaaggaaggctcgtgcaggcactccttcgtgcttcagatggtggaatgggcaagatgggtgcttacatggcaatgcgaagcattgaacaaggaacattcatcgtcccaagtaaaaagcgatgcgatcaaaccaccttgcccgtttcccctgcattcggaggaatgcccttactcgtacacccgccaatgcaaccacgagggacccttgttcgtcatcttacttgaacatgacaagatgtcggtccaagaattcccggcaggctcgacggtaatggacctgatgcaccgcgttggggccaacagcccgaggtggagcccctacagcatacccatgaaggaggacctgcggccgaaggtgaaccacgagcccataagcgacacgggaagggcgctgaacatgggggacgttgtggagctcaccccggccctccccgacaagtcgctgaccgagtaccgtgaggagatccagcgcatgtacgaccgcggtggcttcgccctcgccgccacccgcagcagcggcggcggcggctcaagacggtgatgcactcaccgcaatgttaacaaacaaaacctgttgtaccactgttgtacgatgatgaagtcccaacccattcaattcgttgtaaatacatacagactacatagcctaattcttggcggcccatgatgaggcgctgtaggaaccacccccggatgcaagaggggagccttggctgcaaaatgtgtacactagcggagcagaacgatgtgtataatatgacaagagccgttcaagtttgattcggcttctgct

SEQ ID NO: 1136 - DNA, 2284 bp, Hordeum vulgare
ggctgcagggacgagctcggcgcgctctggcacgacggatccgacgacctcagcttcggcggtggcggtggcggcggcggctactcccactcgccctcgccgctcaagtggcgcgacatccaccaccaccaccacagcccggtctcggtcttccaggggccctcgtcctcgccggcttcccggagcccgtcgtcggcctcctggctcaccggccgcgagcgcgaccgcctcttctccggcttcgtgcgcaacgcgctcggctcctgcatcgactacgtcccggccaccagcccgcggcccgaggtcggcggcggcgagctcgcgttcgagctcgacgagaacctcgcgggggcgagccccgcctgcgagccctacgcccaggagctcctcgccggtgctcaggctcgccaccgcatcttccacgaggaactcgtggtgaaggctttcttcgaggccgagaaggctcaccatggccagacgagggcgagcggcgatccattcttgcaacattgcgtggagacggccgtgctgctggcaaagatcggagcgagcgccacggtcgtctctgctgggcttctgcacgacaccattgatgattcgttcgtggattacgatcacatcttccacatgttcggtgctggcgtggctgatctcgtggaaggggtttcgaagctgagccacttgagcaagcttgctcgtgataacaacacggcaagcagaactgctgaagcagatcgcttgcatacaatgctccttgcaatggccgatgcacgggctgttctaataaagctagcagatcgtgtgcataacatgaggaccttagaagccttgcctttggtcaaacaacaaagatttgcgaaggagaccatggagatctttgtgcctttggccaatcgattggggattgctagctggaaagaccagctggaaaatctttgcttcaagcacttgaacccggaagagcacaaggagctgtcatcaaaattcgcagaaacctttgatgaggcactaatcacatctgctgtggatacactggatgaaggtctgagggaagcaggcatctcatatcacaatctttctggaaggaacaaaaacctttacagtgtttactccaagatgcagaagaagaatttgacaatggatgaagtccatgatatccatggcctgcgccttgtggttgacaaggaggaagattgctaccgagcactcgatgttgtccataaactctggccccaagttgatggaagattcaaggactacatatcgctgccaaaattaaatgggtaccgttcgttgcacactgttgtcatgagcgacggtgatcacacattcgaagtccagatccgcacaaaggagatgcatctacaggccgagtatgggttcgctgcgcactggaggtacaaggaaggctcgtgcaggcactccttcgtgcttcagatggtggaatgggcaagatgggtgcttacatggcaatgcgaagcattgaacaaggaacattcatcgtcccaagtaaaaagcgatgcgatcaaaccaccttgcccgtttcccctgcattcggaggaatgcccttactcgtacacccgccaatgcaaccacgagggacccttgttcgtcatcttacttgaacatgacaagatgtcggtccaagaattcccggcaggctcgacggtaatggacctgatgcaccgcgttggggccaacagcccgaggtggagcccctacagcatacccatgaaggaggacctgcggccgaaggtgaaccacgagcccataagcgacacgggaagggcgctgaacatgggggacgttgtggagctcaccccggccctccccgacaagtcgctgaccgagtaccgtgaggagatccagcgcatgtacgaccgcggtggcttcgccctcgccgccacccgcagcagcggcggcggcggctcaagacggtgatgcactcaccgcaatgttaacaaacaaaacctgttgtaccactgttgtacgatgatgaagtcccaacccattcaattcgttgtaaatacatacagactacatagcctaattcttggcggcccatgatgaggcgctgtaggaaccacccccggatgcaagaggggagccttggctgcaaaatgtgtacactagcggagcagaacgatgtgtataatatgacaagagccgttcaagtttgattcggcttctgcttctgctcgccaggatctgtggagaggaggggcttgggcttgggcttgggcttgtgacagtgtcttcatctgtatcattgcgatgaaaagat

SEQ ID NO: 1137 - DNA, 2888 bp, Brachypodium distachyon
cgaacacggcagaagaagcaacccagaataaacacgagacggcaaagcggtttccccaattcgctcttcttgcttgttcatcgaaggataggcctcaattttggcttccaatcgttcttctgcagcctcgatttcccccaatctgagccgtgtccaccgctgaagtagtttagttattcaatttatttgtttattggcccccaaattcgtcgactccacctcgcgagatcaaattcgtacatcaaattcgtgttccgccgcgccccttcgaactccggtgccggctcgaggtttccgctcccaacagctatccaattttgtcggtaggtaagaagaggttgtgagttcgggcgtttagagctcgtcggtggcgtctcggatcctggcgaccatgtctttgtcggcgatttccctgtacaccagcccgccgggcgcggtctactcttccgagtttgatccgagctgccgtggctcgtcgccgtgcaccaccgcgacgcccccgccgccgggaacctcccaccgcccgtctgccgtcgccggcggcctgtcctgcctcttctcctccccggccgcagcggctgcgccgccccgtgccccggcgcacgacgagctcggcgcgctgtggcacgacggatccgacgacctgagcttcggtggcagctactcccactcgtcctcgccgctcaagcggcgtgaccttcaccaccaccaccaccacagccccgtgtcggtgttccaggggccgtcgtcctctccggcgtcccggagcccgccggcctcttggctcaccggccgcgagcgcgagcgccttttctctggctttgtgcgcaacgcgctgggctcctgcatcgactatgtccccgccaccagtccgcggcctgagctaggtggcggcgagctcgcgttcgagctcgacgaaaacctcccggaggcgagccccgcctgcgagccctacgcccgcgagctcctcgccggtgcccaggctcgccaccgcatctttcatgaggaactcgtcgtgagggccttcttcgaggccgagaaggctcaccacggtcagacgcgggcgagcggtgatccattcttgcaacattgcgtggagacggccgtgctactggccaagatcggggcgaactcgacggtcgtctctgctgggcttctgcacgacaccattgatgattcattcgtggactatgatcacatcttccacatgttcggggctggtgtggcggatctcgtggaaggggtttcaaagttgagccacttaagcaagcttgctcgtgataacaacacagcaagcagaactgctgaagcagatcgcttgcatacaatgcttcttgcaatggccgatgcgcgggctgtgctaataaagctagcggatcgtgtgcataacatgaagactttagaagctttgcctttggtcaaacaacaacgatttgctaaggagactatggagatctttgtgcctttggccaatcgattggggattgctagctggaaggaccaactagaaaatctttgcttcaagcatttgaatccagaggagtacacggagttgtcatcaaaacttacagaaacctttgatgaagcgctaatcacgtctgctgtggatacactagatgaaggtttgagggaggcaggagtctcatatcgcaatctttctggaagacacaaaaacctctacagtgtttactccaagatgctgaagaagaatttaacaatggatgaagtccatgacattcatggcctgcgtcttgtggttgacaaggaggaagactgctaccaagcacttgaggttgttcataaactctggccccaagttactggaagatttaaagactacatatcacgtccaaagttaaatgggtatcgttcattgcacactgttgtcttgagtgaaggcgttcacccttttgaagtccagatccgcacaaaggagatgcatctacaggctgagtatggatttgctgcacattggaggtacaaggaaggttcgtgccggcactcctttgtacttcagatggtggaatgggcaagatgggtgcttacgtggcaatgtgaagcaatgaacaaggaacattcgtcgtgtcaagtaaacagcgatgcgatcaggccgccctgcccatttccgttgcattctgaggagtgcgcttactcatacacccgccaatgcaaccacgaaggacccttatttgttattttactcgaacatgacaagatgtctgtgcaagaattcccagcgggctcaactgtaatggatctcatggaccgagtgggcgccaacagtccaagatggagcccctacagcgtgcccatgaaagaagaccttcgaccgaaggtcaatcacgagcctataagcaatctgagaaggcctctcggcatgggggatgtggtggagctgacaccggcccttcctgacaagtcgctgaccgagtaccgggaagagattcagcgcatgtacgactgcggtggcttcgcccttgccgccactcggggcagccgtggaggatcaagacgctgacggtactcaccacgaaatttaacaacccgtttgtacgactattgtaaaatgctgttgttcaacccattcgattcattgtatatacatacgtacgtagtctaattcttggcagccatgagagctgtaggaagaacaccagccccagctgcagaggctgcaatgtgtgctagctgtctagctgttgctaccagaacaatgtacaaaagccgttacaaatttgattcggcttctccccgaatctgtggggaggaggaaactgttgacaggatctactcatctactccccttgtcctcttgtaaaattgtaccgagagaaagatcttgtgacggaatgccatgccaggtgtgcggtttgagaacctgcaacctg

SEQ ID NO: 1138 - DNA, 1460 bp, Brachypodium distachyon
agacgcgggcgagcggtgatccattcttgcaacattgcgtggagacggccgtgctactggccaagatcggggcgaactcgacggtcgtctctgctgggcttctgcacgacaccattgatgattcattcgtggactatgatcacatcttccacatgttcggggctggtgtggcggatctcgtggaaggggtttcaaagttgagccacttaagcaagcttgctcgtgataacaacacagcaagcagaactgctgaagcagatcgcttgcatacaatgcttcttgcaatggccgatgcgcgggctgtgctaataaagctagcggatcgtgtgcataacatgaagactttagaagctttgcctttggtcaaacaacaacgatttgctaaggagactatggagatctttgtgcctttggccaatcgattggggattgctagctggaaggaccaactagaaaatctttgcttcaagcatttgaatccagaggagtacacggagttgtcatcaaaacttacagaaacctttgatgaagcgctaatcacgtctgctgtggatacactagatgaaggtttgagggaggcaggagtctcatatcgcaatctttctggaagacacaaaaacctctacagtgtttactccaagatgctgaagaagaatttaacaatggatgaagtccatgacattcatggcctgcgtcttgtggttgacaaggaggaagactgctaccaagcacttgaggttgttcataaactctggccccaagttactggaagatttaaagactacatatcacgtccaaagttaaatgggtatcgttcattgcacactgttgtcttgagtgaaggcgttcacccttttgaagtccagatccgcacaaaggagatgcatctacaggctgagtatggatttgctgcacattggaggtacaaggaaggttcgtgccggcactcctttgtacttcagatggtggaatgggcaagatgggtgcttacgtggcaatgtgaagcaatgaacaaggaacattcgtcgtgtcaagtaaacagcgatgcgatcaggccgccctgcccatttccgttgcattctgaggagtgcgcttactcatacacccgccaatgcaaccacgaaggacccttatttgttattttactcgaacatgacaagatgtctgtgcaagaattcccagcgggctcaactgtaatggatctcatggaccgagtgggcgccaacagtccaagatggagcccctacagcgtgcccatgaaagaagaccttcgaccgaaggtcaatcacgagcctataagcaatctgagaaggcctctcggcatgggggatgtggtggagctgacaccggcccttcctgacaagtcgctgaccgagtaccgggaagagattcagcgcatgtacgactgcggtggcttcgcccttgccgccactcggggcagccgtggaggatcaagacgc

SEQ ID NO: 1139 - DNA, 2796 bp, Oryza sativa
acaaaaatccacaccgcaaacgcagcagtagaagcaaccccacacgctcacaagtcacaagagcgaagaagatttccccaatttctttcttacccttgccgttgctcgtcccgcgagaggcagcatccaaatccgccgaatttaatcgcgccaagaccgaattttggccatttttcattcaatttttggtccaggaaccccgaatgcgccgagttcacctcgccaagacatcaaattcgtgatttttttttttttagtttgcgagttcgcgtgtttcgagctcgtcggagggatctcggggtcaggcggccatgtcgttgccggcgatttccctgtacaccagcccaccaccgggcgccgtctactcgtcggagttcgatccgagctcccgcggctcgtcgccgccctgctccaccgcgccgccgtccacctctcaccgcccgcccgccgccgcgggcgggctgtcctgcctcttctcctccccggccgcggcggcctcgccgcctcgtgccccgccgcacgacgagctcggtgcgctgtggcaagatagatccgacgagcccgccttcgccggcggcggcggcggctactcgtcctcgccgctcaagtggcgtgacctccaccaccaccatcaccacagccccgtgtcggtgttccagggcccgtcgtcctctccggcggcctcccgcagcccgccggcgtcgtggctcgccggccgcgaccgcgaccgcgagcgcctcttcgccggcttcgtgcgcaacgcgctgggctcctgcgttgactacgccccggcactcagcccgcggtcggaggtcggcggcggcgagctcgcgttcgagctcgacgagaacctcgcggaggcgagccccgcctgcgagccgtgcgcccgggagctcctcgccggcgcccaggctcgccaccgcatcttccacgaggagctcgtcgtgaagaccttcttcgaggccgagaaggctcaccgtggccagctacacaatctttagctattggttcttggaacacttgaattgcttctgcatcagtctcttatcttccgggcgagtggcgatccatacttgcaacattgtgtagagacagccgtgcttctggccaatattggggcgaattcgacggtcgtctccgccgggcttctgcacgacaccattgacgattcattcattgattatgatcacatctttcacatgttcggagccggcgtggccgatctcgttgagggggtctcaaagttgagccacttgagcaaacttgctcgtgataacaacacagcaagcaggattgttgaagcagatcgattgcacacaatgcttcttgcaatggctgatgcacgggcagttctaataaaattagctgaccgtgtgcataacatgaaaactttggaagctttacctcttggtaaacaacaaagatttgctaaggagaccatggagatctttgttcctttggctaatcgattagggattgccagctggaaagaccagttggaaaatctttgcttcaagcatctgaatccagaagagcacaaggatctatcatctaaactaaccaaatcctttgacgaagtgctaatcacatctgctgtggacaaactagatagaggtctgagggatgcaggcctctcatatcacaatctttctgggaggcacaaaagcctatacagtattcacaacaagatgctaaagaagaatttgacaatggatgagatccatgatatccatggcctgcgtctcgtgtttgagaaggaggaagattgctatcgagcacttgatgttgttcatgaactatggccccaagttcctggaagatttaaggactacatatctcgtccaaaattaaatgggtatcgatcattgcacactgttgtcatgagcgagaatgtccacccatttgaagtccagatccgtacaaaagagatgcacctgcaagctgagtatggattcgcagcacactggaggtacaaggaaggcacctgtaggcactcctttgtactccagatggtggaatgggctaggtgggtgcttacatggcaatgtgaagcaatgaacaaagaacgacctgcatctctaggcgacagtgatgcaattaggccaccctgtccatttcccatgcattcagaagactgcccttactcatatactcggcaatgcgaccatgatggaccgatatttgtcatcctactggaacatgacaagatgtctgtgcaagaattccaagcaaactcaactgtaatgaacctcatggatcgagttgggaccaacactccaagatggagtccctaccgcatccccatgaaggaagatctgcgaccgaaggttaaccacgagcccataagcgatctgaaccggaagctcagcatgggggatgtggtggagctgacaccggcccttcctcacgagtcgctccccaattaccgggaggagattcagcgcatgtacgaccgtggcggattcgccctcgccacccggggtggcagctcgaggcggtgacagtacttcgacaatcttaacagccccaccgcatcattgtacaatgttgtccaacctaattcaattcattgtaaatacaaccctaattcttcgcagccgcagaaaccggaacaacacccccaccaagttctgtaagctggggggagtctgttctgctgcctggagtctgttagcttgacccaggaggctgcaatgtgtaaaagtaaaaacagtgtataatcttttccaaggtagttccagcttctcccaggatttgtggagaggaggctgtagcagaatctacaacctgtgtcct

SEQ ID NO: 1140 - DNA, 3860 bp, Sorghum bicolor
aaagttagcaacaacttattgcttgcgccgcaacgcaattacctttcgttcttgaatcttgattggagaatttcgtctagttcttgtccattcttgtctgaattttgcagcaacgacggctcagtttaggggttgctgacctcctgattttaagctgccaagatataaagatcacttattgctggcgccaggatcagttaccagtagaatcatgtcaagaaacctgtggcccgtgctgctgatttcgatctgcttcttgttttgtcctgtgaggatccatggattctcatggaacatcttctcctcctcgtctgcgcccaaggacggcgacggcgctctggtgatggagctcgagggcgcggtggctgacttcgccctggatggaaccaacgaccctagagggctgaagctgctggagaacgcgcggaacaagctcgccgggccgaggaactgctggcaggaggcgtaccggaagctgttcgccagctgcagcgagatcatggccgacaaggagaggcagtcgcgcctggcgtggcacctcagcagctgcttccaagaggactcagggcggccgccattcgcgtcctgcgcagagggatccaagatggtgcactgccgcaagcggctcagcgaatccgaaggcaaggtcttcctcgagttctttttggagaccaacaccctgtgccaccaattgcaggctgaagctttcaagcacaacactgagagacttgtcaatgacctcacaaggtcttccaagttggctgaggagaagctcgaggtgatcgaggaaaggtcggatcaaatcatcaaagagtctagtcaagttaaggacacactgtcatcgatcgagatgcaagccgacaaactgtcagagacgtcaaagcacgtcgatgagcagatcaacgatgtgctgattcactcgaagaccatctttgagcagtccaaggagattgctaccactcagaaagaactgagtaaagggcaaacggagctcagggagaagattgaggccggtatgacgcgcgttgaggaatcatatgaaagactgggaaacgggatggaaaagataaaagaagagaccggacatatgcaaagggaaattaaaagtgttggtgagtctatgtcttccaagatgctggatttgcagaggactgctgatgacattgggagtgttgctagcaagtcagtggagaaccaaaagcagctactgcatggacagactcgcgccatggatggactgaataagctccacagctctcaagcaaaagctcttgaagaaagcagggaaacaattcagaaacttgcacagtttggccagcgtcagcaggaagagctactatcccggcaagaagaaatccggaaagctcatgagcatctcatcctaaattctcactccatactagaagcacaggaagagttcagagcaaagcaggctaacatttttgctgctctggacaagctgtacatcctgcacaatgccattctagccgagtctcgcttcatcaaggccttcttcttctattgctgcattgtgttcctcatctacatgctcaccagcgcaaagcaaacgttcggcatcaggggccagctctactttggtctgtgcattacgcttctgttggagattgggttgataaaaatcggtgccgacgacttcgacaagcagttctgggtcatgtccaaggtgttcttggtccgaatggtgttcctcggcgcttccactgttcagatcctgcactccatatacacctacagggactacgaggtgctgaaccatgggctgctccagacgctggtcgagaaggggccgtcctcctcttcaccctcccggagcccgccggcttcttggctcgccgcccgcgaccgcgaccgcctcttcgctggcttcgtgcgcaacgcgctcggctcctgcgttgactacgcgccgccctccagccctcgcccggaggtcggcgccggcgagctcgcgttcgagctcgacgagaacctcgcggaggctggccctgcctgcgagccgtacgcccgggagctgctcgccagtgcccaggatcgccaccgcatcttccacgaggagctggtcgtgaaggccttcttggaggccgagaaggctcaccgtggccagacacgggcgagtggtgaaccatacttgcaacattgtgtggagactgctgtgctactcgccaagatcggcgcaaatgcaacagttgtctcggctgggcttctgcatgacaccattgatgattcattcattgactatgatcacatcttccatatgtttggtgctggggttgctgatctcgtggaaggggtatccaagttgagccaccttagcaaacttgctcgtgataacaacacagcaagcaggacagttgaagcagatcgcttgcatacgatgcttcttgcaatggcagatgcacgcgctgttctaataaagcttgcagatcgcctgcataacatgaagaccttagaagctttgtctttggtcaaacaacaaagattcgctaaggagacaaaggagatttttgtgcctttagctaaccgactagggattgctagctggaaagaccagctggagaatctttgtttcaagtatttgaatccagaagagtacaaggagttgtcatccaaactgacagaatcctttgatgaagagctaattacatctgctgtgggtaaactagataaaggtctgagggatgctggtgtctcatatcacaatctttctgggaggcacaagagcctatacagtatccattccaagatgctaaagaagaacttgacaatggaggagatccatgatatacatggcctgcgtctcgtggttgacaccgtagaagattgttatgaagccctttgtgtggttcataaattgtggcctcgagttactggtcgattcaaggattacatatcacgtccaaaactaaatgggtatcgatcactgcacactgttgtcatgagtgaaggcgtccacccattcgaagttcagatccgcacaaaggagatgcatcttcaggctgagtatggatttgctgcacactggaggtacaaggaaggcacttgtaggcactcattcgtgctccaaatggtggaatgggcaagatgggtccttacatggcaatgcgaagcgatgaacaaagaacggactgcctccctaggcaatgacgacactgtgaggccaccatgcccgtttcccttgcattcagaggagtgcccttactcgtatacccgccaatgcaaccatgatggaccactatttgtcatcctcctggagcatgacaagatgtctgtccaagaattcccggcaaactcaactgtaatggatctcatggaccgtgtgggcgccaacagctcaagatggagcccctacagcattcccgtgaaggaagatctgcggccgagggtgaaccacgagcccatatgcgacccaaaccggaagctcagcatgggggacgtggtggagctgacgccggcccttcctcgcaagtccctcagcgggtaccgggaagagatccagcgcatgtatgaccgtggtggctttgcgctctcaacccggggtggcggctcgagacgctgctgacagtagtagcaagacgatgttaaccctttttttctaccattgtactaccattcaattcgttgtaaatatatatagcagttaggtcttgcagccgggtgggttctggcgaaatctgttgttggcctgggtgcgtgttgctgcaccctgtcctgaaccccagaggctgggctgcatgcaatgtgtaaaattagaacgctggtgtaaataagctgttcaagttcgtttcagcttctcccaagatttttggagaaagaaagagctgtagctggatctgcaattctgc

SEQ ID NO: 1141 - DNA, 3855 bp, Sorghum bicolor
aaagttagcaacaacttattgcttgcgccgcaacgcaattacctttcgttcttgaatcttgattggagaatttcgtctagttcttgtccattcttgtctgaattttgcagcaacgacggctcagtttaggggttgctgacctcctgattttaagctgccaagatataaagatcacttattgctggcgccaggatcagttaccagtagaatcatgtcaagaaacctgtggcccgtgctgctgatttcgatctgcttcttgttttgtcctgtgaggatccatggattctcatggaacatcttctcctcctcgtctgcgcccaaggacggcgacggcgctctggtgatggagctcgagggcgcggtggctgacttcgccctggatggaaccaacgaccctagagggctgaagctgctggagaacgcgcggaacaagctcgccgggccgaggaactgctggcaggaggcgtaccggaagctgttcgccagctgcagcgagatcatggccgacaaggagaggcagtcgcgcctggcgtggcacctcagcagctgcttccaagaggactcagggcggccgccattcgcgtcctgcgcagagggatccaagatggtgcactgccgcaagcggctcagcgaatccgaaggcaaggtcttcctcgagttctttttggagaccaacaccctgtgccaccaattgcaggctgaagctttcaagcacaacactgagagacttgtcaatgacctcacaaggtcttccaagttggctgaggagaagctcgaggtgatcgaggaaaggtcggatcaaatcatcaaagagtctagtcaagttaaggacacactgtcatcgatcgagatgcaagccgacaaactgtcagagacgtcaaagcacgtcgatgagcagatcaacgatgtgctgattcactcgaagaccatctttgagcagtccaaggagattgctaccactcagaaagaactgagtaaagggcaaacggagctcagggagaagattgaggccggtatgacgcgcgttgaggaatcatatgaaagactgggaaacgggatggaaaagataaaagaagagaccggacatatgcaaagggaaattaaaagtgttggtgagtctatgtcttccaagatgctggatttgcagaggactgctgatgacattgggagtgttgctagcaagtcagtggagaaccaaaagcagctactgcatggacagactcgcgccatggatggactgaataagctccacagctctcaagcaaaagctcttgaagaaagcagggaaacaattcagaaacttgcacagtttggccagcgtcagcaggaagagctactatcccggcaagaagaaatccggaaagctcatgagcatctcatcctaaattctcactccatactagaagcacaggaagagttcagagcaaagcaggctaacatttttgctgctctggacaagctgtacatcctgcacaatgccattctagccgagtctcgcttcatcaaggccttcttcttctattgctgcattgtgttcctcatctacatgctcaccagcgcaaagcaaacgttcggcatcaggggccagctctactttggtctgtgcattacgcttctgttggagattgggttgataaaaatcggtgccgacgacttcgacaagcagttctgggtcatgtccaaggtgttcttggtccgaatggtgttcctcggcgcttccactgttcagatcctgcactccatatacacctacagggactacgaggtgctgaaccatgggctgctccagacgctggtcgagaaggggccgtcctcctcttcaccctcccggagcccgccggcttcttggctcgccgcccgcgaccgcgaccgcctcttcgctggcttcgtgcgcaacgcgctcggctcctgcgttgactacgcgccgccctccagccctcgcccggaggtcggcgccggcgagctcgcgttcgagctcgacgagaacctcgcggaggctggccctgcctgcgagccgtacgcccgggagctgctcgccagtgcccaggatcgccaccgcatcttccacgaggagctggtcgtgaaggccttcttggaggccgagaaggctcaccgtggccagacacgggcgagtggtgaaccatacttgcaacattgtgtggagactgctgtgctactcgccaagatcggcgcaaatgcaacagttgtctcggctgggcttctgcatgacaccattgatgattcattcattgactatgatcacatcttccatatgtttggtgctggggttgctgatctcgtggaaggggtatccaagttgagccaccttagcaaacttgctcgtgataacaacacagcaagcaggacagttgaagcagatcgcttgcatacgatgcttcttgcaatggcagatgcacgcgctgttctaataaagcttgcagatcgcctgcataacatgaagaccttagaagctttgtctttggtcaaacaacaaagattcgctaaggagacaaaggagatttttgtgcctttagctaaccgactagggattgctagctggaaagaccagctggagaatctttgtttcaagtatttgaatccagaagagtacaaggagttgtcatccaaactgacagaatcctttgatgaagagctaattacatctgctgtgggtaaactagataaaggtctgagggatgctggtgtctcatatcacaatctttctgggaggcacaagagcctatacagtatccattccaagatgctaaagaagaacttgacaatggaggagatccatgatatacatggcctgcgtctcgtggttgacaccgtagaagattgttatgaagccctttgtgtggttcataaattgtggcctcgagttactggtcgattcaaggattacatatcacgtccaaaactaaatgggtatcgatcactgcacactgttgtcatgagtgaaggcgtccacccattcgaagttcagatccgcacaaaggagatgcatcttcaggctgagtatggatttgctgcacactggaggtacaaggaaggcacttgtaggcactcattcgtgctccaaatggtggaatgggcaagatgggtccttacatggcaatgcgaagcgatgaacaaagaacggactgcctccctaggcaatgacgacactgtgaggccaccatgcccgtttcccttgcattcagaggagtgcccttactcgtatacccgccaatgcaaccatgatggaccactatttgtcatcctcctggagcatgacaagatgtctgtccaagaattcccggcaaactcaactgtaatggatctcatggaccgtgtgggcgccaacagctcaagatggagcccctacagcattcccgtgaaggaagatctgcggccgagggtgaaccacgagcccatatgcgacccaaaccggaagctcagcatgggggacgtggtggagctgacgccggcccttcctcgcaagtccctcagcgggtaccgggaagagatccagcgcatgtatgaccgtggtggctttgcgctctcaacccggggtggcggctcgagacgctgctgacagtagtagcaagacgatgttaaccctttttttctaccattgtactaccattcaattcgttgtaaatatatatagcagttaggtcttgcagccgggtgggttctggcgaaatctgttgttggcctgggtgcgtgttgctgcaccctgtcctgaaccccagaggctgggctgcatgcaatgtgtaaaattagaacgctggtgtaaataagctgttcaagttcgtttcagcttctcccaagatttttggagaaagaaagagctgtagctggatctgcaat

SEQ ID NO: 1142 - DNA, 2306 bp, Zea mays
atgtcgttgcccgcgatttccatgtacaccagtccgccgggcgcggtctactcttcggagttcgacccagcctcccgtggctcgtcgccttgcaccaccgctgcgcccccgccgccggccgcctcgtaccgcttgccctccggcggcggcggcctgtcttgcctcttctcctcgccggcagctgcggccgcgccgccccgcgccccggctcacgacgacctcggtgcgctgtggcacaacagatccgacgacctgagcgtccccgccgacgggggcgggtactcctactcgcactcccactcgtcttcgcagctaaagcggagggacctgcatcaccaccaccacagccccgtgtcggtgttccaggggccgtccacctcttcaccatcccggagcccaccggcttcttggctcgccgcccgcgaccgcgaccgcctcttcgctggcttcgtgcgcaacgctctcggttcctgcgttgactacgcgccgcccaccagccctcgcccggaggtcggcgccagcgagctcgcgttcgagctcgacgagaacctcgcggaggctagccctgcctgcgagccatacgcccaagagctgctcgcgagtgcccaggatcgccaccgcatcttccacgaggagctggtcgtgaaggccttcttggaggccgagaaggctcaccgtggccagacgcgcgcgagtggtgacccctacttgcaacattgtgtggagacagctgtgctacttgccaagattggcgcaaatgcaacagttgtctctgctgggcttctgcatgacaccattgatgattcattcattgactatgatcacatattccatatttttggtgctggggttgccgatctcgtcgaaggggtatccaagttgagccacctcagcaaacttgctcgtgataacaacacagcaagcaggacggttgaagcggatcgcttgcatacaatgctacttgcaatggcagatgcacgtgccgttctaataaagcttgcagatcgcctgcataacatgaagaccttagaagctttgccttgggtcaaacagcaaagattcgctaaggagacaagggagattttcgtgcctttagctaaccgactagggattgctagctggaaagagcagctggagaatctttgtttcaagtatttgaatccggaagagcacagggagctgtcatccaaacttacagaatccttcgacgaagagctaatcacatctgctgtggataaactggataaaggtctgagggacgctggtgtctcgtaccacaacctttccgggaggcacaagagcgtgtacagtatccactccaagatgctgaagaagaacttggcaatggaggagatccacgatatacatggcctgcgtcttgtggttgacaacgaagaagattgctacgaagccctctgtgtcgtccatagactgtggcctcgagttactggtcggttcaaggactacatatcacgtccaaaactaaatgggtaccggtcgctgcacaccgtcgtcatgggcgaaggtgtccacccgttggaggtccagatccgcacgaaggagatgcacctgcaggccgagtacggattcgccgcgcactggaggtacaaggaaggccgcacctgcaggcactcgttcgtgctccagatggtggaatgggcgaggtgggtcctcacatggcaatgcgaagcgatggacaaagaacggaccgcctcctccctaggcagtggcgacgccgcgagcgcgaggccaccgtgcccgttccccctgcactcagaggactgcccttactcgtatacccgccagtgcaaccacgacggaccgctgttcgtcatcctcctggagcacgacaagatgtctgtccaagaattcccggcagactcaacggtaatggatctcatggaccgtgtcggcgccaacagctcgagatggagcccctacagcatccccgtgaaggaggatctgcggccgcgggtgaaccgcgagcctatatgcgacccgaaccggaagctgagcatgggggacgtggtggagctgacgccggccctgcctcgcaggtccctcagcgggtaccgggaagagatccagcgcatgtacgaccgtggcggcttcgcgctctcagctcaaggcggtggctcgagacgctgctgacagtagcaatacgatgatgttaacctttcctaccattgtattgtaccattcaattcgttgtaagtataagctagctaggtcttgcagcctgaagctgcaaatgtgtaaaggtagaacgctgtgtatatataagctgttcaggttcgtttcagctg

SEQ ID NO: 1143 - DNA, 2674 bp, Sorghum bicolor
tggttgtgggtggttgacagaggctgctcggcttccggcgaccatgtccgtgccggcgatagccgtgtacaccagcccgccgggcgccgccgtccacgcgccgccggagcacgagtccagctcgcgcggctcggcgccgtgcgcggccgcggcgtccccgtcggcggcgccgagctcccaccgccacgcgggcggcctgtcctgcctgttctcgtccccgtccgcggccccgcggtcgacggcgcacgaggagctcggcgcgctctggcacgacagatccgacgagccgcccatcgttgtcgtcgccgggggcttcggcggcgggggctactcgtacccccagtcgtcgtcgtcgccgtcgccgttcaagctgcgggaccacctccaccgcagcccggtgtcgctgttccacagccctgccgcctcctctccggcgtccaggagcccgtcggtttcctggctcgccggccgcgagcgcgaccggctcttctccagcttcgtgcgcaacgcgcttggctcctgcattgacttcgcgccggtcaccagcttgccgctgggtgtgcgccccgcggccactggtgtcgacgccgccgagctggccttcgagcttgacgaaagcctctctgaggcggagccgtgctgcgaacctgatgctcgtgaactcctcgcccgcgtccaggctcgccactgcatcttccgcgacgagcttgtcgtcaaggccttcttcgaggccgaacgggcacaccgtggccagaagcgggctagtggtgatccgtacttgcagcattgcgtggagactgcggttcatctggctaatattggtgcaaatgcaaccgttgtgtctgccggccttctccatgacacaattgatgattcgttcatggactatgatcatatcttcaggatgtttggtgctggtgttgccgatcttgttgaaggggtttcgaagttaagccatttgagcaaacttgctcgggacaacaatactgcaagtaggactgttgaagctgatcgcctgcatacaatgtttcttgcaatggctgatgcacgagctgttcttataaagttagcagatcgtctgcacaacatgaagacgatagaagctttgcctttggttaaacaacaaaggtttgctaaagagactatggaaatatttgtgccattggccaaccgattaggaattgctagctggaaagaccagttggagaatatttgcttcaaacacttaaacccagaggagcacaaggagctttcttctaaacttgtgatgtcttttgatgaagcacttcttacatctacgcttgataacttggataaaggcctcagagatgaaggcatttcatatcacagtctttctggaaggcacaagagtctgtacagtatatactccaagatgataaagaagaacttaacaatggatgatgtccatgacatccatggtctacggctagtggttgacacagaggaagattgttatcgagcacttgacatagtgcacaagctgtggccccgagtcactggaagatttaaagactatatttctcatccgaagctgaatgggtatcggtcattgcacactgtcatcatctgtgagggtgtccatccatttgaaatccagatccgaacaaaggaaatgcatctacaggctgaatatggatttgctgcgcactggaggtacaaagaaggtggctgcaggcactcctttgttctccaaatggtggaatgggcaaggtgggtgctcacatggcaatgcgaggcaatgagcaaagagcgtccctcatctttgagcagctctgttggcatgaggccaccatgcccttttccgctgcattcggaagattgcccctattcttacagccggcagtgcaaccatgaaggtcctatatttgtgatcatgcttgaacatgacaagatgtctgtccaagagctcccggcaaactcgactgtagttgatctaatggagcgagtcggggccaacagtccgagatggagcccttacagcttcccactgaaagaggagctgcgaccgagggttaaccacaagcccataagcgacccaaataggaagctcagcatgggcgacgtggtagagctgacgcctgcgctccctcacaagtcgctgagcgagtaccgggaggagatccagcggatgtacgagcggggagggtttgcgctcgccaccacccctagaagctgacaccgtcaccgccatgttaacctgctgttgtacaataccctgtaaatatgaactaatccttgcagcagagaaagcccagatgaacaaacccccccaactgaattggctaatggtgcagggtttgatccaggacgctgctgtgtgtaacactttctacatgatgaaatgtgacccaagttcctccaaatattcaggagaatgttcaagtacttgtccttgctatgcctcacctttgtgctgcaatcgccctgtttctgaacttcgccgtcgatggacggcagatacatgcgtgtactacgtggaggaggattccggattctttcggcagaatattctggctgtgtggtctctcgtgtgtggctgtttgtgttgagcaaattgcagctctcctaggattgttggctctgaagacaagagacaaaactgtgtgctgtggacagcaaccaaccaaggccgggtctccaacaggacaaaaac

SEQ ID NO: 1144 - DNA, 2625 bp, Sorghum bicolor
gtgccggcgatagccgtgtacaccagcccgccgggcgccgccgtccacgcgccgccggagcacgagtccagctcgcgcggctcggcgccgtgcgcggccgcggcgtccccgtcggcggcgccgagctcccaccgccacgcgggcggcctgtcctgcctgttctcgtccccgtccgcggccccgcggtcgacggcgcacgaggagctcggcgcgctctggcacgacagatccgacgagccgcccatcgttgtcgtcgccgggggcttcggcggcgggggctactcgtacccccagtcgtcgtcgtcgccgtcgccgttcaagctgcgggaccacctccaccgcagcccggtgtcgctgttccacagccctgccgcctcctctccggcgtccaggagcccgtcggtttcctggctcgccggccgcgagcgcgaccggctcttctccagcttcgtgcgcaacgcgcttggctcctgcattgacttcgcgccggtcaccagcttgccgctgggtgtgcgccccgcggccactggtgtcgacgccgccgagctggccttcgagcttgacgaaagcctctctgaggcggagccgtgctgcgaacctgatgctcgtgaactcctcgcccgcgtccaggctcgccactgcatcttccgcgacgagcttgtcgtcaaggccttcttcgaggccgaacgggcacaccgtggccagaagcgggctagtggtgatccgtacttgcagcattgcgtggagactgcggttcatctggctaatattggtgcaaatgcaaccgttgtgtctgccggccttctccatgacacaattgatgattcgttcatggactatgatcatatcttcaggatgtttggtgctggtgttgccgatcttgttgaaggggtttcgaagttaagccatttgagcaaacttgctcgggacaacaatactgcaagtaggactgttgaagctgatcgcctgcatacaatgtttcttgcaatggctgatgcacgagctgttcttataaagttagcagatcgtctgcacaacatgaagacgatagaagctttgcctttggttaaacaacaaaggtttgctaaagagactatggaaatatttgtgccattggccaaccgattaggaattgctagctggaaagaccagttggagaatatttgcttcaaacacttaaacccagaggagcacaaggagctttcttctaaacttgtgatgtcttttgatgaagcacttcttacatctacgcttgataacttggataaaggcctcagagatgaaggcatttcatatcacagtctttctggaaggcacaagagtctgtacagtatatactccaagatgataaagaagaacttaacaatggatgatgtccatgacatccatggtctacggctagtggttgacacagaggaagattgttatcgagcacttgacatagtgcacaagctgtggccccgagtcactggaagatttaaagactatatttctcatccgaagctgaatgggtatcggtcattgcacactgtcatcatctgtgagggtgtccatccatttgaaatccagatccgaacaaaggaaatgcatctacaggctgaatatggatttgctgcgcactggaggtacaaagaaggtggctgcaggcactcctttgttctccaaatggtggaatgggcaaggtgggtgctcacatggcaatgcgaggcaatgagcaaagagcgtccctcatctttgagcagctctgttggcatgaggccaccatgcccttttccgctgcattcggaagattgcccctattcttacagccggcagtgcaaccatgaaggtcctatatttgtgatcatgcttgaacatgacaagatgtctgtccaagagctcccggcaaactcgactgtagttgatctaatggagcgagtcggggccaacagtccgagatggagcccttacagcttcccactgaaagaggagctgcgaccgagggttaaccacaagcccataagcgacccaaataggaagctcagcatgggcgacgtggtagagctgacgcctgcgctccctcacaagtcgctgagcgagtaccgggaggagatccagcggatgtacgagcggggagggtttgcgctcgccaccacccctagaagctgacaccgtcaccgccatgttaacctgctgttgtacaataccctgtaaatatgaactaatccttgcagcagagaaagcccagatgaacaaacccccccaactgaattggctaatggtgcagggtttgatccaggacgctgctgtgtgtaacactttctacatgatgaaatgtgacccaagttcctccaaatattcaggagaatgttcaagtacttgtccttgctatgcctcacctttgtgctgcaatcgccctgtttctgaacttcgccgtcgatggacggcagatacatgcgtgtactacgtggaggaggattccggattctttcggcagaatattctggctgtgtggtctctcgtgtgtggctgtttgtgttgagcaaattgcagctctcctaggattgttggctctgaagacaagagacaaaactgtgtgctgtggacagcaaccaaccaaggccgggtctccaacaggacaaaaac

SEQ ID NO: 1145 - DNA, 1810 bp, Panicum virgatum
ccgagctggccttcgagcttgacgagaacctccctgaggcggagccgtcctgcgaaccgtacgctcatgaactcctcgccggcgcccaggctcgccaccgcatcttccgcgacgagcttgtcgtcaaggccttcttcgaggccgagagggcgcaccgtggtcagaagcgggctagtggtgatccatacttgcagcattgtgtggaaactgcagtgcatctggccaaaatcggcgcaaacgcgaccgtcgtgtctgctggccttctccatgacacaattgatgactcgttcatggactatgatgatatcttccggatgtttggcgctggtgtagccgatcttgttgaaggggtctcgaagtttaagccatttgagcaaacttgctcgggataacaatactgcaagtaggactgttgaagcagattgcctgcataccatgtttcttgcaatggcagatgcacgagctgttctgataaagctagcagatcgtcttcacaacatgaagacgatagaagctttgcctatggttaaacagcaaaggttttgctaaagagactatggaaatatttgtgccattggccaacagattaggaattgctagctggaaagaccagttggaaaatatttgcttcaaacacttgaatccagaggagcacaaggagctttcctctaaacttgtgatgtcttttgatgaagcgctccttacgtctactcttgataaactagataaaggtctcagagatgaaggtatttcatatcacagtctttctgggaggcacaagagtctgtacagtatatactccaagatgataaagaagaacttaacaatggatgatgtccatgacatccatggcctgcggcttgtggttgagacagagcaagattgttatagagcacttgacattgtccacaaactgtggcctcgagtcactggaagatttaaagattatatatcacatccaaagctgaatgggtatcgatcattgcacactgtcatcatgtgtgagggtgtccatccatttgagattcagatccgaacaaaggaaatgcatctgcaagcagaatatggatttgcagcacactggaggtacaaagaaggtggttgcaggcactcctttgtgctccaaatggtcgaatgggcgaggtgggtgctcacgtggcaatgcgaggcaatgagcaaagagcggccctcagctttagccagctctgttggggttaggccgccatgtccttttcccctgcattcagaggattgcccttattcttacagccggcagtgtaaccatgaaggtcccatatttgtgatcatgcttgaacatgataagatgtctgtccaagagctcccggcaaactcgactgtagttgatctaatggagcgagtcggggccaacagtccaagatggagcccgtacagcttcccactgaaagaggagctgcgaccgagggttaaccacaagcccataagtgatccgaacaggaagctcagcatgggcgatgtggtggagctgacgcctgcgctcccgcacaagtcactgaccgagtaccgggaggagatccagcgtatgtacgagcgaggtgggttcgccctcgccaccacgccgagaagatgacaccgtcatgcccaccgtgttaacatgttgttgtacaataccctctgtaaatacaaaactaatttcttgcagcggagaaagcccaggcgaacataacccccaactgaaaattagcaaatggttcggggtattggtccgggacgctgctgtgtgtaactctttacaaagttgatgaatgaaatatccaaatggtggcgtttc

SEQ ID NO: 1146 - DNA, 2429 bp, Zea mays
gtgccggcgatagccgtgtacaccagcccgcccggcgccgtctacgcgccgccggagctcgagtccagctcgcgcggctcggcgccgtgcgcggccgcggcgtccccgtcagcgccgagctcccaccgccacgcggccgtcgcgggcggcttgtcctgcctattttcgtccccgtccgcggccccgcgggcaacggcgcacgaggagctcggcgcgctctggcacgacagatccgatgagccgccctccgtcgccgggggcttcggcggcgggggctactcgtacccccagtcgtcgccgtcgccgctcaagctgcgggaccacctccaccgcagcccggtgtctctgttccacacccctgcctcctccccggcgtccaggagcccctcggtttcctggctcgctggccgtgagcgcgagcgcctcttctctagcttcgtgcgcaacgcgcttggctcctgcattgactacgcaccggtcaccagcttcccgctgggtgtgcgccccgcggccactggtgtcgacgccgcggagctggccttcgagcttgacgaaaacctctctgaggcggagccgtcctgcgaacctgatgctcatgaactcctcgccggcgcccaggctcgccaccacatcttccgcgacgagcttgtcgtcaaggccttcaaggaggccgagcgggcacaccgtggccagaagcgggctagtggtgatccatacttgcagcattgtgtggagactgcggttcatctggccaatattggtgcaaacgcaaccgttgtgtctgctggccttctccatgacacaattgatgattcgttcatggactatgatcatatcttcaggatgtttggtgctggtgtggccgatcttgttgaaggggtttcgaagttaagccatttgagcaaacttgctcgggacaacaatactgcaagtaggactgttgaagctgatcgcctgcatacaatgtttcttgcaatggctgatgcacgagctgttcttataaagttagcagatcgtctgcacaacatgaatacgatagaagctttgcctttggttaaacaacaaaggtttgctaaagagactatggaaatatttgtgccattggccaaccgattaggaattgctagctggaaagaccacttggagaatatttgcttcaaacacttgaacccagaggagcacaaggagctttcctctaaacttctgatgtcttttgatgaagcacttcttacatctacgcttcataacttggataaaagccttagagatgaaggcatttcatatcacagtctttctggaaggcacaagagtttgtacagtatatactccaagatgataaagaagaacttaacaatggacgatgtccatgacatccatggtctacggcttgtggttgaaacagaggaagattgttatcgagcacttgacatagtgcacaagctgtggccccgagttaccggaagatttaaagactatatttgtcatccgaagttgaatgggtatcggtcgctgcacactgtcatcatgtgtgagggtgtccatccatttgaaatccagatccgaacaaaggaaatgcacctacaggctgaatatggattcgcagcgcactggaggtacaaagaaggtggctgcaggcattcctttgtgctccaaatggtggaatgggcgaggtgggtgctcacatggcaatgcgagacattgagcaaagagcgtccctcgtctttgagcagttctgttggcataaggccaccatgcccttttcccctgcattcggaagattgctcctactcttacagccgacagtgcaactatgaaggccctatatttgtcatcatgcttgaacatgacaagatgtctgtccaagagctcccagccaactcgactgtagttgatctaatggagcgagtcggggccaacagtccgagatggagcccttgcagcttcccactgaaagaggagctgcgaccgagggttaaccacaagcccataagcgacccaaataggaagctcagcatgggcgacgtggtggagctgacgcctgcgctccctgacaagtcgctgtccgagtaccgggaggagatccagcgcatgtatgagcggggagggtttgcgctcgccaccacccctagaagctgacaccatcgtcgccatgttaacctgctgctgtacaatacacctgtaaatacgaactaatccttgcagcagagaaatcccagatgaacaaaccccccaactgaattggctaatggtgcggggtttgatccaggacgctgctgtgtgtaacgctttttacaagttgaaatgtggccaagttcctccgaagattcatgagaaacatgaagtacttgtgtccttgtacgcttttggtttggtttcaatgtttcatttggactggatcaagtccgacctcttccgcgctctaatcagga

SEQ ID NO: 1147 - DNA, 473 bp, Saccharum officinarum
agcagtacaaagaagcacgatagcaagcaaacacttgcccttaatctcgcgattcacgacgacgaccatgagctccacggcggcggtgacgacagcaccggggagcggcggcgccaagacgtcgtggccggaggtggttggcctcagcatagaggaagccaagaaggtgatcctcaaggacaagcccgacgccgacatcgtcgtgttgcctgtcggctcgcgggtgaccgatgattttctgcccaaccgcgtccgcatcttcgtcgacaccgtcgctgagacgccccgtgttggctagttgcccagctcccttttactccagccacaactgaataaaagataatatatgtgtagtaaactcaaaataataactcagaagatgccatgatcgatctatcatgtaccctgttcatgcatcttccgaatggttccggatgtgtgttttactctctatgaatgataccatattacat

SEQ ID NO: 1148 - DNA, 473 bp, Saccharum officinarum
  misc_feature (30)..(33): n is a, c, g, or t
  misc_feature (449)..(449): n is a, c, g, or t
agcagtacaaagaagcacgatagcaagcannnncttgcccttaatctcgcgattcacgacgacgaccatgagctccacggcggcggtgacgacagcaccggggagcggcggcgccaagacgtcgtggccggaggtggttggcctcagcatagaggaagccaagaaggtgatcctcaaggacaagcccgacgccgacatcgtcgtgttgcctgtcggctcgcgggtgaccgatgattttctgcccaaccgcgtccgcatcttcgtcgacaccgtcgctgagacgccccgtgttggctagttgcccagctcccttttactccagccacaactgaataaaagataatatatgtgtagtaaactcaaaataataactcagaagatgccatgatcgatctatcatgtaccctgttcatgcatcttccgaatggttccggatgtgtgttttactntctatgaatgataccatattacat

SEQ ID NO: 1149 - DNA, 717 bp, Saccharum officinarum
aagaagcacgataacaagcaacacttgccctctgtttcctttttttgcatcgtcatcgatcaactgattcgcagttcaattcgcgaatcgcgaccgacgacgacgacgaccatgagctccacggcaacagcggcggcaccggagtgcggcggcagcgccaagacgtcgtggccggaggtggtcgggctcagcgtggaggaagccaagaaggtgatcctcaaggacaagcccgacgccgacatcgtcgtgctgcccgtcggctcgattgtgaccaccgattttgtgcccaaccgcgtgcgtatcttcgtcgacatcgtcgccgagacaccccacgtaggctgataagagtctggctgatgcctagcttcggttcctttcttgctccagaagtgaatattctataaatgaataagtcggacatgctatgtattcatgtccgtgtatctgccacataatggatgtgtacgtcgtgtttctttcctataaactattactaaataattgcatgttcttgcaaaatgtcatccatcctcgcacgaatgaatatatgaaaaatgtcggccaaggatgcaggggagatcaggggggaggaagatgccttggagcgctctgacgacctggttggaaagccagcatgtggtcgatgcaaatgaagactattcgaacgatgtggatctggacataaagcctaaatcctggagcgggggggccgtttat

SEQ ID NO: 1150 - DNA, 717 bp, Saccharum officinarum
  misc_feature (126)..(126): n is a, c, g, or t
  misc_feature (618)..(618): n is a, c, g, or t
aagaagcacgataacaagcaacacttgccctctgtttcctttttttgcatcgtcatcgatcaactgattcgcagttcaattcgcgaatcgcgaccgacgacgacgacgaccatgagctccacggcnacagcggcggcaccggagtgcggcggcagcgccaagacgtcgtggccggaggtggtcgggctcagcgtggaggaagccaagaaggtgatcctcaaggacaagcccgacgccgacatcgtcgtgctgcccgtcggctcgattgtgaccaccgattttgtgcccaaccgcgtgcgtatcttcgtcgacatcgtcgccgagacaccccacgtaggctgataagagtctggctgatgcctagcttcggttcctttcttgctccagaagtgaatattctataaatgaataagtcggacatgctatgtattcatgtccgtgtatctgccacataatggatgtgtacgtcgtgtttctttcctataaactattactaaataattgcatgttcttgcaaaatgtcatccatcctcgcacgaatgaatatatgaaaaatgtcggccaaggatgcaggggagatcaggggggaggaagatgccttggagcgctctgacgacntggttggaaagccagcatgtggtcgatgcaaatgaagactattcgaacgatgtggatctggacataaagcctaaatcctggagcgggggggccgtttat

SEQ ID NO: 1151 - DNA, 1325 bp, Zea mays
aatccgtgtcaaagcctcaaagcgtgaagctatccgtacgatcggataacgaggcggtcccacctcccacggacatccccgtccccaccgatttgtttgtcatcactcgtcactcatcactcatcagctattcttctcttctcctggacaactcaagctcaaaacccaaaatcgaccttgtcgacccggatccgagctaggcacccgcacgaccacccgcctcctgccggtcaccgggacctagcatcgccgggcggcggcgggggaggggaaggtaggcgatgaggaaacgtgagcgggagaacccgtgcgggatctgcgggcactaccacaagtacgaggagggggaggtatgcggggtgtgcggccaccgctggaaaccgtcggacggggagggcgccccgtcgaggcacgagtccgccttccccacagaggtgctcaaggactttctcttcctcgggagctacgacaacgcctcacgctccgaggtcctcagaacgctcagtatctcccacatccttaatactgtgcctgattgccacaatctgtacaagaattcattcacatatcacagtcttcaacgggacaggcctttggattttgatgaggcaaaccaatatctagagaaatgtgaaagagataaatcgcgtgttcttgttcattgcatgactggaaaaaacaggtctgctgctattgttgcagccttcttgatgaagtctagagggtggagacttgcacaatcttttcaatgggtgaaagatcgaagaccacaggttcaactgacagatgcttctcagaaggagcttttggagtatgagctgaagcttttcggacccagtactcaaaccttggttcccactgaatcatttgcttctcttggatttggttatacaaaaccagcaggtgacatgcaaacgcctgtgttcaaccaaacgaccatgccatccatattcgagcgattcaacccaaatgatcgccccaccaatttcacttttggagttgagaggaaagcagaagctaaccctcgagataacaatagtgatggcagggtaaacccaacttcaacggagaacctgatggacagctcttaagatgatttcacgatgtcgctgttgaatctccttgttccagaagtaaacccgctgtaatctgcatgtcgcggaagtaaacctactgctcggtgcctcggtgcaccgaatacttatccggtgtctaggtttcagggaggttttgcccttgtcgcatgagaaatggttctctggaaaccgatctttgctttagaatgactgtatgaaatagatgtttgtggctcatctatctgttcc

SEQ ID NO: 1152 - DNA, 1130 bp, Saccharum officinarum
  misc_feature (613)..(613): n is a, c, g, or t
  misc_feature (807)..(807): n is a, c, g, or t
  misc_feature (815)..(815): n is a, c, g, or t
  misc_feature (830)..(830): n is a, c, g, or t
aggcacccgcacgagcccaccgcctcctgccgatcaccgggacctagcatcgccgcggcggcggcgggagaggggaaggaaggcgatgaggaaacgggagcgggagaacccgtgcgggatctgcgggcactaccacaagtacgaggagggggaggtctgcggggtgtgcggccaccgctggaaaccgtcggacggggagggcgccccgacgaggcacgagtccgccttccccacagaggtgctgaaggacttcctcttcctcgggagctacgacaacgcctcacgctccgaggtcctcaggacgctcagtatcacgcacatccttaacactgtgcctgattgccacaatctatacaagaattcattcacgtatcacagtcttcaacgggacaggcctttggattttgacgaggcaaaccagtatctagagaaatgtgaaagagataactcacgtgttcttgttcattgcatgactggaaaaaacaggtctgctgctattgttgcagccttcttgatgaagtctagaggatggaggcttgcacaatctgttcaatgggtgaaagaccgaagaccgcaggttcaactgacaaacgcttctcagaatgagcttttngagtatgagctgaagctttttggacctagtgctcaacccttggttcccactgaatcatttgcttctcttggatttggttatcaaaaaccagcaggtgacatccaagcgcctatgttcaccaaatgactatgccatccatatttgagcgagtcaacccaaatgatcgccccaccaatttcacttttggagctganaggaatgnggaagtaaccatcangatagcaatagtgatggcggggtaaacccaacttcaacagagaacctgatggacagttcttgagatgatttcacgatgtcgctgttcaatctccatgctgcagaagtaaacctactgtatgaggttttgccttctgtcacttgagaaatagttctctggcaaccgacctttgctttagaatgactatgacattagtcttaactcgtagtaatagatatttctggctcatatctctgttcctttctcgtctagtttcagcaaagctgctgaaagttcctacccaagtacccatattcttcc

SEQ ID NO: 1153 - DNA, 1343 bp, Panicum virgatum
ggtaattcagctccatctaggtttaggtcctcaggagaaatatcagtttctttctcagcttcaactctagctgcctctgcctgcttatcctcttcttccaaaccaagataagtatacatttcatcatcattcatcacagctatagcagcacctatcctatcttccggaattggagtaatttccagggtatcccagtggccgcgggggatcaagcagcgccgcggcggcggtgtgaggaagaggaaggaaggggacaagatgaggaagcgggagcgggagaacccgtgcgggatttgcgggcactaccacaagtacgaggagggggaggtctgcggggtgtgcggccaccgctggaagccgtcggacggggagggcaccccggcgaagcacgagtccgccttccccaccgaggtgctcaaggacttcctcttcctcgggagctacaacaacgcctcccgctccgaggtcctcaagacgctcagcgtctcccacatcctcaacactgtgcctgattgccaaaatctatacaagaattcattcacgtatcacaggcttcagcgtgacaggcctttggattttgatgacgcaaaccagtttctagaacaatgtgaaagagataaattacgcgttcttgttcattgcatgactggaaaaaacaggtcagcagctgttgttgccgccttcttgatgaagtctagaggatggagacttgctcagtctttccagtgggtgaaagaccggcggcagcaggttcaactgacagatgcttctcagaacgtgcttctggagtacgagcagaagctttttgggcccagttctcaacctgtgattcccactgaatcatttgtttctcttggatttggttacccaaaaccagcaggtgacacccaagcacctgcgttcaaccaaatgaccgcgccatccatttttcagcgagttggcccaaatgttttccccctgaattttgcttttggagccgaggggacagtgggagtcaacccagataacaatgacaatggtggggccaaggccaacccagcttcgactgataacccgatggacagctcttaagatgatttcaggctatggaatctccatgatgctgaagtaacctactattaggtgtatcgaatacgcatcggggagggtgtttagctttcagatgggtattttgccttttgtgcactcgagaaatggttgtggcaactgacccgtgctgtagagtgactatgacattagacgctggaggaggtgctggccttctccctgcagaagctggaggccatggccgtgccctcggtccaggccgaggtggccaacgaggacgctccgttcgaggtggc

SEQ ID NO: 1154 - DNA, 1249 bp, Panicum virgatum
ggtctgtgggcgtcgcctcgaacggagcaacgagctcaaaaaccccaatttcccgtcgaaccgatccaaatccaaaccccaaccccacgagaaatctatctcgaatcaccttccccgctctgcctgttcctccgactccaatcacccgcgcgatccctccgcctgcgatctccctcggggatcgagcagcgccgcggcggcgggaagaggaaggaaggaaggaaggcgacggagatgaggaagcgggagcgggagaacccgtgcgggatctgcgggcactaccacaagttcgaggagggagaggtctgcggggtgtgcggccaccgatggaagccgtcggaaggggagggcaccccggcgaggcacgagtccgccatccccaccgaggtgctcaaggacttcctcttcctcgggagctacgacaacgccgcccgctccgaggtcctcaagacgctcggcatctcccacatcctcaacactgtgcctgattgccacaatctataccataattcattcacgtatcacagtcttccgcgtgacaggcctttggattttgatggggcaatccggtttctagaacaatgtgaaagagataaagcacgtgttcttgttcattgcatgactggaaaaaacaggtcagcagctattgttgcagccttcttgatgaactctagagcatggagacttgctcagtctttacagtgggtgaaaggctgtcggccgcaggttcaactgacagatgcttctcaggacgagcttctggaatacgaacagaagctttttggactcggtgctcaacccgtgattcccactgaatcatttgcttctcttggatttggctacacaaaaccagcaggtgacacccaagcacctacgttcaaccaaatgaccgtgccatccatattcgagcgagtcagcccaaatgacattcccgccaacttcacctttggagcccggaggatggtggaagtcaaccctcaagatagcgataacaatggtgggaccaacccagcttcaactgataacgtgatggacagctcttaagatgatatcaggctgttggatctccatgctgccgaagtaaccaaccactaggttacttaccggggagttcagtttcataggggtattggatttttgtgcacttgagaaatggctctggcaactgccccgtgctgtagagtactagagtgactgaccctagtcgaattaaatgatgtttgacaagctggatggtggctcgtatccc

SEQ ID NO: 1155 - DNA, 1090 bp, Saccharum officinarum
cagcggcttccgctgctcttgctgtcctctcctctgtgctatccgctaactagggtttatctgctcgaggaatggcgtcgctgcaggtctccggcgcgggggtcggcgccgcggccttcgctgcgaaggggaaggcctccatcggtgcgctccggcttccatcgacggtgaccgtcggcgaggtccgcccggcgcggcgggcgttccgcggcctcgtcgtcagggccgccaccgtcgtcgcccccaagtatacaacacttaagcccttggccgatagagtgcttgtaaagataaactcttcagaggagaagacaactggtggaattttgctccctacaactgctcagtccaaacctcagggtggtgaggtagttgctgttggtgaaggaaggataattggggataagaaagttgatgttagcattcaggttggagctcaagttgtatattcgaagtatgctggaacggaggttgagttgaatgattacaaccatctggtcctcaaagaggatgacattataggtatcttagaaaccgatgatgtgaaagacatgaagcctctgaacgaccgtgttgtaatcaaggttgctgaagctgaagacaaaactccaggcggtctattgcttaccgaaactaccaaggagaagccatctatcggaacggtcgtagcggttggcccaggttccctggacgatgaaggcaagaggagcccgctgtctgtgtccgcggggagcaccgtcctgtactccaagtatgccggcagcgagttcaagggcgccgatggcacgaactacatcgtgctgagggtctcggatctgatggccgtcctctcctgagcagctgggcgcagctgaacgaaagaggtgctgtgcaggagcaggatgccatgccattgccagccagtggtaccacaaccacaattccctgttgctgcatcgccatttttttttgtgggaatggggttccctggcggcctaacaactgtaggattcctcgcggctttccgtttttttttccccttcttgggcgtctggtctgaatgccctccgaagaacaacaataagcaagcgttcagaaattccgtcgcacg

SEQ ID NO: 1156 - DNA, 1090 bp, Saccharum officinarum
  misc_feature (942)..(942): n is a, c, g, or t
  misc_feature (978)..(978): n is a, c, g, or t
  misc_feature (990)..(990): n is a, c, g, or t
  misc_feature (1011)..(1011): n is a, c, g, or t
  misc_feature (1022)..(1022): n is a, c, g, or t
  misc_feature (1025)..(1025): n is a, c, g, or t
  misc_feature (1027)..(1027): n is a, c, g, or t
  misc_feature (1033)..(1033): n is a, c, g, or t
  misc_feature (1040)..(1040): n is a, c, g, or t
  misc_feature (1051)..(1051): n is a, c, g, or t
  misc_feature (1066)..(1066): n is a, c, g, or t
  misc_feature (1079)..(1079): n is a, c, g, or t
  misc_feature (1082)..(1082): n is a, c, g, or t
cagcggcttccgctgctcttgctgtcctctcctctgtgctatccgctaactagggtttatctgctcgaggaatggcgtcgctgcaggtctccggcgcgggggtcggcgccgcggccttcgctgcgaaggggaaggcctccatcggtgcgctccggcttccatcgacggtgaccgtcggcgaggtccgcccggcgcggcgggcgttccgcggcctcgtcgtcagggccgccaccgtcgtcgcccccaagtatacaacacttaagcccttggccgatagagtgcttgtaaagataaactcttcagaggagaagacaactggtggaattttgctccctacaactgctcagtccaaacctcagggtggtgaggtagttgctgttggtgaaggaaggataattggggataagaaagttgatgttagcattcaggttggagctcaagttgtatattcgaagtatgctggaacggaggttgagttgaatgattacaaccatctggtcctcaaagaggatgacattataggtatcttagaaaccgatgatgtgaaagacatgaagcctctgaacgaccgtgttgtaatcaaggttgctgaagctgaagacaaaactccaggcggtctattgcttaccgaaactaccaaggagaagccatctatcggaacggtcgtagcggttggcccaggttccctggacgatgaaggcaagaggagcccgctgtctgtgtccgcggggagcaccgtcctgtactccaagtatgccggcagcgagttcaagggcgccgatggcacgaactacatcgtgctgagggtctcggatctgatggccgtcctctcctgagcagctgggcgcagctgaacgaaagaggtgctgtgcaggagcaggatgccatgccattgccagccagtggtaccacaaccacaattccctgttgctgcatcgccanttttttttgtgggaatggggttccctggcggcctancaactgtaggantcctcgcggctttccgttttnttttccccttnttngncgtctngtctgantgccctccgangaacaacaataagcnagcgttcagaaantcngtcgcacg

SEQ ID NO: 1157 - DNA, 1048 bp, Zea mays
agaatcgtggcgtctccctggggataaagtacttctccagctcctctgcgtcttccgccgctcttgctgtcctctgtgctatccgctagggtttatctgctcgaggaatggcgtcggtgcaggtctccggcgcgggggtcggtgccgcggccttctctgtgaaggggaaggcctccaccggtgcgctccggcttcgctctacgttgaccttcggcgaggtctgcccggcgcggcgggcgttccgcggcctcgtcgtcagggccgctaccgtcgtcgcccccaagtatacaacacttaagcccttggctgatagagtgcttgtaaagattaactcttccgaggagaagacaactggtggaatcttgctccctacgactgctcagtccagacctcaaggtggcgaggtagttgctgttggagaaggaaggataattggggataagaaagttgatgtcagcattcaggttggagctcaggttgtgtattctaagtacgctggaaccgaggtcgcgttgaacgatcacagccatctggttctcaaagaggatgacgttataggtatcttagaaactgatgacgtgaaagacatgaagcctctgaacgaccgtgttctaatcaaggttgctgaagctgaagacaaaactccaggaggcctactgcttacggaaactgccaaggagaagccatctatcggaacggtcgtagcggttggcccaggccccctggacgaggatggcgagaggctcgcgctgtccgtctccgcggggagcactgtcctgtactccaagtacgccggcagcgagttcaagggcgccgacggcacgaactacatcgtgctgagggcgtcggatctgatggccgttctctcctgaactgggcttgggctggaggacgaacgaggtgcaggtgcaggagcaggcttagcaataccgtaggattcctcgcggctttcccgtcccctcccccctcctacttggttgtcttgtttgactgtcttctgaggaaccgaacaacagtaataagcacaccgatgccgttcatacagatt

SEQ ID NO: 1158 - DNA, 1026 bp, Panicum virgatum
ccgctgctattgctgttctctgtgctatccgctagggtttatctactcgagcaatggcgacggtgcagctctccagtgcgagggtcggggcggcggcgttcgctgcgaaggggaaggcctccctcgaaccgctccggcttccggcgagggtgaccgtcggcgaggcccgccccgcgcggcgggcgtttcgcggcctcgtcgtcagggccgccaccgtcgtcgcccccaagtatacaacgcttaagcccttggctgatagagtgcttgtaaagattaagtcttctgaggagaagacaaccggtggaattttgctccctatgactgctcagtccagacctcagggtggtgaggttgttgccgttggagaaggcaggaccattggggataagaaagttgatatcagcattcaggttggagctcaagttatatattcgaagtatgctggaactgaagttgagctgaatgattacaaccatctagttctaaaagaggatgacattataggtatcttagaaactgatgatgtgaaagacatgaagcctctgaatgaccgtgtactaatcaaggtagctgaagctgaagataaaactccaggtggtctattgcttaccgaaactaccaaggagaagccatctattggaacggtcgaagccgttggcccaggccccctggatgaggaaggcaacaggattccgttgtccgtctctgcaggcagcaccgtcctctactccaagtacgcgggcagcgagttcaaggtcgccgatggtaccaactacatcgtgctaagggtgtcggatctgatggccgtcctctcctgagaagtgggttttcaacagttacctccaaagcttcgaccattctgttgtagcattgtcgccattttgtgggaacaaccaaggttccctggcaatcctctagactttctcgcggcttcccgttctctttggtcaatactagtattcttactctgtgtgatgaataaacattagaagttcggtcgcatgaaatgaattttcttgtattggc

SEQ ID NO: 1159 - DNA, 1045 bp, Panicum virgatum
gtgctatccgctagggtttacctactcgagcaatgacgacgatgcagctctccagcgcgagggtcggggcggcggcgttcgctgcgaaggggaaggcctccctcgaaccgctccggcttccggcgacggtgaccgtcggcgaggcccgccccgcgcggcgggcgtttcgcggcctcgtcgtcaaggccgccaccgtcgtcgcccccaagtatacagcacttaagcccttggctgatagagtgcttgtaaagatcaagtcttctgaggagaagacaacaggtggaattttgctccccacgactgctcagtccagacctcagtgtggtgaggtagttgctgttggagaaggaagggccattggggataagaaagttgatatcggcattcaggttggagctcaaattatatattcaaagtatgctggaactgaagttgagctgaatgattacaaccatctagttctaaaagaggatgacattataggtatcttagaaactgatgatgtgaaagacatgaagcctctgaatgaccgtgtactaatcaaggttgctgaagctgaagataaaactccaggtggtctactgcttaccgaaactaccaaggagaagccatctattggaacggtcgtatctgttggcccaggtcccctggatgaggaaggcagcaggatcccgctgtccgtctctgcaggcagcaccgtcctctactccaagtacgccggcagtgagttcaagggcgccgatggcaccaactacatcgtgctgagggtgtcggatctgatggccgtcctctcctgagcagtgggttttcaacagttacctccaaagcttcgaccattctgttgtagcatcgccattttgtgggaacaaccacggttccctggcaatcctctagactttctcccggcttcccgttctctctttggtcaatactagtattcttactgtgtctgaggaataaacataaaaaattcggtcgcatgaaaggattttcttgtactggcatgcgtatgatcgctgcgataccgttcagaccctacccgttc

SEQ ID NO: 1160 - DNA, 953 bp, Cenchrus ciliaris
  misc_feature (310)..(310): n is a, c, g, or t
  misc_feature (412)..(412): n is a, c, g, or t
  misc_feature (423)..(423): n is a, c, g, or t
  misc_feature (426)..(426): n is a, c, g, or t
  misc_feature (433)..(433): n is a, c, g, or t
  misc_feature (440)..(440): n is a, c, g, or t
  misc_feature (447)..(447): n is a, c, g, or t
  misc_feature (453)..(453): n is a, c, g, or t
  misc_feature (495)..(496): n is a, c, g, or t
  misc_feature (499)..(502): n is a, c, g, or t
  misc_feature (519)..(519): n is a, c, g, or t
  misc_feature (528)..(528): n is a, c, g, or t
  misc_feature (534)..(536): n is a, c, g, or t
  misc_feature (539)..(539): n is a, c, g, or t
  misc_feature (562)..(562): n is a, c, g, or t
ccgctgtctgcctgccttgccccccgttttcctctgctcttgctgttctctgtgctatccgctagggtttatctactcgaggaatggcgtcgctgcagctctccggcgcggggttaggcgccgcagccttctccgcgaatgggaaagcctccctcgaaaagctccggcttccggcgatggtggccgtcggcgagacccgcccggcgcggcgggcgtttcgcggcctcgtcgtcagggctgccaccgtcgtcgcccccaagtatacaacacttaagccattggctgatagagtgcttgtaaagatcaagtnttctgaggagaagacaaccggtggaattttgctcccaaccactgctcagtccagacctcagggtggtgaggtggttgctgttggagaaggaaggaccattgnggataagaaanttnatgtcancattcangttgganctcaanttgtatattcaaagtatgctggaactgaggttgaattgaatnnttnnnnccatctagttctcaaanaggatgacnttatannnatnttagaaactgatgatgtgaaggncatgaagcctctgaatgaccgcgttctaatcaaggttgctgaagctgaagagaaaactccaggtggtctattgcttacccaaaccaccaaggagaagccatcgattggaacggtcatagctgttgggccaggtcccctggacgaggaaggcaacaggagcccgctctccgtctctgcaggcagcaccgtcctctactccaagtacgccggcagcgagttcaagggcgccgacggcaccaactacgtcgtgctgaggttgtcgaatctgatggccgtcctctcctgagctgacctgcgggttttcgacaggtacctacttgaattagggtcgtagtatcttgctgtatctgaggaataaacaggcgttcaaatttcaaaattcggtcgcata

SEQ ID NO: 1161 - DNA, 1218 bp, Brachypodium distachyon
acttcactgcttctgctttagcctctttctctctctagggtttatctcctccagcgaattaggattacgcggctaggcttcgaactcgaggcaagcaaatcctcgagcaataatggcgtcggtgcagctctgcggtgccgcggttgccgcggcgtccttctccaggaagggagcggcatcactcgaggtgctccgcgtccccacgccggcggccggaggggcccgcccggcgcggcgggcgttccgcggcctcgtcgctagggccgccaccgtagtcgcccccaagtatacaacgctcaagcccttggccgacagactgcttgtaaagattaagtctgctgagcagaagacgacaggtggaattttgctcccttcgacagcccaatctaaacctcaggggggtgaggtagttgccattggagagggaagaaccattgcggataacaaagttgaagtcagcattcaggttggagctcaggttgtatattccaagtatgctggaacagaggtggagttgaatgactccaaccatctaattctaaaagaggacgacatcataggtattctggagacagatgatgtgaaagacatgaagcctcttggtgaccgtgttcttatcaaggtagctgtagctgaagataaaactcccggtggtctcttgcttaccgaaactgctaaggagaagccatctatcggaacggtcgtcgctgttggaccaggccctctggacgagcaaggcaagaggatcgcgttgccggtatctgcaggtagctccgtcctgtactccaagtacgctggtgctgaattcaagggtgctgacggcacgaactacatcgttttgagggtatcggatctgatggcagtcctctcctgagttggactaccaggttcccgcttgcgcaggcgctggccgcaattttccgatcggagatgtttcaaggcgacttgaactacatgaagagaaaatgaatcccttttactagaggtttgcaccaagccaggtttttgtctgatgttccaatgctcttccatccttgtaccgctcccaatgttgttggtacgatctctatcatacgattgtagcatcaagattcaaacacggaaaacaaaccttgtttctatatagcaataaaaattacgatcttcgaggtgatcttactattatcagatcctatgatcatgacattattaatcagcagaaaaaaaaagttgagatag

SEQ ID NO: 1162 - DNA, 850 bp, Brachypodium distachyon
ctttctctctctagggtttatctcctccagcgaattaggattacgcggctaggcttcgaactcgaggcaagcaaatcctcgagcaataatggcgtcggtgcagctctgcggtgccgcggttgccgcggcgtccttctccaggaagggagcggcatcactcgaggtgctccgcgtccccacgccggcggccggaggggcccgcccggcgcggcgggcgttccgcggcctcgtcgctagggccgccaccgtagtcgcccccaagtatacaacgctcaagcccttggccgacagactgcttgtaaagattaagtctgctgagcagaagacgacaggtggaattttgctcccttcgacagcccaatctaaacctcaggggggtgaggtagttgccattggagagggaagaaccattgcggataacaaagttgaagtcagcattcaggttggagctcaggttgtatattccaagtatgctggaacagaggtggagttgaatgactccaaccatctaattctaaaagaggacgacatcataggtattctggagacagatgatgtgaaagacatgaagcctcttggtgaccgtgttcttatcaaggtagctgtagctgaagataaaactcccggtggtctcttgcttaccgaaactgctaaggagaagccatctatcggaacggtcgtcgctgttggaccaggccctctggacgagcaaggcaagaggatcgcgttgccggtatctgcaggtagctccgtcctgtactccaagtacgctggtgctgaattcaagggtgctgacggcacgaactacatcgttttgagggtatcggatctgatggcagtcctctcctga

SEQ ID NO: 1163 - DNA, 1114 bp, Oryza sativa
tcggctgctgctgctgctgctgctctctccgcgctgcgcttccgctgctctagggtttatctcctgctgccgctcggatttcgcggcgagcaatccaccggagatggcgcccgtgcagttctccgccgctggagttggcgcggtggccttcgctacgaaggggatggcctcccgcgacgcgctccgcctcccgccgccggcggccgtccgggtgctccgccaggcgccgcggccgtcacgcggcctcgtcgtcagggccgccgccgccagcgtcgccccgaagtatacaacgctcaagcccttggctgatagagtgcttgtaaagattaagtctgctgagcagaagacaactggtgggattttgcttccttcggctgctcagtctaaaccccaagggggtgaggtagttgccattggggagggacgaactgttggggataacaaagtggaagttagcattcaggttggatcccaagtcgtatattcaaaatatgctggaacagaggtggagttgaatgattccaaccatctgattcttaaagaggatgacatcattggtattctggagactgatgatgcaaaggacatgaagcctcttagcgatcgtgttcttatcaaggtcgctgaagctgaagataaaactcctggtggcctattgcttactgaaacaacaaaggagaagccgtctattggaacggtcgtggctgttggccctggtcctctggatgaggaaggcaagaggattccattgtcggtctctgcaggcagcactgttctatattccaaatatgctggcagcgagttcaagggctctgatggcacgagctacatagtgttgcgggtgtcagatctaatggctgtcctctcctgaattaccaggtgcgctcagctgagccatccatcgtactatgccctttcagcaaccatcttttttggaaaatattgctcctggagataacattaaagccactcgaatccccttttgttacaccaaaattggggtggtggtatatcatactgataaattataatgaatgccaactttttttggttgttttcagctttgtaatgatttatagaaaaatgggagaataactcctaacctttgcaccaa

SEQ ID NO: 1164 - DNA, 1396 bp, Zea mays
atcctcacatcgtccacagaatttcacgcatcgcacggggaacaccgatcgatcgatccctcgagaagcagagacaagtagcccgcccgcccgcccgcacacatagagacagagagaatcaagccgccgccgaccagtgacatggcgccctgggccattgccatccacggcggcgcgggcgtggacccgaacctcccggagcaccggcaggaggaggcgaagcgcgtgctggcgcggtgcctgcaggtgggcgtggacctgctgcgcgcgggcgcgcaggcgctggacgtcgtggaggccgtggtgcgcgagctggagacggaccccttcttcaactcggggcgcgggtccgcgctcacccgcgccggcaccgtggagatggaggccagcatcatggacggccgcggccgccgctgcggcgccgtgtccggcgtctccaccgtcaagaaccccgtgtccctggcgcgccgcgtcatggacaactcgccccactcgtacctcgccttcgacggcgccgaggagttcgcccgtgcgcagggcctggagaccgtggacaacagctacttcatcacggatgacaacgtcggcatgctcaagctcgccaaggaggccggcagcatcctgttcgactaccggatcccgctggcggggacggacacgtgcagcgcgctggcgggcgcggcggacagcaacggcggcggcgtgcacaaggcggggatggtcatgaacgggctgcccatcagcgtgtacgcgccggagacggtggggtgcgcggtggtggacgcgtcgggggcctgcgcggcggccacgtccacgggcgggctcatgaacaagatggccggccgcatcggggactcgccgctcatcggctccggcacctacgcgtgcggcgcctgcgccgtgtcgtgcacgggcgagggcgaggccatcatccgctgcacgctcgcgcgcgacgtggccgccgtcatggagtacaagggactgcccctgcagcaggccgtcgactactgcgtcaaggagcgcctcgaccagggattcgccggcctcatcgccgtctccggcaccggcgaggtggcgtacggattcaactgcaccggcatgttccggggctgcgccaccgaggacgggttcatggaggtcggcatctgggagtgagctggaggccccgccatctaaacacaaatcaaaatcagtgtgcgtgcagctgcatgtggccatcctgcgattgccatgtgtttaatctccgggtcacaggtgttgtcgatgatccaccactagtagtagcgattgcatggagattggtgctcgggtcaataatgatggtgattgtgacggagtgccctgcaaaataattaataattcgtgtgaaaaagttgattatatggttcctgacact

SEQ ID NO: 1165 - DNA, 1002 bp, Hordeum vulgare
ggcgcgctgggccattgccatccacggcggcgcgggcgtggacccgaacctgccggagcacaggcaggaggaggccaagcgggtgctggcccggtgcctgcaggtgggcgtcgacctgctgcgcgccggcgccaccgcgctggacgtggtggaggccgtggtgcgggagctggagacggacccctgcttcaactcgggccgcggctccgcgctcacccgcgccggcaccgtcgagatggaggccagcatcatggacggccgcggccgccgctgcggcgccgtctccggcgtctccaccgtccgtaaccccgtctccctcgcccggcgcgtcatggacaagtccccacactcctacctcgccttcgacggcgccgaggatttcgcccgcgagcagggtcttgaggttgtggacaacagctacttcatcacggaggagaacgtgggcatgctcaagctcgccaaggaggccaacaccatcctcttcgactaccgcatcccgctcgccggggccgacacctgcagcgcgcaggcggcggcgaccgagaaccacaacaacaacggcatggtgatgaacgggctgcccatcagcatctacgcgccggagacggtggggtgcgccgtggtggactgtaacggcttcacggcggcggccacctccacgggcgggctcatgaacaagatgacgggccgcatcggcgactcgccgctcatcggcgctggcacctacgcgtgcgggcactgcgccgtgtcgtgcacgggcgagggcgaggccatcatccgctccacgctggcgcgggacgtggccgccgtgatggaatacaaggggctgcctctgcaggaggccgtggacttctgcgtcaaggagcggctcgacgaggggttcgccgggctcatcgccgtgtccggcaccggcgaggtggcatacgggttcaactgcaccggcatgttcagaggctgcgccaccgaggacggattcatggaggtcggcatctgggagtgagc

SEQ ID NO: 1166 - DNA, 1328 bp, Hordeum vulgare
ccaactccaagcagagcaacaccaacaccaagaagaagaagagcaagcagagcatcacgtagccacagcgacaccgagaggtcgagacccatcgaagcgccttccgccacctagcacagcacaccaccaccgtcacatacacgcacgcacatggcgcgctgggccattgccatccacggcggcgcgggcgtggacccgaacctgccggagcacaggcaggaggaggccaagcgggtgctggcccggtgcctgcaggtgggcgtcgacctgctgcgcgccggcgccaccgcgctggacgtggtggaggccgtggtgcgggagctggagacggacccctgcttcaactcgggccgcggctccgcgctgacccgcgccggcaccgtcgagatggaggccagcatcatggacggccgcggccgccgctgcggcgccgtctccggcgtctccaccgtccgcaaccccgtctccctcgcccgccgcgtcatggacaagtccccgcactcctacctcgccttccagggcgccgaggatttcgcgcgccagcagggactggaggtggtggacaacagctacttcatcacggaggagaacatcggcatgctcaagctcgccaaggaggccaacagcatcctcttcgactaccgcatcccgctggtcggggccgacacctgcagcgcgcaggcggcggcggcggccgacaaccacaataacaacggcatggtgatgaacgggctgcccatcagcatctacgcgccggagacggtggggtgcgcggtggtggactgtaacggcttcacggcggcggccacctccacgggcgggctcatgaacaagatgacgggccgcatcggcgactccccgctcatcggcgccggcacctacgcgtgcgggcactgcgccgtgtcgtgcacgggcgagggagaggccatcatccgctctacgctggcacgggacgtggcggccgtcatggagtacaagggcctcccgctgcaggaggccgtggacttctgcgtcaaggagcggctcgacgaggggttcgccgggctcatcgccgtgtcgggcaccggcgaggtggcatacgggttcaactgcaccggcatgttcaggggctgcgcaaccgaggacggcttcatggaggtcggcatctgggagtgagcaagtgcgcgagctcagccggaggatgtgtccgcactattgtgtgtacatacatttggccatcctgtgattgccatctagttctagtctaggaatcctgggttagtagcactagttccttcataaccatgagctaccgaataaacatgaatatatcgtggaaatcattattg

SEQ ID NO: 1167 - DNA, 1354 bp, Brachypodium distachyon
agcacagcacgcagagcaaaaacagagtaaaaacacgccgtagccaagccaaatctccttcctcaacccacagcttgcccccaaaccaacaaagccaatcttctctcctgatggcgcgttgggcaatcgcgatccacggcggcgcgggagtcgacccgaacctcccggagcaccgtcaggaggaagccaagcgcgtcctggcccggtgcctgcagctcggcgtcgacctgctccgggccggcaccccggcgctcgacgtcgtggaagccgtggtgagggaactcgagtcggacccgtgcttcaactccggccgcgggtccgcgctctcccgctccgggtccgtcgagatggaggccagcatcatggacggccggggccgccgctgcggggctgtttctggggtgtcgaccgtcaaaaaccccgtgtcgctggcccgccgcgtcatggagaagtcgccgcactcgtacctcgcgttcgacggcgccgaggagttcgcccgtgagcaggggcttgaggttgtggacaatagctacttcatcaccgaggagaacgtcggcatgctcaagctcgccaaggaggccaacagcatcctgtttgactaccgtatccctttgaccggcgccgacacgtgcagcgcattggctgctgcctcggagaagaaccacggcgccggcaacggcatggtgatgaacggcctgcccatcagcatctacgcgccggagaccgtcggctgcgccgtcgtcgactcgacgggcgcgtgcgccgcggccacgtcgacgggcgggctgatgaacaagatgaacggccggatcggcgactcgccgctgatcgggtcgggcacgtacgcgtgcaaggcctgcgccgtgtcgtgcacgggggaaggcgaggcgatcatccggtccacgctggcgcgtgacgtggcggccgtgatggagtacaaggggctgccgctccaggaggccgtggactactgcgtcaacgagcggctcgacgaaggctttgccgggctcatcgctgtctctggcaccggggaagtggcctatgggtttaactgtactgggatgttcagaggctgtgccaccgaggatgggttcatggaggtcggcatctgggagtgagccgagctagctctgttgtgtctatccttggagattggagcttgttagctagtgtgcatgcatgtggccatcctgcgattgccgtgtggtggctctagtctgtttattattggggttttagtgctagcagtagtggttgctagtgtgtgattggaggctggattaatatgtttattagatgatgatgatgatgatttgccctgggaaataataatgtgaaaagttctatggcttgt

SEQ ID NO: 1168 - DNA, 1120 bp, Brachypodium distachyon
agcacagcacgcagagcaaaaacagagtaaaaacacgccgtagccaagccaaatctccttcctcaacccacagcttgcccccaaaccaacaaagccaatcttctctcctgatggcgcgttgggcaatcgcgatccacggcggcgcgggagtcgacccgaacctcccggagcaccgtcaggaggaagccaagcgcgtcctggcccggtgcctgcagctcggcgtcgacctgctccgggccggcaccccggcgctcgacgtcgtggaagccgtggtgagggaactcgagtcggacccgtgcttcaactccggccgcgggtccgcgctctcccgctccgggtccgtcgagatggaggccagcatcatggacggccggggccgccgctgcggggctgtttctggggtgtcgaccgtcaaaaaccccgtgtcgctggcccgccgcgtcatggagaagtcgccgcactcgtacctcgcgttcgacggcgccgaggagttcgcccgtgagcaggggcttgaggttgtggacaatagctacttcatcaccgaggagaacgtcggcatgctcaagctcgccaaggaggccaacagcatcctgtttgactaccgtatccctttgaccggcgccgacacgtgcagcgcattggctgctgcctcggagaagaaccacggcgccggcaacggcatggtgatgaacggcctgcccatcagcatctacgcgccggagaccgtcggctgcgccgtcgtcgactcgacgggcgcgtgcgccgcggccacgtcgacgggcgggctgatgaacaagatgaacggccggatcggcgactcgccgctgatcgggtcgggcacgtacgcgtgcaaggcctgcgccgtgtcgtgcacgggggaaggcgaggcgatcatccggtccacgctggcgcgtgacgtggcggccgtgatggagtacaaggggctgccgctccaggaggccgtggactactgcgtcaacgagcggctcgacgaaggctttgccgggctcatcgctgtctctggcaccggggaagtggcctatgggtttaactgtactgggatgttcagaggctgtgccaccgaggatgggttcatggaggtcggcatctgggagtgagc

SEQ ID NO: 1169 - DNA, 1406 bp, Triticum aestivum
cggagcaacaaccaacaaagaacagagtaccatatcaactagccgtagccacacagagagatcgacggaagagccttagctttagccatcgcctagcacagcacaccaccgcaccaccaccagcacctacataagcacgcatggcgcgctgggccatcgccatccacggaggcgcgggcgtggaccccaacctgccggagcaccgccaggaggaggccaagcgcgtgctggcccggtgcctgcaggtcggcgtcgacctgctccgggctggtgcgacggcgctggacgtcgtggaggccgtggtgcgggagctggagacggacccctgcttcaactcgggccgcggctccgcgctcacacgcgccggcaccgtcgagatggaggccagcatcatggacggccgcggccgccgctgcggcgccgtctccggtgtgtccaccgttaaaaaccccgtgtccctggcccggcgcgtcatggacaagtccccacactcctacctcgccttcgacggcgccgaggatttcgcgcgcgagcagggcctggaggttgtggataacagctacttcatcacggaggagaacgtgggcatgctcaagctcgccaaggaggccaacagcatcctcttcgactaccgcatcccgctggcgggcaccgacacttgcagcgcgcaggcagcggcggtggagggccacggcagcaatggcatggtgatgaacgggctgcccatcagcatctacgcgcaggagacggtcgggtgcgcggtggtggactctaacggcttcacggcagcggccacctcgaccggcgggctcatgaacaagatgacgggccgcatcggcgactcgcccctcatcggcgccggcacctacgcgtgcgggcactgcgctgtgtcgtgcaccggcgagggcgaggccatcatccgctccacgctggcgcgggacgtggcggccgtcatggagtacaagggcctcccgctgcaggaggccgtggacttctgcgtcaaggagcggctggacgaggggttcgcggggctcatcgccgtgtccggcaccggcgaggtggcgtacgggttcaactgcaccggcatgttcaggggctgcgccaccgaggacggcttcatggaggtcggcatctgggattgaagtgcgcgagctcagccggagatgtgtccgcatgtagtgtgtgtacatacgtttggtcatcctgcgattgccatctggttttactctaagaatcctcggttactagcactggttacttcaaagccatgagctaccggataataaacatgggactgcctatgcacgacgtgcctcaaaaaagttccatcagtaacttatattgtagaccgtttgatcttcatccaacggttgtaaacaaaactgtcttcttcctcaaaaaaaaaa

SEQ ID NO: 1170 - DNA, 1073 bp, Triticum aestivum
  misc_feature (30)..(30): n is a, c, g, or t
  misc_feature (34)..(34): n is a, c, g, or t
  misc_feature (58)..(58): n is a, c, g, or t
  misc_feature (157)..(157): n is a, c, g, or t
  misc_feature (184)..(184): n is a, c, g, or t
  misc_feature (223)..(223): n is a, c, g, or t
  misc_feature (271)..(271): n is a, c, g, or t
  misc_feature (277)..(277): n is a, c, g, or t
  misc_feature (361)..(361): n is a, c, g, or t
  misc_feature (370)..(370): n is a, c, g, or t
  misc_feature (373)..(373): n is a, c, g, or t
  misc_feature (378)..(378): n is a, c, g, or t
  misc_feature (385)..(385): n is a, c, g, or t
  misc_feature (388)..(388): n is a, c, g, or t
  misc_feature (541)..(541): n is a, c, g, or t
  misc_feature (583)..(583): n is a, c, g, or t
gagagagagagagatccaagtgccttcagncacntagcaacacaccacccccagcacncatacataagcacgcatggcgcgctgggccattgccatccacggcggcgcgggcgtggaccccaacctgccggagcaccgccaggaggaggccaagcgngtgctggcccggtgcctgcaggtgggngtggacctgctgcggtccggcgccgccgcgctggacgtngtggaggccgtggtgcgcgagctggagacggacccctgcttcaactcnggccgnggctccgcgctcacccgcgccggcaccgtcgagatggaggccagcatcatggacggccgcggccgccgctgcggcgccgtctcnggcgtctcnacngttanaaacccngtntccctcgcccggcgcgtcatggacaagtccccgcactcctacctcgccttcgacggcgccgaggatttcgcccgcgagcagggccttgaggttgtggacaacagctacttcatcacggaggagaacatcggcatgctcaagctcgccaaggangccaacaccatcctcttcgactaccgcatcccgctcgccggngccgacacttgcagcgcgctggcggccgcgtcagagaagaacaacagcaacggcatggtgatgaacgggctgcccatcagcatctacgcgccggagacggtgggctgcgcggtggtggactccaacggcttcacggcggccgccacctcgaccggtggtctgatgaacaagatgacgggtcgaatcggcgactcgccgctcatcggcgccggcacctacgcgtgtgggcactgcgccgtgtcgtgcaccggcgagggcgaggccatcatccgctccacgctggcgcgggacgtggccgccgtcatggagtacaaggggctgcctctgcaggaggccgtagacttctgcgtcaaggagcggctcgacgagggtttcgcggggctcatcgccgtgtccggcaccggcgaggtggcgtacgggttcaactgcaccggcatgttccggggctgcgccaccgaggacggcttcatggaggtcggcatctgggagt

SEQ ID NO: 1171 - DNA, 1231 bp, Triticum aestivum
  misc_feature (31)..(31): n is a, c, g, or t
  misc_feature (369)..(369): n is a, c, g, or t
  misc_feature (549)..(549): n is a, c, g, or t
  misc_feature (551)..(551): n is a, c, g, or t
  misc_feature (583)..(583): n is a, c, g, or t
  misc_feature (611)..(611): n is a, c, g, or t
  misc_feature (664)..(664): n is a, c, g, or t
  misc_feature (938)..(938): n is a, c, g, or t
  misc_feature (941)..(941): n is a, c, g, or t
  misc_feature (989)..(989): n is a, c, g, or t
  misc_feature (995)..(995): n is a, c, g, or t
  misc_feature (1116)..(1116): n is a, c, g, or t
  misc_feature (1130)..(1131): n is a, c, g, or t
  misc_feature (1169)..(1169): n is a, c, g, or t
  misc_feature (1195)..(1195): n is a, c, g, or t
caacaagaagagcacagcatcacgtagccgnagcgacagagagagagatccaagtgccttgagccacctagcaacactccacccccagcacacacatacacgcacgcatggctcgctgggccattgccatccacggcggcgcgggcgtggacccgaacctgccggagcaccgccaggaggaggccaagcgcgtgctggcccggtgcctgcaggtgggtgtggacctgctgcggtccggcgccgccgcgctggacgtggtggaggccgtggtgcgcgagctggagacggacccctgcttcaactcgggccgcggctccgcgctcacccgcgccggcaccgtcgagatggaggccagcatcatggatggcnacggccgccgctgtggcgccgtctcgggcgtctctacagttagaaacccggtctccctggcccgccgcgtcatggacaagtccccacactcctacctcgccttcgacggcgccgaggatttcgcccgcgagcagggtcttgaggttgtggacaacagctacttcatcacggaggagaacntnggcatgctcaagctcgccaaggaggccaacancatcctcttcgactaccgcatcccgctngccggggccgacacctgcagcgcgctggcggcggcgacggagaacctcaatancaacggcatggtgatgaacgggctgcccatcagcatctacgcgccggagacggtggggtgcgcggtggtggactcgaacggcttcacggcggcggccacctcgaccggagggctgatgaacaagatgacgggccgcatcggcgactcgccgctcatcggcgccggcacctacgcgtgcggtcactgcgccgtgtcgtgcacgggcgagggcgaggccatcatccgctccacgctggcgcgcgacgtggcggccgtcatggagtacaagggcctnccnctgcaggaggccgtggacttctgcgtcaaggagcggctggacgagggnttcgcngggctcatcgccgtgtccggcaccggcgaggtggcctacgggttcaactgcaccggcatgttccggggctgcgccaccgaggacggcttcatggaggtcggcatctgggagtgagcatgtncgggagctcagccnnagatgtctccgcacgtagtgcgtgtacatacatttggncatcctgcgattgccatctggttctngtctaggaatcctccgtagtagcactggttagctac

SEQ ID NO: 1172 - DNA, 1334 bp, Avena sativa
gagcacaacctcggcgtagagtcacagagatccaagagcctagtagtatttcctagcacagcacacccccaatcgccacccacacacaaatgggtcgctgggccattgccatccacggcggcgccggcgtcgaccccaacctcccggagtaccgccaggaggaggccaagcgcgtcctggcccgctgccttcaggtcggagtggacctgctccgcgccggctcccccgcgctggatgtggtggaggccgtggtgcgtgagctggagacggacccctgcttcaactctggccgaggctccgcgctcacccgcgccggcaccgtcgagatggaggccagcatcatggacgggcgcggccgccgctgcggcgccgtctccggcgtgtccaccgtcaggaaccccgtctccctcgccaggcgcgtcatggagaagtcgccccactcctacctcgccttcgccggcgccgaagatttcgcccgcgaccagggtcttgaggttgtggacaattcctacttcatcaccgaggagaacgtcggcatgctcaagctcgccaaggaggccaacaccatcctgtttgattaccgcatcccgctggaggacacctgcagcgcgctggcggccgcatcggagaaccacgccagcaacggcatggtcatgaacgggctgcccatcagcatctacgcgcaagagaccgtggggtgtgctgtcgtcgactccagcggcttcaccgccgcggccacctcgaccggcggtctcatgaacaagatgacgggccgcatcggggactcgcctctcatcggagcggggacctacgcctgcaacctctgcgcggtgtcgtgcacgggcgaaggcgaggccatcatccgctgcacgctggcgagggacgtcgcggccgtcatggagtacaaggggctccccctgcaggaggccgtggatttctgcgtcaaggagcggcttgacgaggggttcgcggggctcatcgccgtgtctggcactggagaggtggcgtacgggtttaactgtactggcatgttcagggggtgtgccacccaggatgggttcatggaggtcggtatctgggagtgagcgagcgagcgacgatttagaactggtcgaataatgtaaattgtgtgtgcgtttgtgtgagcctttggccatcttgcaagatctccatatgtggttctactctagtgatcagtggtttgtagctactagctagtggattagaatcagtggcggtgctagggagacgagcagggtccatgccacccaccccttatgacatgctaaaacaatgcattttttatacataaggttggattagaagcaattttt

SEQ ID NO: 1173 - DNA, 1287 bp, Oryza sativa
atcgcaacgcacgcacaattcacagcaacacaagcagaagcacagtagaacgcctaggaaatactacgtcgatggcgaggtgggccattgcgatccacggcggcgccggggtggacccgaacctgccggagcacaggcaggaggaggcgaagcgcgtgctggcgcggtgcctgcaggtgggcgtggacgcgctgcgctccggcgcggcggcgctggacgtcgtggaggccgtggtgcgggagctggagagcgaccccttcttcaactccgggaggggctccgcgctcacccgcctcggcaccgtcgagatggaggccagcatcatggacggccgcggccgccgctgcggcgccgtctccggcgtctccaccgtcaagaaccccgtctccctcgcccgcctcgtcatggacaagtccccccactcctacctcgccttcgacggcgccgagcagttcgcgcgcgaccagggtctagaggtcgtcgacaacagctacttcatcaccgaggacaacgtcggcatgctgaagctcgccaaggaggccaacagcatcttgtttgactaccgtatcccgctgtccgggtcggagacgtgcggcgcacaggccgtgtcgtcggacaacagccacggcaacggcatggtgatgaacggcctccccatcagcatctacgcgccagagacggtggggtgcgcggtggtggactccagcggccacaccgcggcggccacgtccacgggcgggctgatgaataagatgacggggcgcatcggcgactcgccgctgatcgggtcggggacctacgcgtgcggcgcgtgcgcggtgtcgtgcacgggggaaggcgaggccatcatccgctccacgctcgcgcgcgacgtcgccgccgtgatggagtacaggggcgccgggctgcaggaggccgtcgactactgcgtcaagaagcggctcgacgaagggttcgcggggctcatcgccgtgtccagcacgggcgaggtggcgtacgggttcaactgcaccggcatgttcagagggtgcgccaccgaggacggattcatggaggtcggcatctgggagtgaggtgggcagcctttgtgcgtgcgtgcgtgggcctgtggccatcatgcgattgccatagagtggtgtcttggggtcatgggccgcctcccgtgtgttcgtgggctagaattagtgggtattaattagtggattggggagattggaggtgggcttgaataatgacgatgatggcgataattcgtctggaaataataatgtgaaaagttatattgct

SEQ ID NO: 1174 - DNA, 1287 bp, Avena sativa
ggtcgctgggccattgccatccacggcggcgccggcgtcgaccccaacctcccggagtaccgtcaggaggaggcgaagcgcgtcctggccaggtgcctgcaggtcggcgtggacctgctccgcgccggctcccccgcgctggacgtggtcgaggccgtggtgcgtgagctggagacggatccctgcttcaactcgggccggggatccgcgctcacctgtgccggcaccgtcgagatggaggccagcatcatggacggccgcggccgccgctgcggcgccgtctccggcgtgtccaccgtcaagaaccccgtctccctcgcgcggcgcgtcatggagaagtcgccccactcttacctcgccttcgccggcgccgaagatttcgcccgcgaccagggccttgaggttatggacaacagctacttcatcaccgaggagaacgtcggcatgctcaagctcgccaaggaggccaacaccatcctgttcgactaccgcatcccgctggaggacacctgcagcgcgctggcggccgcatcggagaaccacaccagcaacggcatggtcatgaacgggctgcccatcagcatctacgcgcaagagaccgtggggtgcgccgtcgtcgactccaacggcttcaccgccgcggcaacgtcgaccggcggtctcatgaacaagatgacgggccgcatcggggactcgccgctcatcggagcggggacctacgcgtgcaacctctgcgctgtgtcgtgcacgggcgaaggcgaggccatcatccgctccacgctggcgagggatgtcgcggccgtcatggagtacaaggggctaccgctgcaggaggccgtggacttttgtgtcaaggagcggctcgacgaggggtttgcggggctcattgctgtgtctgggacaggagaggtggcgtacgggttcaattgtactggcatgttcaggggttgcgccaccgaggacgggttcatggaggtcggtatctgggagtgagcgagcgacgatctacaactgctcgaataatgtaaattgtgtgttcgtttgtgtgagcctttggccatcttgcaagatctccatgtggttctactctagtgatcagtggtttgtagctactagctagtggattggaatcactagcggtgctagggagacgagcaggggccatgcaccccaaccccctatgacatgctaaaacaatgcaatttttatacttaaggttggattagaatcattttttagagaaaattgtcatggtcggcgtccctaatggatgattaccaagtttgg

SEQ ID NO: 1175 - DNA, 1079 bp, Hordeum vulgare
caagcagagcaacaccaacaccaagaagaagaagagcaagcagagcatcacgtagccacagcgacaccgagaggtcgagacccatcgaagcgccttccgccacctagcacagcacaccaccaccgtcacatggcgcgctgggccattgccatccacggcggcgcgggcgtggacccgaacctgccggagcacaggcaggaggaggccaagcgggtgcttgcccggtgcctgcaggtcggcgtcgacctgctgcgcgccggcgccaccgcgctggacgtggtggaggccgtggtgcgggagctggagacggacccctgcttcaactcgggccgcggctccgcgctcacccgcgccggcaccgtcgagatggaggccagcatcatggacggccgcggccgccgctgcggcgccgtctccggcgtctccaccgtccgtaaccccgtctccctcgcccggcgcgtcatggacaagtccccacactcctacctcgccttcgacggcgccgaggatttcgcccgcgagcagggtcttgaggttgtggacaacagctacttcatcacggaggagaacgtgggcatgctcaagctcgccaaggaggccaacaccatcctcttcgactaccgcatcccgctcgccggggccgacacctgcagcgcgcaggcggcggcgaccgagaaccacaacaacaacggcatggtgatgaacgggctgcccatcagcatctacgcgccggagacggtggggtgcgccgtggtggactgtaacggcttcacggcggcggccacctccacgggcgggctcatgaacaagatgacgggccgcatcggcgactcgccgctcatcggcgctggcacctacgcgtgcgggcactgcgccgtgtcgtgcacgggcgagggcgaggccatcatccgctccacgctggcgcgggacgtggccgccgtgatggaatacaaggggctgcctctgcaggaggccgtggacttctgcgttaaagagcggctcgacgaggggttcgccgggctcatcgccgtgtccggcccggcgaggtggcatacgggttcaactgcaccggcatgttc

SEQ ID NO: 1176 - DNA, 1156 bp, Saccharum officinarum
agctacctagctagaggacacgagacacgatggccttgcaggtcaccggcggcgtgggctgctgctgccctcgtcctctcccgggcagtggcggccggcggttggcgcaggcggcggcgctctgtctcccgccccgcgcggtagcgtccggcgcgaccacggtggtggaggaggacgagggcaaggtgaggctgggcggctcaagcgtcgcggtcaccaagctcggcatcggcgcgtggtcctggggcgacaccacctactggaacgactccgagtgggacgataggagactgagggaggcacaggacgcgttcgatgcgagtatcgataacgggatgaccttcttcgataccgcagaagtatacggtacagcactgatgggagcggtcaattctgagagtttactgggaggattcatcaaggataggcaacagaaggaacaggtcgaggtggccgtcgcaacaaagttcgctgcccttccttggagatttggaaggggtagtgttctttccgcgctgaagaaatcactagaccgtcttggcctatcgtcagttgagctctaccaactccactggccagggatttgggggaacgaaggataccttgatggcctcgcagatgcttatgagcaaggcctagtaaaggctgttggagtctcaaactacaatgagaagcgccttcgggatgcacatgctcgcctgaagaagaggggggttccacttgctgcaaaccaggtgaattacagcctcatatacagaacccctgagctgaatggtgtgaaggcagcttgtgatgagctcggtatcaccttgattgcttattccccgattgcccaaggtgttctgacaggtaagtatactcctgaaaaaccccctactggtcctcgagcaaatacatacacacctgagttcctcaccaagctccaaccacttatgaacaggattaaagagattggagcaagctatggcaagagtccaacccaggtgtctctgaactggctgacctgccaggggaacgtggtgccaatccccggagccaagaatgccagccaggccaaggagttcgccggtgcactcggttggagcctgacaggagacgaggtcgaagagctacgaactctggcacgcgaaatcaagggcatcaagatgcccatcga

SEQ ID NO: 1177 - DNA, 1554 bp, Zea mays
acacgcaaacacgcacacacaccgtacccctcagctcgcgccaccggccaccgcacacagaacgcgtgctccgtccgtcctccctctgcctcgcgcgcgcagggttagcgtgagctgatcgagcaacgagagctagctagctagaggacacgacacgatggccttgcaggtcaccggcggcgtgggctgctgctgccctccgggcagtgcccggcggttgccgcaagcggcggcgctgtgtcgcccgccccgcgcggtagtgtccggcgcaaccagggtggtggaggaggacgagggcaaggtgaggctgggcggctcaggcgtcgcggtcaccaagctcggcatcggcgcgtggtcctggggcgacaccacctactggaacgactccgagtgggatgataggagactgagggaagcacaggacgcgttcgatgcgagcatcgataacgggatgaccttcttcgatactgcagaagtttacggtacagcactgatgggagcagtcaattctgaaactttactaggaggattcatcaaggaaaggcaacagaaggaccagatcgaggtgtccgttgcaacaaagttcgctgcccttccttggagatttggaaggggtagcgttctttcggcgctgaagaaatcgctagaccgtctaggcctagcgtctgtcgagctctatcaactccactggccagggatttgggggaacgaaggatatcttgatggtctcgcggatgcttatgagcaaggcctagtcaaggctgttggagtctcaaactacaatgagaagcgccttcgggatgcacatgctcgcctgaagaagcggggggttccacttgctgcaaaccaggtgaactacagcctcatatatagaacccctgagttgaatggcgtgaaagcagcatgtgatgagctcggcatcaccttgattgcttattccccgatagcgcaaggtgttctgacaggtaagtacactccagaaaacccccctactggtcctcgagcaaacacatacacccctgagttcctcgccaagctccaaccacttatgaacaggattaaagagatcggagcaagctatggcaagagtccaacccaggtgtctctgaactggctgacctgccaggggaacgtggtgccaatccccggagccaagaatgccagccaggccaaggagttcgccggtgcactcggctggagcctgacgggggacgaggtggaagagctacggactctggcacgcgagatcaagggcatcaggatgcccatcgaggagtcgtagatactctgtatttcaccaacccatgtcgtagcaggcgctgacggagaagacgacgcaaggatctagaaataaaccaggttgtgtaagtagaatagcttccaacgaatctcaggcctaagcattgtaagtatgcaatattcatttgccgaaaccagggctgtacctctgctgcctgttctctgctgaaaaaaaagttaggatggaaagatagagactattgtgccgcaaaacaacacaaaggaaattactgaaaatgaaagaaaagttacaac

SEQ ID NO: 1178 - DNA, 1326 bp, Panicum virgatum
cagaggagagagcgtcgcgtacctcctgcctcgcgcgcgcgcgctcggtgagctagtgagcgagtggtctgatcgagcagcgagcgagcgcgcgatggccttgcaggttaccggcggcgtgacctgccgctgccctcctgcgctccccggcggcggcgggtggcgggcgcgctgccgcccgccccgcgcggtggcgtccggcgcggcggcggcggtcgaggagggcgagggcaaggtgcggctgggcgagtccggcgtcgccgtcaccaagctcggcatcggcgcctggtcctggggcgacaccacctactggaacgactccgagtgggacgataggagactgaaggaggcacaggaggcgttcgatgcgagtatcgataacgggatgaccttcttcgacacagcagaagtgtacggtacagcgctgatgggagcagtcaactctgaaagtttactaggaggattcatcaaggaaaggcaacagaaggagcagattgaggtcgctgtcgcaacaaaattcgctgcccttccatggagatttggccgaggaagcgttctttctgcactcaagaaatcgctagaccgtcttggcctgtcctctgtggagctctaccaacttcactggccagggatatgggggaatgaagcgtaccttgatggcctggcggatgcttatgagcaaggccttgtaaaagccgttggagtctcaaactacaatgagaagcgccttcgggatgcacatgcacgcctgaagaagaggggtgttccacttgctgcaaaccaggtgaattacagcctgatatacagaactccggagttgaatggtgtgaaagcagcttgtgatgagctcggcatcaccttgattgcctattccccaatagcccaaggtgttctgacagggaaatacactccagaaaatccccctactggcccacgagcaaatacatacactcctgaattcctcaccaagctccaaccacttatgagcaggatcaaagagattggagcaagctacggcaagagtccaacccaggtgtctctgaactggctgacctgccaggggaacgtggtgccgatccccggggccaagaatgctagccaggccaaggagttcgccggcgctctcgggtggagcctgaccggcgacgaggtcgaagagcttcgaactctggcgcgcgagatcaaaggcatcaagatgcccatcgaagagtcataaattttctgcatttcatcctccaatggtatatcgctgataggagattaacgtttttaagagagaaaaaaatgctatgatgcagaaatgaacagaagttgcatacaacatgt

SEQ ID NO: 1179 - DNA, 1348 bp, Oryza sativa
ctcgagccagcagcaacacgcacgcacgcaccacacacgtagcagcagagcaatggcggcggccatggcgctgcaggtggtggccggcggcggctgctgttgccagcggcccgttcttggagctggtcggcggcggttggcggcggcgcgtgcggtggcgtcggacgcggcggcggcgaaggtgagcgaggaggaggggaaggtgaggctgggtgggtcggaagtggcggtgagcaagctcggcatcggcgcctggtcgtggggggacaccacctactggaacgactccgagtgggacgacaggagactgcaggaggctaaagcagcatttgacacaagcatagataatgggatgaccttatttgatacagcagaagtttatggtacagcgctgatgggagcagtaaattctgaaagtttactcggaggtttcatcaaggaaaggcaggagaaagaacagattgatgttgccgtcgcaacaaagtttgctgcacttccatggagatttggccgaggaagtgttctttccgcactgaagaaatcgcttgaccgtcttgggttatcttcagttgagctctaccaacttcattggccagggctatggggaaatgaagggtatcttgatggacttgcagatgcctatgagcaaggccttgtaaaggctgttggagtctcaaactacaatgagaaacgccttcgggatgcatatgcgcggatgaagaaaagaggagttccacttgctgcaaaccaagtgaactacagcctaatatacaggactcctgagttgaatggtgtgaaggcagcttgtgatgagcttggcatcaccctgattgcttattccccaatagcccaaggtgttctgtcaggaaaatacactccagaaaaacctcctaccggtcctcgagcaaacacatatacccctgagttcctcaccaagcttcaaccactcatgaacaggatcaaggagattggagaaagctatgggaagaacccaacccaggtttcactgaactggctgacatgccaaggcaatgtggtgccaatccccggagccaagaacgccggccaggcgcaggagttcgccggcgcgctcggctggagcctcaccggcgacgaggtcgaagagttgcggtctctggcacgcgagatcaagggcatcaagatgcccatcgaggagtcatagacatgtaaaaactgaagaagtttttcatgtatatgataggagatgtgtattgattgtaccatgcaatagtaaacattttacggcgataaaatgtgtagaaggtgtagaaaatgagtcagaaatttctgcctgcatgaatagaaaaggtttatatgactttgagcc

SEQ ID NO: 1180 - DNA, 1384 bp, Triticum aestivum
cgacccacgcgtccggagagctctttaagagatcgagtggtggctggtgcctcagcggccgagcaagcgagcgagcgagcaaagtacagtactagctggtggagcttgcaactagctaggaatggcttcgctgcaggtcggcgccggccgcggcgtgggttgctgcttcggcccgctggacggccggcggcaggagaggagagcgacggcggcgctgcgaccgccgagggcgggtgcgggggcgaaggtggcggaggaggacaaggtgaggctgggcgagtccagcgtggcggtgagcaagctcggcatcggcgcgtggtcgtggggcgacaccacctactggaacgactccgagtgggacgacaggagactgaaggaggctaaagcagcattcgacgccagcatcgacaacggaatgactttctttgacaccgccgaagtatacggcacagcgctcatgggagcagtgaattcagaaagcctactgggagatttcatcagggagaggcagcagaagggggcggtggaggtgaccgtggccaccaagtttgcggcgctgccctggaggttcggacgtggcagcgtcctctcggcgctcaagaagtcgctggagcgcctgggcctcccctccgtcgagctctaccagctccactggccagggctatggggaaacgaagggtaccttgatggcctggcggacgcgtacgagcaaggtctcgtcaaggccgtcggagtctccaactacaatgagaaacgcctccgggacgcacacgcgcggctcaagaagaggggcgtcccgctggccgtgaaccaggtgaactacagcctcatctacaggacgcccgaggagaacggcgtcaaggctgcctgcgacgagctcggcgtcacgctcatcgcctattcccccatcgcccaaggtgttctgtcagggaaatacactccggagaatccacccacgggtcctcgggggaatacctacactcccgagttcctcgccaagctccaaccgctgatgaacaggatcaaagagattggagtaagctatggcaagaaaccaactcaggtgtctctcaactggctgacctgccagggcaacgtggtgcccatcccgggggccaagaacgccgggcaggcaatggagttcgccggtgcacttgggtggagcctcaccgccgacgaggtcgaggagctgcggaccctcgcgcgcgagatcaagggaatcaagatgcccatcgaggagtcatgatgcgttggattagatgacatcacttctactcttgtaccaggtggtgtacgtccacatgagccatcgcgaccccatgtagtacaacaagtagatgtagaaataaataagagcaacttcaaccgggcgacctacaaaaac

SEQ ID NO: 1181 - DNA, 1433 bp, Leymus cinereus x Leymus triticoides
  misc_feature (275)..(275): n is a, c, g, or t
  misc_feature (1021)..(1021): n is a, c, g, or t
  misc_feature (1081)..(1081): n is a, c, g, or t
  misc_feature (1183)..(1183): n is a, c, g, or t
gccaaacatattagttaagccccagcgcaacggccgatcgagctgagagctctttaagagatcgagtggtggctggtggctcagcggccgagcgagcgagcgagcaaagtgcagtactgactggagctcgcaactaggaatggcttcgctgcaggtcggcgccggccgcggcgtgggttgctgcttcggcccgctggacggccggcggcaggagaggagagcgatggcggcgctgcgaccgccgagggcggcggcggcgggtgcgggggcgaagntggcggaggaggacaaggtgaggctgggtgagtccagcgtggcggtgagcaagctcggcatcggcgcatggtcgtggggcgacaccacctactggaacgactccgagtgggacgacaggagactgaaggaggctaaagcagcattcgacgccagcatcgacaacggaatgactttctttgacaccgccgaagtatacggcacagcgctcatgggagcagtgaattcagaaagcctactgggagatttcatcagggagaggcagcagaaggggccggtggaggtgaccgtggccaccaagtttgcggcgctaccctggaggttcggacgtggcagtgtcctctccgcgctcaagaagtcgctggagcgcctcggcctcccctccgtcgagctctaccagctccactggccagggctatggggaaacgaagggtaccttgatggcctggcggacgcgtacgagcaaggtctcgtcaaggccgtcggagtctccaactacaatgagaaacgcctccgggacgcacacgcgcggctgaagaagaggggcgtcccgctcgccgtcaaccaggtgaactacagcctcatctacaggacgcccgaggagaacggcgtcaaggccgcctgcgacgagctcggcgtcacgctcatcgcctattccccaatcgcccaaggtgttctgtcagggaaatacactccggagaatccacccacgggtcctcgagggaatacctacactcccgagttcctnaccaagctccaaccactcatgaacaagatcaaagagattggagtaagctatggcaagaanccaactcaggtgtctctgaactggctgacctgccagggcaacgtggtgcccatcccgggggccaagaacgccggccaggcaatggagttcgccggtgcactngggtggagcctcagcgctgacgaggtcgaggagctgcggaccctcgcgcgcgagatcaagggaatcaagatgcccatcgaggagtcatgatgcactggatgacatcacttctactcttgtacctggtgtacgtccacataatccatccatcgcaaccccatgtagtagaacaagtaggtgtagacgataaataaagggaaacgtttatatccggtcgaccggttgagttttctgccggtcgcaccgctca

SEQ ID NO: 1182 - DNA, 1523 bp, Hordeum vulgare
caacggccgatcgtgctgggagctctttaagagatcgagtggtggctggtggctcagcggccgagcgagcagagtacagtagtcggagctcgcaagtcgcgactaggaatggcttcgctgcaggtcggcgccggccgcggcgtgggttgctgcttcggcccgctggacggccggcggcaggagaggagagcgacggtggcgctgcgaccgccgagggcggcggcggcggcgggtgcgggcgcgaaggtggcggaggaggacaaggtgaggttgggcgagtccagcgtggcggtgagcaagctcggcatcggcgcatggtcgtggggcgacaccacctactggaacgactccgagtgggacgacaggagactcaaggaggctaaagcagcattcgacgccagcatcgacagcggaatgactttctttgacaccgccgaagtatacggcacagcgctcatgggagcagtgaattcagaaagcctactaggagatttcatcagggagagacagcagaagggagcggtggatgtgaccgtggccaccaagtttgcggcgcttccctggaggttcggacgtggcagcgtcctctccgcgctcaagaagtcgctggagcgcctcggcctcccatccgtcgagctctaccagctccactggccagggctatggggaaacgaagggtaccttgatggcctggcggacgcgtacgagcaaggtctcgtcaaggccgtcggagtctccaactacaatgagaaacgcctccggaacgcacacgcgcggctcaagaagaggggcgtcccgctcgccgtcaaccaggtgaactacagcctcatctacaggacgcccgaggagaatggcgtcaaggccgcctgcgatgagctcggcgtcacgctcatcgcctactcccccattgcccaaggtgttctatcagggaaatacactccggagaatccaccaacgggtcctcgggggaacacctacacccccgagttcctcaccaagctccaaccactcatgaacagaatcaaagagattggagtaagctatggcaagaacccaactcaggtgtctctgaactggctgacttgccagggcaacgtggtgcccatcccgggggccaagaacgccgggcaggcaatggagttcgccggtgccctcgggtggagcctcaccgccgacgaggtcgaggagctgcggaccctcgcgcgcgaaatcaagggaatcaagatgcccatcgaggagtcatgatgcattggaggacatcacttctactcttcgtgtacgtgttatacgtccacgtgatccatccatagcaaccccatatgtagtagaacaagtagatgtaaccgcatgggacatgtggttaggccaaactccaacgtgcgactccaaaaaaaacttatatttttatccgtttggatcagaaataagactgttgtttggcccttttgtccagcgtgccggagcaaatttggccggagcccaaccaacagtcatatttcatcccgcccttttgtaagaaaaag

SEQ ID NO: 1183 - DNA, 1553 bp, Hordeum vulgare
caacggccgatcgtgctgggagctctttaagagatcgagtggtggctggtggctcagcggccgagcgagcagagtacagtagtcggagctcgcaagtcgcgactaggaatggcttcgctgcaggtcggcgccggccgcggcgtgggttgctgcttcggcccgctggacggccggcggcaggagaggagagcgacggtggcgctgcgaccgccgagggcggcggcggcggcgggtgcgggcgcgaaggtggcggaggaggacaaggtgaggttgggcgagtccagcgtggcggtgagcaagctcggcatcggcgcatggtcgtggggcgacaccacctactggaacgactccgagtgggacgacaggagactcaaggaggctaaagcagcattcgacgccagcatcgacagcggaatgactttctttgacaccgccgaagtatacggcacagcgctcatgggagcagtgaattcagaaagcctactaggagatttcatcagggagagacagcagaagggagcggtggatgtgaccgtggccaccaagtttgcggcgcttccctggaggttcggacgtggcagcgtcctctccgcgctcaagaagtcgctggagcgcctcggcctcccatccgtcgagctctaccagctccactggccagggctatggggaaacgaagggtaccttgatggcctggcggacgcgtacgagcaaggtctcgtcaaggccgtcggagtctccaactacaatgagaaacgcctccggaacgcacacgcgcggctcaagaagaggggcgtcccgctcgccgtcaaccaggtgaactacagcctcatctacaggacgcccgaggagaatggcgtcaaggccgcctgcgatgagctcggcgtcacgctcatcgcctactcccccattgcccaaggtgttctgtcagggaaatacacgccggagaatccaccaacgggtcctcgggggaatacctacactcccgagttcctcaccaagctccaaccactcatgaacagaatcaaagagattggagtaagctatggcaagaacccaactcaggtgtctctgaactggctgacctgccagggcaacgtggtgcccatcccgggggccaagaacgccgggcaggcaatggagttcgccggtgccctcgggtggagcctcaccgccgacgaggtcgaggagctgcggaccctcgcgcgcgaaatcaagggaatcaagatgcccatcgaggagtcatgatgcattggaggacatcacttgtactcttcgcgtacgtgttatacgtccacgtgatccatccatagcaaccccatatatagtagaacaagtagatgtaaccgcatgggacatgtggttaggccaaactccaacgtgcaggctccaaaaaaaacttatatttttatccgtttggatcagaaataagactgttgtttggcccttttgtccagcgtgccggagcaaatttggccggagcccaaccaacagtcatatttcatcccgcccttttgtaagaaaaagataaaccaattaatccacggtcaccgcca

SEQ ID NO: 1184 - DNA, 1493 bp, Triticum aestivum
  misc_feature (132)..(132): n is a, c, g, or t
  misc_feature (773)..(773): n is a, c, g, or t
gcgccaaccaagccgcaggccctctccctgttcctcctcgtcccctctcctcctggccagacaaactagttaagccccagcgcaacggccgatcgagctgagagctttttaagagatcgagtggtggctggnggctcagcggccgagcgagcgagcaaagtacagtactagctggagcttgcaactagctaggaatggcttcgctgcaggtcggcgccggccgcggcgtgggttgctgcttcggcccgctggacggccggcggcaggagaggagagcgatggcggcgctgcgaccgccgagggcgggtgcgggggcgaaggtggcggagggggacaaggtgagactgggcgagtccagcgtagcggtgagcaagctcggcatcggcgcctggtcgtggggcgacaccacctactggaacgattccgagtgggatgacaggagactgaaggaggctaaagcagcattcgacgccagcatcgacagcggaatgactttctttgacaccgccgaagtatacggcacagcgctcatgggagcagtgaattcagaaagcctactgggagatttcatcagggagaggcagcagaagggggcggtggaggtgaccgtggccaccaagtttgcggcgctaccctggaggttcggacgtggcagtgtcctctccgcgctcaagaagtcgctggagcgcctcggcctcccctccgtcgagctctaccagctccactggccagggctatggggaaatgaagggtaccttgatggactggcggangcgtacgagcaaggtctcgtcaaggccgtcggagtctccaactacaatgagaaacgcctccgggacgcacacgggcggctcaagaagaggggcgtcccgctggccgtcaaccaggtgaactacagcctcatctacaggacgcctgaggagaacggcgtcaaggccgcctgcgacgagctcggcgtcacgctcatcgcctattcccccatcgcccaaggtgttctgtcagggaaatacactccggagaatccacctacgggtcctcggggtaatacctacactcccgagttcctcaccaagctccaaccactgatgaacaggatcaaagagattggagtaagctatggcaagaacccaacacaggtgtctctcaactggctgacctgccagggcaacgtggtgcccatcccgggggccaagaacgccggccaggcaatggagttcgccggtgcactcgggtggagcctcaccttcgacgaggtcgaggagctgcggaccctcgcgcgcgagatcaagggaatcaagatgcccatcgaggagtcatgatgcattggattatatgacatcacttctactcttgtacaacttgtacaacttgtacctggtgtacgtcgacgtcgacatgatccattgcaaccccatctagtagaagaagtagatgtagacgataaataaagtgatcgcaaagaaaaaagacgataaataaaggacacgaatacg

SEQ ID NO: 1185 - DNA, 1598 bp, Avena sativa
cacagactaatctccaccacagcaagctagcgatcgagctgattagctgagcttagaggaggtccaccgccacgtacgacgagtggtgctggtggctcaacgcaaccgagtgatatatagtacctagtgtgtgcacaagcacaactgcagatcgatcgagtgtagtagctagccaggtagagagctgtacgtcaaggatcgatggcttccttgcaggtcgccgccggcggtggagtggggtcctgcttcggcccgttgaacggcggccggcggcgggcgaggagggcagtgttgcggccgccgagggcgtcggcggcggtggcggaggaccaggagaaggtgaggctgggcgagtctagcgtggcggtgagcaagctcggcatcggcgcttggtcgtggggcgacaccacctactggaacgactccgagtgggacgacaggagactgaaggaggctaaagcagcgttcgacgccagcgtcgacagcgggatgacattctttgacaccgcggaagtatacggcacggcgctcatgggagccgtgaattcagaaagcctactgggagatttcatcagagagaggaagcagcaggggccggtggacgtgacggtggcgaccaagttcgcggctctcccgtggaggttcggccgcggcagcgtcctctccgcgctcaagaagtcgctggaacgcctcggcctcccctccgtcgagctctaccagctccactggccagggctatggggaaacgaagggtaccttgatggcctggcagacgcgtacgaccaaggtctcgtgaaggctgtcggggtctccaactacaatgagaaacggctccgggacgcgcatgcgcggctcaagaagaggggcgtcccgctcgccgtcaaccaggtgaactacagcctcatctacaggacgcctgaggagaacggcgtcaaggccgcctgtgacgacctcggcgtcacgctcatcgcctactccccaatcgcccaaggtgttctgtcggggaaatacactccggagaacccgcccacgggtcctcgagggaatacatacactcccgagtttctcaccaagctgcaaccactcatgaacagaatcaaagagattggagcgagctacggcaagaacccaactcaggtgtctctgaactggctgacctgccagggcaacgtggtgccgatcccgggggcaaagagcgccgggcaggccatggatttcgccggggcgctggggtggagcctcaccgtcgacgaggtcgaggagctgcggaccctcgcgcgcgagatcaagggcatcaagatgcccatcgaggagtcgtgatggaccatcacttcttgtcctgtactctactagtagtacctcgtgttaacatgcattgcatgattgatcatcccaagttcccaacccatgtatctagtagaagtagatgtagaaaataagtaaatcgggcaggagtttcaggcagtgccacacagttttctgtcaaattgacatcattagcaaaatggctgtgatctgtgggtaccaacataaggttttgctaattctaaatcgtctgagatcactggagtccaagtcgacccctgcaaaaaaaaaaa

SEQ ID NO: 1186 - DNA, 1466 bp, Festuca arundinacea
  misc_feature (482)..(482): n is a, c, g, or t
  misc_feature (542)..(542): n is a, c, g, or t
  misc_feature (567)..(567): n is a, c, g, or t
  misc_feature (576)..(576): n is a, c, g, or t
  misc_feature (578)..(578): n is a, c, g, or t
  misc_feature (617)..(617): n is a, c, g, or t
  misc_feature (635)..(635): n is a, c, g, or t
  misc_feature (658)..(659): n is a, c, g, or t
  misc_feature (662)..(663): n is a, c, g, or t
  misc_feature (665)..(665): n is a, c, g, or t
ggcacgaggcaccacagcaagcgagctgatcagctgagcttcgaggaggtccaccgccacgtacgagtggtgccgctggctcaccgagtgatatatacgcccggccggtgtgtccgtgtgtgcacaagcacagctgcagatcgagtgtggtagccagatcaacacagagctgccaaggatccatggcttcgttgcaggtcggcgccggcggtggcgtggggttctgcttcggcccgttggacggcggccggcggcgggcgaggagggcagtgctgcggccgccgagggcgtcggcgacggtggcggaggatcaggagaaggtgaggctgggcgagtctagcgtggcggtgagcaagctcggcatcggcgcatggtcgtggggcgacaccacctactggaacgactccgagtgggacgacaggagactgaaggaggctaaagcagcgttcgacgccagcgtcgacagcgggatgaccttcttngacaccgctgaagtatacggcacggcgctcatgggagcagtgaattcagaaagtctactnggagatttcatcagagagaggaagnagcaggggncngtggacgtgacggtggcgaccaagttcgcggcgctcccntggaggttcggccgcggnagcgtcctctccgcgctcaaganntcnntngaacgcctgggcctcccctccgtcgagctctaccagctccactggccggggctatggggaaatgaagggtaccttgatggcctggctgacgcttacgaccaaggtctcgtcaaggctgtcggagtctccaactacaatgagaaacggctccgggacgcgcacgcgaggctgaagaagagaggcgtcccgctcgccgtcaaccaggtgaactacagcctcatctacaggacgcccgaggagaacggcgtcaaggccgcctgcgacgagcttggcgtcacgctcatcgcctattctccaatcgcccaaggtgttctgtcggggaaatacactccggagaacccgcctacgggtcctcgaggaaatacatacactcccgagtttctcaccaagctccaaccactcatgaacagaatcaaagagattggagtgagctacggcaagaacccaactcaggtgtctctgaactggctgacctgccagggcaacgtggtgccgatcccaggggcgaagaacgccgggcaggccatggagttcgccggcgcgctcgggtggagcctcaccgccgacgaggtcgaggagctgcggaccctggcgcgcgagatcaaaggcatcaagatgcccatcgaggagtcgtgatggatcatcacttcttgtactgtaccacgtgtcattgtgcatcgcaggattgatcatcccaacccacgtagtagaagtagatatgtagaaataaacaaaccgggcaagtttcagccggtgccagccagttttctgttaaattgacattgttggcaaaatgactga

SEQ ID NO: 1187 - DNA, 1492 bp, Brachypodium distachyon
gttaaaacctgccagctgctcatctgccactcgtggctcggtgactcggtgagtgtgcagcaaagagcggagctagctaggctgtccgtgcgtgaagatggccgccgcttggtcgatgcaggtcggcggcggctgccgctgctctttcggcggccggagagcggcgtcggggaaagcggtgcggcggctgccggtgataagggcgtcggcggcgaaggtggaggaggaggagaaagtgaggctgggggagtcgagcgtggcggtgagcaagctggggatcggggcttggtcctggggcgacacaacttactggaacgactccgaatgggatgacaggaggctcaaggaggcgaaagccgcgttcgacgccagcgtcgacaacgggatgaccttcttcgacaccgccgaagtctacggaacagcgctcatgggggcagtcaactcagagagcctactgggagatttcatcagggagaggaaggagaagggcgaggtggacgtggtggtggccaccaagttcgccgcgctgccatggcggttcggccgcggcagcgtcctttccgcgctcaagaactccctcggccgcctcggcctcccctccgtcgagctctaccagctccactggccagggctatggggcaacgaagggtaccttgacgggctggcggacgcgtacgagcaaggactggtgaaggccgtgggggtctccaactacaacgagaagcgtctccgggacgcgcacgcgcggctgaagaagcgcagggtgccgctggcggcgaaccaggtgaactacagcctcatctaccggacgccagagctcaacggcgtcaagcaagcctgcgacgaactcggcgtcacactcatcgcatactccccaatcgcacaaggtgttctgtccgggaagtacactccggagaagcctccgacggggcctcgagggaacacatacaccccagaattcctcaccaagctccaaccgctgatgaacaggatcaaagagatcggagcaagctacggcaagaacccgacccaggtgtctctgaactggctggcgtgccagggcaacgtggtgccgatcccgggggcgaagaacgccgtgcaggccatggagttcgccggggcgctcggctggagcctcaccgccgacgaggtcgaggagctcaggacgctcgcccgcgagatcaagggaatcaagatgcccatcgaggagtcatgatcgaattgagtgctcgatcgatgctccggccgccgtccgatcaccatattcatgatcggctcttgcaccgctgcttattagcaacctgctgctgatcgatgtaatcaccaccgccatgtatgatcccaacctgtgtcctagtagaattagaagaagtagaaaataaaatgggtgaatgaacaggacagagtgttttcggatggttttgtggatcatatacatatatacatttacatgggtttagccactacacgcccgcgcgtgtgtgccccggtt

SEQ ID NO: 1188 - DNA, 1448 bp, Brachypodium distachyon
gttaaaacctgccagctgctcatctgccactcgtggctcggtgactcggtgagtgtgcagcaaagagcggagctagctaggctgtccgtgcgtgaagatggccgccgcttggtcgatgcaggtcggcggcggctgccgctgctctttcggcggccggagagcggcgtcggggaaagcggtgcggcggctgccggtgataagggcgtcggcggcgaaggtggaggaggaggagaaagtgaggctgggggagtcgagcgtggcggtgagcaagctggggatcggggcttggtcctggggcgacacaacttactggaacgactccgaatgggatgacaggaggctcaaggaggcgaaagccgcgttcgacgccagcgtcgacaacgggatgaccttcttcgacaccgccgaagtctacggaacagcgctcatgggggcagtcaactcagagagcctactgggagatttcatcagggagaggaaggagaagggcgaggtggacgtggtggtggccaccaagttcgccgcgctgccatggcggttcggccgcggcagcgtcctttccgcgctcaagaactccctcggccgcctcggcctcccctccgtcgagctctaccagctccactggccagggctatggggcaacgaagggtaccttgacgggctggcggacgcgtacgagcaaggactggtgaaggccgtgggggtctccaactacaacgagaagcgtctccgggacgcgcacgcgcggctgaagaagcgcagggtgccgctggcggcgaaccaggtgaactacagcctcatctaccggacgccagagctcaacggcgtcaagcaagcctgcgacgaactcggcgtcacactcatcgcatactccccaatcgcacaaggtgttctgtccgggaagtacactccggagaagcctccgacggggcctcgagggaacacatacaccccagaattcctcaccaagctccaaccgctgatgaacaggatcaaagagatcggagcaagctacggcaagaacccgacccaggtgtctctgaactggctggcgtgccagggcaacgtggtgccgatcccgggggcgaagaacgccgtgcaggccatggagttcgccggggcgctcggctggagcctcaccgccgacgaggtcgaggagctcaggacgctcgcccgcgagatcaagggaatcaagatgcccatcgaggagtcatgatcgaattgagtgctcgatcgatgctccggccgccgtccgatcaccatattcatgatcggctcttgcaccgctgcttattagcaacctgctgctgatcgatgtaatcaccaccgccatgtatgatcccaacctgtgtcctagtagaattagaagaagtagaaaataaaatgggtgaatgaacaggacagagtgttttcggatggttttgtggatcatatacatatatacattt

SEQ ID NO: 1189 - DNA, 1926 bp, Zea mays
gtcaaacaaaaaggcccaaaaagccgctccgagcctccgacctcgcatccggcccgattcgactagggttttagcactcccagtcccggctcccgccgtcgcctcgacgcttcccccctcttcctccgccgccaacccagcgagagagctcccagtccgcgaagacatggcggggaagaagcgcaagtccggctccgagaagccgacgaagcaccgcctcccgctgggagccgatgccgacgctgtcgccgaagcctcgaagcgccgccgatcgggcgccaccaagcagcaccaggcggacgaggaagcgtccatcccgccctctctcagcgccaagatcctccgcgaggcgcgcaagcagcaggaagaggagatgcgcgccgactccagcgacgaacagcgaccctcagccgtcgaggcgaccgcggggccgtccacgtcgtcctcgtttcccgtccccgccgccgacggcgagaatgagggggacgacgtcgatgagttcgacgggtttgacgcgctgagcgagtacgatggcggtgaggtggagatcaacgaggaggacgagaaggccctcgctgctttcatgtcaaaggacaaagctgccgagcgcacccttggcgatatcattctccagaagatcagggagaaggacgccgaggtcgcaactggtgaaggacgacctcgtgtaaaattggacaacagcattattgaactttataaagaggttgggaagttcttaagccggtacacgagtgggaaaattccgaaagccttcaagcgcataccatcgatggagtgctgggcagatgttgtgcagctaacggagccagagaattggtctcctaatgccgtgtatcaagcaacacgcctcttctcttcgaacatgaacacaaagaatgctgagcggttctatgaagccattttgctaccccgtgttcgaaatgacataaggaagaacaagaggctgcattttgcactctaccagtcgctgaagaaggccctttataagcccgcggcatttaacaagggaattttgctaccactctgtcgggaaaggaattgcaccctacgcgaagcagtgattattgggagtattatccagaaagtttccattccatttctccatgcaagtgtagctctagtaaaactagcagagatggagtactgtggcactacaagttacttcatcaagctatttctagacaagaaatatgctttgccataccgtgcacttgatgcagtgcttgcccatttcatgcgttttgttgatgatgagaggatcatgcctgttatatggcatcaatcactgcttgcatttgtggaaagatacaagaacgagttagagaaaaaggataaggagaaacttgcacgtttgttggatcaccagaaacactatttggttactccagaaattcgaagggagcttcgagggagctgcaacaggggtgaaaaagatacaaatttgcatactttgtcacctatctccgtcattaccaagcctatcgaggaagacaaatgggacgtaccacaagtgccaatggaggaagattagccagattctccaacatcgatttttacacttcatttgtttttgaattaaatttctaaagatattgctgtattttattgggcgtgaacttttagtgccaatattggggtaaaataggttcccagtagattgggcccccaatgttctgagggcattttgcagtcggaatgtgattcacacacagaaaagtttgttttgatcatttggagcattccaagggggcattcagcatggacatgtagcatactgtctttcgcagaagtgggtaagaaatggttgatcatgttactttgtagctgcgacaactaaaggtgtaccatacttgaaccagaaatgaaaatgaataacccggagttcgtttggttttttagggtctt

SEQ ID NO: 1190 - DNA, 1658 bp, Panicum virgatum
atccagcggagccccgagtccacgaagctatggcggggaagaagcgcaagtccggctccgagaagcagccgaagcatcgcctcccgctcggcgcggatgccgacgcggtcgccgccgcttctaagcgccgccgctcgggcgccgccaagcagcaccaggcggatgaggaggcgtccatcccgtcctccctcagcgccaagatcctccgcgaggcgcgcaagcagcagcaggaggagatgctcgctgactccggcgacgaggggcccccagccgccgcaaaggcagccgcggggccgtccacgtcgtcctcgttcccagtccccgccgcggatgacgaggaggaggacgacgtcgacgagttcgacgggtttgacgcgctgagcgagtacgacggcggcgaggtggagatcaacgaggaggacgagaaggcccttgctgccttcatgtcaaacgacaaagctgccgagcgcacacttggtgatatcattctgcagaagatcagagagaaggatgccgaggtctcagctgaagggacggcctcgtgtaaaattggacaacagcatcattgagctttataaagaggttgggaagttcttaagccgatacacaagtgggaagattccaaaagcattcaagcgcataccatcattggagtgctgggcagaggtgctgcagctaactgagccagagaattggtcccctaatgcagtatatcaagcaacacgcctcttctcttcgaacatgaatacgaagaatgctgaacggttctatgaagccattttgctccctcgtgttcgcaatgacataaggcagaacaagaggcttcattttgcgctctaccaatcgctcaaaaagtccctgtataagcctgcagcatttaacaagggaattctactgccactctgtcgggaaaggaattgcactctccgtgaagcagtaattattgggagtattatccagaaagtttccattccatttcttcatgcaagtgtagctctagtgaaactagctgagatggagtattgtggcactaccagttacttcatcaagctatttctagacaagaaatatgctttgccataccgggcgcttgatgcagtgcttgctcatttcatgcggtttcttgatgacgagagaatcatgcctgttatatggcatcaatcactgcttgcatttgtggaaagatacaagaatgaattggagaaaaaggataaggagaaacttgtacgcttgttggatcaccagaaacactatttggttactccagaaattcgaagggaacttcggggcagctgcaacaggggtgaaaaggataataatatggagacttcctcgcctatctctgtcatcacaaaacctattgacgaagacaaatgggacgtaccacaagtgccaatggaggaggattagtctgtttgaatatttatccaccgttgagtgtcattccccattgtcaatttttgcacaactttattgagtgaaatacagagagatgctgtaatgaacatttacatgtttgaaatgaacttgccatttgttgtggtggggccgacctggaaggcacatgtagttagctggcgacatcctttattcttgagatgcatggccatgtgataagtaccccattaggctttgggatgaaattaagctgaagttac

SEQ ID NO: 1191 - DNA, 1768 bp, Oryza sativa
ctaatcccccacttttcccgactcctctccttcccggcgccatcgcctcctccctcctcccgccgccggcgccgccgcctcgcctcgcctctcctcgctcatcggcgctagccatggccgggaagaagcgcaagtccgcctcctccgacaagcagccgaagcagcagcagcagcggctcccactcggcgccgacgccgacgcggtcgccgacgcggcgaagcgccgccgctcgggggcgtcgaagaagcaccaggcggaggaggaggcctccataccttcctccctcagcgccaagatcctccgcgaggcgctcacccagcaacaggaggagtccctcgccgaccagcgccccgccgccgccgccaccgccgctccgtccccatccttctccttccccgtgcccaagaaagatggcgaggaggacgaagacgatgatgacgtcgacgagttcgatggcttcgacgcgcagagcgagtacgacggaggcgtgccggagattgatgaggaggacgagaaggctctcgctgcattcatgtcaaaggacacctcttcgaagcgctcacttggtgatatcattctcgagaagatcagggaaaaggatgcagaaatctcaacagaaggacggactcctgtgaagttggactccagtattattgaactttataaaggggttggggagttcttgagccgatacacaagtgggaaaattcctaaaggattcaagcgtatcccatcattggaatgctggccagatgttctgcagctgactgagcctgaaaattggtctcctaacgcagtatatcaagcaacacggctcttctcttcaaacatgaacgcgaagaacgctgtgcgattctatgaagctattttacttcctcgtgtccgtaatgacataaggaagaacaagaggcttcattttgcactataccagtctctgaaaaaatgcctgtacaagcctgcagcgtttttcaagggaatattgttgccgctgtgtcaggaaaggaattgcactctgcgggaagctgtaattattggtagtatcatctcgaaagtctccattcctcctctccatgccagtgcagctttaatgaaactagcagagatggagtactgtggcacaactagctactttattaagctatttcttgataagaaatatgctttgccatatcgtgttgttgatgcggtttttgctcatttcatgcggtttattgatgaggagagggtcatgcctgttatatggcatcaatcactcctagcctttgtggaaagatacaagaatgaattagagaaaaaggacaaggagaaacttgcacgcttgttggatcaccagaagcactatttggttactccagaaattcgtagggaacttcggatgagctgcaacaggggtgaaaaggacacaatcatgtcgatatgctccccagtttctgtgatcacgaaaccaattgaagaagacaggtggaatgttccggaagtacctatggaggagtaatcgtttgattcttaatactggtggggaggggcaattttccgtaccagtgttgtagttttgcttgccgaatgaacttttcaagaggtatttcagttctatgcagcaatggatcgatgccagcaagggaagttgtaatgcaaatttttgatcagtttggaaatgtatctgatagtaacagagtattcagcgtgtagctgtaatatacgtcaccagaattgtagtgttttgtacacaaattgtctttagttttcaaatataccatcacaattcac

SEQ ID NO: 1192 - DNA, 1283 bp, Zea mays
acctggcaacactatcccctttcgccggcgccgctcccgctccatcccacccgcgctctccagtctccacggatcgatcgaagcttccgtcttccggcgcgatgttcccgtgccgccccctggctccgccgcacctgccgcgtgccccttccctcgcgcggcttccactgtcgtcgctgcggccgccgtcgtcgtcgctgcgcgtggtgcggtgcatggcgaaggagcggcgggtacggatggtggcgaagcagatccagcgggagctcgccgacatgctcacccgcgaccccgtgctgcagcgcgccgtgctccccgaagccgcgctcggcgctgaccgctacctctcgtcgctcaccaccatcgccgacgtcgagctctccaacgacctccaggtgtgcaaagtgtacgtgtccgtgtttggggacgagagggggaagaaggtggccatcgaggggctcaaggccaagaccaagtacgtcaggagccagataggcaggaggatgaagcttcgcctcacgccggagataaggttcatcgaggatgagtctatggagcgtggaagcaggatccttgctatacttgacaaactaaaggaggaaagggagcaacaagaaggaaaagatggagaggaagatgatgattcatatatatcagaagaagatgatggtgactgggatgcagatgagccagatgaggaggacatcatttacgtaaaatagcccattgtcttctaggaacttggccatcattcatccagaacacagcagttctcttcagagtttaattctgtgaagttcactgctcgcctgcttgtcgaagcactccaaagtatatcagcacttgaagaggtctacagagacatctcttttgccaattgaagcaggacatatcacacccttgctgccatttagaagctggtcatgtccttttttatggcttttcaatgcgggggatatttcaaagaggaatttggaagtctttttttttcctgtccactggattatgatatctgaccattgacgcaagacagtttgggctgatgctcattcctctgttatgttaactagcacttgtttaatttgtacttgcctagttatcttgctgtatttcagtctccatttcttctatggttttggtacagtatttcctctttctataagccattatgtaatagagtagcatcagtatgattttaatgataatttatcactctctcatctgatctaacaaaaacgatctggacaaagttacataaggcaaatcagtccttgagttcctaa

SEQ ID NO: 1193 - DNA, 1257 bp, Panicum virgatum
ctcgctcccacccgcgctctcgacgatcgaagcttccggccgcgatgttgccgtgccgcccgctggcgccgccgccgccgccgctgcctcgtgctctcaccttcgcgcggctcccgccgtcgtcgctgcgcgtggtgcggtgcatggcgaaggagcggcgggtgcggatggtggcgaagcagatccagcgggagctcgccgacatgctcacgcgcgaccccgtcctgcagcgcgcggtcctccccgaggccgcgctcggcgccgaccgctacctctcctccctcaccaccatcgccgacgtcgagctctccaacgacctccaggtgtgcaaggtgtacgtgtccgtgtttggagacgagagggggaagaaggtggccattgatggcctcaaggccaagaccaagtatgtcaggagccagattggcaagcggatgaagctgcgcctcacgccagagatacggttcatcgaggatgagtccatggagcgtggaagcaggatccttgctatacttgacaaactgaaggaggaaagggagcaacaagaaggaaaagatggggaggaagatgcagaaggttcatatatatcagaagaagaagatggtgactgggatgcagacgagccagatgaggaggacatcatttatgtaaaataaccacattttctaggaacctggtcatcattcatccttccatggaacactgcagtttgcttcggagttcaatccagtgaagttcgtaactcactgctcacctgcttgtcgaagcgctccaaagtgtctcagcatttgaagggctttgcctttgcagtgccaacacttttgccaattgaagcaggtcatatcacactcctgctgccgattagaagttggtcgcatcctttcttcatggatcatcgacgtggaggatattttaaagaggactcctgaagatatataatcatttttctgtccactggatctgatatctgaccatcagtgcaagctagttttgattgatgttcatttctgtgttatgttaactagcgctctcactagggtcatgtgtatctttctagtttttttttccctgagcgtctcactagttatcttgctgtgtttcagtgtccaatttcttctataatttgggtacagtatttacctctttctctaagacactatgtaatagggtagcgtcagtattatttgaagataaacgagcactttctcatctgagctagtacaagaaaatgatctgggcaaagttacaaatgtaccctcc

SEQ ID NO: 1194 - DNA, 4006 bp, Oryza sativa
tattgttcgattcgacacgacgacactatcccctcccacttccccgactcatcgtcttccacggcctcaccgcgaagccgccggaaaaccaccaccgccaccaccgccaccgctacactcgcgtcgaggtgatcggcgatgttcacctgccggccgctggtgtcccctccgctgccgcggcgcctcgccgtcgcgtcccctctggcgcccgcgcggccgcctccctcgtcggcgtcgtcgctgcgcgtggtgcggtgcatggcgaaggagcggcgggtgcggatggtggcgaagcagatccagcgggagctcgcggacatgctcacccgcgaccccgtcctccagcgcgccgtcctccccgaggccgcgctcggcgccgaccagtacctctcctccctcaccaccatcgccgacgtcgagctctccaacgacctccaggtgtgcaaggtgtatgtctccgtgtttggggacgagagggggaagaaggtggccattgctgggctcaaggctaagactaagtacgtcaggagccaaataggcaagcggatgaagctgcgcctcacgcctgagatacggttcatcgaggatgagtccatggagcggggaagcaggattcttgctatactggacaaattaaaggaggaaagggagcaacaagaaggaaatgaagaagaggaagatggagaaggtgcaaatctatcagaagaagaagaaggtgactgggatgcagatgagccagatgaggaggacatcatatatgtaaaataacctgatgtgccttcttacttgcccatgattcatccaacccccgaatgcagcagctatcttagattttagtcctacaaagatgagaactctctgctttgcaaagtgttccaaagttcctcaacactaggagagcttgtctgttgccaattagaagcagatcatatccttttttacatcgccggtcaaagctgaagctattttggcgcagagttctgaaggaagatttcccctttttctgttcactagaccatggtcttcgaccgttggtgaaagatgctttaacttaagttcatccttgtcgtatgctgactagcacctgttatatgtctgcttaccttgctgaatttcagttctcattttctgttttgtttgggaatggttgtatacctttcagtaaattatgccatacagcagtacctttagttctgtactgtgtattgataaaggcacattttctgatttacgaacttcgaactacgtacttgccattgtgaaattgtaagagctggtagtggctcatctggcaaaacaatcagctgaagaaacagctgctagagaagatgaggtgcctactctatacacatataactcaactgggtttgtaattcggtatcggattagtgtttatatgaccttctgtattttccttctacattgcaagagggatttttctttattcgggctactgatttcagaagtttcccagcttcttctgtcattcacatttttgatggtattagctgttctggccttctcccattctgctagatgttcatttcagcatacacatttttatcaaaattacttcatcagtcttaattttcagcttttccaggcttctttatcagcagcatatattccccggtgtatgaacaatctgaaataattatttcatattaacctgggcttattgagtcaaacaattaaggtggaagaaagcgttctcaggaaactgaaaagaaggcaaatccaactacaaaatggttgcatgcaatgtttgaacagtgggccttctattctgtatttgttatttgttctcaacatttcagagagagcactgaggagtaaacaacctcagaaagaatgtgatagtctaaacaaaatcatcttggtgatggttagagatgtactgctgccatctcattattttatcaagaggaactgcaaaggtgcaaatcaaaccatgaaagagccaactgatactttcgcgctatttctatgtggccattcatctagagaagttggaggtcagaacttaattaaacatccctgatatcctttccatctgttatgcaaaattctactcagatatagatacacctgccgtcttgcaaatcaaccataagaaagatggaagaggctctggtggataccctattttccttgttagcagagcatcgtccattgttattactttgtcagttgacagacatagtgccatgattctgaatgcttgtccaccaagagctgtgtaccatacactaaacccaaaagactgtggacatgaatatcagaattccctttcagttgaggtcaccctactacgttctcactggaagacccgtggaatatcctacttttgtttattctcggaaacaaatctagcagcgtaatcatacaagggcttttaggaaccaacagattctccagagtacagaagaaacagccggttgaagtcctgatataccgttgctggagtaatgctcaaatagtcagtgaggatcagcaagctctgggtcacaattgatttgactttgaacatttccaaaattgacagtaactaagcaaagcgtgctactgatggagcatcttctgcataacaaaaggctggttacttatctaatgcttggagaagttaggaaataactggttctagaaactggattggcaagacaactttagcaccaggtaagtggttccaatggttttttgctttcaccaagattaacaaactgggaaaactaatacaggcagctgccctaccacggtgcaaatgtcttatctaaggaagaagagaagttgaatctacacaagaagattcctagaattacataaagcttatgctcagatctgaaggatacaaagataataatttcggtagaggcagctgaactggttcttgtaccaaaatgaaggtacataggaatgacagaatctttaagagaaaaaggagttcaagtcttccacattgaatgattatggagattcatcacgagcagtcaactgagagatactccttgtcccttcagaattggaagcacacaacagtcgttgtccttgcacattgagatgctcaattgttcattgtctcgtttacagacgagagatggtaatcactaatcagatctagcctgctcattattctactggtaatgcagtgatgaaatgtgttcttaaaatgacacaggaagcatcttttgatgcagcgtggaacttgcattagcgagggcgcatacatgccgagtatgtttgtgctactgtttctgatgaagaagagatagctaaggtacgcaagctggctttacgtagatcacatgaacaatgttcttgtgacgcacttcaattcccatgttgcaaaataagactcaaaattattttgacgtgatttagatgctgcccaagatttcaagtcaaatatgagatatatgttgcattcataccatacatagcggaaataccagaagtgtttgaaagatatatcattgttgctttcttttcatcatttttttttccgagaaccgaagttatacagggtcgtcatgattagaataacgtgctattcttgaactaggtgtcattgtaacttgttaaagctttatgagctgaaggagagttaccaccattcgatgggcaccgacacttgttttgcaggatcgtgctgtaaaatggcatcgtactcaaaggtgaatcagttttgctttggtttctgtaactggcgttgagtcctttcccccaaactgaagaaagtcggcagggtcactggttgtcctggttttcaggaatcactctcaatctatgagttcctcctctatttttttgaggtaatccctgtactctcccttcatttaactgtattactactatcatatgaggtttaaaccaacccagtaataatttactagttaggtgtacatatttttttaactatgttactccctgcatccacaaatacaagatgtattttgtttcactggtacaagactttgaccaatactgaacagaaggagtaattgctact

SEQ ID NO: 1195 - DNA, 1051 bp, Avena sativa
acaatatccatccattcctactccgacggccgaccgccgcctcaccgcagcccaaaaaaatccccctgccgcgtcccccgcacaccccgagacgatgttcccgtgccgcccactggtgtccccgccgctgccgcgcgccctcgccgccgcggcgcccgtctccatgcggcggctgccgtcgacggcgctgtcgctgcgggtggtgcggtgcatggccaaggagcggcgggtgcggatggtggcgaagcagatccagcgggagctcgccgacatgctgacccgtgaccccatcatgcagcgcgccgtactccccgaggccgccctcggcgccgaccgctacctctcctccctcaccaccatcgccgacgtcgagctctccaacgacctccaggtctgcaaggtgtatgtgtcagtgtttggggacgagagggggaagaaggtcgccatggccgggctcaaggacaagactaagtatgtcaggagccagataggcaagcggatgaagctgcgcctcacgcctgagatacggttcatcgaagacgagtccatggagcgtggaagcaggattcttactatactggacaaactaaaggaggaaagggagcagagagaaggaaatgatgtagaagaagacggagaggcttcagatctagtagaagaagaagatggtgactgggatggagatgagccagatgaagaggacataatttatgtaaaatagcccactacgtcttttagaagcttgatcaccattcgttcaacttccgaactcatcagttcttttagaagttagtcccatgacggtgagaaatcactgctcaccttgttggcaacactctctccagagcatctcaacaccggaagagctttacagagacatctaggcaggccaaaccctttccttcaaggccggtcaaccagcaaagatatctaaagcagaattcagagggtgtcttatcatgttcactagatcagtatctgaccatcaatgagagacagttgcactgatgttcatccttctatgtatgctaactagtccttgttatgtgca

SEQ ID NO: 1196 - DNA, 1139 bp, Leymus cinereus x Leymus triticoides
  misc_feature (8)..(10): n is a, c, g, or t
atcccccnnnccgcaccccgcgacggtcgaaatcagcgaggatgttcccgtgccgcccgctggtgtccccgccgccgccgcgggctctcgccgccgcggcgcccgtctccgtgcggcggctgccctcgtcgtcttcgtggtcgtcgatgtcgctgcgcgtggtgcggtgcatggccaaggagcggcgggcgcggatggtggcgaagcagatccagcgggagctggccgacatgctgacccgcgaccccgtcatgcagcgcgccgtcctccccgaggccgccctcggcgccgaccggtacctctcctccctcaccaccatcgccgacgtcgagctctccaacgacctccaggtgtgcaaggtgtacgtgtccgtgtttggggacgagagggggaagaaggtcgccatggccgggctcaaggacaagaccaagtacgtcaggagccagattggcaagaggatgaagctgcgcctcacgcccgagatacggttcatcgaagacgagtccatggagcgcggaagcaggattcttactatactggacaagctaaaggaggaaagggagcaaagagaaggtaatggcgaagaggaagatggagaagcttcagatatagcagaagaagaagatggtgactgggagggggatgagcccgatgaggaggacataatttatgtaaaatagctactacttctcaaagctcggtcaccattcgttcaacttcagagctcatcagttctcctagagtttgttccttgtccacctcatcgacaaagcgctccatggtatctcaacacttgaagcctgacgatatctgaagcgaatttagcgggcataatattgtaccatgttcaccagatcagtacctgacctgaccatcctgttcagtatgctaaccagtccctgttatgtctattcatgtcgctgattgaacatggaggcacatgcctttcatttttccattttgtatttggtttgggagctgtcttgtacgtctcccttcagattgttttctagcacaaaagcagataggtaacattgactgttcattccctttttttgtggcggtcctgtcctgtaagatacaaacttcaagcgtcccttgataaatggaaaagggcaaatcgcttgccctgttcttca

SEQ ID NO: 1197 - DNA, 1210 bp, Triticum aestivum
ggagatattgttggattctcaacactatccccttcccactcccccacagcgacggccgacggcctcaccgcggcgcaaaatcccccaccaccgcgaggatgttcccgtgccggccgctggtgtccccgccgctgccgcgggccctcgtcgccgcggcgcccgtctccgtgcggcggctgccgtggccgtcgtcgtggtcgccgacgtcgctgcgcgtggtgcggtgcatggccaaggagcggcgggtgcggatggtggcgaagcagatccagcgggagctggcggacatgctgacccgcgaccccgtgatgcagcgcgccgtcctccccgaggccgccctcggcgccgaccgctacctctcctccctcaccaccatcgccgacgtagagctctccaacgacctgcaggtgtgtaaggtgtatgtgtccgtgtttggggacgagagggggaagaaggtggccatggccgggctcaaggacaagaccaagtacgtcaggagccagattgggaagcggatgaagctgcgactcacgcccgagatacggttcatcgaggacgagtccatggagcgcggaagcaggattcttactatactggacaaactaaaggaggaaagggagcagagagatggtaatggtgaagaagaggatggagaagcttcagatatggcagaagaagaagatggtgactgggagggggatgagccagatgaggaggacataatttatgtaaaatagcccaccccttctcaaatctcggtcaccattcgatcaacttcagagctcatcagttcttgtagagtttagttccacgttcacctcgttgacaaagcgctccatggtatctcactgcttgaagagcttcgcagagacgtctgctgccaattagaagaatcaaggcaatatccattctttcaagactgacgatatctaaagccaatttataggacgcgctatcatcatactatgttcaccggatcagtatctgaccatcaataggagacagtttccactgatgtccatccttgtctgtatgctaactggtccctgttatgttatgtccaccctgctgtgtgtctgttcatcttaatgaacatggagctaggcagttgcctttcagttttcagttctctatttggtcttttacatgtttgtttcaattgttttctggtgcaaaggccaaaggcagatactagttctagatcgcgagc

SEQ ID NO: 1198 - DNA, 1278 bp, Brachypodium distachyon
aaatcaatccggcagatattgttcgtttctacactatccttggcttcccactccgacaggcgacggcctcaccggctcaccgcagtgcaaaaatcccccgaatccccatacaccccgccactaccgaagcagcgccgatgttcccgtgccgcccgctggtgtctccgccgctgccgcgcgctctcgccgtctccgtgaccgtgcggcggctgccgtcgtcggcgctgtcgctgcgcgtggtgcggtgcatggccaaggagcggcgggtgcggatggtggcgaagcagatccagcgggagctggccgacatgctgacacgcgaccccatcatgctgcgcgccgtcctccccgaggccgccctcggcgccgaccgctacctctcctccctcaccaccatagccgacgtcgagctctccaacgacctccaggtgtgcaaggtgtatgtgtccgtgtttggggacgagagggggaagaaggtcgccatggccggactcaaggacaagaccaagtatgtcaggagccagattgggaagcggatgaagctgcgcctcacgcctgagatacggttcatcgaagacgagtccatggagcgcggaagcaggattcttactatcctggacaaactaaaggaggaacgggagaagcaagaaggaaatgatctagaggaagatgcagaaacttcagatctaggagaagaagatggtgactgggaaggagatgagccagatgaggaggacataatttatgtaaaatagtccattatgccttcttgaagcttcaacatctgtcaaacttcagagcccatcagttcatttagagtttagtcccatgatgatgagaactcagctgctcaccctgttgacaaagggcttcaaagcgtctcagcactcgaagagctttgcagagatatctacattgccaattagaagctggccaaatccttgtttttttttcaaagctggccaatgaggaggatatctatgtggaaatttgagggcatcattaccattttatgttcactagatcagtatctgaccatcaaatggaagacagtttcattgatgttcatcttgtctgtatgctaactagtcccctgttatgtttacctgacatgtctgtttgtctgactgaacatggaggcacatgcctatagttttcattttctatttggtttgtgaactttgatgtacatctgtaaccagattaccatgtaatacctccgtttcaaaaatttaagacgctttggctgttttactgtgggagttgccttgcttttgc

SEQ ID NO: 1199 - DNA, 1157 bp, Triticum aestivum
ctatccccttcccactcccccacagcgacggccgacggcctcaccacggcgcaaaatcccccaccaccccgaaaccagcgaggatgttcccgtaccggccgctggtgtccccgccgctgccgcgggccctcgccgccgcggcgcccgtctccgtgcggcggctgccgtgggcgtcgacgtcgctgcgcgtggtgcggtgcatggccaaggagcggcgggtgcggatggtggcgaagcagatccagcgggagctagcggacatgctgacccgcgaccccgtgatgcagcgcgccgtcctccccgaggccgccctcggcgccgaccgctacctctcctccctcaccaccatcgccgacgtcgagctctccaacgacctgcaggtgtgcaaggtgtatgtgtccgtgttcggggacgagagggggaagaaggtggccatggccgggctcaaagacaagaccaagtacgtcaggagccagattggcaagcggatgaagctgcgcctcacgcccgagatacggttcatcgaagacgagtccatggagcgcggaagcaggattcttacgatactggacaaactaaaggaggaaagggagcagagagaaggaaatgctgaagacgaagatggggaagtttcagatatagcagaagaagaagatggtgactgggagggagatgaaccagatgaggaggacataatttatgtaaaatagcccactacttcttctgaaagctcagtcaccattcgttcaacttcagagctcatcagttctcctagggtttccgtgtccacctcatcgacaaagtgctccatgggatctcaacgcttgaagcctgaggacatctgaagcgaattcatcgggcataagatcgtaccatgttcaccagatcagtatctgacctgaccctcaataggagacagtttcgctgatgtccatcctgttctgtatgctaaccatccctgttatgtccacctgttgtgtctgttcatgtcgctgattgaacatggaggcacgcgcctttcattctgtatttggtttgggagctgtcttgtacatctcccttcaaaatgttttgtagcacaaagccgggtaggtaacattgactgttcattgtcctgtaaatcttgtgccctattcttcaaaaaaaaaaaggggggg

SEQ ID NO: 1200 - DNA, 760 bp, Brachypodium distachyon
accgtccatggcaagaggcaaggtgcagctccggcgcatcgagaacccggtgcaccggcaggtgaccttctgcaagcgtagggcaggattgctgaagaaggccagggagctgtcggtgctctgcgatgccgatatcggcatcatcgtcttctccgcccacggcaagctctatgacctcgccaccaccggaaccatggatgggctgatcgagaggtacaagagtgccagtggaggagaaggcagcatgcaggctgatggctttggtgaccacagaatggacccaaagcaggaggcaatggtgctgaagcaagagatcgacctgctgcagaagggactgaggtacatttatggaaacagggcaaatgagcagatgagtgttgaagagctgaattccctggagagatacttggagatatggatgttcaacatccgctccgcaaagatgcagataatgattcaagaaatccaagcactgaagagcaaggcaatttggattctttactatatgcaggaagacatgttgaaagctgcaaacgaaattctccaggaaaagatagtagaacagcatggattagtaggacatcatggattgatcgacgtaggcatgacgatagcagatcagcagaatgggcattttagtacagacccactgatagaagagatcactaacccactgactatactgagtggctattctacttgtaggggctcagagatgggctattccttctgatggtaataaggccctgggggactagtt

SEQ ID NO: 1201 - DNA, 2798 bp, Sorghum bicolor
atgagctccggaaaggcgcagcagcggccacacgccgtgctcatcccgcagccggcgcagggccacgtcacgccgatgctgcacctcgccaaggcgctgcacgccagggggttccgcgtcacctacgtcaactccgagtacaaccaccgccgcctgctccggtcccgcggccaggactcgctcgccggcaccgacggcttccgcttcgaggccgtccccgacggcctgccgcagtccgacaacgacgacgtcacgcaggacatcgccgcgctctgcctgtccaccaccgagcacagcgccgcgccgttcagggacctgctggcgaggctgaacgccacgcccggcagcccgccggtcagctgcgtcatagccgacggcgtgatgagcttcgcgcagcgggtcgccgaggagatggggatcctggccttggttttctggaccaccagtgcgtgcggcttcatggggtacctccacttcgccgagctcatccgacgagcctacgtgccactcaaagacgaaagtgacctgtcgaacgggtacctggacaccgcgatcgactggatccccggcatgcccggcatccgtctgaaggacatccccagcttcatcaggacgacggacccggacgacgtgatgctcaacttcgacggcggcgaggcgcagaacgcgcgcaaggcccgcggggtcatcctcaacacgtacgacgcgctggagcaggacgtggtggacgcgctgcgccgcgagttcccgcgcgtgtacaccgtcggcccgctcgccacgttcgcgaacgccgcggcaggaggcgggctggacgcgatcggcgggaacctctggaaggaggacacgagctgcctccggtggctggacacgcagcgaccgggatcggtggtgtacgtcaacttcggcagcatcacggtgatgaccgccgctcagctcgccgagttcgcctggggcctggcgagctgcggctcgccgttcctgtgggtcatcaggccggacctcgtgtccggcgagaacgccatgctgccggaggggttcgtcacggacaccaaagaaaggggaatcctggcgagctggtgtccgcaagagctggtgctctcgcacccgtccgtcggcctgtttctgacgcactgcgggtggaactcgacgctggagagcatatgtgccggcgtgccgatgctctgctggccgttcttcgctgagcaaccgacgaactgccggtacgtgtgtgacaaatgggggattgggatggagatcgacagtgatgtgaggaggcaggaggtggcgcggctcgtgcgcgaggcgatggacggggagaggggcaaggcgatgagattgaagtcgatggtgtggaaggagaaagctcgacaagcagtggacgaaggtggatcctcgaggaaaaacatggaccggatgtacaaccaccgccgcctgctccggtctcgtggcgcggacgcgctggatggcctcgacgacttccggttcgagaccatcccggacggcctgcctccgtccggcaacgacgacgacgacgtcacgcaggacatccccacgctctgcgagtcgcttctccggaacggcgccgcgccgtttagggacctactgacgaggctcaaccgcatgcccggccggccgccggtcacctgcgtcgtgctggacaacttcatgagcttcgcgcagagggtcgccaacgagatgggcatcctcgcagtggtgttctgcaccatgagcgcgtgtggcttcatggggtatctccactacaaggagctcatggacagaggctacgtgccactcaaagatgagagctacctgaccaacgggtacctggacacggtgctcgactgggtgcccgggatgccgggcatccgtctgcgagacattcccagcttcatccgcacgacggacccggacgaattcatggtccatttcgacagcaacgaggcccagaacgcgcaccgcgcgcagggggtcatcttcaacacgttcgacgcgctggagcaggacgtcgtcgacgcgatgcgccgcatcttccctcgcgtgtacaccatcggcccgctcctcacgttcgccggcaccatggcccgccccgacgcggcggcgatcagcggcagcctctggaaggaggacctgagctgcctccggtggctggacgcccggacgggcggctcggtcgtgtacgtcaacttcggcagcatcacggtcatgacgccggctcagctcgccgagttcgcgtggggcctggcgcgctgcggcaggccgttcctgtgggtcatcaggccggacctcgtcaccggcgacaaggctatgctgccggaggagttctacgctgagacgaaagagcgagggctcttcctcagctggtgcccgcaggaacaggtcctgtcgcatccgtcgacggggctgttcctgacgcactctgggtggaactcgacgctggagagcatccgcgccggcgtgccgatgatctgctggccgttcttcgccgagcaggtgaccaactgccgatatgcctgcaacaactggggcattggactggagattgacaacaatgtcacgagggaggaagtggcacggctcataaaagaagccatggacggcgagaaaggcaaagacatgaaagcgaaagcaacgatgtggaaggagaaggccgtggcggcaacagaaggcggcgggacctcgagcgttaacattgaacgtttggtcgaattcatgcttgaaggaaatgttcctacagctgcaagctaattgtatgaacagtacatgcatatgaaaaccaaagtactcctataatattgcca

SEQ ID NO: 1202 - DNA, 2706 bp, Zea mays
aaggcgcagcggcggccgcacgccgtgctcatcccgcagccggcgcagggccacgtcacgccgatgctgcacctcgccaaggcgttgcacgctagggggttccgcgtcacctacgtcaactccgagtacaaccaccggcgcctgctccggtcccgcggccaggactccctcgccggcaccgacggcttccacttcgaggccgtccccgacggcctgccgcagtccgacaacgatgacgtcacgcaggacatcgccgcgctctgcctgtccaccaccgcgcacagcgccgcgccgttcagggacctgctggcgaggctgaacgccatgccgggcagcccgccggtgagctgcgtcatagctgacggcgtgatgagcttcgcgcaaagggtcgccgaggagatgggaatcctggccttggttttctggaccaccagtgcgtgcggcttcatgggctacctccacttcgccgagctcatcagacgaggctacgtgccactgaaagacgaaagtgacctgacgaacgggtatctggacacggcaatcgactggatccccggcatgccggacatccgtctgaaggacatccccagcttcatcaggacgacagaccgagacgacgtgatgctcaacttcgacggcggcgaggcgcagaacgcgcgcagggcccgcggggtcatcctcaacacgtacgacgcgctggagcaggacgtggtggacgcgttgcgccgcgagttcccgcgcgtgtacactgtcggcccactcgcagcgttcgcgaacgccgcggcaggaggcgagctggacgcgatcggcggaaacctctggaaggaggacacgagctacctccggtggttggacacgcagcggccgggctcggtggtgtacgtcaacttcggcagcatcacggtgatgaccgccgcgcagctcgccgagttcgcctggggcctggcgggctgcggccggccgttcctgtgggtcatcaggccggacctcgtgtccggcgagaccgccatgctcccggaggggttcgtcacggacaccaaaggaaggggaatcctggcgagctggtgcccgcaagagctggtgctctcgcacccgtccgtcggcctctttctgacgcactgcgggtggaactccacgctggagagcgtatgcgccggcgtgccgatgctctgctggcccttcttcgctgagcaaccgacgaactgccggtacgtgtgcgacaaatgggggatcgggatggagatcgacaatgatgtgaggagggaggaggtggcgcggctcgtgcgcgaggcaatcgacggagagtggggaaaggcaatgagagtgaagtcgatagtgtggaaggagaaagctagacaagcggtggaggatggtggatcctccaggaaaaacttggatcgactgtacaaccaccgccgcctgctccggtcccgcggcgcggactcgctggcgggcctcgacgacttccggttcgagaccatccccgacggcctgcctccgtccggcagcgacgacgacgtcacgcaggacatccccgcgctctgcgagtcgctctcccggagcggcgccgcgccgttccgtgacctcctggcgaggctcaacggcatgccgggccgtcctcctgtcacctgcgtcgtactggacaacttcatgagcttcgcgcagagggtggccagcgagatgggcatcctggcagtcgtgttctgcaccatgagcgcgtgtggcttcatggggtacctccacttcaaggagctcatggacagaggctacgtgccactgaaagatgagagctacctgaccaacgggtacctggacacggtgctcgactgggtgcccgggatgcggggcatccgtctgcgagacatgcccagcttcatccgcacgacggacccggacgagttcatggtccacttcgacagcggggaggcccagaacgcgcgccgcgcgcaggggatcatcgtcaacacgttcgacgcgctggagcaggacgtcgtgggcgcgctgcgcggcgtcttccctcgcgtctacaccatcggcccgcttctcacgttcgccagagacatggtccgtcccgacgcgtccgcgatctgcgggaacctctggaaggaggacccgagctgcctcgggtggctggatgcccaggggcccggctcggtcgtgtacgtcaacttcggcagcatcacggtcatgacgccggctcagctcgccgagttcgcgtgggggctggcgaactgcggcaggccgttcctgtgggtcatcaggccggacctcgtcacgggcgagaaggctatgctgccggaggagttctacgcggagacgagagagagagggctcttcctcagctggtgcccgcaggaacaggtcctgtcgcatccgtccaccgggctgttcctgacgcactctgggtggaactctacgctggagagcatacgcgccggcgtgccgatgatctgctggccgttcttcgcagagcagacgaccaactgccgatatgcctgcgcgaactggggcattggactggagatcgacaacaatgtcacgagggacgaggtggcacggctcatagaagaagccatggacggcgagaaaggcaaagacatgaaggcgaaggcaacagtgtggaaggagaaggccgtggcagcaacagaaagcggcgggacctcgagcgtcagcattgatcgtttggtcgagttcctgcttgaagga

SEQ ID NO: 1203 - DNA, 2685 bp, Oryza sativa
gacacgtttggccttcacgcgccagtgcgccactgctctgtctacacggcgctttctcaagatcagatatgcacaaatccacctgacagcaacacgtttggcctgaccgcggcgccgagcgtccgtccgtctgcacgccggaggagaagacacacggcgatgagctcctgcgaggcgaggcgggcgcacgcggtgctcatcccgcagccggcgcagggccacgtcacgcccatgctgcacctcgccaaggcgctgcacgccagggggttcttcgtcacctacgtcaactccgagtacaaccaccgccgcctgctccggtccagcggccctggcgcgctggccggcgccgcgggcttccgtttcgaggccgtgccggacggcatgccggagtccggcaacgacgacgtcacgcaggacatcgccgcgctctgcgtgtccaccaccaggcacagcgccgagccgttcagggagctgttggtgaggctgaacagcacgcccgggacgccgccggtgagctgcgtcatagccgacggcgtgatgagcttcgcgcagagggtcgccgaggagatgggcatcctggccttggtgttctggactacgagcgcttgcggcttcatgggttacctccacttcgccgagctcatcagacgaggctatgtgccactcaaagacgagagtgacctgacgaacggatacctggacactccgatcgactggatccccgggatgcgaggcatccgtctcaaggacgtgccaagtttcatcagaacgaccgatccggacgacgtcatgctcaatttcgacggcggcgaggctcagaacgcgcgcaaggcccgggggctcatcctcaacacgtacgacgcgctggagcaagacgtcgtcgacgcgctgcgccgcgagttcccgcgtgtgtacaccgtcggcccgctcccggcgttcgccaaggccgccgccggcgaggtgggcgcgatcggcggcaacctctggaaggaggacacgggctgcctccggtggctggacgcccagcagcctggctccgtcgtgtacgtcaacttcggcagcatcaccgtcatgtcgccggctcatctggccgagttcgcgtggggcctagcttgctgcggccggccgttcttgtgggtcatcaggccggacctcgtctccggcgagaaggccatgctgccggaggagttcgtcggcgagaccaaagagaggggcgttctggcgagttggtgcccgcaagagctcgtcctctcgcacccgtccgtcggcctgttcctgacgcactgcgggtggaactcgacgctggagagcatatgcgccggcgttccgatgatctgctggccgttcttcgccgagcagccgacgaactgccggtacgtgtgcgacaagtggggggttgggatggagatcgacagcaacgtgagcagaacggaggtggcgcggctcgtgcgcgaggcgatggagggggagagaggcaaggccatgcgagtgaacgccatggtgtggaaggagaaagccaaggaggcgacagaggaaggaggttcgtcgagcagaaatctggaccgtctgatcgaattcttgcattcttctgggagtgacgctcgctgagttcatattatcatatcacaaattatcttgtgcgtgctttccgctcatctagtggcactgagaaatgcagtgcaaataattggtcagtcaaaattcctgttcgtgtcagagtataacatggaaggatacggagtttgctagcacaaaacaactgtgctgctggatggcgacttgatcaccagctcaatttctccgggattctagatcgcaaaatgacggaaagggattctagatagtagattcgtctcgcggcccgtgcagccgtgcgctctaatcagccggcgctagcacactacgcgtcagccaaatctgacgtggaggagtaaaaaggaaagaaaaaggatggagtgagtgttccatctatcgtccgactgaagcgcaatacacgagaaaaggctgctttcttccaaccagatacgaggagatgaggtgtatatgcgaatattaaatatctaaatcttcaatagaggtaaacaaacagctaatctaacagccagcctattatattagtgatggctataggtgacatggtactattatagagccggcagctagctatattattatccttgctccgggtgatctccgatactcggccactacaccagtggatacgcacgagcagctagcagtgacagtttcgacgcacgcggctgtggtagcgaaggaacggctcggccgcttggatggctacacacacctggtgcggatgcgtacatgcacggacatcacgggcttctacagaaaaagttactttcaaaattatgaaaaatccagcacgttccaccctggctgctatcaaccgggaggcttcgatgatggagcggtgattggttgttcttcacttgttctgggcttatccagcggaaattggttgattgcgaacttcgtggactttaaccaaactccatataaaagattccctccgtggtataccgtcaggataatacaggtgcattttgtatatctgtttatcttttctttctttatgtaggtaaattgcatcggtgtatacaaaattgtcgtatgaatgcaacctagtgtacgaacttgtaaaatacttgttttggtgtatga

SEQ ID NO: 1204 - DNA, 2527 bp, Zea mays
acacaaacagaagcaggcacccaccacggcaccacccccaaacaaaaaccgcgggtcggtgccggcacgcacccccgccgcgcccgcgcgcgaggatccgtccgacgcgacgccacggcaggacggtcccgatcccaatcctgccactgccagtgccaccctgtgacccatcgatttgcttgccattccaccacctctctctgctccactgcagcagtgctcctcctcctccaccaccacgcggtccatctcactctcacaggctccaattggcatctcgtctcgcgctcgctttccccagtccactcgcgctctcgtttcccggagcttcgcgatgcagcgccttctcgcgctggtggcagccctgctggtgctgctggcgtcgcgtccagcgctggccaccgacccctacgccttcttcgactgggacgtctcctacgtcactgcggcgccgctcggcgtcaagcagcaggtgataggcatcaacggcaagttcccagggcccgtcgtgaacgtcagcaccaactggaacgtcgtcgtcaacgtgctcaacgacctcgacgagcccctcctcatcacctggaacgggatccagcaccggaagaactgctggcaggacggggtgctcggcaccaactgccccatcccgcccggctggaactggacgtacgagttccaggtgaaggaccagatcggcagcttcttctacttcccctccaccggcctgcagcgcgccgccggcggcttcggcggcatcgtcgtcaacaaccgcgacgtcatcgccgtgcccttcgcccgccccgacggcgacatcaccatcttcatcggcgactggtacaacaagaaccacacggatctgaggaagatgctggacaaggggaaggacctcggtattcccgacggcgtgctgataaacggcaagggcccgtaccggtacaacgacagcctcgtgccgcccggcatcgagtacgagaccttcaatgtgcatccgggcaggacgtaccgcatccgggtgcacaacgtggggacgtcgacgagcctcaacttccggatccaggggcacagcatggtgctggtggagacggagggctcctacacgtcgcagcagaactacacgagcctggacgtccacgtgggccagtcctactccttcctcgtcgccacggatcagaacgccagctccgactactacgtggtcgccagcgcgcggcaggtgaacggctcccagcccctctggcgccgcgtcacgggcgtcgccgtgctccgctactccacctccgggggccccgcgtcgggcgccctacccgacccgccgcaggaccaggacgacagggccttctccatgaaccaggcgcggtcggtccgctggaacctgagcgccggcgcggcgcggcccaacccgcagggctcgttccgctactcggccatcagcgtgacgcaggcgtacctgctgcggggcgcggggcccgtgtggatcggcggcaggcggcgcgcggcgctgaacgggctgtcgtacgcgccgcccgagacgccgctgcggctggcggacgcgtacggggtggagggcgtgtacacgctcgacttccccgagcgcccgccgctccggggcgccgcccccaggatcgcgcggtccgtcatcaacggcacctaccgcgggttcatggagctcatcttccagaacaacgacaccaggatgcagagctaccatatggacggctacgccttcttcgtcgtcgggatggactacggcgagtggacggaggacagcaggggcacgtacaacaagggggacggcgtggcgcgcagcacgatacaggtgtacccgggcgcgtgggcggcggtgctggtgtccctggacaacgtcggcgtctggaacgtgcggtcccagaacctagactcgtggtacctggggcaggaggtctacgtcagggtcgtcaaccctgaggacaccggcaacaagaccgagatggccatccccgccaacgctctctactgcggccagctccacaagtaccagaaggagcagactccgcaccacaagatgggggcgtctgctgcggcgccacgctcgtcggtgtccctagcgcgccggctgctcgcgacggcgctgctcctcgccggatccttcgtgttcgcgccgtagagtgagtggcaaccgttacttctgcaccgaggcggcacccgtttatgtaggtttgattaggattaggcgtaggccgcgtcattacctatgagaattgttcatatgccagcagtgctggcctccgcctggtttcctatggtacagttctccctcgctttcattgtgtgtgtgtgtgcgtgtgttagttagcctctgttaggaagggtcgatggtttctctctgattagttcattccttttgatggtgattccgatcttagcgtttttgtatcgcacctcatgtagtcctgttcttcaactggctaagaacgttttactggacatcgttttataatgtgagctgtggggattcatttctaaacaagaaaatcgtgagtggctgaga

SEQ ID NO: 1205 - DNA, 2424 bp, Oryza sativa
gctacaaattggacgggagcacgcgcgcatcccaatcccccatccatccgctaacttttgcggtttccgcccccaccaccatcaccacctccaccaccttcgcgcccctgtacatcaccacccccgtctcgcgctggctcatcatcatcttcttcttcttctcgcccagtgagagacactgtgtcagtcactgagtcacactcacagtgccactgatccgccatgagctagctcaagctgagctgcaggaggagtgcagataagagaatccgccttgctttcctcgccgcgcgcattctcgtcgtttcccaaggaagcttcctttcttttcttcttctccggtcagtcgcaatgtggcgggctctcgcggcggcggcggcggcggtggcggtggcggtggtcgtggcggcgcggccggcggcggcgactgacccctacgcgttcttcgactgggacgtcggctacgtcaccgcggcgccgctcggcgtcaagcagcaggcaaaactcgcctcaattattctcctcggtgtgataggcatcaacggcaagttcccaggaccaaccgtgaacatcagcaccaactggaacgtcgtcgtcaacgtgctcaacgacctcgacgagcccctcctcatcacctggaatgggatccagcaccggaagaactgctggcaggacggggtgctgggcacaaactgccccatcccgtcgggctggaactggacgtacgagttccaggtgaaggaccagatcggcagcttcttctacttcccttccaccggcctccagcgcgccgccggcggctacggcggcgtcgtcgtcaacaaccgcgacgtcatcgccgtccccttcggccgccccgacggcgacatcacaatcttcatcggcgactggtacaacaagaaccacacggatctgaggaagatgctggacagtggcaaggacctcgggatgccggacggcgtgctgattaacggcaagggcccgtacaggtacaacgacagccttgtcccggccggcatcgagtacgagaccatcaatgtggatccgggcaagacgtacaggatccgagtgcacaacgtggggacgtcgacgagcctcaacttcaggatccaggggcacaacatggtgctggtggagacggagggctcctacacgacgcagcagaactacaccaacctggacgtccacgtcggccagtcctactccttcctcgtcaccaccgaccagaacgcgagctccgactactacgtcgtcgccagcgcgcgcatggaccagttcgacaagtccttctccatgaaccaagctcgctccgtcaggtggaacctgagtgccggagcggcgaggccgaacccacagggatcgttcaggtactcgtcgatcaacgtgacgcaggcgtacctgctgcggagcacggcgccggtgacgatcaacgggcggcgccgcgcgacgctgaacgggctgtccttcacaccgccagagacgccgctgcggctcgccgacgcgtacggcgtcaggggcgtctactcgctcgacttcccggagcggccgctgcgcggcgccccccggatgggccgctccatcatcaacggcacctaccgcggcttcatggagctcatcttccagaacaacgacaccaggatgcagagctaccacatggacggctatgccttcttcgtcgtcgggatggactacggcgaatggacggaggatagtaggggtacttacaacaagggtgacggcgtcgcccgcagcactgtgcaggtgtacccgggagcgtgggcggcggtgctggtgtccctggacaacgtgggcgtctggaacgtgaggtcggagaacctggactcatggtacctgggccaggaggtctacgtcagggtcgtcaaccctgaggacaccggcaacaagaccgagatggccatccccgacaacgccctcttctgcggccagcttcacaagtaccagaagcagcagacccctcaccacaagatggggacgtcggcggcggcggccgccgtcgtggggagccgggtggcggcggcagcaatgctgctcctcgccggagcagtcatgatctcgccgtagagtggcgacgtgtttcttctgcaaggaggtgactccgtcgtgtaggattgtttaggatcagggttcaggatcgtagcctgttttctctgttgatatgagtttgtcagtgtgccgcttgattgtgctgcccattgttcgttttcttttcatttttctttttacctcattttgggttcttttagggtgggtagagattgcttcttgattcgattcgttcgtgcatttgcatttgttcaccaggatcaactctggttactccaattctttttggtagtgtaactctgtttgatcgtctgaaaaactgttaaaaaaaaaagacagcatcagctttgttcagtggag

SEQ ID NO: 1206 - DNA, 545 bp, Saccharum officinarum
acaaagaagcacgataacaagcaacacttgcccttacgttcacgacccacgacgatcaccatgagctccatggcggcgacggcaccggactgcggcggcaccaagacgtcgtggccggaggtggtcgggaagagcgtggaggaagccaagaaggtgatcctcaaggacaagcccgacgccgacatcgtcgtgctgcccgtcggctcgattgtgaccaccgattttgtgcccaaccgcgtgcgtatcttcgtcgacatcgtcgccgagagacaccccacgtcggctgataagaggctggctgatgcctagctagcttcggttccttccttgctttagcattgaatattctataaaatgaataactcggacatgctatgtattcatgtccgtgtcgaccgtgtgtctgctgaataatggatgtgtacgtgtttctttcctacaaattattactaaataatggcatcgttcttgcaaaataaatgtatcaaaatgtcatccatccttgcacgaatgaatatatgaaaggggatcagttgtttgttgtc

SEQ ID NO: 1207 - DNA, 543 bp, Sorghum bicolor
aatcagcagcataagaagcacaataacaaagccacacttgccctttcaattcgcgaccgacaaccgccgaccatgagctccacggcgacggcggcaccagagtgcggcggcgccaagacgtcgtggccggaggtggtcgggaagagcgtggaggaagccaagaaagtgatcctcaaggacaagcccgacgccgacatcgtcgtgctgcccgtcggctcgccggtgaccatggattaccgcaccaaccgcgtccggatcttcgtcgacaccgtcgcccagacgccccatgtcggctgataaagctagctagctgcttctgctgctgcatgtctcagtgctgcttccttcgctcctcgttccagaacatcaataaaatacgatgatcgaataacgcgcggacatgccatgtatgcatgtcagtgcatctgccgaaaaaataatggatgtaaacgtgtttctttcatactataaattatcactacataatggcatcgttcttatagatataaataaatgtatcagaatgtcgttcatccttgcacg

SEQ ID NO: 1208 - DNA, 543 bp, Sorghum bicolor
aatcagcagcataagaagcacaataacaaagccacacttgccctttcaattcgcgaccgacaaccgccgaccatgagctccacggcgacggcggcaccagagtgcggcggcgccaagacgtcgtggccggaggtggtcgggaagagcgtggaggaagccaagaaagtgatcctcaaggacaagcccgacgccgacatcgtcgtgctgcccgtcggctcgccggtgaccatggattaccgcaccaaccgcgtccggatcttcgtcgacacagtcgcccagacgccccatgtcggctgataaagctagctagctgcttctgctgctgcatgtctcagtgctgcttccttcgctcctcgttccagaacatcaataaaatacgatgatcgaataacgcgcggacatgccatgtatgcatgtcagtgcatctgccgaaaaaataatggatgtaaacgtgtttctttcatactataaattatcactacataatggcatcgttcttatagatataaataaatgtatcagaatgtcgttcatccttgcacg

SEQ ID NO: 1209 - DNA, 528 bp, Triticum aestivum
aggaagcacaataacaagccacacttgccctttcaattcgcgaccgacgacaaccggccaccatgagctccacggcagcggcggcaccggagtgcggcggcgccaagacgtcgtggccggaggtggtcgggaagagcgtggaggaagccaagaaagtgatcctcaaggacaagcccgacgccgacatcgtcgtgctgcccgtcggctcgccggtgaccatggattaccgcaccaaccgcgtccggatcttcgtcgacacagtcgcccagacgccccatgtcggctgataagctagctagctgcttctgctgctgcatgtctcagtgctgcttccttcgctcctcgctccagaacatcaataaaatacgatgatcgaataacgcgcggacatgccatgtatgcatgtcagtgcatctgccgaaaaaataatggatgtatacgtgtttctttcgtactataaattatcactacataatgacatcgttcttatataaataaatgtatcagaatgtcgttcatccttgcacg

SEQ ID NO: 1210 - DNA, 660 bp, Panicum virgatum
  misc_feature (10)..(10): n is a, c, g, or t
ggaaccagcngtacaagaagcacaagaaaaaacacttgtagccatcaacttcttcttcttcttcttcaccgtcatcaactcatcatcagctcagaccctagctagcgaccgaagaagaagaagatgagctcctccgcggaagcagctgatcagtgcggcggcggcaagacgtcgtggccggaggtggtggggatgagcatagaggaggccaagaaggtgatcctcaaagacaagcccgacgccgacatccacgtgctgccggtcggcacgccggtgaccagggatttccgccccaaccgtgtccgcatcttcgtcggcaccgtcgcccagacgccccatgtgggctagcagctctgcccatagctttcttgctcacaacatcatgcgcgttccaaataaagccatcctatgtatgtatggatgtgtgttgttaccctatggatccaataaataagggatgtaaaaggtgaataaagcatcgattgtgtgtagccttacaagaaccgccttcttgtttcttactctcatcaagctagcttcgttttcttcaccttggtgtgtaatggtacgtagagatgcacaaatcattcggacatgaatgtgtctaatttctaaaatggaacatataccataactatgatgagcagggctctcacatta

SEQ ID NO: 1211 - DNA, 584 bp, Saccharum officinarum
cagcaatcagcagcagtagcgcagtacaaagaagcacgataacaagcaacacttgcccttacgtcgacccacgacgacgatcatgacctccacggcgacggcaccggagtgcggcagcgccaagacgtcgtggccggaggtggttggcctcaccatagaggaagccaagaaggtgatcctcaaggacaagcccgacgccgacatcgtcgtgctgcccgtcggctccattgtgaccgcggattatcgccccgaccgcgtccgcatcttcgtggacaccgtcgcccagacgccccacgtcggctgacaagaggctggctgatgccgagctagcttcttcggttccttccttgctccagaagtgaatattctaataaaaatgaataactcggacagtattcatgtccgtgtatctgccgaatagtgaatgtgttatgtgtacgtgtttctttcctgtaaactattactaaataatggcgtcgttctttcataaataaaatgtcgtccatccttgaacgaatgaatatatgaaaggggattagttgtttggtttcactttctttcaattaaaaacagcttgtcaacat

SEQ ID NO: 1212 - DNA, 584 bp, Saccharum officinarum
  misc_feature (533)..(533): n is a, c, g, or t
  misc_feature (547)..(547): n is a, c, g, or t
cagcaatcagcagcagtagcgcagtacaaagaagcacgataacaagcaacacttgcccttacgtcgacccacgacgacgatcatgacctccacggcgacggcaccggagtgcggcagcgccaagacgtcgtggccggaggtggttggcctcaccatagaggaagccaagaaggtgatcctcaaggacaagcccgacgccgacatcgtcgtgctgcccgtcggctccattgtgaccgcggattatcgccccgaccgcgtccgcatcttcgtggacaccgtcgcccagacgccccacgtcggctgacaagaggctggctgatgccgagctagcttcttcggttccttccttgctccagaagtgaatattctaataaaaatgaataactcggacagtattcatgtccgtgtatctgccgaatagtgaatgtgttatgtgtacgtgtttctttcctgtaaactattactaaataatggcgtcgttctttcataaataaaatgtcgtccatccttgaacgaatgaatatatgaaaggngattagttgtttgntttcactttctttcaattaaaaacagcttgtcaacat

SEQ ID NO: 1213 - DNA, 424 bp, Saccharum officinarum
  misc_feature (28)..(28): n is a, c, g, or t
  misc_feature (384)..(384): n is a, c, g, or t
  misc_feature (392)..(392): n is a, c, g, or t
  misc_feature (394)..(394): n is a, c, g, or t
  misc_feature (414)..(414): n is a, c, g, or t
  misc_feature (420)..(420): n is a, c, g, or t
gtcgacccacgcgtccgcaccatcacangccacacttgccctttcattcacgaccgacaaccgacgaccatgagctccacggcgacggcggcaccggagtgcggcggcgccaagacgtcgtggccggaggtggtcggccagaacgtggaggaagccaagaaggtgatcctcaaggacaagcccgatgccgacatcgtcgtgctgcccgtcggctcgccggtgaccatggattaccgcaccgaccgcgtcccgcgtcttcgtcgacaccgtcgcccagacgccccatgtcggctgataaaagctatagctatctagctgctgcctagcttcaattccttcctcgctccagaaccagaacttgaacatataaaaatgaataacttnggaaatgncnacgcattttgcctggtccgngccatntgcc

SEQ ID NO: 1214 - DNA, 515 bp, Saccharum officinarum
  misc_feature (11)..(11): n is a, c, g, or t
  misc_feature (367)..(367): n is a, c, g, or t
  misc_feature (375)..(375): n is a, c, g, or t
  misc_feature (377)..(377): n is a, c, g, or t
  misc_feature (397)..(397): n is a, c, g, or t
  misc_feature (403)..(403): n is a, c, g, or t
  misc_feature (411)..(411): n is a, c, g, or t
  misc_feature (417)..(417): n is a, c, g, or t
  misc_feature (451)..(451): n is a, c, g, or t
  misc_feature (482)..(482): n is a, c, g, or t
  misc_feature (485)..(485): n is a, c, g, or t
caccatcacangccacacttgccctttcattcacgaccgacaaccgacgaccatgagctccacggcgacggcggcaccggagtgcggcggcgccaagacgtcgtggccggaggtggtcggccagaacgtggaggaagccaagaaggtgatcctcaaggacaagcccgatgccgacatcgtcgtgctgcccgtcggctcgccggtgaccatggattaccgcaccgaccgcgtcccgcgtcttcgtcgacaccgtcgcccagacgccccatgtcggctgataaaagctatagctatctagctgctgcctagcttcaattccttcctcgctccagaaccagaacttgaacatataaaaatgaataacttnggaaatgncnacgcattttgcctggtccgngccatntgccaaangggggnggggggggtttttactaaaaaaaaaggaggggcnaaccggtttttggttaaaaaaaaatggtttnaanaaccggccattccttttcttggattggaat

SEQ ID NO: 1215 - DNA, 541 bp, Saccharum officinarum
cacgagcaataacaagccacactttccctttcaattcgcgaccgacaaccgacgagcatgagctccacggcgacggcggcaccggagtgcgacggccccaagacgtcgtggccggaggtggtcgggctcagcgtggaggaagccaagaaggtgatcctcaaggacaagcccgatgccgacatcgtcgtgctgcccaccggctcgcctgtgaccatggattaccgccccaaccgcgtccgcatcttcgtcgacaccgtcgcccagacgccctatgtcggctgataagctcgctgctgctgctgctgcatgcccagcttccttcgctcctcgctctagaacttgaataaaatatgacgaataacgcggacatgccatgtatgcatgtatgtgcaaaatccgaataatggatgtatacgtgtttttctttcctactataaattatcactaaacagtggcatcgttcttagataaataaatgtaccagaatgtcgttcatccttgcacgaatgaatatatgaaagagggatcagttgtttgtttt

SEQ ID NO: 1216 - DNA, 554 bp, Saccharum officinarum
cacgagcaataacaagccacactttccctttcaattcgcgaccgacaaccgacgagcatgagctccacggcgacggcggcaccggagtgcgacggccccaagacgtcgtggccggaggtggtcgggctcagcgtggaggaagccaagaaggtgatcctcaaggacaagcccgatgccgacatcgtcgtgctgcccaccggctcgcctgtgaccatggattaccgccccaaccgcgtccgcatcttcgtcgacaccgtcgcccagacgccctatgtcggctgataagctcgctgctgctgctgctgcatgcccagcttccttcgctcctcgctctagaacttgaataaaatatgacgaataacgcggacatgccatgtatgcatgtatgtgcaaaatccgaataatggatgtatacgtgtttttctttcctactataaattatcactaaacagtggcatcgttcttagataaataaatgtaccagaatgtcgttcatccttgcacgaatgaatatatgaaagagggatcagttgtttgttttgaattctctcatt

SEQ ID NO: 1217 - DNA, 418 bp, Zea mays
gcaagatttacctgcccatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttcctttccttgccccagaacttgaaataaatatatatacgatgaaataacgcgggcatgccgaataatggatgtgtgaattctcactaattaagtaatgcataaataaacgtattc

SEQ ID NO: 1218 - DNA, 654 bp, Zea mays
aatgctgactattttggctgcaagcatgggataaccatggattttttttcctgcagtgttgctatctgttctttgtttcgtagtggctgtttatcctcgtgtgcctcgcgtgcgtatatacacacacctctgcctgcatgcaacgcagctctataaatacctcatcaccggtgcactcgcttaatatatatccaacaaccagcagtgcaacaagcaagatttacctgcccatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttcctttccttgccccagaacttgaaataaatatatatacgatgaaataacgcgggcatgccgaataatggatgtgtgaattctcactaattaagtaatgcataaataaacgtattcaaatgtcgccccttcttgcacag

SEQ ID NO: 1219 - DNA, 390 bp, Saccharum officinarum
ggagttcttcatcaactcaagtatactcgtcatgattaccatcatctgaggtacgttgaccgcgccgacgatgagctcctcggcggaagcggagcgcggcggcgccaagaagtcatggccagaggtggtcgggctgagcgtggaggaggccaagaaggtgatcctcaaagacaagcccgacgccgacattttcgtgctgcccgtcggctcttcggtgaccgcggatttccgtcccaaccgcgtccgcatcttcgtcgacaccgttgccgagacgccccgtgtcggctagccgatgctgcatagcatatatagctagctttcgtgctcatcgatcaggaactgaataactaaataattcaggaggtcatgcagatcgatccacacatatat

SEQ ID NO: 1220 - DNA, 470 bp, Saccharum officinarum
cccacgcgtccgaagaacgataacaaacaacacttgcccttcaattcgcgactacccacgacgacgaccatgaggtgcacggcgacggcggcagcaccggagtgcggcgacgccaagacgtcgtggccagaggtggtcgggctcagcgtggaggaagccaagaaggtgatcctcaaggacaagcccgacgccgacatcgtcgtggtgcccgtcggctcgagtgtaaccaccgattttgtgctcaaccgcgtgcgtatcttcgtcgacatcgtcgcccagacgcctcgcgtcggctgataagaggccggctgatgcctagctagcttcggttccttccttgctttagaactgaatattctataattaaaatgaataactcggacatgccatgtattcatgtccgtgtatctgccgaataatggatgtgtacgtgtttcttttcctactataaattattactcatccatttc

SEQ ID NO: 1221 - DNA, 2143 bp, Zea mays
cccgacccaaccaaagccagaagacacggtgccgtcagctgtgctcccggcgctcccgcaccacaagcaagcgcgtgcgcgccgtcaagtcgcctctacagcaacttccaccgcgtactccctccctccctcgtctcgtcttcgtctccaggtttcgcgggggccaaggtttctgccggagcagtcgcggtctgcgctgcggcacggcgacgaggtggggatggagtaccgcgacaagctcgtgctggcgcccatggtccgcgtgggcaccttgccatttaggctactggctgctgaatatggtgctgatattacttatggagaagaaattattgatcacaaattcttgaagtgtgagcgtgttacaaatgaatctcttgggactactgattttgtggagaaagggactgacagtgtagttttccgtacatgcccacaagaaaggggcagggttgtattccaaatgggcacatcaaatgctgtgagggcacttaaagctgctcagatcgtgtgccgtgatgtttctgctatagatatcaacatgggttgtccaaagtctttttcacttagtggagggatgggtgctgcattactctccaaacctgagcttatacacgatattctgacaacactgcggaggaacttggacacaactgtgacatgtaaaatccgtcttctgaacacacctaaagacactgtggagttggcacgccggattgagaaaactggtgttcctgctcttgctgtccatggaagaaagattaaagatagaccgagagatcttgccaagtgggatgagatagctgatgttgtgtcagcgctgtcaattccagttatagctaatggagatgtctttgagtatgaggattttaagagaattaaagatgcaacaggtgccgcgtctgttatggttgctagaggtgctatgtggaatgcctccatcttttgtgccaaaggaaaaacaccttgggaggatgtcaaaagagagtatgtaagaaagagcatattgtgggacaacgatgtgaagagcacgaaacataccttgaaagaaatgataatgcactattcttgccttgaacttcctgaggggaaaggcgttataaagtgtgatacatctgaagatttagcgagactatacggggaagaggactactataattttgttgttgcaaataggaaatgaatacaatttgatgttgtgagctctcatgtgtaccaggtatctatttccgaatacattgggtctagagctagtgaaaaaggaaataatattatgtgaaactgatgaagttgatagtttcatgtagtctacatgcggtactttttccttgcaaataacaattacttgcaaaataagcatgtttgttgacatgggtttcaaaactaaaattggttccagttccttggccaggtagccactcttaataggggcttgcatgctggtagtctgtaaactagcgattagagtttgtaaatgtatgatactgatcaagaagtcaagaactggctaaactaaatggtattttacctggacccagcaaaaccggtgaaacttgcctggaacttgaagaaagatgttcacttgcatgattaaattgcaaatcagagtaaggcttgaatagccagacgaagagtgtggtgcctgcagagacaagctgttgagatgcagaatgaaactagaaatgcctttgttgagaagcttgttcattatccttttcagttgttcagtgtacgcatcctgagatgtacaatcctttaatgagaggagagtatcatcttctaaggagtcaagggtgttgttcaaggcatgttcctgaatagagaatgcagtgcctgttatgattgccccagatcttctgcttggattcctatctcaccctttattgatgggattaggaggaattcctgccaccaaggacaacgggatttgccattttggcgctgtctggacttaacactgaagctgctgatctttctcttgtactggtaatagttaggtttatacctgaaattaatcaaacaccatttttttgtaacaaatactaatttatttgctttctatactatggaaattttgtcatgtattgttggtggaaatactattgcgcttttgaaggaattgaaagactttgatatgttgact

SEQ ID NO: 1222 - DNA, 1432 bp, Panicum virgatum
  misc_feature (369)..(369): n is a, c, g, or t
  misc_feature (476)..(476): n is a, c, g, or t
gtttcgcggggcagcacgcgggccgcggggagggtgtgaggagtcggagccggcgcagtgtgcgcggcggcacggcgacgccgcggggagggatggagtaccgcgacaagctggtgctcgcgcccatggtccgcgtgggcaccttgccatttaggctactggctgctgaatatggtgctgatattacatatggagaagaaataattgatcacaaattcttgaaatgcgagcgcgttataaatgaatctcttgggactactgattttgtggagaaaggaactgacaacgtagttttccgtacatgcccacaagaaaggggtcgggttgtattccaaatgggcacatcacatgctgtgagagcacttaaanctgctgagattgtgtgccatgatgttgctgctatagatatcaacatgggttgtccaaagtctttctcgcttagtggagggatgggtgctgcattactctccaaaccngagcttatacatgatattttgacaacattgcggaggaacttggatacaacagtgacatgcaaaattcgtcttctgaacacacctaaggacacagtggagttggcacgccgcattgaaaaaactggtgttcctgctcttgctgtacatggaagaaagattaaagacagaccaagagatcctgctaagtgggatgagattgcggatgttgtgtcagccctgtcaattccagttatagctaacggggatgtctttgagtatgaggactttaaaagaattaaagatgctacaggcgccgcttcagttatggttgctagaggtgccatgtggaatgcctctatcttttgtgccaaaggaaaaacaccttgggaagaggtcaaaagagagtatgtaagaaagagcatattgtgggacaatgatgtgaagagcacgaaacataccttgaaagaaatgataatgcactattcttgccttgaactgcctgaagggaaaggtgttataaaatgtgacacttcagcagatttagcgagactatacggggaggaggactactacaattttgttgtttcaaataggaaatgaacagaatctgatgttgtaagctctcttggggaccagggaggtttagttttggcgctgtctggtcctgtgaggattgacaaattatcggtcttcgttgggacactagggctgttgttgtattggtaatggatatacctggaattaagaattatctgaagctcatactaatttatttggtactatagggaatgaaattttgtcatgtattatttggtggaaatagtatggtgtattcttttgggggtaattcaagtagactttgatatgttggctgtattgttacagtccgatggtctgacaaatattgaaagtttccatgatatatatctttgatacacaagcctggcactggaaaataatcaatccagttgcatatc

SEQ ID NO: 1223 - DNA, 1612 bp, Oryza sativa
gagggctggaggtctggagagccagaggagaggagtagcggacgcggtgccctgttcgcgtacgcaaggaggaattcgccgcggagtcctctccaaacttcgcggggaaaaaaattcggagccgccgagcggcggcggcgcggcggggatggagtaccgcgacaagctggtgctcgcgcccatggttcgcgtgggtaccctgccgtttaggctactggctgctgaatatggtgctgatatcacttacggagaagaaataatagatcataagtttttgaagtgtgaacgtgttacaaatgaatctcttggtactactgattttttggagagagggactgatactgtagtattccgtacttgcccacaagaaagggatagggttgtattccaaatgggaacatctgatgctgtgagggcactgaaagctgctcagcttgtgtgtaacgatgttgctgctatagatatcaacatgggttgtcccaaatctttctctcttagtggtggaatgggagccgcattactctccaaacctgagcttattcatgatattttgaccacattgcggaggaacttggacactaccgtgacatgtaaaatccgtcttctgaacacacgccaggacactgtggagttggctcgccgagttgagaagattggtgttccagcccttgctgtccatggaagaaaggtcaaagacagaccaagagatcctgctaagtgggatgagattgcagatgttgtgtctgcactgtcaattccagttatagctaatggagatgtatttgaatatgaggattttaaaagaattaaagatgctacaggtgccgcttctgtaatggttgccagaggtgccatgtggaatgcctcaattttttgtcccaaaggaaaaacaccttgggaggatgtcaaaagagagtacgtgagaaagagtattttgtgggacaatgatttgaagagcacaaaacaaaccataaaagaaatgataatgcactattcttgccttgaattccctgaaggaaaaggtgtgaacaagtgtgatacaatagctgatttagcgaaactatatggggaagagtactacaatttcgttctttcaaataggaattgaacaccttgattttttctaacatccatgttacacagcccctgcctggaatccataccagttttatgaattggtttggaaggatctaccatattacgaaacaaatactttgcagttttgactgaacttgtactttgtgatctataatgaccaagttattgttatcgttgggtctggagcgccctacatttttgggaagttgttatgacagatgttgttgatgataatattctgtttggttgttggacatcacctatgggtggggcttcagtctcgatctctcaggttcttaaatcggggttctggaagcaccaagtgtccaagtctgcatcaccgttgacatcagaaattaaagccgattcacacgggtaattcttttgggttagcttattatatcaccatatctaagacaattgctgcagtagacaaattatggcgtggttgtcatcttgtacacttccagaaattcagtttcttgcaataagtaaggttattaaaggtcaaatg

SEQ ID NO: 1224 - DNA, 1460 bp, Brachypodium distachyon
aggccgcggtcgccgccggttcgccttttattctcggcggtactcgacacggagcaactcctcgttgtccaaaatccccggagaaagagggagagagtcagaggcggagcagccgcggagaagcggcggcgctagcaagctatggagtaccgcaacaagttggtgctcgcgcccatggtccgcgtgggtactctgccgttcaggctactggctgctgagtatggcgctgatattacatacggagaagaaattgtagatcataagtttttgaagtgtgaacgtgttgcaaatgaatctcttgggactactgattttttggagagagggactgataatttagttttccgaacgtgcccacaagaaagggacagggttgtatttcaaatggggacatcagatgccgtgagggcacttaaagctgctcagattgtgtgtaatgatgttgcagctatagatatcaacatgggttgcccaaagtctttctctgtcagtggaggaatgggtgctgcattactctccaaacctgagcttatacacgatattttgaccacactgcgaaggaacttggacacaaccttgacatgtaaaatccgtcttctgaacacacgtcaggacactgtggagttggcacgacggattgagaaaaccggtgttccagctctggctgtccatggaagaaaggtcaaagacaggccaagagatccctctaagtgggatgagattgccgatgttgtgtccgcattgtcaattccagttatagctaatggggatgtttttgagtacgatgattttaagagaatcaaagatgccacaggtgccacgtctgtaatggctgctagaggtgccctgtggaatgcatctattttttgtgccaaagggacaacaccttgggaggaggtcaaaagagagtacataagaaagagtattttgtgggacaatgatgtgaagagcacaaaacatacattaaaagaaatgataatgcgctattcttgccttgaactcgctgaagggaaaggtgtgataaagtgtgattcatcagcagatatagcgaaactttacaaggaagaggactactataattttgttgtttcaaacaggaaatgaacaaaacttggttttgctaacccttcatgcgacccaggtatctatataactgtgcaagtttgcatttcttcacaaggaatgaaagagatgtttcgatagagaagttctctcctgcaaaattaagaatcggctcaagaattcatgttctgtacgatttgaaaacttactttcccagtttcacttgcatggtgaatggttcctttgataaatgttgtcattggtcctttcttgtctgtatggtgtctaaattgaagtgcagtatgtggggaccaaaacttgatttcaacttgttaattgcatttgtctgtgtgcacacccacgcgtgtgttttcctgaaccatgagaagtggctaaat

SEQ ID NO: 1225 - DNA, 1040 bp, Brachypodium distachyon
cagccgcggagaagcggcggcgctagcaagctatggagtaccgcaacaagttggtgctcgcgcccatggtccgcgtgggtactctgccgttcaggctactggctgctgagtatggcgctgatattacatacggagaagaaattgtagatcataagtttttgaagtgtgaacgtgttgcaaatgaatctcttgggactactgattttttggagagagggactgataatttagttttccgaacgtgcccacaagaaagggacagggttgtatttcaaatggggacatcagatgccgtgagggcacttaaagctgctcagattgtgtgtaatgatgttgcagctatagatatcaacatgggttgcccaaagtctttctctgtcagtggaggaatgggtgctgcattactctccaaacctgagcttatacacgatattttgaccacactgcgaaggaacttggacacaaccttgacatgtaaaatccgtcttctgaacacacgtcaggacactgtggagttggcacgacggattgagaaaaccggtgttccagctctggctgtccatggaagaaaggtcaaagacaggccaagagatccctctaagtgggatgagattgccgatgttgtgtccgcattgtcaattccagttatagctaatggggatgtttttgagtacgatgattttaagagaatcaaagatgccacaggtgccacgtctgtaatggctgctagaggtgccctgtggaatgcatctattttttgtgccaaagggacaacaccttgggaggaggtcaaaagagagtacataagaaagagtattttgtgggacaatgatgtgaagagcacaaaacatacattaaaagaaatgataatgcgctattcttgccttgaactcgctgaagggaaaggtgtgataaagtgtgattcatcagcagatatagcgaaactttacaaggaagaggactactataattttgttgtttcaaacaggaaatgaacaaaacttggttttgctaacccttcatgcgacccaggtatctat

SEQ ID NO: 1226 - DNA, 1678 bp, Hordeum vulgare
ggggacagcgcggtcgccgccagcgtcgccttctcttcttccctgtggcactgtccgctccggaaccttgtcctccagaattgaggggtagcaaggagagggtcagaggcggagcagccgcagccggcggagacgcggcgacgcgaggcaagaagagatggactaccgcaacaagctcgtgctcgcgcccatggtccgcgcgggtactctgccgtttaggctactggctgctgaatatggcgccgatattacgtatggagaagaaataatagatcataagtttgtgcactgtcagcgtgttacaaatgaatctcttgggacaactgattttttggaaagagggactgatagtgttgttttccgaacatgcccgcaagaaagggatagggttgtcttccaaatgggcacatcagatgctgtgagagcacttaaagctgctgagattgtgtgcaatgatgttgctgctatagatatcaacatgggttgtccaaaggctttttctgtcagtggaggaatgggttctgcattactctccaaacctgagcttatacatgatattttgactacattgcggaggaacttgaacacaccagtgacatgtaaaatccgtcttttgaacacacgccaggacactgtggagctggcacgccggattgagaagtgtggtgttccagctctggctgtccatggaagaaaggtcaaagacaggccaagggatccggctaagtgggatgagattgctgatgttgtgtccgcactgtcaattccagttatagctaatggggatgtatttgagtacgaagattttaagagaatcaaagatgctacaggtgccacatctgtaatggctgctagaggtgccttgtggaatgcctccattttctctcctaatggcaaagtaccttgggaggatttcaaaagagagtatgtgagaaagactattttgtgggacaattgtattaagagcacaaagacgacactaagagaaataataatgcactatatttgccttgaactccctgaagggaaaggtgtgataaagtgtggttcgtcagcagatgtagcgagactttatggggaagaggattactataattttgttgtttcaaataggaaatgaacaaaacaggattttgctaacctctcatgtgacccagcttctgcttggatccctctgttggttttgcgaatgttttctctggaggtctttgcatgagttttggagaaattcatatatcaccaaacaatacaaggtgtgcagttttggcttttggactttgccattttggtatacgatcaagatcaactgagaattcactgattccttattttgtggggtacagttttcggcgtgttcttataggattttttgagaaaaaaaggctgttgctttagactgacaggaatcttgaagcattttgagatactgtgttctttccgtttctgacaaagtataatccatgactgataaacaccatttctgtaagcttacatttattagttattctgccgatccgtattgccgaaaggctgtgtcatgtattagtcatggaaatcatgtaacatggaaagttcaagtagacattattgtgttacctgcacatggattatgttcaattgtttatcatgattcaaatgatttggagttgtttgattaaaagaacaaaaaaaaaaaaaa

SEQ ID NO: 1227 - DNA, 1141 bp, Triticum aestivum
gcacgaggcttctccgcggcactgtccgccgcggaccctcgtcctccagaattcccagggtagcaaggagagggtcagaggcggagcagccgcagcggccagcggccaccggcggagacgcggcgacgcgaggcaagaagtgatggagtaccgcaacaagatggtgctcgcgcccatggtccgcgcgggtactctgccgtttaggctattggctgctgaatatggcgcggatattacgtacggagaagaaataatagatcacaagtttgtgaactgtcaacgcgttataaatgaatctcttgggacaactgattttgtggagagagggactgatagtgttgttttccgaacatgcccgcaagaaagggacaaggttgtctttcaaatcggcacatcagatgctgtcagagcacttaaagctgctgagcttgtgtgtaatgatattgctgctatagatatcaacatgggttgtccaaaggctttttctgtcagtggaggaatgggttctgcattactctccaaacctgagcttatacatgatattttgactacattgcggaggaacttgaacacaccagtgacatgtaaaatccgtctactgaacacacgtcaggacactgtggagttggcacgccggattgagaaatgtggtgttccagctctggctgtccatggaagaaaggtcaaagacaggccaagggatccggctaagtgggatgagattgctgatgttgtatccgcactgtcaattccagttatagctaatgggaatgtatttgagtacgaagattttaagagaatcaaagatgctacaggtgccacatctgtaatggctgctagaggtgccttgtggaatgcctccattttctctgctaaaggcaaagtaccttgggaggatttcaaaacagagtatgtgagaaagactattttgtgggacaacgatattaagagcacaaagacaacgctaagagaaatcataatgcactacatttgccttgaagggactgaagggaaaggtgtgataaagtgtggtttgtcagcagatgtagcgagactttacggggaagaggattactataattttgttgtttcaaataggaaatgaacaaaacaggattttgctaacctctatgtgacccag

SEQ ID NO: 1228 - DNA, 993 bp, Ricinus communis
atggagtacgagaacaagctggtcctcgctcctatggttcgagttggtacgttgccctttaggttactagctgctgaatatggtgcagatattacttatggagaggagattattgatcacaagcttctcaagtgcgaacgcaaagtcaacgaatacattgggtgcactgattttgtcgagaaaggaacagaaaatgttgtcttcagaacctgcaatgaagagaaaaatcgggttgtattccaaatgggcacttctgatgctgtgagggctctaactgctgctcaaatggtgtgcaaagatgttgctgctatagacatcaatatgggctgccctaagtcattttctataagtgggggcatgggtgctgcactgttgactaaaccggagctcattcatgatatattgacaacactaaagaggaacttggactctccggtgacatgtaagattagacttctaaagtctccccaggatacggttgaactggcaaggcgaattgaaaaaactggtgtttctgctctagctgttcatggaaggaaagttgcagataggccgagggatccagctaagtggagtgagattgctgacattgtatcaacattatctattccagtcattgcaaatggagatgtctttgattatggtgactttgaacgaattaaagctgcaacaggtgcttcatcagtgatggttgcaaggggagctctttggaatgcttcaattttctctcctaaaggcaaagtacattgggaggacgtcaaacgagagtatgttagaaagagcatcttatgggataatgatgttaaaagcacaaagcacacattaaaggaaatgattatgcattattcttgccttgaacttccagaggggaagggtgtgatcaaatcagaaactctggcagatatagcgaaattttatggggaggaaaggtactatcagcttgtcaatgaaaagcggctcggactcgacggaagcatagaaaaatttttgtag

SEQ ID NO: 1229 - DNA, 1100 bp, Coffea canephora
gcaacccggctgggttcttcatcatcattcctcaggattcaactaatttgtcgtctccgcgtgaccaggcagaagacggctgcccgaaaatggattacagagacaagctagttttggcgcctatggtccgcgttgggacgttgccattcaggttactagctgcagaatatggcgccgatataacatatggggaagaaattattgatcataaactcctcaagtgcgagcgtcgaattaatgatgtgctcagatgcactgatatagtggagaaaggaacagaaagcgttgttttcagaacatgcccagaagagagaaataaggttgtatttcagatgggtacttctgatgcagtaagggctcttaaggctgctcagttagtgtgtaaggatgttgcagcagtggacattaatatgggttgccccaagtcattttccttaagtggaggaatgggtgctgctcttttgagtaaaccagagctgattcaagatattttaacaaccttaaagaggaatttgcatacgcctgtgacatgcaagattcggctgttaaaatcatctcgtgatacggtggaattagcgcagagaattgagaaaactggtgtttctgctcttgctgtccatgggaggagagttgcagacaggccaagagaccctgctaagtggaatgaaattgctgatgttgtagctgccctttcaatacctgttatagccaatggtgatgtttttgagtttgaagattttgaacgcatgaaagttgctacaggtgcctcatgtgttatggttgctagaggtgctctttggaatgcttctattttctctcctaccggcaaactaccatgggaagatgtgaaaagagagtatataagaaagagtatcttatgggataatgacatcaagagcaccaagcaaactctgaaggaaatgataatgcattactcttgccttgaattcccggagggaaaggctgtgactaaggcagagactttggcagatctcgctcaactttatgggcaagagcaatattatgagtatgtcaaattgaaccagctctcatctactcgaagtaggtgaaatcctttcagcagcttaaccatgagcctg

SEQ ID NO: 1230 - DNA, 1537 bp, Solanum lycopersicum
agtcgtcgtaaagttcgttcggacccttccgcggcgccgctcgtcaattgcaaccactccgatactccgccgtggttggtcgccgccggctgggaaaattcttcctctcttttcaagtcaaggcatcgcactaacttatctgcctcgtcagaatgatggattacagaaacaagctagtcttggctccaatggtccgagtgggtacattgccgtttaggctgcttgctgcccaatatggagctgacataacctatggagaggagattattgatcataagatcatcaaatgtgagcggcgagttaatgatgtcttagggactactgacatagtggagaagggaactgataatgttgttttcagaacgtgccccgaggagagaaatcgagttgtatttcagatgggcacttctgatgccatgagggctctcaaagctgctgaaatagtgtgtaaggatgtagcagcagttgacgtaaacatgggatgccccaagtcattctctattagtggaggcatgggtgctgcactgttgagcaaaccagagctcatccatgatattttgacaacattgcgaaggaacttggatgtaccaataacatgcaaaattaggttattaaaagatccgcaagatacagtggaattggcacgacgaattgagatgactggtgtctctgctcttgctgtccatggaaggaaagttccagataggccaagagatcctgcaaagtggaatgagattgctgatgttgctgccgctctctctattccagttatagcaaatggtgatgtttttgaatatgaggattttcaacgtattagaaatgtaacaggtgcttcatctgtgatggttgcaagaggagccatgtggaatgcttctatattctcttctgagggaaaaacaccatgggaagatgtcaaaagagagtatgtgagaaagagtatattgtgggataatgatatcaaaagtacaaagcacaccctgaaggaaatgattacacactattcttcccttgggagcccagaggggctggcagtaattaaatcagatacctttgcagatgtagcgaaactttatggagaagaggaatactatgaatatgtctcagaaagccggaggaagcagcagatgaaataagataagtagttcaccctcactaatcatacaagtcaatacaccaaggtgtcgattaaattggactaccgttataatttataaagcaagagatagaggtggactttgcacatgaggttgttaatgagttctgacttccttcccgtgacgcgactatacccaactgctatcccttgtttgagtttgaagtaacattccacaaccgctgaacgaatccatcagtttgaacaatattcattgtaggctgtacactaaattgaacttagtgggtttacctaacctgcataaaccaacacgatagctatgtatccgttggatcataagggggtacaattgaagtttttgctttattcatgctgcagacatcatttgcaaatttaatatatttatgtttagtgatatgactg

SEQ ID NO: 1231 - DNA, 1031 bp, Manihot esculenta
ctttggcttcgttcacctgatctccaatctccttcgattaagaagatggattaccagaacaagctggtcttggctcccatggttcgagtcgggacattgccgtttaggttgctagctgctgaatacggcgctgatattacttacggagaggagattattgatcacaagatggtcaaatgtgaacgcaaagtaaacgaatatattgggtgcactgactttgtggagaaagggacagaaaatgttgtcttcagaacctgctatgaagaaagaaatcgagttatattccaaattggcacttctgatgccgtgagggctctaactgctgctcaaatagtgtgtaaggatgttgctgcaatagatgtcaatatgggttgccctaaatcattttctataagtgggggcatgggtgctgctctgttgaataaaccagagctcattcacgatattttgacaacgctaaagagaaacttgagctgtccagtcacatgtaagattcgacttctaaaatcttcccaggatacggtggaactggcaagacggattgaaaagactggtgtttctgcccttgctgttcatggaagaaaagttgcagatagacctagggatccagccaaatggagtgagattgctgatgtggtatcagcattatctattccagttattgcaaatggagatgtctttgattatggtgattttgcacgaattaaagctgctacaggtgcctcttcagtgatggttgcaagaggagctctttggaatgcttcagttttctctcctgaaggcaaagtgcactgggaggaagtgaaaagagaatatgtcagaaagagtatcttatgggacaatgatattaaaagcacaaagcacactttgaaggaaatgattatgcattattcttgccttgaacttccagaggggaagggtgtgatcaagtcagaaaatttggcagatatagcgaaactttatggggaggaaaggtactatcaatttgtgaatgaaaatcggttctcgtccaatggaagctgagaggaaat

SEQ ID NO: 1232 - DNA, 1582 bp, Solanum phureja
tcgtgtaaagttcattcggacccttccgcggcgccgctcgtcaattgcaaccactccgatactccgccgtggttggttgccgccggctaggaaaattcttcctctcttttcaagtcaaggcattgcactaacttatctgccttgtcagaatgatggattacagaaacaagctagtcttggctccaatggtccgagtgggtacattgccatttaggctgcttgctgcccaatatggtgctgacataacctatggagaggagattattgatcataagatcatcaaatgtgagcggcgagttaatgatgtcttagggactactgacatagtggagaagggaactgataatgttgttttcagaacgtgccccgaggaaagaaatcgagttgtatttcagatgggcacttctgatgccatgagggctctcaaagctgctgaaatagtgtgtaaagatgtagcagcagtggacgtaaacatgggatgccccaagtcattctctattagtggaggcatgggtgctgcactgttgagcaaaccagagctcatccatgatattttgacaacattgcggaggaacttggatgtaccgataacatgcaaaattaggttattaaaagatccgcaggatacagtggaattggcacgacgaattgagatgactggtgtctctgctcttgctgtccatggaaggaaagttccagacaggccaagagatcctgcaaagtggaatgagattgctgatgttgctgccgctctctctattccggttatagcaaatggtgatgtttttgaatatgaggattttcaacgtgttagaaatgtaacaggtgcttcatctgtgatggttgcaagaggagccatttggaatgcttctatattctcttctgagggaaaaataccatgggaagatgtcaaaagagagtatgtgagaaagagtatattgtgggataatgatatcaaaagtacaaagcacaccctgaaggaaatgataacgcactattcttcccttgggcgcccggaggggctggcagtaattaaatcagataccttggcagatctagcgaaactttatggcgaagaggaatactacgaatatgtctcagagagtcggaggaagcagataacataagataccctcactaatcatagaactcaatacaccaagatgtcgatgaaactagacaaccagttataatttataaagcaagagatagaggcggaatttgcccatgaggttgctaatgagttctgacttccttccgtgtgatgtgactataccgactgatatctcttgtttgagtttgaagtaacattccacagccgctgaacgaatccatcagtttgaacaatattcattgtaggctatacactaaattgaactagtgggttaccttacctgcataaaccaacacgatagctatgtatcctttggattataaggggtaccccattgaagtttttgctttatttccgtggttcatgttgcagacatcatttgcaaatttaatatatttatgactgaaatcatgtacaactaattttttttgtagtagtataaagtctaaagacgatttgcattttgat

SEQ ID NO: 1233 - DNA, 1561 bp, Solanum tuberosum
gcggacccttccgcggcgccgctcgtcaattgcaaccactctgatactccgccgtggttggttgccgccggctaggaaaattcttcctctcttttcaagtccaggcattgcactaacttatctgcctcgtcaagaatgatggattacagaaacaagctagtcttggctccaatggtccgagtgggtacattgccatttaggctgcttgctgcccaatatggtgctgacataacctatggagaggagattattgatcataagatcatcaaatgtgagcggcgagttaatgatgtcttagggactactgacatagtggagaagggaactgataatgttgttttcagaacgtgccccgaagaaagaaatcgagttgtatttcagatgggcacttctgatgccatgagggctctcaaagctgctgaaatagtgtgtaaagatgtagcagcagtggacgtaaacatgggatgccccaagtcattctctattagtggaggcatgggtgctgcactggttgagcaaaccagagctcatccatgatattttgacaacattgcggaggaacttggatgtaccgataacatgcaaaattaggttattaaaagatccgcaggatacagtggaattggcacgacgaattgagatgactggtgtctctgctcttgctgtccatggaaggaaagttccagacaggccaagagatcctgcaaagtggaatgaaattgctgatgttgctgccgctctctctattccggttatagcaaatggtgatgtttttgaatatgaggattttcaacgtattagaaatgtaacaggtgcttcatctgtgatggttgcaagaggagccatttggaatgcttctatattctcttctgagggaaaaataccatgggaagatgtcaaaagagagtatgtgagaaagagtatattgtgggataatgatatcaaaagtacaaagcacaccctgaaggaaatgataacgcactatgcttcccttgggcgcccggaggggctggcagtaattaaatcagataccttagcagatctagcgaaactttatggtgaagaggaatactacgaatatgtctcagagagtcggaggaagcagatgacataagataaatggtttcaccctcactactcatagaactcaatacaccaagatgtcgatgaaactagacaaccagttataatttataaagctactagtggagtgttctgaagcaagagatagaggtggaatttgcccatgaggttgctaatgagttgaagagttgcgtagttctgacttcctcccgcgtgatgtgactataccgactgatatctcttgtttgagtttgaagtagcattccacaatcgctgaacaatattcattgtaggctatacactaaattgaactagtgggttaccttaccccattgaagtttttgctttatttccgtggttcatgttgcagacatcatttgcaaatttaatatatttatgggaagtgatatgactgaaatcatgtacaactaaacaattttgaagcagtataaagtctaaagacgattagcattttgat

SEQ ID NO: 1234 - DNA, 2728 bp, Saccharum officinarum
agcgattctgtgttcgcaccagcgccggcacaggcaacgcagcgccgcaccgagccgagccacttagcgaggaagcagcagcctccacggcgaggagagaatggggagaggagggatcggaggctcggcgggcatgaccatggagaacgccgattccgcccgcgcattcgtgaaggacgtcaagcgaatcattatcaaggtgggcacagctgttgtcactgggcagaatggccgattggcaatgggcaggctcggttctctctgtgaacaggtgaagcaactgaattttcaagggtatgaggtgattctggtaacctcaggagctgttggtgttgggaggcagaggctccaataccgtaagcttatacatagcagctttgcagatctacaaaatcctcagatgaactttgatggaaaggcctgcgctgctgttggtcaaagtggtctgatggctatctatgacacattatttagccaacttgatgtaacgtcatctcaacttcttgtaaccgatcgtgatttcaaggatccaagttttggggaccagctccgcgagactgttttttcactattaaatcttaaagtaataccgttgttcaatgagaatgatgccataagtacccggagacaaccatatgaggattcatctggtatattctgggataatgacagtctagcagctctgttggcagccgaacttaatgctgatcttcttatcatgcttagtgatgtggagggactctatagtggtccaccaagcgatcctcagtcaaagattatccacacatatgtcaatgaaaagcatgggaagctaattagttttggagagaagtctaatgttggaagaggtggcatgcaagctaaagtggctgctgctgctaatgctgcatcaaaaggtgtacctgttgtcatcgcaagtggatttgcaacggatagcatcattaaagttctcaaaggagaaaagattggtacacttttccacaatgaagcaaatttgtgggaatgttccaaggaagctacagcccgagagatggcagttgcggcaagagactgttcgagacgtctacagaagttgtcgtcagaggaacgcaaaaagattttgctagatattgctgatgctctggaagcaaatgaggatgcaattaggtctgaaaatgaagccgatgttgaggcagcacaagctgctggttatgaaaagtcgttggttgctagaatgaccctaaagccaggaaagataacaaaccttgcaagatccattcgtgccattgctgacatggaggaccctatttcccatacattgaaaagaacagaggttgctaaagatctggtttttgagaaagcatattgcccattgggtgttctgctcattatttttgagtctcgtcctgatgcattggtccagattgcatctctggcaatccgaagtggtaatggtcttcttttgaaaggaggaaaagaagctatgagatcaaacacaatattacacaaggtcataactggggttattccagatattgttggtaaaaagctcataggccatgtgactagcaaagatgaaattgctgatttgctagcgcttgatgatgtgattgatcttgtcattcctagaggcagtaagaatctagtctcccaaatcaaagcaacaactaagattccagttctaggtcatgctgatggtatctgccatgtttacattgacaaatcagccgacatggatatggcaaaaaggatagtattggacgctaaggttgattatccagcagcatgtaatgcaatggaaacactacttgttcataaagatcttaacaagagtgagggccttgatgatctattagtggaacttgaaaaggaaggagtagttatttatggtgggcctgttgcacatgacaaattgaaagtaccaaaggtagattcatttcgtcatgagtatagctcaatggcatgcactcttgaatttgttgatgatgtgcagtcagccatcgatcacataaatcgttatggaagtgcacacacagactgcatcatcacaactgatgaaagtgctgcagaggcttttctgcagcaagtcgatagtgccgctgtgtttcataacgcaagcacaaggttctgtgacgggacgcgctttgggctaggtgcagaggttggcataagtacagggcgcatacatgcccgcggacctgttggagttgatggacttctaactactcgctgcattttacgcggtagtggacaagtggtgaatggtgacaagggagtggtttacacccacaaggatcttcctttgcaatgaggcaaagaacctctgttgtagtacaattgctcgtaacgaatggctgaactaccttttaagtaccattttctttattccatgcaacaaagataggtgtcgtaacaagcagaaggacctgatactttctcggcggtgcctatttattagaaaatgatgtattcagaccatttcggtacgaggcttgtaagctgtgtttgtcgttgtgttcttgtcgtataagccctagaacttccgagacatctgtattagaggcgttttagctggttgatatgcgatggttttggatgaaacttgaatctgttcccatgcaatgataatgcatgtgtgatgagatcttacctttccgtttaagggcgccgatctagaggtttttcgtgaagcaggtttttcctagtttaagtcagccctctttcatttattattgttcgtctgattagc

(The sequence listing continues in the following parts.)

What is claimed is:

1. A method of increasing tolerance to an abiotic stress condition, yield, biomass, growth rate, vigor, and/or nitrogen use efficiency of a plant as compared to a non-transformed plant which is grown under the same growth conditions, comprising:
    (a) over-expressing within the plant an exogenous polynucleotide comprising a nucleic acid sequence encoding the polypeptide selected from the group consisting of SEQ ID NOs:548, and 5893-5898, and;
    (b) selecting plants resulting from step (a) for an increased tolerance to a salinity stress, an increased growth rate and/or for an increased biomass as compared to a non-transformed plant which is grown under the same growth conditions,
    thereby increasing abiotic stress tolerance, yield, biomass, growth rate, vigor, and/or nitrogen use efficiency of a plant as compared to the non-transformed plant which is grown under the same growth conditions.

2. The method of claim 1, wherein said nucleic acid sequence is selected from the group consisting of SEQ ID NOs: 75, 343, 1221, 1222, 1223, 1224, 1225, 1226, and 1227.

3. The method of claim 1, further comprising growing the plant expressing said exogenous polynucleotide under the abiotic stress condition.

4. The method of claim 1, wherein said abiotic stress condition is selected from the group consisting of salinity, drought, water deprivation, flood, low temperature, high temperature, heavy metal toxicity, anaerobiosis, nutrient deficiency, nutrient excess, atmospheric pollution and UV irradiation.

5. The method of claim 1, wherein the yield comprises seed yield or oil yield.

6. A method of growing a crop comprising growing a crop plant transformed with an exogenous polynucleotide which comprises the nucleic acid sequence selected from the group consisting of SEQ ID NOs: 75, 343 and 1221, wherein said crop plant is derived from parent plants that have been transformed to express said exogenous polynucleotide and that have been selected for at least one trait selected from the group consisting of:
    an increased tolerance to a salinity stress condition, an increased growth rate, and an increased biomass as compared to a non-transformed plant which is grown under the same growth conditions, and said crop plant which comprises said exogenous polynucleotide having said increased tolerance to said salinity stress, said increased growth rate and/or said increased biomass, thereby growing the crop.

7. A method of growing a crop comprising growing a crop plant transformed with an exogenous polynucleotide comprising a nucleic acid sequence encoding a polypeptide selected from the group consisting of SEQ ID NOs: 548, and 5893-5898, wherein said crop plant is derived from parent plants that have been transformed to express said exogenous polynucleotide and that have been selected for at least one trait selected from the group consisting of: an increased tolerance to a salinity stress condition, an increased growth rate, and an increased biomass as compared to a non-transformed plant which is grown under the same growth conditions, and said crop plant which comprises said exogenous polynucleotide having said increased tolerance to said salinity stress, said increased growth rate and/or said increased biomass, thereby growing the crop.

8. The method of claim 7, wherein said polypeptide is set forth in SEQ ID NO: 548.

9. The method of claim 7, wherein said parent plants have been selected for increased biomass as compared to a non-transformed plant which is grown under the same growth conditions.

10. The method of claim 7, wherein said parent plants have been selected for increased tolerance to a salinity stress condition as compared to a non-transformed plant which is grown under the same growth conditions.

11. The method of claim 7, wherein said parent plants have been selected for increased growth rate as compared to a non-transformed plant which is grown under the same growth conditions.

12. A method of selecting a plant for increased biomass, growth rate and/or tolerance to salinity stress as compared to a non-transformed plant which is grown under the same growth conditions, the method comprising:
    (a) providing plants transformed with an exogenous polynucleotide which comprises a nucleic acid sequence selected from the group consisting of SEQ ID NOs: 75, 343 and 1221,
    (b) selecting said plants for increased biomass, growth rate and/or tolerance to a salinity stress condition as compared to a non-transformed plant which is grown under the same growth condition, and
    (c) growing a crop of said plant selected in step (b),
    thereby selecting the plant for the increased biomass, growth rate and/or tolerance to the salinity stress condition as compared to the non-transformed plant which is grown under the same growth conditions.

13. A method of selecting a plant for increased biomass, growth rate and/or tolerance to salinity stress as compared to a non-transformed plant which is grown under the same growth conditions, the method comprising:
  (a) providing plants transformed with an exogenous polynucleotide encoding a polypeptide selected from the group consisting of SEQ ID NOs: 548, and 5893-5898,
  (b) selecting said plants for increased biomass, growth rate and/or tolerance to a salinity stress condition as compared to a non-transformed plant which is grown under the same growth condition, and
  (c) growing a crop of said plant selected in step (b),
  thereby selecting the plant for the increased biomass, growth rate and/or tolerance to the salinity stress condition as compared to the non-transformed plant which is grown under the same growth conditions.

14. The method of claim 13, wherein said polypeptide is set forth in SEQ ID NO: 548.

15. The method of claim 1, wherein said polypeptide is set forth in SEQ ID NO:548.

16. The method of claim 7, wherein said exogenous polynucleotide comprises the nucleic acid sequence selected from the group consisting of SEQ ID NOs: 75, 343, 1221, 1222, 1223, 1224, 1225, 1226, and 1227.

17. The method of claim 13, wherein said exogenous polynucleotide comprises the nucleic acid sequence selected from the group consisting of SEQ ID NOs: 75, 343, 1221, 1222, 1223, 1224, 1225, 1226, and 1227.

* * * * *